United States Patent 8,067,671 (METHODS FOR GENETIC CONTROL OF PLANT PEST INFESTATION AND COMPOSITIONS THEREOF) - sequence listing, part 37

SEQ ID NO: 69982 - DNA, 822 bp, Heterodera glycines
  misc_feature (394)..(394): n is a, c, g, or t
  misc_feature (400)..(400): n is a, c, g, or t
  misc_feature (407)..(408): n is a, c, g, or t
  misc_feature (416)..(416): n is a, c, g, or t
  misc_feature (428)..(428): n is a, c, g, or t
  misc_feature (431)..(432): n is a, c, g, or t
  misc_feature (464)..(464): n is a, c, g, or t
  misc_feature (467)..(467): n is a, c, g, or t
  misc_feature (469)..(469): n is a, c, g, or t
  misc_feature (478)..(478): n is a, c, g, or t
  misc_feature (482)..(483): n is a, c, g, or t
  misc_feature (494)..(494): n is a, c, g, or t
  misc_feature (497)..(497): n is a, c, g, or t
  misc_feature (500)..(500): n is a, c, g, or t
  misc_feature (511)..(511): n is a, c, g, or t
  misc_feature (514)..(514): n is a, c, g, or t
  misc_feature (520)..(520): n is a, c, g, or t
  misc_feature (546)..(546): n is a, c, g, or t
  misc_feature (557)..(559): n is a, c, g, or t
  misc_feature (590)..(591): n is a, c, g, or t
  misc_feature (614)..(614): n is a, c, g, or t
  misc_feature (621)..(621): n is a, c, g, or t
  misc_feature (624)..(625): n is a, c, g, or t
  misc_feature (637)..(637): n is a, c, g, or t
  misc_feature (642)..(642): n is a, c, g, or t
  misc_feature (654)..(656): n is a, c, g, or t
  misc_feature (659)..(660): n is a, c, g, or t
  misc_feature (674)..(675): n is a, c, g, or t
  misc_feature (681)..(681): n is a, c, g, or t
  misc_feature (684)..(684): n is a, c, g, or t
  misc_feature (688)..(688): n is a, c, g, or t
  misc_feature (691)..(692): n is a, c, g, or t
  misc_feature (699)..(699): n is a, c, g, or t
  misc_feature (701)..(701): n is a, c, g, or t
  misc_feature (709)..(709): n is a, c, g, or t
  misc_feature (721)..(723): n is a, c, g, or t
  misc_feature (725)..(725): n is a, c, g, or t
  misc_feature (731)..(731): n is a, c, g, or t
  misc_feature (733)..(735): n is a, c, g, or t
  misc_feature (739)..(739): n is a, c, g, or t
  misc_feature (745)..(745): n is a, c, g, or t
  misc_feature (747)..(749): n is a, c, g, or t
  misc_feature (753)..(754): n is a, c, g, or t
  misc_feature (756)..(756): n is a, c, g, or t
  misc_feature (766)..(766): n is a, c, g, or t
  Genomic contig location: Contig_ID=SeqID_41951; Location=99..920; Strand=-
  SCN-specific regions: Sequence locations=1-306,334-822
atagggcgaggcaaaagatcaaacgccagaagaaacaaccggaagccgttcgacgccaggcaatcgccgacttgctctccggatgcccgaacgagttcggccaggtcctcaaatacatcgtgagttcgttcgttcgttttttccaaaattaataaactaacaaattaaattttgcaggacgacatgaagtacaccgacaagcccgactacgactggatcatcgcgacattgcgcagcagcctcagcaacgccggcgtccaggaattcccctacgactgggagacgggcaagcgcaacgcggcaccgggcgctggaggcggcggaggaggagacagctacttcaactgatgagccgtgcagcagcagcagcagcagaagaatcgccaagaagcgncaccgngcagaanngaacaaangaccagcgcggncgnnggcagaaaagccacggcgacgactcggaacgngcnanggaagagangggnngacccccgcanganggnggaaaggaagncgnaaccgnaacaggcacgggaaaaacgacgcgcnagaaaacgcgnnnccccgaaagaccgagcgggccgaaggccaannaagagaaagagcccacgcgccgngccaagnganngaaaaaacaagncaagngcgagcaaaacnnnggnngaagcagacaacanngcaggnagngacnggnnaaaccancngaaagcgngggggaaagagnnnangcgacncnnngcgngagcancnnngacnnanagaggcaaanagcgaagcacagggaagaacatggcgaaaaatacaaagaaaattacgaaaaataaa

SEQ ID NO: 69983 - DNA, 3569 bp, Heterodera glycines
  Genomic contig location: Contig_ID=SeqID_9007; Location=136..3704; Strand=-
  SCN-specific regions: Sequence locations=1-1050,1072-1257,1279 -1871,1893-2658,2689-3360,3388-3419,3441-3569
  Gene Ontology: Mol. function=phosphorylase kinase, intrinsic regulator activity; Cellular component=phosphorylase kinase complex; Biological process=glycogen catabolism
atgatgaaagtaacggcgattgtatgctcatttgtcctgaatgcttttgcatcagtgaggaacacatgaaaaacgagcgagacgaattgaacagtcagcagttttatccggtccctcacgacgaatttggccaccacctttggtccaacgctgtgcttgtcatcggcttattgttgagtgggtgtggctaatgcaccagttggtttaattctcatcctatttttgcaatttttttcaggggaacggctaatccatcccagtgacattgacccgatttatcggcatttgccggccagtcaacggcctcggaatatgccggtgatgccttcatcggcctttcacgtccgtctcttcctttttcttcgttcattcggattacttttgttttttgagggtcgcatgaaaggctttcccgtggtgcaagtggcgcttatctccgagtcggctcagctgcagatgatgctctccacttatggcatcaccacacaaactccccacgaagttgagcccgttcaggtctgaccgaagaatttggaaaagtacaaattggaaaaactaacaaaacattgactaattgtttgtctcctctctcagatttggccttcatggcgaatggtgaaattgtacgagcgtttgggccgagacgaaaagttgggccttggcggccgaccgttgcgacccttggggccattgaacacgtcgaaaatatttcgaatttgtgggaataccgtggtcatttacccgctcatttttgagctgaaagatttctacacaaacgcggactcttcgactttaattgaggacataaaggcaattgaattgggaaaacgagttttggacaagaagtgcttttagggtgatttggaattcatttcgagaaggtggaaattgagtggcaggttcattttagcacttacaattatgcatgaatttagttttcttttacgaaaatactccttttaggccaactttttgtatgattttgcgtgaagaaaatgtcgccggagagtgagtaaaatagttttaaatggaacctccttaaaactatttcaggtacttttcaaatatgctggaccttttggtcagtcttaaaaacggcttcgtaaatggtgtccgagttcggctgggaagaatccatgtcagtggtgtcattcttcataacctattgaaatgtttatatttattaagcaattgatcaacaccggctgtatagaacatgtttgtactccaaatgaaaactccattctatacaaaatgccaattcttccccattttcagattgacatggtcaacccagacgatgtcgagtttgatgtcgatgtccttgaagaaattgacgcaaaagaagcattgctccgagcacggaccaaactgaggaaagtgccgccagaaaagttagaaggattactatcggagcagcaattgagcggaatgggagaccacgaattggtcggtggagcctttattattgtaaatagccaaaggacggaaacaatgatggaaatcggcgtgctttggtcacccctcccaattttacacttaatttagtatcaaataatcgcccgaaataatatcgaaaaccttcgcagagtcgcttttgccgtgggttattttcctctttccctccaaaatgcttctttttagatcgctgtgttgcaaatgcgttaccctggtacttttgttgtacaaggaggttgtccaaaggcaagcacatccaaaataatgacatcgattgggttaagaaactcttctcgcccgaatggaacgtgtgtacagccaagcgtgccaattccgatattggtggttggtgcgctattgcgcggctaaattacgcaaaactatgatcagtttggcgccgtaatacacctgttcattctctgttttcacgttaattttctttcaacagatcggtcactaatcttttggtccgtggaaaacaggtaaaaaaattgcctatagatttgaattaaattcgaaaatgcacttttgggttatcatcggccaaaaagcatcaaaagaaatcaccgtcaattcgccgtcaacgcccgtagaattgcagaaggccttgttcgacagttgcatagacccgtacgctgcggtgtttcagcaagagctgataatcgcatgttcagatttggtaacgtgggaaatatctcattctaaattcctttttggcacagataactcagaaaagtgcctcctttgacggcgttctcaccattcgtttggcatggtgacttatatgcattttccaatatttaactattttttggaaaaaaattcattaggtaaacattaaatttcattgcaaatcataatgcttacctaactatgccgttttaaaggtacactgatgcgattgatatgcttctgtgctttgttatggaagacctaaagaaccgtcaaaaattgaacaacggaactgccgcttctccgattaaaaccaatgatttggtgacattttttgaacgcatttggcagggttccattcgcagagaatttggttttttgcataaaaattttttaatttgggttttttaatagaaagtgggaagagcgtttgtgccttcgatttgcctccgacagttgtcaaaaatctgcttgctgaactgttgacaaagcaagatgtctggagattgctgtaagtttggattgtgcatttggatttatttattttttcttatttcagttcgcctttgcaaatgaaaaaattgaacggggcactgaaccgagtaccgacaaatttgtacgacagagtttggaaggtcggtcaaaatattcgcagagaaaatggctggcattgctgtttaagatactcgaaagagtggagcaaggcatcgtcatttcaggccatgtccttcctcaggttggaatccgaatcaaagaatgttctacaaattgaaaccaataaagttgtccaaatccattctcagtacccaactctgcatgttatgacgcagcatgagctcaatttttcatacaaaattggtgttgttttcgacttccttgaattggattccttacccaccctttttagagtcgatgatgagcgacatcgcaaaccctgaaaatcgtcagctgattgtcgaattgttttgtattgtagctacaataatggagagaaacccagtaaataataagcgacatttttaacgatgcaaagacgctgaattaaggaaatttatttcgccggtgcgttggactgtgacttggtcagtcgttttaagtaattcccctgatcaccgattgtacgcttcccattccagcttttgtcacaagcattcaacatgttctgtgaagagcggagggtcaaagaccgcgtgaacatgacgcctttctacgcaatcgacgacgacccttccgccccctctacttcctcttacttaatacgggtgggcgtttcttttacacagattggacttggttgttaaaaaacattttcactaaaatgtttaatacattcttctccagattgttgttgacaaattgctcaaagacacaaataccaaacacacaatcagtcttcgaaacaatttactgcaaaaggccgaagaagaatgttcaattat

SEQ ID NO: 69984 - DNA, 585 bp, Heterodera glycines
  misc_feature (512)..(512): n is a, c, g, or t
  Genomic contig location: Contig_ID=SeqID_9008; Location=64..648; Strand=-
  SCN-specific regions: Sequence locations=1-415,437-585
  Gene Ontology: Mol. function=phosphorylase kinase activity; Cellular component=phosphorylase kinase complex; Biological process=glycogen catabolism
atggacctgatcgccctcttcattctcgttttggtcgaaatgactgtggccggtgctcaaatcatttacacgccccacgaggtggcctttctgcagaacctcgtattttacattgagcgtacttatcgcacgccggactttggcatttgggagagagggacccgatacaaccggggcaacccggaactgcactcatccagcctgggatttgtgaaggttagtgcagtttattggttttagtcactttgtttcccttttccaattacaggccgcgctcgagtcggtcaatggttttaacgcatatggacacaaagggaccagtgactcggtcatttacgttggtcagtcattcatttactgtgtcattgcgaattgcgatgcatattttcttttttataaaatcacagacattgacggacacaaccgcaacagaacgacctttgagactttgttgcctcgcgagtccaactccaaaaacaccgacgcgtcattgattttgaccatcggatggncttcctttgcgacccatgacgaccaaaagtttgagacgacacttagcaaatgcctgcgccacctcgagggacg

SEQ ID NO: 69985 - DNA, 700 bp, Heterodera glycines
  Genomic contig location: Contig_ID=SeqID_9009; Location=382..1081; Strand=-
  SCN-specific regions: Sequence locations=1-489,519-542,564-700
  Gene Ontology: Mol. function=structural constituent of ribosome; Cellular component=cytosolic ribosome (sensu Eukarya); Biological process=protein biosynthesis
atggtcaaaatcatgaagccgggacgtgtggtgattgtgctcagtggacgctatgcggggcgtaaggctgtcgtcgttaagagctatgacgagggctcatcagagaggccgtatggacatgcattgattgcgggaatcgacaagtattttcatgatatgattcttggttttatcaaaatccctaaaggtatcctctgaaagtgaccaagaagatggggaagaagcaagtggagaagcgaattcgcatcaaaccattcctcaaggtcaccagcctccagcatttgttgccaactcgttgcatattcgaggccgatttggacaagagtttggtgaacaaagagtggatcaaagagccgcgaaagaagaagaatgccatcattagcgtcaaaaaagaatttgagaccagctacaaagccggaaagagcaaatggttattcacaaaacttcgtttctgagcggttacagaggggaaacaaagcgatttccttatttgcattgttgttgtttttgtgttatgagtaaagatttaaagaatcgaagaaacatttttgatatcgtaatttaattcacataatatacataaaccaatttgaaagcatgttttcatgactttttatacaattagaaatttcgaaaaagtgtggggataaactttataattgcctccctctgtcttcatccgtttggcatcactaataaa

SEQ ID NO: 69986 - DNA, 990 bp, Heterodera glycines
  Genomic contig location: Contig_ID=SeqID_9009; Location=1197..2186; Strand=-
  SCN-specific regions: Sequence locations=1-45,67-409,431-547,569 -931,968-990
  Gene Ontology: Mol. function=RAB-protein geranylgeranyltransferase activity; Cellular component=Rab-protein geranylgeranyltransferase complex; Biological process=protein modification
agtggcatttactggtgtttagctgcactcaaagtattgggagaaaatataaacgacgaagaaaaattagctgacctcatcaaaagaaaatcaaaatgaagatggtggttttgctgcggctgatggccatgactcacacattttgcatacactaagtgcgattcaagtggctgttatcattggcagactcgatattgtaggtgacaaattttattttcaccaaaaaaacgatcttcagataaatttggatgcgaccgtcgaattcattaaatcgttacaacaaaatgatgggagttttgccggtgatcacgggggagagattgacacgaggttttctttctgtgctgctgcatctctgtattttcttaatcgtcttggttcaattgacgttcataaagcagttgaatttgttattaactgttacaattttgatggcggctttggaacaaggcctggctctgaaagtcatgctggacaggtggggttgaattatttttaaatcttgagtaaatcgctaccaacttgcttaggtttactgttgccttggaacactctctgtttgtggttgcttggagcttattgatgtggaacgaaccgcaacatggctggctgaacggttccattcaaatacatgttttgtttattatcttttgcttcaatagacaatgcccttccggcggactttgcggacggcccgagaaactgcctgatgtgtgttattcttggtgggtgcttgcatcattggccatcataaaacgattacattggattgatggcgaatctctcacccacttcataatcgccagtcaagatgatgaaaagggagggatcgccgatcggcctggagatgaatctgaccctttccatactgtttttggcctttacggccttagtcttttgggacataaagggttggaggctgttgatcctgtattttgtatgacaaagaaatctctggtgaattttgcttttgcgtgatgatatgccagc

SEQ ID NO: 69987 - DNA, 452 bp, Heterodera glycines
  Genomic contig location: Contig_ID=SeqID_41952; Location=357..808; Strand=-
  SCN-specific regions: Sequence locations=1-178,208-452
atggcatttttcacaaattttctgtccatcggagttatttttctcgccaattttgtcccacaagtaagccaattatttattaattattccatagtaatcttctttttttcaggcttctccatgcactaatgttataggttatgtaccaggatgctgtcatgacatagttagcttaacgtaatatttttaattttaaaaataatttatccaggggagtaactaacatcgtaattgtcccaagacttggtatatctttgtgatttttgggaagccaatagagtttgttaggcgctttcgaatgataccagtgttgttggatttggtcaacaaagaaaacagttatgatgctctaaacttggctcagacggaactgccccacttccatgccgagaacctatagccccgactgtcagtttccgaaatgtcgggcccctaaatgtcgaataattaaa

SEQ ID NO: 69988 - DNA, 473 bp, Heterodera glycines
  Genomic contig location: Contig_ID=SeqID_41958; Location=334..806; Strand=+
  SCN-specific regions: Sequence locations=1-56,78-172,195-302,327-473
atgaatcccaaaataattccaaatgaacttttgtttgaaataatcgcctttatccgctttaaccgcaaatgggcaaagtgccgagtttgtttttcatttgatcaatttttgatccgacggcaagctgattggctgaaattaatattcacagtggtcagacacatattttctcttttccacaaataaatacatgaatttactctgtttttctccctcgtcccccaccaaaattggctcttttaaaagaggacgatccaatgcatactgtatttgatggattactgtcgcaaaaatattgtttctaattaaattatttaaaataaatactcaaaatacttttcaggttaagaactgcaaatcgttggtcagaagtttggtgaatcgcatcaaacagattccagtgaattatgaggtccacatggatggtgtgccacaaagtgcggcacgtcatcatgctgaattgacgtacattg

SEQ ID NO: 69989 - DNA, 367 bp, Heterodera glycines
  Genomic contig location: Contig_ID=SeqID_9011; Location=568..934; Strand=+
  SCN-specific regions: Sequence locations=1-53,163-341,364-367
atgtcatcattcacgacttcttcatcagcggacgaattttctcctctccaacgtaaaaaatttgttaaaattcataattaaaatacaataataaaaacatttttcaataattaaatttgctaaaattaattttttttttttttaattaatttttcatttttagcaatttttccaaatctgagcacatcggaggaaatgagtgttctgattgccagaattgctgagctgaatcgagcgaaaacaatggagccatcaatcgcaagttctgaagtgtttggacaagacggatacggtagagaatttaagcataattgaggggttacagtatgaaattttataatcaaagaaatggttttgaaatttatta

SEQ ID NO: 69990 - DNA, 1772 bp, Heterodera glycines
  Genomic contig location: Contig_ID=SeqID_9012; Location=377..2148; Strand=-
  SCN-specific regions: Sequence locations=1-71,93-115,137-476,499 -535,557-581,603-1227,1249-1519,1609-1637,1672-1772
atgccgtggcataattcatctgcaactagttgtaggcatcggcctgatcaaaatgacatttagcctctaatacatttttgacacactattttcatagggaaattggcgattgaagtttttaaaattttttaaaaatctttttgtgttttccagtgcctggccgttcgccctcgtcactgaagcgtgcctcgttgccgcccgcctccgccatgttcacgccgccgtccacgctgatgccgatgccggagcagcgaatccaactcagcgggcagtgccaagcgtgccgcttggaacttagtgtatgttttctgatttaaaaaaaaatccaacaaaacgccaagatttttccatgacttttaaaaaaaatgaatttcaggaccaacacaagggcatccaatgcacagcgatcagccagggctgcaacagagtgttccactgggtaggctttcttcaaatctatctgatcagaaaatttttgtcccatcattcccttcctcccctacctaaaggtcatttgttgaaatgatcagtcattttattccaacatttttcattctgacccgattttgtttgttggggggtggtaaatttttaaaaattttcacacaaaaacatatttcaagaatttgctttgctggttttctttcaaatttactgaccggaaaaatttagaaccccccctcccccccactttacccaaaggtcattattatatgttgaagtgatcactgatcaggcattttattccaattttttttttcaatttgacccgattttgtttgttgagggatggcaaatttttaaaaatttgcaaaaaatttctacacaaaagcaaatttcggaatggactttgaagaggaggggggccttgttgttggtctccttcccttatgcaatttaagcgacctgatcaacatgaatcgattacgtcatccccgccccgaaaattaaaaaaaaacaaacaaaatttaaatttcatagaaagtaaaaaaatgaaattttgaaaaatccaaagtttttcaaaaaatgccatcccttttgcttcccttgcaggaatgtgccgatctgacgccggaagcgttccaagaattctgcaaggacccgcgcctggaatggatttgccgggactgctacgcgcaaaagggggccaactgcgtttttgcaatatgacgacgacaacacaatgccacacaaacacattcggtgctgtgatcaaatcgattgatcgactccaatcaatgccaatcaatacttcgatcaatcaatagcagtgtttagcatggaaacactgatcggaggatgactgacctttccaatgatttcatcactaattaacgccatcccaacttttttatttttttacaacgactcaaaagccccccactttcctaatgaccaaacaaaaactttttgctatacaaaattagctgtatgtgtgtgctgttgtttagcgtctccaaaaacattcattcactttttgcgcctcttctgcaatacaaaaccaaaaaaacccattttcatttatatttcatattcttaaatttaattaattaattatttatattttaaattcatcttttagatttatgtattgtttttatattatatgatgatattttcttgtgcagagctctttaacaatatttaatgctttcttaattaagtaaattttggaatttatcactcgaaaatttaaaaaaatttctaaccaaaattggggtcagaaggctgtaactttttgagttgagcattaaaaaatgtgaaaaaataaa

SEQ ID NO: 69991 - DNA, 147 bp, Heterodera glycines
  Genomic contig location: Contig_ID=SeqID_41962; Location=133..279; Strand=+
  SCN-specific regions: Sequence locations=1-147
atggtgggggagttggggcttactgtatcatggagggctattgagtgggtgggcgcattggctcccggacaatccgacagtggacaatcggacagaggtggacaatcggacagtgaggacaatccgacagagatggacaatcggaca

SEQ ID NO: 69992 - DNA, 60 bp, Heterodera glycines; identical to SEQ ID NO: 51396
  Genomic contig location: Contig_ID=SeqID_41963; Location=553..612; Strand=+
  SCN-specific regions: Sequence locations=1-1,23-60

SEQ ID NO: 69993 - DNA, 196 bp, Heterodera glycines
  Genomic contig location: Contig_ID=SeqID_41968; Location=1..196; Strand=-
  SCN-specific regions: Sequence locations=1-56,83-196
ggttcgatgaaactttttaaaatataagcctaaactttttggcctgtttaaaaaggaattaaaaatttttaaaatatttattcatctcccttttgatagaaaaaacatcagagagccttaattaacctgtaaataaagttttgtgtgtttcagagcactttctgaaaaaatacttatgaattaattttgcaaaaaa

SEQ ID NO: 69994 - DNA, 306 bp, Heterodera glycines
  Genomic contig location: Contig_ID=SeqID_41968; Location=518..823; Strand=-
  SCN-specific regions: Sequence locations=1-35,57-144,166-190,219-306
ttaagcctaaaatttttcgcatatttaaaaagcaattcaatatttttagattttttattcatctccctttttgatagtgaaagcatctgagtgcctaaaataacttgtaaataaaatttggtgcgtttcagagcagtttgtgaaaaaatatttatgaattaattttgctaaaaaaataaaatagtgaagctttaaaaattaataaaaaattttaaattcagaattactggagttagcatcatagcagtgcttttccttgtctttttgatgccctcgcaaaatctggttcgcttctgatcagtttat

SEQ ID NO: 69995 - DNA, 431 bp, Heterodera glycines
  misc_feature (11)..(11): n is a, c, g, or t
  misc_feature (38)..(38): n is a, c, g, or t
  misc_feature (99)..(99): n is a, c, g, or t
  misc_feature (123)..(123): n is a, c, g, or t
  misc_feature (141)..(141): n is a, c, g, or t
  Genomic contig location: Contig_ID=SeqID_41970; Location=566..996; Strand=-
  SCN-specific regions: Sequence locations=1-124,175-431
atgtttttttntgtgaagtatatattgagagatgtttngttgtttgagttggtgtgtgtgattttttgtggatagtatgtgtatataaatgtgtttttnttaagaaggaatgaaataatatgngtattataattagatagnttaaaataaatttatttatattttgtatttttagaggaactcagccattgttattatgactcaactgtttatttccatccgtgacaatcatttataagataattttttgtcaatatggatctctaatttatttatgaggacatcagagataaaagttagctgcaacaatgatatccataaatatggccgaatcggaaagtataaggaatattgtcaatagacatcgtagtttgcagttattttaaaattaacgactaatctattccttttgtcttaggctacaaaataaa

SEQ ID NO: 69996 - DNA, 1056 bp, Heterodera glycines
  Genomic contig location: Contig_ID=SeqID_9014; Location=80..1135; Strand=-
  SCN-specific regions: Sequence locations=1-34,96-280,303-350,373 -481,503-799,821-1024,1046-1056
atggcagctgaagccttggtgaaaagtgagcttgagaagaaggaggaggaagagccgaagaaagcagaagaagccaagaagcagaaggagaagaaacttaaagagctggagaaacaggcggtagaactgcgagtcatgctggctgaggtggaaaacggtggcaaaaccggcaaaaaccccgggaagggagattcaccggggagggcaaagtgggggaggaaacgtggaaactccccgctcggacaacccgaaagagggcggacaggacgtcgacgacaccttatcattggaggaggaggcggtgccattgctgcgccgtccggcgggaatgtcggcaattttgttgccaacgagagggccggaggaggaagaagcggcaacttggtcttcaacgccgacggcatggcgagggaattgtcagaggatgaggaaaatgagtgggctggggaattttctgtcaccctcccccgcccaaccgcttcacccgaacaaaggagggaagaagcgccggggaggacgatgctaatcaggaatccggaggggacattcccggatgaagaccatttcttaaatttgtcgacattttcacccctcctattttttctccttacaaaaattttcatttctttcttttgctttaaatttcacttcttttcatttttgccatttacataatgttttcttcaacttcaccacttgccttttctttccaaattttctgcctattcacatctgactccgatttctattcctttgtttacactttctcagatcggacatttccatttggccatttgcattcattatttttcctttgtttagcctttttccccgccaatttgtgcccttcggcgtctaattttggcttcactttttcactcgtccaatttatcatcatcgtaatcttcttccctctgaattattcccactttttgacccccccatcataatccttatcgcttttttctcctccaatttcttttaccatatatccaacgacatcttgccttttaatcaccgaccaatttctgaccattttttatcatcatcaataaa

SEQ ID NO: 69997 - DNA, 175 bp, Heterodera glycines
  Genomic contig location: Contig_ID=SeqID_9015; Location=149..323; Strand=+
  SCN-specific regions: Sequence locations=1-109,131-175
actattagagcatctgaagagctctcgaatgataccaagattgttggatttggatgacaaagaaaaaaagttatagtcgaaaaacatgtgctggcgcccaaccgtgcgcgcccaaaaattttgaaattttgcagactattagagcatctgaagagttgggactttttgcttgtca

SEQ ID NO: 69998 - DNA, 132 bp, Heterodera glycines
  Genomic contig location: Contig_ID=SeqID_41973; Location=485..616; Strand=-
  SCN-specific regions: Sequence locations=1-132
taaaaagcaattaaaaatttttagattttttattcatctccctttttgatagtgaaagcatcagagagccttatttaacttttaattaacatttggtgcgtttcagagcacgttctaaaaaatatttatgaa

SEQ ID NO: 69999 - DNA, 165 bp, Heterodera glycines
  Genomic contig location: Contig_ID=SeqID_41974; Location=1..165; Strand=-
  SCN-specific regions: Sequence locations=37-71,93-165
aaaaaataaataaataaaattttaatttaaatttaacggattttctgtgataaagccgcttgcttcattatttgtttcttcttctgctgttggccgatcagcagtgaccaaattcccattcacatcgaactgttgcggtggcagcgattgctttacggacaaacg

SEQ ID NO: 70000 - DNA, 742 bp, Heterodera glycines
  Genomic contig location: Contig_ID=SeqID_41978; Location=71..812; Strand=+
  SCN-specific regions: Sequence locations=1-719,741-742
atgccgcctcttccacagccaacggaaagagacgcaaaaatggaaaaacatttcaatcgccggtttgggactcgaccgcaacaatttgtgtcaaataagccaatttgggctagacaccgactctcgcagaactggagtgcaggaaccatctgtgaatgcaccggagtcatttacaaggtcaaatttcccgacggttcgacaaatcgcttccatgcgaaccaattgcgaaaccgggaaaacacggcaaatggacacgaaccattgaatgttttaaatgaggcattccatctgccgatcaccgcgccgaacgttggaaatgtagggcaggaccttgagccaaggcctgaaccgatcaacgatgagctccaggacgagatcgaacccgaacaggcccgtcgaagcccgacaccgccgcaacaacaagtgccgcgccggagtggacggaaccgccgagcccctgatcggtactcgcccggatgagccaatcaaaaggggaggtgttcgggtgatgaccccgagagagacatttaaattattttatttaagttatttccctctctctgtctcccgcactatttctctcattttattgtgtctgcactccctttgtaaggtcagacacatctttcctcccccatattgtgacccccgctcatttccatcgttcattctgtcttcttgttaatttcccacatttttctccgattgtcctccgccccaaatattaatttatttgtttcca

SEQ ID NO: 70001 - DNA, 481 bp, Heterodera glycines
  Genomic contig location: Contig_ID=SeqID_41980; Location=218..698; Strand=+
  SCN-specific regions: Sequence locations=1-481
aattgttccgaggaagcgaatccatgtgatattattaaagaaggatttccaaaaaagtgctgcagaccaagaaccaaaaaaactacggtaggtatacgatattagtatacaaaatgtatatgcgttttacgagtgtagttttttagaataattctacagaaagggatccacatgacattactgaagaaagaaatgcaaaaaagcgctgtagtcaaaagataaaagaaatttttgaaagcgagacaactcagccgcagccagacaatttgcgctacccaattaacgagtatattagtactaatgagtttgcgcatgaagatattatactcgagctgccaattagtggtatgttaattagttttattacattttgaagacagtttttgtttcagaattcacaatggaatacatcagggaatatggtttggttcgaccgctgttgttcaaagaacaaccagagaatttgggaatgaggtcttaa

SEQ ID NO: 70002 - DNA, 96 bp, Heterodera glycines
  Genomic contig location: Contig_ID=SeqID_9016; Location=324..419; Strand=+
  SCN-specific regions: Sequence locations=1-96
agatgcctgatatcccgaaataaatgcatcaacaccgaaatctccggagtgcccgtcagtttttgctgctgtaacactgaagatttgtgcaatgga

SEQ ID NO: 70003 - DNA, 431 bp, Heterodera glycines
  misc_feature (5)..(5): n is a, c, g, or t
  misc_feature (27)..(27): n is a, c, g, or t
  Genomic contig location: Contig_ID=SeqID_41982; Location=405..835; Strand=-
  SCN-specific regions: Sequence locations=1-431
tctgnggaccaattcttagagtcttgngaccaattcttagagtctttggaccaattcttagagtcttgggaccaattcttagagtctttggaccaattcttagagtcttgggaccaattcttagagtctttggaccaattcttagagtcttgggaccaattcttagagtcttgggaccaattcttagagtctttggaccaattcttagagtcttgggaccaattcttagagtcttgggaccaattcttagagtctttggaccaattcttagagtctttggacaaattcttagagtcttgggaccaattcttagagtcttgggaccaattcttcgtcttggatcagttattagagtctttggaccaattcttagagtcttgggaccaattcttcgtcttggatcagttcttagttttcttgggacaaattag

SEQ ID NO: 70004 - DNA, 1356 bp, Heterodera glycines
  Genomic contig location: Contig_ID=SeqID_41983; Location=107..1462; Strand=+
  SCN-specific regions: Sequence locations=1-530,552-1207,1302-1356
  Gene Ontology: Mol. function=protein phosphatase inhibitor activity; Cellular component=cytoplasm; Biological process=G1/S transition of mitotic cell cycle
atgaaatattacgacgttcgttcactctacccccacacgaatgctgtgacagcataccccgtgggtcacccaacacgagtgaacatcattggtgaggcagagcaggcggttgactggcgacgcgccgaccaggtgccggtccgaggcattctaaaagtgttcgttgtgccgccccatcacgttgatgtgcctgtactgcccgtgaaatttgatcagcggcttcttttcccgctgtgccgtacgtgcgctctgcaacatccgcatggagccgtcaatgaggactacgagtgcacgcatcgcgaggatgatgagcgggggtgggtgtccactgtgacgtcaatcgagttggaggaggcgcttcgcaacgggtaccggtgtacggcctactatcgctccgtcgagtgggacgatacgcggtggagcgaccgcgtttttcgaggctacgttgcagaattcatggccatgaaaacacatgccagcggcttcccggatgaaattggcacaaccgaggaagatcagcagcaattcatagaggaatgtgaggacaaattcggaatccgaatcgagcgggaaaagatggtgcacaacaaggccaagcggaccatcgcaaaactgtgcaacaactccctgtgggggcgcttctctttgcgcaatgggttgtccaaaatgattgtgaccgactcgcccgcggaactgcgcgctctgcttgacaacccagcggtggaggtcagctccgttgaccagctcaccgacgaatgcgttctggtcacctatgcggccggaaacgaatgggttgaggaacacgagtgctcaaacattgtgctctctctttggacaacatcagtcgcgcgcctccacttgttgcggctaatgcagacggttgtgcgcgcaccaaactcggtgctcatctacaccgacacggacagtgtgtgtttcgctaatcgtgaggcggacgggtgccctctggagacgggacctcacctaggcgacctttcggatgaatggccggaccatgaactcgtggaatttgtttccggcgggtgcaaacagtacgccctgcggatgcggcaccaccaaagcggggaggagaaaacagtgctcaaagtacggggcataacactgagcgccgatgcctgtcagcttctccactttgacacattcaagaggagtgtcctacactacgcaatgtgcccaatgtgccattcaaatgatgatgatgatgatgatgatgatgatgatgatgatgatgatgatgatgatgatgatgatgatgatgatgatgatgatgatgatgatgacgaagacatttgttcaattttgattgagtaccccaattttctgaggccccaacattaa

SEQ ID NO: 70005 - DNA, 1209 bp, Heterodera glycines
  Genomic contig location: Contig_ID=SeqID_41985; Location=74..1282; Strand=+
  SCN-specific regions: Sequence locations=1-161,183-437,459-1064,1088 -1209
atgcatcgcgaaatccgcgaaacaatgcatatgcaactgcacagatgcagtgacagttggtgtggtcctagcgacccaatttacgggcggtgcaagaaggggttcccagccccttactcaaaatgtacgattttgcgcccggacaggcccgcgatgtatttccggccttcaccatctgatggtggtgcccaattagaggtaaacggcttaatatacgacaactcacatgtcgtgccgtataatccttatattctgctgcgttaccgagtacaccataatgtactgtttgcatatggtaacaaagcaaatattaaatatgcactcaagtacccattcaaagggccaggacattgttatgtcgagtgcaaagaagagtccggcaataaaattggaattgatgagccggctcaatatgccaagatgaacttccgtggtgcaacggaagcatatgccattgttcattcaatgccatttgcccgtctttcgcatcatgttgtcaaattggcaattcatttgccaaaccaacagcccattgtatatagggcattccagctggtgagcaaagctcaacaaatccagcaaggcgaactgccagaaacgcagtgttcagcctattggaaacaatggcaaaatgagtggaagaatgatccaaagtttaaggacattcttttcgaaaaagtccctgagcggttccgatgggcaaaggacaaatgggtcctgtacaaaaggcagcaaattaaaaggccacctatcggccgaattgttcctgtacccccatcggacccggaaaggttcgcgctctattcacttatgcgtcactttcctggagacccagaccatcttaagatggttaatgggttgctttgtacctcattcactgaggctgcaataatgcatggtcttcttgaagacaacaaaatttgggacaaaactctggcggaggcagctctgtcgcgctggccagatcagatgagatggctttttgtgagcatcctggtctatggccagccgagtaatgccatagaattgtggaacaagtacaaagaccaaatgtacaatccgcaaggcattattactccggcacagcataaagtagcagagcttgaagccctagccgacattgattggcggctgcacagctgctttaacttaagctgtgtgcattttagcctgccagacccgccaacttcaattgccaaaaatacttga

SEQ ID NO: 70006 - DNA, 380 bp, Heterodera glycines
  misc_feature (26)..(26): n is a, c, g, or t
  Genomic contig location: Contig_ID=SeqID_41989; Location=437..816; Strand=-
  SCN-specific regions: Sequence locations=1-380
  Gene Ontology: Mol. function=DNA helicase activity; Cellular component=nucleus; Biological process=spermatogenesis
acgattttgtttaccctcccccgtcncctcttaggtgtacgcatcaaagaagtgaaggaagtgttgagggcgaagtggtcgatttggcgccggtggaggccgaccatccgatcggaggctttgggaagacgatttcgcatgttaattgcgttctgaaaacgacaaaagggtcgcgcgaattacgtttggatccgaccatttacgactcactgctgaagcaaaaagtgacaccgggagacatcatttacatcgaggcgggctcggggactgtcaaaaggatgggccggtcggacattttcgccaacgaattcgacttagacgctgacgaatttgtgccaatgccgaagggagacgtgcacaaacagaaggaaattgtccaa

SEQ ID NO: 70007 - DNA, 1254 bp, Heterodera glycines
  Genomic contig location: Contig_ID=SeqID_41991; Location=1..1254; Strand=-
  SCN-specific regions: Sequence locations=1-268,290-414,436-553,576 -910,932-1254
  Gene Ontology: Mol. function=protein binding; Cellular component =extracellular space; Biological process=cell-matrix adhesion
gcagcaaaagcccaacaaatcgctgccctttagcaatggcaccaaacgcgcgaggggacggcaccgaaagtttgctaatcgggcgggggatggccatcattcagcggaacgcggaacccaacgtgaacggcaagcaggtcgggcagctgaaatggcatttctatccgtcatcctttgcttttctgtgcagttggttgttttaccccatcaaattgtggtggacatcgaattcgattgtcattcgggtgaccatttgtccgcttttcccttttctcacggaacaaattcagaacgtttcttttggagtgatatttccggacattccattcgttctgcttttctcaatggcactgggctcagttccaacttttccgaagtgctccgaagccccgagggtttttgccgtgtttattttcacataaaagagaaatttgcgcagggattgccattgattggccttcgcgcaacatttactatgtggacagcatcaaaaacgaattgggagtgttgagcatcgacggacgctttcagaaggctttgctgacggagggactgaacaatccgaggcattcattctctcccctccccccattcgttggcatttgatttgaattccaacagggcattggtaatcgacttggaaagtcggcatttgtattactccgattggtcccgagaagggcccaaaattggcagagtttcgttggatggaagtgcaaatgaaagtcggttcggagagacactcccaaacaatcgttggacaacgacggacttttcagttttcatttcggacgacgtgcacttgcccaacggaatggttctgctgcagcagcggagatggctttgttgggttgacgcgggcattcagcaattgtcatgcattgggctggacggaacggggcgaagagtggtcagtcaatcaatcaatcatcactcataagctatgtatgaccccctcccccattttggcatcggaattaaaattttgccacaatttctgaccgtttcaaaagaacggagataaatggcgaaagccaaccgaagaaaaggcattttcagatttacgccccgcttgagtatccctttgggctgacagtgaatggagcggaggagcgcttttactggaccgattgggaagagtttgggttttgatgccttcggaataactgcccctattcttaagcatgaaaatccattccgtggatgttttcgacagaagggtacacccaatttttgccaggaggtggcggaaaa

SEQ ID NO: 70008 - DNA, 946 bp, Heterodera glycines
  Genomic contig location: Contig_ID=SeqID_9017; Location=1268..2213; Strand=+
  SCN-specific regions: Sequence locations=1-179,201-220,242-263,320 -621,643-706,741-832,855-946
atgggcttaacactgttggccaccatacccgcttcatcatgtttacagtccgagcagcgcgagctgtacattgacaactttacattgatgttcttcgacagcttaatggtacagttcaatggtgtttagaatgaacttttctacgatagtaatggaattaattggtgcctaaaatttggaaattaaaataataataatttcattaaggttgctttgaactctgcttttccggaacatcaagttcaatacgacttctttgaatgtaattttattttaaattaattacctttataaaaaatattttaattttttataaaatgtctttcgaattcaatctttctgaatttcatcaaataatttttttacacaaaatgtgaatttaatatatgcaaaaataaaaatttaattcgatagcattatttattgattaatgatgacaaacttaatatcactactaattatcataattatgagtaattcaagctgattttaagatgaggatgaggacggtgaaattatgcgagtgcgtacggacgaagagttggccacctttttgtccgatttagcaccaaattgtgggcggcaacggcaaccgctcaaaatttgtttgagtaaattgataaaattaatacactaattaagtgtgattaatttgaaggaacgtcgaccaattgccatcggcaacaaagcattgattttgaggacgatgaacatgaacaacaacaacaaaaccaacagcaccaatttgagccggaagagctgcagtttgttgaacgactgtcagatggccaatttggcagtgtgtataagtgagaaaattaattgaatgaatcagtccttgaaaaatccttatttcgaggatttttccgaggttggccacttccacaaaaagtgcaaaaatcaaatatctgattttttaatatgttttttatcaatgtttttaata

SEQ ID NO: 70009 - DNA, 523 bp, Heterodera glycines
  Genomic contig location: Contig_ID=SeqID_9017; Location=2570..3092; Strand=+
  SCN-specific regions: Sequence locations=1-269,291-305,328-523
atgaggcctacaaaattcctggctagcggttttcgagtcgagaaatctctcgggtttttggtggcctcgactctcggacttacttttttcatctctcaactaacatacagagcattggacacccgaaatgatcggatgatggcggtgaaatgtatcgcggtggatggcacaagcggcacacggcaaagtctgctcaacgaaattgccattcttaaggtgctcctgtgatctgatgcaggacagcagcagatctataatccaagcaatttaaagaaaattaaacaattattatttaattggagcccattaattaatttattaaaatttcgcattttagattggataaaaaaaccaacaaatataggaaactgaagctatcaaaatgcttgaaatttgtccaattaattttatttcacttttcatacttctcagtagaggtgtgcccatgcgaacattgtccaattccatgcggcactttttgtggacaatcaactgctcatttgcatggtcaagcaaatactaa

SEQ ID NO: 70010 - DNA, 913 bp, Heterodera glycines
  Genomic contig location: Contig_ID=SeqID_9018; Location=295..1207; Strand=+
  SCN-specific regions: Sequence locations=1-373,395-469,498-544,576 -586,652-913
atggcattgggccgtttcccatttgggcctggatcagcagttatggtgccaaatctgttcacaatcgaatcactgatcagcaggccggaaacgatcgccaccgtaatccgtcagccggaactgagtgccgttgggtacggtttcgaccgtctgatcgctggatggtaatcgggaaatattcaaaaatgatttgaaatgatgagcagtaacattaataataagctggaacataaattgattgaaggaaaatcccatttttgggtattcaattgtccgaagaaagaaaacggtatgccaaaattttgtaaaattaacgcattaaattggaatgtgcgctaaatgggcgtaattttgggaatttcgatcacaaaccttccttgatttttataattttctaattttatttcacctgaaagccgacaatttttagggttgatgaaaattttaaagagtttcaaagggaattgccatttaaattgaaaaattattaaaaaattgcatctcaaatggatttttattcactaagtttggaatttccagtctcaatttaaattttataattaattagtttttttgctttagagagatatatttaaaagaataattaaaataaaaatttaataatattttttaaaatatttttaaaaatttctttcagtctttcactaaatccgaaagaacgtctcagacccgaacaaatttatcaacacgactttttggcagctcatagaccaatggaccaaagtttggtggccaaatttattgctgaaaagaggcaaaattcacaattttgcggaaataacggaataatttgagaaaattcacaccgtgtcaatgtttaaatttgaatctatgtaaaggaaactatttaattgaatataagaaaatgcataacttggtagtagaattttca

SEQ ID NO: 70011 - DNA, 214 bp, Heterodera glycines
  Genomic contig location: Contig_ID=SeqID_41993; Location=498..711; Strand=+
  SCN-specific regions: Sequence locations=1-126,152-214
gtgcttagcagtccatggcgtcgccactccatctttttgggcagtcacgcaattgcagcgagcgaagaatttgaaaaatgctgtgtaaatgggatgaatttggcggaatatttaagcaggattgacggagaatgaatgaatgaatgagctgctgatgaaccatatgaaacaaatttttggggtttttaactttttttttcatttttaaatgcaa

SEQ ID NO: 70012 - DNA, 505 bp, Heterodera glycines
  Genomic contig location: Contig_ID=SeqID_41996; Location=301..805; Strand=-
  SCN-specific regions: Sequence locations=1-1,23-31,53-295,317-427,449- 505
caaaagttttttacaaccacttattgccaatataatttcttgcagattgaaagccatccattgcctgccggttctcggcacagcaaagcactaatagggtgtttgactcacttcaaaaaataattcattacccaacagttttttacaaccacttattgccaatttaatttcttgcagatttaaagccatccattgcctgccggttctcggcacagcaaagcactaatagggtgtttgactcacttcaaaaaataattccatacccaaaagttttttacaaccacatattgccaatctaatttcttgcagattgaaagccatccattgcctgccggttctcggcacagcaaagcactaatagggtgtttgactcacttcaaaaaataattccatacccaaaagttttttacaaccacatattgccaatctaatttcttgcagattgaaagccatccattgcctgccggttctcggcacagcaaagcactaatagggtgtttgactc

SEQ ID NO: 70013 - DNA, 405 bp, Heterodera glycines
  Genomic contig location: Contig_ID=SeqID_41999; Location=487..891; Strand=+
  SCN-specific regions: Sequence locations=1-405
aaaaagaccgaagcgccgccgctttcgccacccaaatcgacgcaaggaaaagcggaagagcctccgtcagatgttttttcttcaggtgggaaatggattgagaggagaaattgcgtcatttgttgtgtggtgcccccgaaatttccaattttttcagacaacaacatggactatggaacattgaaggattttgaccccaaccgatttggagcaccgccactgaaaacgcagcaaaacatggaaaagaatggtgaaaacgaacatgaacaatttcggggatgagaaaattgtgatcactgatcagtcatttattttgcaaattttttagcaccgccgctcaaagtgccagagaaacgtgccaccgcaaaaaaaggcaggataaaaatggatcaattggaaatttga

SEQ ID NO: 70014 - DNA, 75 bp, Heterodera glycines
  Genomic contig location: Contig_ID=SeqID_42000; Location=5..79; Strand=-
  SCN-specific regions: Sequence locations=1-75
atgtggtcatacgtatcattaccaatgcatcgacaaatagagtgcggtgatttggctttttataacttccaatta

SEQ ID NO: 70015 - DNA, 408 bp, Heterodera glycines
  Genomic contig location: Contig_ID=SeqID_42000; Location=465..872; Strand=+
  SCN-specific regions: Sequence locations=1-78,100-123,145-408
atggatgtccatgacgaggaagttgaaattattgggactaggtcaaatgagaggcaaatggaccgggctcatcgacaagaacaacagcaggaaaaattttactcccaacaacaaatgtctgaggaaagtgaagaagcattgttttgcatttctaagcatgacgttaaagaaataagccaagtggtcaaagcaatggcattccgagacgtgagaagcaatggcaaaaccatggcagaaaacattccgttttagcattgcacattaaatgtaagcaatgagggcattcgcttggcagttgacgaccaacacaatcagcaaggcagtgcctacttcagatccgagcacttccaagacttcaactttcgtacccaaacatgcagcattaaaataccgatgaggcctcttatg

SEQ ID NO: 70016 - DNA, 533 bp, Heterodera glycines
  Genomic contig location: Contig_ID=SeqID_42001; Location=80..612; Strand=-
  SCN-specific regions: Sequence locations=1-67,92-316,338-352,374 -427,454-492,514-533
atgtctggaagtgaaccagtgtctaatgagatcctaaacaagtcagtaataacagttgacagggacgaatggcaaatttttaaaattttatagctaatattgtcgggagaagtgccatttttattcggaagttttttcagaagattttgggtctcgatgatgttaaaatttatatccggtataaagcattgatcaatttctataatattacccaagcatggattgcttgagtcggtttcactattattaaatgaattggcaaataaggtggcaaataattcagatttctcagcactgttatgatagcatttattttcataaattagattaggtatttcaaagggattgacattgaattttgtatatatttataaattgaatttcttccctttgaaatagcctttttctcaatttggctatggtatttatttgtttgtatttttatatgtaaagaaatgctatcgtatagtgcttttttggaagttttagcttgcctgaataatttagccttttctttgatggatgctaataaa

SEQ ID NO: 70017 - DNA, 646 bp, Heterodera glycines
  Genomic contig location: Contig_ID=SeqID_9019; Location=1413..2058; Strand=+
  SCN-specific regions: Sequence locations=1-25,54-181,208-345,367 -406,452-457,505-646
atgcttaactttttgcaatcgcttaaccaaacatttgctcaacagcaacaaaaggcgccggacgatgaagcggaggaaggagaggaaatgaaagagcaattggcagagccaacaatcgacgcattggtggaggaacggatgaaagtcaattgaggggagggggggggggaggggaatgatcaaatttaaaaaaaattaaaaaaaaaagtcgaaaaatgattgggcttaattaatccctgaccaaaagtggtcgtctacattttcacggattgccgatgcatttctcattttcatttttttcttgtaaattttagcaattggagcgttttacgcgtgaaaaacgcgaccgaaaagaagcggagaaaagagcagcggacagaagaaactaatgggaaatgaattgaagaattaattaattaattaataattaacaaaggataattaattaatttttcagaattattttttaatgagaaataaaaataattaattttttaaattaatgtcgtcattagcccatttaaccttttagattaattatttgcctatatttatttgtaattctttctccttcttttattaatcttttcttatcaattattttttgcttatttgtcgatttttacaatttttgataataataata

SEQ ID NO: 70018 - DNA, 556 bp, Heterodera glycines
  Genomic contig location: Contig_ID=SeqID_9020; Location=2682..3237; Strand=-
  SCN-specific regions: Sequence locations=1-556
atggagactgggagattatttttcaacctagttcaaagggggtatataattggagaccggcagattaatggagactggcatataaaaagagcaaatacggtaaatggataaagtatattatgtaaattattgcttttcagccgttgctcaaagacttggaggtgaaatttggacaaaagttcaagccgaccaccggctttgagggaattgtccaagggattgtcgtcggcgaagacggatttgtccacgtcaacggcgactaccggcggaggacgaatatgcacccggagggcttctgatcacttgggccgatcatttaggatctgatcaaacggcggaaattccatgtctttctcaattttatgtgccaatgccaaagcttttccctttttttcacttttcatatttttaccggtttatttcacttggctatttaaataatgtgcatctttcttgtgtgtgtttatattacttttattccttttaatttgtttgtttttgctgttttatcacttcaatgacattttgtgcaaaaataagtgaaaatgaaaataaa

SEQ ID NO: 70019 - DNA, 3827 bp, Heterodera glycines
  misc_feature (2637)..(2637): n is a, c, g, or t
  Genomic contig location: Contig_ID=SeqID_9020; Location=1..3827; Strand=+
  SCN-specific regions: Sequence locations=1-567,589-744,766-848,881 -1251,1294-1388,1410-2049,2073-2164,2186-2280,2302-2654,2690 -3261,3290-3765,3787-3827
  Gene Ontology: Mol. function=beta-mannosidase activity; Biological process=protein modification
ttcaccctcttttctgcactaaaagcaaatgcaaatgttttgaggatttggggcggcggattttacgaattggacgaattttatgagcaggcggacgaattgggtaaaaggcaattaattaattgctgctaattatttattaattaatgagttaatacgcatttatttgtaatccttcgataatttctgatggttaattttcaattttcgggcttctcatttggcaagattttatgttcgcctgctcattgtatcccatcgatcctcattttttgcgttcggtggaagccgaaattgaggaacaagtaaataaaaaatagggaaaagggacgagtgaatggcacggattggcattttgtggaaatgccattgtttaaccgaaaaaacatgatctctcccaacagcattctgatgaatgatagttacgtcaagataaacaatcacaaatcatctctgttttccgattgcgatcggatcattttttctggctcaatgccaacatttgtccgtgccctttgtgtatgatcggcttcacttgtccagactgatcagtgtgatcagtgatcagtctgtccttcccccctcttttggcactatccacattctctgtccttttcatgtgcttcgccttcggcaccatccgtcggtgctctgttgggcggggaacaatgaaaacgaattggccgtgcgttcgcaatggtatccttcgtgggattaccccgaggaggcccaagcgcgggactatgtgaaactgtacaaaaaacacattcaaacattggccgtcaagttggacccgaccagaccatttctgctgtccagcccatcgaatggaatcgaaacggaaaggcaaattaattaaaataaaataaattaaattaaaaaagtaacgaatttcagggagggcggagtgtctaaaaacccgggcgacccggcgtacggcgacgtgcacttttactcggagtcggtcaatctttggaagccgtccaatttccccgtgccgcgctgctcctccgaattcggtgttcagtcaatgcctttgcggtgattgggcacccgccgaagtgttgaatgaattcgcttttccatcagtgggacaatggcacgttggattggtccgtccgattggaattacaaaagcggcactttggtcagtcggcaacatcaccccggcggcgttttgaatttgccggcaatcgtttcgcaacatttcaatgtcttcgtttggtccccccattttcaattcctttttcattttaagctcctctcctccaacttttcttctctctctttgtccgccccttttttcatcgacaaattcgcttttctctcccaaattcatcaggcaattgcacttcaagcgcaaattgagcattaccgaaggtgaaaatagcaaaactgaacaaacccagcgaagggatggaatggcatttccatttcatcattttgcattttgattttgggtcgttttggcaaagtgccagttcagtgttccttggctgttacagtcactttttgcccttctgcttggaatttatctttgattactccaaaatgctctctctctttttctgaaggttccgttctcatttggacgaggccgggcttggccacacaatgtgcgcgatgtattggcaattgaacggtctgtctgtccattgcgtaattacaagcaactaattaacaaatttttcaattcaattaacagatgtttgggcagcgcccacttggtcaaccgttgactttgacttgcgttggaaagttggccaccatttcgtgcgccgttcgttctctccgctaatcgtttcaatggtccgtttggaaatgaaaggacaatcactcgattcaattttcatttattttttagtttttggactcaaatggcattttccgcctttggactgtctccgatttgtctctgtccgtccaaaatgccattgtgcgactgtcacttttcccccttcgcaacggactttccccccttttcactgccaatgtttccgtcccaaatatttctccgctttcctcccaagagattcctctcccgtaaggcattaattaattaataattaagggtaattaatgatcaaagcatttctctttgttttcctaattgttcagtgattggcctcccattgcctttgttcgtcctttctcttcttatgacgagggtgacttccttctcatcgccgatctgatcagttcccgtggtgatttgctaagtccccgtgccgttttgtaccccgacaaaatgttccacgcggggctctacggaagtgccgcggtgtcctccctcagagacaacaaaaacggcactttctccgtgaaggtcactctcaccaacaatgttttgccattgctttggctcgacctcagtgacgcgtttaaaaagtgccaaacatttgccaattttcttttatttttacgtttttttcagtgccaaccctgaagtgcttttcttttttgaggtcatccacgggcatatttcactaactgccatttttccatttacatttttaggaaaatgcatttccccgcagttttcgtcccaccattttttcacgctttcaaatttgtagaaaacccaaaagagttcgaatttggcaaagatgacatttgctttgatggcattgtgacganacaaatgtaaaaaggggataaattttatcatttttttactaatatttattttcattttcacttatttttgcacaaaatgtcattgaagtgataaaacagcaaaaacaaacaaattaaaaggaataaaagtaatataaacacacacaagaaagatgcacattatttaaatagccaagtgaaataaaccggtaaaaatatgaaaagtgaaaaaaagggaaaagctttggcattggcacataaaattgagaaagacatggaatttccgccgtttgatcagatcctaaatgatcggcccaagtgatcagaagccctccgggtgcatattcgtcctccgccggtagtcgccgttgacgtggacaaatccgtcttcgccgacgacaatcccttggacaattccctcaaagccggtggtcggcttgaacttttgtccaaatttcacctccaagtctttgagcaacggctgaaaagcaataatttacataatatactttatccatttaccgtatttgctctttttatatgccagtctccattaatctgccggtctccaattatataccccctttgaactaggttgaaaaataatctcccagtctccatttatgtgccgggggggggggggggataaatagaattttttaataatttatttggccggcttcttcgtgatcgtttcgtccatctttaaccgtttcagttgccctaaactcgcgcaaaaaagcccagaaggctgtttctatgcctcaaaacataaaaaattacaaaaaaaaacttcattttgatcacgttaaaaatttcgacattttgaccgacttgtcgacactttgtcccactactcccaaacattgttagacctgtcaaaacattgtttaacccatttaaaaacaaatatcaagctctacgcactcaattacccccaaaatctcccactcactgcgaaagccgacttttttgaccaaatttttagacaaatgaccaactcaactttgggctagggactcaaattttttaaaagaaccgcctcaaaatgctctaaccaaaaaccacctcgcccattacccacggcaacttaaaagccgctacgggcgcaaaaaaaacatgcaactctaaaaaaattcggaaaaattccctttttgaccagtttttcggacaaatgacctacttaactttgagctaggggtccaaaattt

SEQ ID NO: 70020 - DNA, 1075 bp, Heterodera glycines
  Genomic contig location: Contig_ID=SeqID_42003; Location=170..1244; Strand=-
  SCN-specific regions: Sequence locations=1-23,46-1075
  Gene Ontology: Cellular component=membrane fraction; Biological process=steroid metabolism
aggttgataaacaattaacattgataaaagaaacttaatgaaaaacgcattttttaaaggagtttcgctcaattttggacaattcgcggtccggtaccgtactcttctcattcggcaccgtagccaacacgcgcactttgggcgaatcgttgcgacggatgcttctccgcacattcagccaattccccgattttgagttcatttggaaattggacggagaatcggcagaaaatgagtcggaactgatcaaagcaacaccaaatgttcacactttcgaatgggtgccgcaaaatgccattttaagtgtgccattcttttattgcactccttaaattttgtcgaattttgagggcatccaaaattgcgcgcttttgtcactcattgcggccaaaacagtctggccgaagcagcaaaaatcggtgtgccaattgtggccattccgctgttcgctgatcagctttacaacgccgtgttggcaaagcaccgagggatggcagtccacgttgacattcgccagctgatcacagacaaaacgggcaaagtgctgggaacagcgctcagtcgggtgagcaaaggtggaccatcgattgatcggatcattcgatcacttttcacaaccaaacaaaatgaatgagaaagcaaaaatgaaaagcacttcaaatgcatagaaaattaattatttttaggaggatttattttactaaagcttttttttgttttggacaatcagaattttctcaacgaattgggaatggcatttcgaattccgatgaagaatcattaatctccaataatcagttttaaaattttaacagaatgttaattggtttcttaggttctccacgatgcctcttttcgtgccaatgccaaactcatccgaaagaaaatcgctttgtcgcccttcggtgcaaaagagcaattggtgcgttgggtggaatttgcagcggaatttccgcatctgaacgagcttaacttgccaaccgatgctgaattgggatgggttgcttattattcaatcgatgccattctgttctccattggtgcgatatttttggcaattttggcactttttttg

SEQ ID NO: 70021 - DNA, 77 bp, Heterodera glycines; identical to SEQ ID NO: 42007
  Genomic contig location: Contig_ID=SeqID_42007; Location=1..77; Strand=+
  SCN-specific regions: Sequence locations=1-77

SEQ ID NO: 70022 - DNA, 522 bp, Heterodera glycines
  Genomic contig location: Contig_ID=SeqID_42011; Location=469..990; Strand=+
  SCN-specific regions: Sequence locations=1-37,85-313,335-373,410-522
atggctaaagaaaatgaaaaagaattgaatccggaggtaatataattaatttaatttaatattttattttaaaaacttttttttccttttcagttggataagccaaatccagaagaaatgccactcttggaaaacactcccatcaatgatttagtcaaaaaaattgaccgttcagttggccatacatcaaaatctgatttttcaaagcaattctcatggctgttgaagtgtgcattatgcataattttgccggtaaggcacattttaatgaagtattagttaattaatatgtacatatgttggaatgggttccttttttaatttaaaaatttttgatggagacacgaacttgctgattagattatcactgatcaataaaaaaaatttcattttataaaatataatttttcttgattttgattcgaactttctgctgatccgaaatcattgatcaacaaaaatcactttcagtttatgaagccaaatacattttcttggcctttgacccgaacttctttttga

SEQ ID NO: 70023 - DNA, 342 bp, Heterodera glycines
  Genomic contig location: Contig_ID=SeqID_9021; Location=501..842; Strand=+
  SCN-specific regions: Sequence locations=1-34,56-138,161-247,289-342
cacgccgatggtggccaaacgaatgccatgacgacgtggggagagggagaagcatcgcctggccaattcgagagtctcgaccaaattccgtccagggacacagaaattttaatcaaattgaatttaaaattcaaacccaatgaaatttatttgttattattgttcgtgttttcattcttcaaatatcaaaaatatttttgacatatcgcccgccaccttcatttgagaaaaaacaactgtgagtccctaattttatcatttaaattaataattcatatttatatttttgtttgtccattagttcgttcattttttctcaattaaatgattaattaattttgt

SEQ ID NO: 70024 - DNA, 3610 bp, Heterodera glycines
  Genomic contig location: Contig_ID=SeqID_9021; Location=1102..4711; Strand=-
  SCN-specific regions: Sequence locations=1-234,256-288,327-334,370 -372,398-773,796-1116,1142-1145,1173-1180,1210-1242,1264-1998,2021 -2100,2122-2396,2418-2453,2497-2679,2701-2796,2818-2953,2980-3610
atggtcaatgtgctcggcttccccgctttgaccgctccgaccagcaaaagttgggtcactggcatgccgttgggcgtgcagctgatcgccgcaccgttcaacgaggcgcttctgatcgctgccgccaaagaattggaacgcggattcggtggatgggtgaaaccgggccaaattgtgccaaacatttgaattgggcgaggacggaaagaggggaaggaaagacggacagacaaatgatcaaacgacaaaccatcaccggactaagaaaaaatgcactaatttcatgaaagtgttcgaggaaaaaataaaatttatgaaaattcaaataatgggtcattttaaagaaacttttttaaaaattagactatctgctttatttattttttgcaaataaatcgtcataacttatctcagctcgtgctggcgcattttagaaatcctcgaaatggtcaaaaacctaaaaaatatataaacccacaacttttggtacttccgggttttgtcaccccccccccctgttctaggctagtttgtaacattggtctcgaatctgacatgtatttggacatattacgaaccccggacccaaattcgaacaaaaagtctgaaataaaatttttaaaattcactttttgttctaaaataaattaaaacaagcaaaaataaactcaaatcattacaacatcaaaaaataatcattgtgcacaggctcgaacataaatgtgagtttctgaaaaattcgaattttcgactttttgtttgaattcgggtccgggatttgaagtaggccaaaatggatgccatattcgtgatcaacaaccccaaaaacccttcactttttcacgactttttagcaaaaaactggggttgatcggaaatattttcagtccttctaatttgcacaaatcattcattgtacaccaacaattttcataatgaatactcataaaatagttaattatgcattcatttgatatgtaaatcaaaaaactgccattggatttgtccgtccgaagcagtgaatgaaaaagcgatcagcagcagcgaatcagtgaaaatgattcgtcagcatcagtttttttttgtcatcacttttgctgtccattcttttcgcttacatttttcattcattcattcgttccattaaatataatttttccaaaaaatattttccatctaattgataaaaatatttatttaatagccaaaaccaattgatctgagggttttgtaaataatagcttcatttatggaaggagaggggaggggggtcattaagttgtaaagttgtaattacatcctaaccaacaactcaaataccgtgtgagagtgttgtcgagaatgtcagtccttgagtgaaaattttgaatggtcgttatttacaggaacccacccacacacttaccgtacccagcactttaccctcttctcccttcattctttgttcaccgatttcgtgtgccctctccccaaaatgtgctcctccgtcagtgccgtcgtccttctcgcggctgaactgcttgcatttgccgtcctcgtggcaaatgccgccgacagtccctttttttctttttcttttttttgttctttgcacttaacttacaaattcagagaccggacattctgaaaaggtgtgcgctccattgaaggacaaggacaagggcttttacgatgaatgcttgaagtcggaggtggtcaaacaaaagggattcatcccgaagcatttgcgccctccgtggttggcccttgacatattcggggacaacagagcggaaaaggtggacagcaattgctacgcctgctacaagggcagcatggcgagcggtggaaaattcgatgaggaggaatactgcgcatgccatgtttgtttttgagggttaaaactgcacaattgacattttagaaaaatcaaacatttgtttttcaaatttttgcttttcaaaaactttttgtttttgcaaaaaaataagaccctgacaaaattctctctgattttacttttcttgggttttttgttaaataaaaaaaccagcagacttttggccaatctttggtttgggatttgttttggctcactttctttagttttatgatcggtcattaatttttaaaacttcttcagtatgaaaacaaagccccggacattaaatttggaaacttatttggctccatccaattgagcgataaactcgacagttgcgtggataacttctacaaagttgctttggtaggcatttaattggccgttgccctttcgcctaaatttttggtgaagatttggtactgtatgtcagtttctttggtactgtagggttcggattgatactgtacgaattgaattcagagcaaaccaattaaatcaactacatttaaaattatttctttgttgcttagatgccaaaatgcggaaatgaaaactacgaccatatccgtcactgtgccattgtaccaacattttatattttatttatttactttttaatttaatcattttatctcaaaggttcacttctacaagaacgatccggcaagcgaacccgaaggcgccgagtttaagcgtaaactttaaaaaaaacatggccattcattccacgggcttttaagggactcttttgctgttggacgggtgcgtgagcggagtgaaaaccgcatgcaaaggcaaagtgaaagtcgagttcaccgagccgggcaccggcttcttctccggaaattgttacgaagaagccaaaactgcgctcgagaacgagtgagtgtccgggcccaaaacactatctatcattgctgaattagtggccagactttggcaaaggttggaaaataaggacgatttggaaacttgtcagcacttagctggtttggctgtacattataatttttgcagtttcgaactcagcaaagggaatgacctttctggtttttctgaaaaagacgagaatggcactatcaccggtggaaatttatttattttttaaattaattccttaattcattagaacaagcagacgacagcaccgtgttcacgttgcccgtgctgttgcagcatcgcaagtgcagcggactcggcagtgccaccatggacaacacgttcaaggacatcactctcacaatcagcggcggcgagtaagcattgaacaccaattacatccaatcactttcccactaaatatttgttcagttgcgagtcgcaaagcttcaaactcaaggacgtggacgcaagcaaagtgagggaaaagcaaaaagaggggatcggtcgaatggaatcggtcggacacactcacatgatgagttttagcagcaaatgttcaggcagcattcaatttcttttttcaaattcaaaatcattaattataagacgcattaatccatttatttgtgattggtttaataaaagttattttttgttcctaattgtgccaataaaaattttttgtagggccgtgtgcaggaaatgcgcggactcgagctgagaatgagcgacggcactgccaaacaatggactgacgattcggggaattatcaatacacaaagaaggatcagctgatgttgaagccgatggagaacatcgataaaatcgatgaatttgggaagttcaaaaatccatcttactga

SEQ ID NO: 70025 - DNA, 1057 bp, Heterodera glycines
  Genomic contig location: Contig_ID=SeqID_9021; Location=3274..4330; Strand=+
  SCN-specific regions: Sequence locations=1-175,197-229,259-266,294 -297,323-643,666-1057
atgaagggagaagagggtaaagtgctgggtacggtaagtgtgtgggtgggttcctgtaaataacgaccattcaaaattttcactcaaggactgacattctcgacaacactctcacacggtatttgagttgttggttaggatgtaattacaactttacaacttaatgacccccctcccctctccttccataaatgaagctattatttacaaaaccctcagatcaattggttttggctattaaataaatatttttatcaattagatggaaaatattttttggaaaaattatatttaatggaacgaatgaatgaatgaaaaatgtaagcgaaaagaatggacagcaaaagtgatgacaaaaaaaaactgatgctgacgaatcattttcactgattcgctgctgctgatcgctttttcattcactgcttcggacggacaaatccaatggcagttttttgatttacatatcaaatgaatgcataattaactattttatgagtattcattatgaaaattgttggtgtacaatgaatgatttgtgcaaattagaaggactgaaaatatttccgatcaaccccagttttttgctaaaaagtcgtgaaaaagtgaagggtttttggggttgttgatcacgaatatggcatccattttggcctacttcaaatcccggacccgaattcaaacaaaaagtcgaaaattcgaatttttcagaaactcacatttatgttcgagcctgtgcacaatgattattttttgatgttgtaatgatttgagtttatttttgcttgttttaatttattttagaacaaaaagtgaattttaaaaattttatttcagactttttgttcgaatttgggtccggggttcgtaatatgtccaaatacatgtcagattcgagaccaatgttacaaactagcctagaacagggggggggggtgacaaaacccggaagtaccaaaagttgtgggtttatatattttttaggtttttgaccatttcgaggatttctaaaatgcgccagcacgagctgagataagttatgacgatttatttgcaaaaa

SEQ ID NO: 70026 - DNA, 190 bp, Heterodera glycines
  Genomic contig location: Contig_ID=SeqID_42012; Location=800..989; Strand=+
  SCN-specific regions: Sequence locations=1-190
atgcaatggaaaccggaagtgcgtacaaaagtgattagaagaggtgcaaaagtgattagaagaggtacaactgtgattaaaggaggtacaaaagtgattaaaggaggtacaaaagtgattaaaagaggtacaaaaatgattagaagaggtacaactgtgattaaaggaggtacaaaaatgattaaaagag

SEQ ID NO: 70027 - DNA, 436 bp, Heterodera glycines
  Genomic contig location: Contig_ID=SeqID_42021; Location=90..525; Strand=-
  SCN-specific regions: Sequence locations=1-56,83-185,208-209,235 -391,417-436
ggttcgatgaaactttttaaaatataagcctaaactttttggcctgtttaaaaaggaattaaaaatttttaaaatatttattcatctcccttttgatagaaaaagcatcagagagccttaattaacctgtaaataaagttttgtgtgtttcagagcactttctgaaaaaatacttatgaattaattttgcaaaaaataaataagtaatgaaaaagtcagaatttcgaaaaattttaaaaacaacaagcgttggcattttttctggttaagttagtcctttacaatggagaaggcctgcaaaatttggagagattatatcgattttagtgcgctaggttcgatgaaactttttaaaatataagcctaaacttttttggcctgtttaaaaaggaattaaaatttttaaaaattttattcatctcccttttgatagaaa

SEQ ID NO: 70028 - DNA, 331 bp, Heterodera glycines
  Genomic contig location: Contig_ID=SeqID_42021; Location=668..998; Strand=+
  SCN-specific regions: Sequence locations=1-135,162-278,307-331
tttattattttgcaaaattaattcataaatatttttttcagaaactgctctgaaacgcaccaaatgttaattaaaagttaaataaggcactcagatgctttcactatcaaaaagggagatgaataaaaaatctaaaaatttttaattgctttttaaatatgcgaaaaattttaggcttaactttttttttataaactggtcagaagcgaaccagattttgcgagagcatcaaaaagacaaggaaaagcactgctatgatgctaactccagtaattctgaatttaaaattttttattaatttttaaagcttcactattttatttttttagca

SEQ ID NO: 70029 - DNA, 116 bp, Heterodera glycines
  Genomic contig location: Contig_ID=SeqID_42021; Location=1006..1121; Strand=-
  SCN-specific regions: Sequence locations=22-116
aatttttaaaaattttattcatctcccttttgatagaaaaacatcagagagccttatttaacttttaattaacatttggtgcgtttcagagcagtttctgaaaaaatatttatgaa

SEQ ID NO: 70030 - DNA, 399 bp, Heterodera glycines
  Genomic contig location: Contig_ID=SeqID_1211; Location=1440..1838; Strand=-
  SCN-specific regions: Sequence locations=1-399
tccttcgccgaggccgtggttcccgtccagttcatggtgctatcgacgttgccgttccgattcaaccatacggtccaattggcgaatgagatcacccaagaacgcttagcgctgacaagtcgtacacgagttgatgctgctggagaagtgcagacgattgtgatggtgctacgctcttccatggagtttgatgacacacagttgaaggaatggctgaacactacgagaattaatgcggcgtttcatgacaatttggtccacattggcttcaacgacaacgaaattgggtgtgttacagtttgggggtttctgattttccaaccattttttcagagaattgccatcaccatctgctgatgctgaatccgcgtcgagaacgagaaccaccagcagatcgtt

SEQ ID NO: 70031 - DNA, 879 bp, Heterodera glycines
  Genomic contig location: Contig_ID=SeqID_1212; Location=263..1141; Strand=-
  SCN-specific regions: Sequence locations=1-192,231-267,298-879
atgctcagcgagtataaaagcaacgaaattcggccatttcgctcttcccacacattcattcattcatttccgtattttcgccttccgttggcctcgacaacgcaacagcagcaacagcagacggaaacaatcgacgcagaactgtgcacaacaaccgacgtcatctgtctgctgttaaacactgggcatatctcacaatcatcaccatcatcatcagcagcagcaaaagcagaggacaacaaaacgcatggaccaaaagtgataaaactttagaaaattttttgaaaaatcacaattttctttgtttttttcagccgactcagcgacttcgcttggatggaaacattggcgtggctcggtcgtgcagaagtgggcatgaagctggcgctggtcaacacccggttcaacatgctggtggacaagcaattcatgctacggcagtggcgctttggcgagtttcacatctgcgagcgggaaggagcacaacgaggcggcgcagaaatcatgacatcggaagacggcaccaacttcatcacgttgccactgcccaccacgccgatgccgagcagtgtcgtcggcttccaatcactctccatttggtcgaaaaaattcaataattttcataatttccccccatttttgcaggttcatcaacgcggacgtcatcaaatttctgcgccggattcgccgtctgttcgccgaggacatcgcactggaattctccactcggcacacggagtttcgcagttggcaagtgattgcgcgacatgtttggccactgttacgggacgggatcagcacattggtgtgcctgaggaagtgcgatttggccatgctgcgcaaacacgtgtcgccgaccgtgctgttcgactgccctga

SEQ ID NO: 70032 - DNA, 508 bp, Heterodera glycines
  Genomic contig location: Contig_ID=SeqID_1217; Location=310..817; Strand=-
  SCN-specific regions: Sequence locations=1-31,62-276,332-406,440-508
atgaccgctgaagagatggcatccgaggagatgaaaaaggtccgtgaacagttgaccaaggagaccattttggagcaccaaatgtccgtccaagaaggtcagtggaaagtttcggaatcgcaacattgtgaccgacggaaaacttggcacctttttgcgacttttgacggttttgggtccccaattttggatggtttccaccggttttatgccgtaaaaaatgctaaaattacgcgaattggaaaaaaaatcagcgatttatggggacacattcacatatttaatttttcaaactaatttaattaggaattttttaaataaaaaaatttttccctattttcaggcactccgacggacatgttcaagtgggttttttctgcgtttttttttgttgcaatttcagtacttttgccatcacacatttatttgttattattacacatttattgtgctttttgcagggcgttgtccacttccaaaacattggaccgttttgggaattggatga

SEQ ID NO: 70033 - DNA, 65 bp, Heterodera glycines
  Genomic contig location: Contig_ID=SeqID_1217; Location=1217..1281; Strand=+
  SCN-specific regions: Sequence locations=1-65
tctccattaaaggccctgtctccaattatgtccccctttctgaggatgttgaaaaataatcgccc

SEQ ID NO: 70034 - DNA, 623 bp, Heterodera glycines
  Genomic contig location: Contig_ID=SeqID_9023; Location=811..1433; Strand=-
  SCN-specific regions: Sequence locations=1-102,124-362,385-623
atgtttgaaatgttttggttcccgggattaggtcaattgttcggtcaattcatggtcttgagaaaggttttgggtcttggagtcaacaagtctcggtctgagaaaggtttgaaaattttggggctcggaatccatcaattaccggtctcgagaaatgtttatattttgggtcccgggtttggtcaaggttttagcctcaagctacatcatcacgatgtaatattcgcccgaacaccgtatacacaaaaaaaaaccgagccaaattacagtaaaacaaaaatttactacagtaataaactgacagttgtggccaaaatgcgcagtgaatggagatgggcacggccaagccaagtcaatgcgaatgcccatgccaaaaagagcaaaacggtggccatggacaaaatgacacagcaacggatgtgccaaccgtagtcaaagcggggcttaattcgacacaaattaagtcacaatggttggcattttggtagccataacgaagatttttgctactttgatagtgaaaatggttacgcttttccatccatgaggcaaatttttttaggtaaaaaatgactcaaaaattcataatttttaatccgtgatcaggccatgttcctaataaa

SEQ ID NO: 70035 - DNA, 555 bp, Heterodera glycines
  Genomic contig location: Contig_ID=SeqID_42022; Location=124..678; Strand=-
  SCN-specific regions: Sequence locations=1-44,68-143,165-243,265 -372,395-501,525-555
atgtatctgtataaatttgctcaagtaaattgtaaatcggaaattattagcgtttatcaactccatacttccgcaacacttatacagtttattttgagggggtaatgagctgaaattgtaagaattatacaagctggccaaaccaaaataataaatggaaaattattggcgcttatcgactcgatccttctgcgacgcctatacaatttatatttccatgataatgagctgaaattttgagaatttcaaagtgataatgaaatgtaaatagagaatctcacaatttcagctacttaatctctaaataaatactgcagcaatattgtagaaggatcgggttaataatattctctgatttattattttcacgaccatccttgtgaaattctcaaatttcagctaattatcatctaaatataaactctaacagcgttgcggaaatattgagttgatagcgccaataatctccgacttattattttcacgaccatctttgtgaaattttcacattttcagctcattttcctccaaatgtatctgtataaatttgcttaa

SEQ ID NO: 70036 - DNA, 135 bp, Heterodera glycines
  misc_feature (16)..(16): n is a, c, g, or t
  Genomic contig location: Contig_ID=SeqID_42023; Location=1084..1218; Strand=-
  SCN-specific regions: Sequence locations=1-135
aaagtacagggctatnagggaagctactcccgaaggattcgttctccccataaatctgggcgcatcggttcggggggactgccccgaaaacaaaaaaatcgattttttcaagtgtccgtttggggtactcaaaca

SEQ ID NO: 70037 - DNA, 389 bp, Heterodera glycines
  Genomic contig location: Contig_ID=SeqID_42029; Location=7..395; Strand=-
  SCN-specific regions: Sequence locations=1-20,42-275,297-389
atgccaaaacaaaacgaaatcgttttaaaatattcctttctggacttgacttggtttcttgatatcgaagctgttttctacgctatttctaaaacggttataccaaacctcagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagtcatttctgggactttttcagaaatcagaattaattctccaaatgtggccccaaattttaggcccccagccacagccccttcttctcccagttttaagtcttggatttgtcaaataaa

SEQ ID NO: 70038 - DNA, 460 bp, Heterodera glycines
  Genomic contig location: Contig_ID=SeqID_42031; Location=788..1247; Strand=-
  SCN-specific regions: Sequence locations=1-263,294-460
aacaatggcgggattgacggcggactgatcggcgccccccggagcgaatactcagccgatgcaatgcgaagcgggggacaattggcggcccgggagggcgagcagctcctcggtctgctgagaatgtgccgtcagaaatcggtggggccggggaattccgaaatatttttttgtaaaccaagatttagctgaaacgttcgcaacacaatttggaggggctttgctccgcacttttccaaatggccaaagaacagcgaaggcgaaaacggagggacattttggggagggaaaggcaccaaaatgaaatggcaacgaaacgtccttttttgccaattggggaggacgaagagcaatggctatggtggtagcagaaaaggacaggacaaaaaggagagattctgctgatcagtcggaacggagagagattcaaatcgaagcgatcggaaaaagaaaatcagaa

SEQ ID NO: 70039 - DNA, 666 bp, Heterodera glycines
  Genomic contig location: Contig_ID=SeqID_9025; Location=55..720; Strand=-
  SCN-specific regions: Sequence locations=1-30,52-142,164-242,264-666
atgagcacaccaccaaaagcagacgacaaaaagaaggaagtgggcggaattatgaacatcggcaacacatgctacatgggcgctgcactccaagcattggccaacgtgacggcactcagcaattttctgatggaaaagtgggtgccaataatgccaatgtccaatgccatcaatttatgttttcacccctctttttcagcgaaaaccgactgcccaacaacaaactcgtcatggaatatgtgcaaatgatcaaaagcattttggtgttgcgacaaccggcggcgccattcgaactgaaggtgtggtgaacagtgtgccgtggtgatggtggtgttgcgtttcatgactcgccgttttttcaggaattcatctccagccgtaccaatttgttcgctgattcgttccaacatgacagccaggagttcatccaattctttgtggacgcgctgcacgagtcgatgaagggcattctgcgcggtgttacgcaaggcgtcagctgtgacatgtacagaaatgacggcgcgggtggtagtgctgatcaacgtgacgaccaaatttggcgcaatgcaatcgacgtaatgccaaattgtgtgcttttttttgtacttaatttggcattttcagcattggagaaacgaagtgctcgcaccaaagaaaggcagcgtg

SEQ ID NO: 70040 - DNA, 438 bp, Heterodera glycines
  Genomic contig location: Contig_ID=SeqID_42034; Location=690..1127; Strand=+
  SCN-specific regions: Sequence locations=1-56,80-106,128-246,268-438
atgagaataagaatgaatcagctactgtttactcagacttctcggtaaaagcgacttttattttaataaaactttttcaaaagaactaaaattatgaattcaaagcattatttttattttattttatcataaacgatttctattatctgaaaaatattcttttagatactgcattacagattgggattttatttggggtatgtcaaattgcccatttgattcaaatatgcttattctttgtcacattctaaaaaaggtttattatcacttgaatcaatcaaccggacttacaacatttgaaagtggcaagcaaaaccagacataattttcgatgatttcgtggccatggaagcccccgcggagatcacacaaaatgcgacaaaagcagccgtacaaaacgacgcgtattttccccaaaattttgaccagcgtcgacaa

SEQ ID NO: 70041 - DNA, 63 bp, Heterodera glycines
  Genomic contig location: Contig_ID=SeqID_42035; Location=58..120; Strand=+
  SCN-specific regions: Sequence locations=1-63
gttaagttagtcctttacaatggagaaggcctgcaaaatttggagagattatatcgattttag

SEQ ID NO: 70042 - DNA, 142 bp, Heterodera glycines
  Genomic contig location: Contig_ID=SeqID_42035; Location=820..961; Strand=+
  SCN-specific regions: Sequence locations=1-32,59-142
taagcctaaactttttggcctgtttaaaaaggaattaaaaatttttaaaaattttattcatctcccttttgatagaaaaagcatcagagagccttatttaaatgttaattaacatttggtgcgtttcagagcagtttctgaa

SEQ ID NO: 70043 - DNA, 1020 bp, Heterodera glycines
  Genomic contig location: Contig_ID=SeqID_42041; Location=245..1264; Strand=+
  SCN-specific regions: Sequence locations=1-93,133-373,395-1020
atgtccgcatcaattatcaaaaatggggttctgggttttgttcgtgttttggctctatggtctcgtactctgctcgaggcaattagttcgggaagagacagggagtgagtgagagagagaaagagagagagaaatctagaatcttccaaattaaacattcttggaatcatcaatagccctaagagtcctcaattagtttgtaaaatttaaaaaaatagttgtttgtttcaaaaaatttacggtcaaaaatgtccgggaaacgagttttttgaagtttacaagccttaacttttttgatagactaaaagaggactcttacagctatcgaatgacaccaagaatgtttaatttaggtgattctataaatgatcccttaaattttacaaattattttatggtagtgtctttttatggtccggtggactgatagagccatcagagtgcttattccgttcaggtttaatcaacccaaacactggagtgttcaatgaccgtgcgaatgtacaacagccagtgccgttgtaccatgcgcttcggcgcggctttatcaaattgccgagcatggcaacgggaatcgcattgacacttaccgattgcgttgagtggttcttcatcgacgacaacaccggcaaattcagcgaccgtttttccgatgatcagttctcattgttcgatgcgatccaccaacctcgtccgctggtcaagagcaacgtgcgagaaatcattgacatggcaaacaatcggcggcttactgttgcggaagcggtgcgtgcgaatgtcttgtgccaagacactggaagattcatcaatgtgcacggacacgctgagtcgctgcgtgatgcgtaccaactcaaattggttcaaaagccgcagactttggccgaggtcattgatagtggctcgctggacaacgatggtcgtttcatcgatggtgttaaacctcgcactctgctcgaggcgatttgttcgggaatgctcgacccggatgtggcgcacatcagagcgggaccaggcgacgaa

SEQ ID NO: 70044 - DNA, 154 bp, Heterodera glycines; identical to SEQ ID NO: 64263
  Genomic contig location: Contig_ID=SeqID_9028; Location=866..1019; Strand=-
  SCN-specific regions: Sequence locations=1-154

SEQ ID NO: 70045 - DNA, 735 bp, Heterodera glycines
  Genomic contig location: Contig_ID=SeqID_9029; Location=1411..2145; Strand=-
  SCN-specific regions: Sequence locations=1-76,98-308,330-457,479 -700,722-735
atggtccgcactttctttcacgacaacgaggctgggttcaccaaaaaatattatttctgcgaactccaattttttgctatcaatgaattggtaaatgggatttcggcgtttttcgcaaagcatcatttgtccattttgaccaattccggacaccggatccgaactcgaacaaaaagtcgaaattcaaatttttctaatttcagaaattgaaaaatttaaattttcgactttttgttcgatttcggacccggtcttcggaattttatacaaaatcttcaggatttagaatcacagaatgaaacaaaataattgtgttgaattaaattgaaatattcccttttcagccttgggacattgccgtgttgaagttctacgcagaaaccatgggaaatatttgggaccccctttttacgtacctggacgaagtcatcacttcggtgagcctatcatttacagcaaataattggcattattttataatggacaaataagcaaagtgtacaattctttattttccaaaataatcaatcagtcttatttaacatttagctcgagaatggtgacatgccggcgtacattaccgaatcgtcgccaaaaaattcggccaattctctcgaggacctcccgtcggttgaggcaccgcaatcggatgattagttggagtgacaaacacttttctggcatctctgttccttcatcaaaaatgtcctttgttgttgttatgggcataataaa

SEQ ID NO: 70046 - DNA, 56 bp, Heterodera glycines; identical to SEQ ID NO: 67737
  Genomic contig location: Contig_ID=SeqID_42045; Location=611..666; Strand=+
  SCN-specific regions: Sequence locations=1-56

SEQ ID NO: 70047 - DNA, 504 bp, Heterodera glycines
  Genomic contig location: Contig_ID=SeqID_42049; Location=120..623; Strand=-
  SCN-specific regions: Sequence locations=1-481,503-504
atgaatggccaaaaggatgagaacaccaaaagtgggacttttcaggaccaaacgattcgcagtgttcgcgccgtgggcgtcggtccgatgatcgccggttcgccgggccctgcccaactcggcgaccagcagcagtcgtgtgccagcactcagcaacaattcttggcaccggtcgaaattcgtcaattcccacaaaatgctcgcctttggactgagcagcgcccgatcggagacggaggagcggcgacacaaatggacgcccaattccatcccaccggaacacagtcgataatggtaccacaacatggccaatccacaggacggtcacttccaacgctttcagatgccaaatggcgccgcatcggtggaatttctgcagccgccgccgcccaatggcaatttccaatcgctgtccaacggaatgcaattgttcacgcaacaaatgatgtccgattgaaagcacattctaatgaatggaagcaaagatcttttatttgtatttaa

SEQ ID NO: 70048 - DNA, 56 bp, Heterodera glycines; identical to SEQ ID NO: 67782
  Genomic contig location: Contig_ID=SeqID_42050; Location=325..380; Strand=+
  SCN-specific regions: Sequence locations=1-56

SEQ ID NO: 70049 - DNA, 633 bp, Heterodera glycines
  Genomic contig location: Contig_ID=SeqID_42051; Location=46..678; Strand=-
  SCN-specific regions: Sequence locations=1-633
atgattggttttatgagcacaaatgcgcaaaatccaccacaaatgcaaaatgcttataacccgcaactccaacagccgtatttgccccaagggaaccaccaatttggcatgataaaccaagcacacattccgcaagttgttcagccaatttcgcaaccacaacagcaacaaattaatgccgctcaaaatttggctcgccaaaatttcgaaaatcgtccaattgagaatgtcattgaacggggaagagaaccgggaatggaccaagtagcatacgcactcataattagtcaaatccccgctctaaaagtcaatgaaggtgcggaaaagttccgtgaatttttcaagcgttttgattcgaatactggcgaatggacaaatgcgaaaaggataagttcgctcgagtccaaagtttttggacgagccgagagggcctttaggtcggcatgttcgacagtacctttccgctatgagttaatcaaacgtgaaatgttgcggcaactagaggagactgatgcacgcgaatggaatgcatttgaccaaaaagtcccgcttataaacccaaaccgaacaacgcaaatccgcaacgcccacaaaatacgcaatcgcgaaattttctcaggcaaaattatttag

SEQ ID NO: 70050 - DNA, 1611 bp, Heterodera glycines
  Genomic contig location: Contig_ID=SeqID_9030; Location=2872..4482; Strand=-
  SCN-specific regions: Sequence locations=1-405,427-684,707-1611
atgccgccaccgcatgaaaagacgaccctccgatcattccttggagcattaaattattatggtcgtttcataaaggaaatgcgccaaatccgcacaccattagaccaactgctcaaaaaggatgaaaattggaaatgggaggcagaacaacagcaagccttcgaaaaggcaaaggaaattatgacgtcggaactgctattgacgcattacgacccgtcattgccaattgtcgtcgcagcagacgcttcaaaagatggaatcggcgcgacaattagccacattttccccgacaaaagagagaaagtgatcgaacacgcatcgtgcacactgtcgagcgcacaacgcaattacagccaaatcgagaaagaggctttggcactcgtttttgcagtgcaaaaatttcacaaaatggtgtttggcagaaaattcactctgctcaccgatcacaaaccgctgctggccatctttggttccaagaagggcataccaatttatgccgcgagccgactgcaaagatgggccttaattttgtcaaattacgagttcgacatcaaatatgtcaacacagcagcatttggacaagccgacgtcctttcccggctcatcgcaaattacccaaggccagaagaagacattttgattgcaaacatttgcacagaaacggaatgcttcatcaacagtgtattccaagtccaaattgatcaattgccattgacagcggctgagattgcggatgcaacagccaaagacgaaattctctcagaacttttgagactgccaaagaatggttggccaaacaaatgcaacgacccaaacatcgctccattctttccgaaacgagacgaaatcgtggaagtggaaggttgtttgctgtaccaacagcgcgtcatcatcccaggaattctacggggtcgagcattgaaggctttacatttgtcacatccaggaattgtgcgaatgaaagcgctcggacgccgtcacatttattggccaggattggattcggaaattgagaaaaccgtcaaatcctgtgaagaatgccaaaacgcacagaaaaatccgacaaaaagcacacttgctccatggacgccaacaagcaaagtctctgaaagagttcacattgattttgcgggcccatgcgacgacggatttgtgtatttgattatggtggattcctactcaaaatggcccgaagtctgccaaatgaagagcataaattctcaggccacggttggtttcctccgatcgatcatttacagactgggagtcccggaagaaattgtgtcagacaatggaacacaatttcgttccgctgattttgccaaattttgcacagaattcggcatcaaacacactttcaccccgccataccatccacaatcgaacggacaggcagaaagattcgtcgacacgttcaagcgtgcaatgaagaagtgctcgaaaaacgacaaagattgggccgagaaagcgctcctttcttatcggacgactcccaacgcgacatcgaacggctactcacctgatcagttattctttggacggaagctccgtaccaaaatgtcgcttgttcacccgaggggagagccaattgagaatattgatcatgactga

SEQ ID NO: 70051 - DNA, 309 bp, Heterodera glycines
  Genomic contig location: Contig_ID=SeqID_9031; Location=221..529; Strand=-
  SCN-specific regions: Sequence locations=1-10,33-176,198-309
atgaacgcggcaaaattggaacaaattttgaacgctgtgcttacgcaatccgaaacaaggatgcagcaactgcttggaaatgcagtgccagcgaacaacaacctcagcaatgccaatttggcgagttcaattgacgcccgaatttcgaaattttattacgacgcggagagcgcaaacacatttgaacaatggttcaaacgttttggcacactaatcgaggacgatggaaaagacttacctgaagcgacaaaagtccgtcttctattgggaaaattatcggacgaggactacaacaaataccgagacagc

SEQ ID NO: 70052 - DNA, 748 bp, Heterodera glycines
  Genomic contig location: Contig_ID=SeqID_42053; Location=415..1162; Strand=+
  SCN-specific regions: Sequence locations=1-139,161-510,532-748
atggcggaggaaaccagcaaaaccagtgaaaacatcgctgaggacaacggcatcaaagtgctcgactctttgtttgccgccgtcgcccacgcctcaaaatgtttggcattcgctgccggcacgcccaacttctgcttggccacgcccgccttcctggctgtcatggtacggcctttcggacacttcctctatttttaggggaggatggtcagtaataaaatggtgttttcgtaatttagaaacacttccgctccctcctccttttttgggttggcaaataaaatgccatcatttcgctgtgtgatttaggcgctaggatttctataaattgtaacctttgacacgtgcgcatcagaaattaaccccacaaactgcggtcaaatttatccttgcaaaaaatgttggcaaattcggcggttgcgcccgaactttttttttgtcggttgagtaagccgaaaaatggaccaccttttttgttttggcctctgttcaaaccgaaagtaacacaccaatttaaaaaatcaaataaatcttcggaatgaatttccccattttccccaaaaactctgtttttctatttttaggtttggtgctgtttcctcatgccggtaatggtcatacggggagagggcatcatttgaattgagtcgaaatgcgttttgtttcagcctgtcgctgtgcttttccgcagctatcgccgcgacggcaacgcgttcactgtgcaggcggcgtacaacgtcattctgtg

SEQ ID NO: 70053 - DNA, 85 bp, Heterodera glycines; identical to SEQ ID NO: 65905
  Genomic contig location: Contig_ID=SeqID_42054; Location=314..398; Strand=+
  SCN-specific regions: Sequence locations=1-85

SEQ ID NO: 70054 - DNA, 799 bp, Heterodera glycines
  Genomic contig location: Contig_ID=SeqID_42057; Location=14..812; Strand=+
  SCN-specific regions: Sequence locations=1-335,360-799
atggctgacccattgaatacccgcgggtcgactcttttccaggcaatttcccccgaatgctatgccaattcgggcacttttgcgcacattacgggattaatgccgtgagtatttttgcgcactctaaacattactttacttttaccattgttacttttacagtaatcacgaataccgtttccgattggccgcaatgaccgccacgggtgatgtgctgtactccgagccgatctctgcgcgcacccgacatgaacaggcgccagtggtgtacaacagcaaagaacgacgcgaattggacggaacacatcatcaacagcagcacaatgataacagagtagggaagagcaaaataaaaatgagcaattaaatcacgagtgggaaatttaagggcactttgacttaccaaacgaccccacgtacgtccatccttggccacgactcggctgaccatcatccgccgcatcatttgttcggccaatcatccaaccatatcaaaaaattggcggtctcctccgttcaatcatcgtctaaaaaacagcaaaagaatgtgcaacaaaaaccaatcgcaccacaactgtcagcggaagaacaaccagaagaaactacggcaacttccagggcgatgttgccgaaagcgccgaactgttcagcacccaccttctcggcattgactagtgaaagtgcacgagtcgcctggaaattggtcaaatccgccgaagatggaggaacaaaggaactgtcaccgaaggtggagaaacaaaggaaaacagccaaagcacgtcgtcgacatcagcactga

SEQ ID NO: 70055 - DNA, 579 bp, Heterodera glycines
  Genomic contig location: Contig_ID=SeqID_42061; Location=315..893; Strand=+
  SCN-specific regions: Sequence locations=1-132,170-174,196-482,523 -524,546-579
atgggcacagaatttaaaggcttatatgaagaacataaaaaatccgaaaaagctaggaaaaaatatttaaaaaatcagccaaaacaaccgattcgtgcagctgttgcaaatgaattttcgagacatagtaagaaaaattaaaaaacaaaataaaattgtaaaataaaaagtttgaaaaaattgggtattttaaatccttgattattagagatcggatacggaccagatccgtatacggatttttacggatccatagtccgtatttttttcggccgatacggattttttacggacaacagttttccctggtttttagtccgtaatccgtatcgatatcaagtccgtaatactgatactgatccctattttcgcaaaattccgatctctattgattatcaacgaaatttgtttaaaaatgcttaaattcatttttacttaatttttcttggattacatggtggttgaatataccaatggacttgaaattatttatgtatttttattttcatttaaaaaaatattgctgatttttattgaagaaattttcgggatgaagaaatttttaaaagcttccgcaaa

SEQ ID NO: 70056 - DNA, 660 bp, Heterodera glycines
  Genomic contig location: Contig_ID=SeqID_9032; Location=621..1280; Strand=+
  SCN-specific regions: Sequence locations=1-126,148-359,384-454,479 -612,634-660
atgcaaatgaccaaacgaagaactgcactttcaactccaaaacaaggtaagaaccataaaaaagataacgcgaagaacggcgaatgcaaatatagtaattattctcgagtttcgctattatcacaaatgtttggctattgcatatcaccaattttttgttaaggaaatgattggactttccgctcaaactgcttaacgaaagtatatcaaactttaaaaactgttgtgaattcttgtccccagttatataatgagaaaattatatgtacaaatatttgaagtttatttatatttcgtttttgaccaatcttcaaattttggcatgaatttttttcaaaaaactctttagtgtcgaaattactcagtgtccaaaatactcagtgtcgaaattacccagtgtcgggattacatggcaccatttttaattattccaaaatttaaacagggcggggactatatatttttagaatttttagtagaaaaaacctgtttaaaatactggggtcattttcgcgaggccgtttttgcgcgagtgcctgttttagcattagaattgttcagatgttattgtacgaggcattggcataataattgtggtaaaattcattttaaaaattgtaacagtctatatcaagtaggttagtgcacgaccggttatta

SEQ ID NO: 70057 - DNA, 774 bp, Heterodera glycines
  Genomic contig location: Contig_ID=SeqID_9032; Location=2548..3321; Strand=-
  SCN-specific regions: Sequence locations=1-287,316-497,531-708,730-774
atgaccagtgagtgagaagattcattaaaaaattgctttttgggggtcagtgattcaaaagggtgaccccttcgcacaccgggggggggggggtcaaaacgaagggtacacctcaaaacatcgacgggcgaaacttcaccgggacataacttaccgcaaattaaaaaaaaagattttcgtaatactgctgagggtacccacctttttggcagaaaaatgtttgaaaagattgcttaaagacatcgatttcccatcaaattttcatttctaacggcggaaaaattcgaatttttatttatttttccatcaattttcagttgtgacgcccctttgggttggcgcaatggatggccacttcgaagtgtgccaagcgttggtcaaacacggggccgacgtcgacttgggcgcgccgcaatttgccatgtcaccactgatggccgcatgtaacatcaatgcccggctggacactggtctttttttcatttctaaacatacccaaaatttaaattaaattttattaaaaaaaaaatccctgactaagccagtcggtgatgcttatctcagcgtgccatcataaattctgttattttcattctgactgttgcagttgatcttctgatcaaaagtggtgccaatgtgaatcatagcgacccaaagggccataccgcgttaatgtgtgcaacgaagttggggctgaaagacatcgtcaagcgactggtgaaagccggggcaggcgctgaccaagcgaaggaaacgggtaattaccgtaataaa

SEQ ID NO: 70058 - DNA, 51 bp, Heterodera glycines
  Genomic contig location: Contig_ID=SeqID_9033; Location=47..97; Strand=-
  SCN-specific regions: Sequence locations=1-51
gaatatgaagcggatgcactgaaatcggacggtgaattggagcgcgaagaa

SEQ ID NO: 70059 - DNA, 824 bp, Heterodera glycines
  Genomic contig location: Contig_ID=SeqID_42062; Location=410..1233; Strand=+
  SCN-specific regions: Sequence locations=1-18,41-824
gtagagaaaattttatcgaaaatttattttaatttaaaatctccggcaagttttgctggaattcaaaaaattttaaatgcggccaaaaagattgacccgaaaattacgaccgatgacgttaataaattcctagaaaagcagaaaacatacacgattcacaagcccatcaggaaaagattcccgagactaaagacgataccaagtggcttccataccgattaacagtgcgatttgtgcatatttgaccagttgaaaaagcataacgacggttataaatatttattggtctgcatcgacgtgctgagtcgaatgatcttcagtgcaccggccaagtcaaagaagagtgaggacatgatcgaagcttttgatcgtgtgttcgaaaagtctaaaattatcccgatgaaaatatatagtgacagtgggcttgaattccaagcaggaaaaatgaaaaaatattttgaggaaaaattcatcatcaaaaatgtaatgtatagtcctgatctgcacgccggagtcgttgaaagggcaaatcggacaataaaggagcgcttgtacagatattttacaaagaaagacactcttcgatgggtcgacgtaatagacaaaataataacaaacattaacaacagtgtgaatagaacactgggagccaaaccgtcttcaattaattttgaaaatgcccgtgcgctctgggaaaaattatataaggagaaggaatttaaaatttcgaaaaagaacaaatttaaaattggcgatatcgttcgaattacaaggaaaagggaaaatttcaaagggatacctcccaactttaccgaagaattgtt

SEQ ID NO: 70060 - DNA, 56 bp, Heterodera glycines; identical to SEQ ID NO: 52733
  Genomic contig location: Contig_ID=SeqID_42063; Location=487..542; Strand=+
  SCN-specific regions: Sequence locations=1-56

SEQ ID NO: 70061 - DNA, 774 bp, Heterodera glycines
  Genomic contig location: Contig_ID=SeqID_42064; Location=127..900; Strand=-
  SCN-specific regions: Sequence locations=1-130,152-166,221-774
atggcccatcaaatggcacgagcggcgatcaacaaaggggcacgagtgctgagtgtacttgagaaggtcaaattggtctgctggtttgaggagacgcattcctttgcgcaagttgctcgaaggtagtcaaatggcacaacaaatggggaaaagaagatgcagtggaatttggagtttcccaattcaaaaatttaggaattttttaaattccaaggaatttcggtatgacatccatttcagttgattcgaaaaaacccagacagtaattcgacaatataaaataattggttacgattttaggactattctaattaaatttacataaatttgggcggggcttttggcattctcgaatttatgaccatggagactcaatattatcatggaattccgatagctcaaaaaatttcggcattcaatcgaaattccgtgccaaaaatgttggaactcagtaattgaaaccggcattcctacacatccctgatcaccacaaataatgattaattttttaactcttgatcatattccaatttttgaagatatcgggccgagttcggcatggagccaccgcaaatggaccaagtgaagaagttgcaccaacgattcctgaacacgggctcaattctgaatggcaccaccacaccgcagacgatggcaacggcattatccgccggcatcgatgacgtcgtggtcaaccaatcccagcaaatgtcggtggtgtgcgatgcgggcgcgttggatgccgaggaacagctgagaatggcacggatgtga

SEQ ID NO: 70062 - DNA, 1053 bp, Heterodera glycines
  misc_feature (1048)..(1048): n is a, c, g, or t
  Genomic contig location: Contig_ID=SeqID_42066; Location=116..1168; Strand=+
  SCN-specific regions: Sequence locations=1-467,501-565,588-630,652 -687,710-1010,1040-1053
  Gene Ontology: Mol. function=protein phosphatase type 1 intrinsic catalyst activity; Cellular component=bud neck; Biological process =cellular morphogenesis during vegetative growth
agagcggaggaggccttgggcgcggagacgaccccgctgggagcagaactggaaaaactttgtgcaaacgccgaacggatcgcagtgcaacaggagaagctcatggaaaagatggaactctacaagcaaaaactgagcagcggattggcacatggcacagcaatgctggtggcgtccaaagtggtcggagagcggacacccttcggagaagccctgcagaagacggctcaaactctggcagctcttgacgcggcgcgacgacagctcagcaaaagcgacgtgaagctgggaggcaccaccacaacaatcagcgctatccgcgtgagttagcttgttttgtttttgttttttgctggtaatttcccattttcagaaacaactggcactgctgcagacgaaacgcttggatttggacgtcttcaaagcgaaatttaggcgcgcatcaacaaccgaggaaaaaaatgccgtgagaatgttttttgttgttgttgctgctgagttcacgatttttcaatccttttcagattcagccccaattgcaacgagcacagagcgagttcacgcgccttcaaacacagctgaaggagctcgtcttggactaccagaagaatatgcagaacatgaagaagagcctgctggagttcgtggaggcccaaatcaaattccacacgatgtacgtccaagcggcaacaacaacagcaccagcaaagccgatggcagaagctccgagaccattccccgacaatttgatccaaaaaattgtacggtcgaaacaaatggagtttccgaaagaggtgaaaaagcgagttttgcattgtcaatttcatccctttttgcaggtttccagcggagaaattcaacaactgtgcgctgccgcaactgacgccttcaaacgccaaccatcgctggtcgaaatccttccgcctgttatggtctgcggcgacgtccacggccaatttcctgacttgatgagaatcttcaactgcctcgggaccccgccggagaagaaatacctgttcctgggcgactacgtggaccgtggcgcgcnaatcc

SEQ ID NO: 70063 - DNA, 796 bp, Heterodera glycines
  Genomic contig location: Contig_ID=SeqID_42069; Location=458..1253; Strand=+
  SCN-specific regions: Sequence locations=1-48,129-151,184-302,324 -340,368-596,636-652,675-796
atggacaaacaaaagaaacgaacgaccgaaaattatgagaagggtgagagagaagagagggacagcagcagagaagaaaaggacgaagagagcggaggaagagcgaaaaagagaataggcagagaaaattggcaaatcccagcggaaaaacagacatttttgaaaattaatttgacacaaaaaggagaaaatgccattaaacaatgacaaaattaaaatgattttgaattttattaacaaggctttttagtttatttttcggaatatttaatttaactaattttattgacccccaattagcgacagaatttcaattaaattaatatattccacttagtccgttggttttgatttttattttattatacatcttaaaaacatgtcaaaaatgcaaattaattaattaaattgggattttcccccattttccatctcccatttggccatcacataaatttgcatcgatttgtcttctcaaaaatattcccttccaaaacagaaattgaaatgccccgcagatgtgaagtgtaatgactccaaatgttcacattgttcacacattcctgctcggtcagctcaatttttgtctgaaaacgaattaaatttcatttatttattttttaattcaattaaatggaataaaaatagcagataatttacaaacatttaaaatttagagctgataattaacattattgagtttttatggcggggtggggtaaagaaatcatttgctatttgtaagggaagagattggcacaatccccgccttacggcatatgccccaattagttaa

SEQ ID NO: 70064 - DNA, 485 bp, Heterodera glycines
  Genomic contig location: Contig_ID=SeqID_42070; Location=468..952; Strand=+
  SCN-specific regions: Sequence locations=1-13,35-51,72-203,225 -329,371-386,453-485
atgatgactactgcagcagcaatgacaacatccaccacaccacagctacaacatcatcatcatcatcatcaacagcagcagcaaagcatttttgcccggctttccgccaccattggccaccacagtcaatcggaacaaaaattggcacgaatgagggccgcttattctggcgccaacgaaggtggcggcggtgccagtgccaatgccaaaatccaaaaagccgggtaaggagatgctgggttttttggaaatttttattagataaatgaattttgctgagggaaattgaaaagcaaaattagattattttatgtgattttttttttgtgaattttttttattaataaatgaatttttaaatgtattttatgggaaaaagcgaaaagaaaaattaaatttatgtgaataatttaatttaattttagttaatgtaaattttttttttttatattgagagttttaatcttacaagctgaattaaatta

SEQ ID NO: 70065 - DNA, 658 bp, Heterodera glycines
  Genomic contig location: Contig_ID=SeqID_42071; Location=362..1019; Strand=+
  SCN-specific regions: Sequence locations=1-313,344-533,571-658
atgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggagggggggggggcgaaggcccaccacgaggccgcgaagaggccgagtgagtaccttcggtgcaggaaaattattaaattttaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaatttttcgaaaatctgagtctttcgtttttatttatttgcaaaattaattcataaatattttttcagaaagggttctgaaacgcaccaaattttatttacatgtttagtttatgcactctgatgcttttttctttcaaaatgggagggga

SEQ ID NO: 70066 - DNA, 450 bp, Heterodera glycines
  Genomic contig location: Contig_ID=SeqID_9034; Location=19..468; Strand=+
  SCN-specific regions: Sequence locations=1-450
atggaagaatgggagagatccttccaagtggcggccaaacgatggaaaaacgacggacaaggtgtaccgcaacacaacagaagaccaatgggacgagtcgcgacacccgtcatgtcgtatttggacgggatttttcagcggcgtgccaaagtgccgtccgtcgccagcatgagagtgacgaacacagcgcgagaatggatcaatcgaaatcgagacgagatgggggcgttccccccagcaacagcccatcggccggcactgatgcaaccaaaaatcgaaaagcatcaggctcacgtgaacgacgactatcgggagcgtcagacataccccattcgacggcatgctcgagacgagggagaacatgatcggaagcacgggagggacgaaatcacgggaatgacaacattcgagactgttcggctgcaaccgccgataccgttctgcgtgtag

SEQ ID NO: 70067 - DNA, 888 bp, Heterodera glycines
  Genomic contig location: Contig_ID=SeqID_9034; Location=717..1604; Strand=-
  SCN-specific regions: Sequence locations=1-232,255-888
atgaggactatcacacagacaacacaaccgcagctgttgatcgggattcgaaaattctgggatttcgtgaccggctttcggaaaacggaaaggggcacgtacattgtcgacacggtttttgggccaatcgtgtgcggcgaacggttccaagtgagtagcggggcaactcccgctccgtccgtgttcatgaccttgccatgcggagaagatgaacgcgatcaaatgccgccgatcagagcagttgaacaattttggtcattggaagcaatctggataagagacgacccgacagacgacgcggatgcgcaagcagtgatacaattcgaacgatcagtgcgccaactcaacgacgggcgctactccattcgattgccatggcgggagtgccaccccgctttgcccaccaatttcagcatggcctatcgacggctaacgacaatgcttcaacgactgcagaagactcccgaggtgctcaagcagtacaccacagtgatcaccgatcagctcaatgcagcaataatcgaggaaacgacgatcggagctggtaaacacgaacacttcatccctcaccaagcagtgatcacgcccaaaaagttgcgggtcgtctacgatgcgagcgcacacacacgaggggcaccttccctcgacggctgcctactcagaggcccagtttggctgccggatttggccgacatgctcattcggttccgagcatgccgagtaccagtgatcgccgatgtcgagaaagcaggtgacataccgatttcgacgcctcgcatttgggctcacgccaagccccttttgtctcgccgccgttgtacgacaccacctgcgcaaatacgactccaacttcgcggaggaactcattcgggacacatacgtggataa

SEQ ID NO: 70068 - DNA, 1830 bp, Heterodera glycines
  Genomic contig location: Contig_ID=SeqID_9034; Location=1855..3684; Strand=-
  SCN-specific regions: Sequence locations=1-89,111-1830
atgcgacgggcactcgaggatgaagaagaagcaatcgcgcggtctcgattgagcgggtcattcgggaccaacaacagccatccggtgggggacgacccacctccactggaaaatcggaacatggaagaatgggagagatccttccaagtggcggccaaacgatggaaaaacgacggacaaggtgtaccgcaacacaacagaagaccaatgggacgagtcgcgacacccgtcatgtcgtatttggacgggatttttcagcggcgtgccaaagtgccgtccgtcgccagcatgagagtgacgaacacagcgcgagaatggatcaatcgaaatcgagacgagatgggggcgttccccccagcaacagcccatcggctggcactgatgcaaccaaaaatcgaaaagcatcaggctcacgtgaacgacgactatcgggagcgtcagacataccccattcgacggcatgctcgagacgagggagaacatgatcggaagcacgggagggacgaaatcacgggaatgacaacattcgaaactgttcggctgcaaccggcgattttttccggaaagcccgaggattggacgacattttgggcctatttcaagcgagctgtggacgacaaacccattcccgggttcgagaagcagcttcatctcctgcgctgcttaaaggagggatcgccagcccggcgggctgtcgaagtctaccctccctccgacggcaactacccggtggtcgtgcaacttttgaaagagcgattcggcgacacggacgatttacagcgggcaattcgggcccggcttcttcatttggcaccggcaaaggacaatgtgaacagcctgacgacgatgatcgacgagtttgagcggtgcgtgtgccaactcgagcagctcggagcgaacgtggacgacgactcatttggcccattgctggaggcaaaattgccggtgcgactgctcacggaattgcggatcagagaaagcatgatgggctcgaaatggtcagtgcgcgatttcaggagagcggtgtcggcacaagtgcggtgcatgcgatcagctgagtcagcactggcggcaatgaaagacccggaagtacgcactgatcaccgaaccgaacgtgatcatacgggacgaggaggcaaagcaggtcgagaacctttcaaagagcatttatggtacgggacagccaacaaaacccgtgcgcagcccaacggaacacgaaaagaagagcagtgcgggacgagtgcccgtttcaccgggcgaacagtggcacgcggcaacgagaacggacacacgggcgggggcgggaatggaccccgcttcgcgcaaaatgggctccctccaagcttcgggagggggaattgttcgttttgtctggagagcggacatcggccgagtgaatgccgcgcctatccgacgccgcaggaacggaggaagcgactaattgagcaaaagcgatgcctgcgttgcctgggctctgatcacacattcgaacagtgccaacgaacggtccgatgtgacgcatgccgaaaggacgatcatcattggcttatgtgctggaagaaccaaccgggaaaccaatcccggctctccggagaacctgaacggaaggagaacaaccacgcgatgctgatcagtgggatggaccaacccactcacgtcactacagcacgagacgagccgaacagtcgagacatatccgagacgaatgccggggagcaacgggctttcacagcttttggaagccgagtcccggcccagcaaatgatccgaagagtgaccgcagcagcagaagaaggcgaagaacgagtgccaaacaacattgctgtttga

SEQ ID NO: 70069 - DNA, 354 bp, Heterodera glycines
  Genomic contig location: Contig_ID=SeqID_42077; Location=1..354; Strand=+
  SCN-specific regions: Sequence locations=1-288,310-354
gggagcaaaaatcccacgcagaattaaagtacaggctatagggaagctgttccggaaggattcggtctccccataaatctgggtgcatcggttcggggggtctgccccgataacaaaaaaatcgattttttcaagtgtccgtttggtgtactcaaacaattatggggagcaaaaatccaacgcagaattaaagtacaggctatagggaacctattccggaaggattcggtctccccataaatctgggcgcatcggttcagggggtctgccccgaaatccccaaaaaaattttttggataaaaattatttaaatgaactgactagataatatttataataggctattcctcttcc

SEQ ID NO: 70070 - DNA, 1112 bp, Heterodera glycines
  Genomic contig location: Contig_ID=SeqID_42079; Location=161..1272; Strand=-
  SCN-specific regions: Sequence locations=1-204,246-575,598-634,657 -736,758-801,989-1040,1062-1112
  Gene Ontology: Mol. function=snRNA binding; Cellular component=small nuclear ribonucleoprotein complex; Biological process=growth
atggctttggcaaagtgtcctgcttcgacagttcaaattttgggggctgagaaagcgctcttccgagcactcaaaactaaaaaggatacgccaaaatatggaataatttatcacgcgcaattggtcactcaagccggacaaaagtcaaagggaaaggtgagacgaaaatgtgacaaacataaaacggctaaaaacgcaatacccttaacaagaaatcaaacaaatcattattgtctttaaagatagcacgaaaattggcagcaaaagtttcacttgcgacgcgagtggacgcactttgcgacgaatcattgggcaacggacagggaattgaggcgagggtgtacatagagcaggcgataaaagaggcggacgcgcggggaggggcgaaaaagcaacgcttttctggcgtgaaacaggcaccgaagggcgcgtacactttcaaaaagtgagtcaatcgaggagaaattgatccccggttttcggttatgcttaaaatttcgcgaaatggggaaaatgctccctttgttagttttttactgaaactttatcttgtttctctaaatacaattgatttcgtttttaaatttcaatttttcttcatctgaaaactcaccatcaccaattggacttaatgttaaattagtcttcatataaaaagtaacatttttaaggggggaggtgcatcattatgacgcaaagttcgacatgacgctaaaaaagggaactgaacaggccgaagaaccgcaacaggaagaacaacagagtggaaaagcaaaaaaagggacgaaacgaatgcgaagcgaaggagaaactgagggaggggaggaagaaacggaagaacaccagcaaaaggagaaggagcaaaagaaggtcaaattggaagagacggaaggggaggagggggaagcgactcggaagaaggcaagggaagagacggaggagcccagcggaggagagcagcagaagggtcagaagaaaaagaagaagagcaaaggctgatcggagagtggccttaagaaagatggaaaggctggacaatttggagattcattttatcttttaaatttgtccattttgttgaattttttgttatcattgttttctttaataaa

SEQ ID NO: 70071 - DNA, 348 bp, Heterodera glycines
  Genomic contig location: Contig_ID=SeqID_42081; Location=346..693; Strand=+
  SCN-specific regions: Sequence locations=1-12,35-102,125-132,155 -297,319-348
atgggactcaacccaccagcattccaatcactgggactcaacccaccagcatttcaatcactgggactcaacccaccagcatttcaatcactgggactcaacccaccagcattccaatcactgggactcaacccaccagcattccaatcactgggactcaacccaccagcatttcaatcactgggactcaacccatgggactcaaccccccagcatttcaatcactgggactctcacccccagaatttcaatcactgggactctcacccccagcatttcaatcactgtgactctcacccacagcatttcaatcactgggactctcacccccagcatttcaatctctga

SEQ ID NO: 70072 - DNA, 120 bp, Heterodera glycines
  Genomic contig location: Contig_ID=SeqID_9035; Location=323..442; Strand=+
  SCN-specific regions: Sequence locations=1-120
atgtgcgaccgtttaacacaaatccaagaccttgtcaatgatttggccaaccacatgtgcaattcggtcggtgttctgcaggcgagtgccgggccgtgcgaatttgggacagctccggag

SEQ ID NO: 70073 - DNA, 906 bp, Heterodera glycines
  Genomic contig location: Contig_ID=SeqID_42089; Location=44..949; Strand=-
  SCN-specific regions: Sequence locations=1-34,57-663,685-714,740-906
atgaagcaattttgcctttcactgttctctattggtgtttctgtttggctattgacaatatttttgctgctgatgataatgccatcatccattgatggcattcaaattacagtgaaagctgatgcaatgttaaccaaggaaagcaatcagaccactgttgtggtacaaggctcaaccacagtgaaagagttgaaggagctgatcaaaaaagaggcttggaggattcagtcagaaaagaaaacatttggaatcaaaaacccagatgatggtactgtgactgtgcttcaggacagtgatacaatggctgacaataaaattgaagaaggcgcagtcattttagtgttcgtaaattttgaaattaaagtgactgctgaagaaaatatattcaatgaacagtcgcccataaaaactaagataatcactgttagggtaaatggaacggaaaaggtggaagatttgaagcaaaagataattggaaaaatggaaatggagaccaaaacaaagattggaactgaactcacaaaaatatcactgcaatacggcccagaagatgattatgtttttcttaatgatgaaaaaaaaatttattattatcagtttcaaaaaagtggcattattcgcttgtccattggtgaatttcaaattgttgttcgagaagaaattgagaatgaagtgaaaaattatcctatttgggtaaagagtaatgaaactgtggcaattctgaagaaaaagatcaaaagtttggttgaaattgagcccgaagaacaaacattgtcgtggactttaaacggtcaaacatttgatgacaataaaacattaaaatttaatctcattgaaaatgcattagagtattatggcaccgaaaataacactaccattacattgtccagagaatttaaaattaca

SEQ ID NO: 70074 - DNA, 908 bp, Heterodera glycines
  Genomic contig location: Contig_ID=SeqID_9037; Location=1327..2234; Strand=+
  SCN-specific regions: Sequence locations=1-49,71-168,199-360,384-908
  Gene Ontology: Mol. function=RNA polymerase II transcription factor activity, enhancer binding; Cellular component=nucleus; Biological process=negative regulation of transcription
atgcgtccttttgccaaaaatctttgcgcttcaatggccaaagcgttgggcgccgctgctccgtccgcgctgcgtgagctcaaattggccggcgtgcggcttctgtccaatgcgatcactcggctcagttcggtcgcccatttggcggtcaccgcgcgcgaagtgctccaaagcgacgaacaaatggcacaaatgcacgccgacttcgccaggtaaaacgcacagaattccaacattttcaaatttattgcattttcaggttggactttgctgtgctgcacgaacaggtcgaggttcgtttattgccttgggaaatgttcgtttttttgtcctttctttcgagagtctcgacttcgtttcctcccctttctttcactcctttctttcctttctcaatttgcttcagtggtgttgcgattggtcttctggttggcttcgttcgttggaggaacagttcggtgccgggttgtctcagcgccggcgcttggaagaatgggccgattggctggactgtctcgccgcgcgagtgctgcaaacaccggcaccgcttacaccggcgcgttccccgcaggacactccgccgacggcgcccgaggcgcaattcgtccgtggcaaacagttgcttctcgcgtggaccttttggaggtgccaaaggaagcaaagagcggggcgaatcatcgttttttttgcagctctttggtgctgcgcgacttcactctccgctccgccgcctctttcggccaatttcacttggtaaatgccaaagtcggtttgtgtcaatggcatagccttgcagatccgtctgctgttcgacgactatttgtccatttcggttgaacgccgtctcgcgcagctcagcggacagccggcgatcgccttaatggcacccgaggcaaaaagtcgacaaa

SEQ ID NO: 70075 - DNA, 684 bp, Heterodera glycines
  Genomic contig location: Contig_ID=SeqID_42093; Location=6..689; Strand=-
  SCN-specific regions: Sequence locations=1-237,259-563,585-623,645-684
atgtttccaatcggagagaaaggacagccgaaaagggcggcttctttcatttcattgaaaggaaatgacgcggaaagagaggaaaagcagcaaaaatgccaaaacggcgaaatggcacagtcgcggaagagaatttcattcaatttgccaattgaggaagagggacaacaacagcagataaagagacgaagtgaaaatgcattgggcatcgtacaacagctgagacgatggtcaacgagagacggagagggtggcaagagaagcaaagagaccgatggaggtaaaaagaggaggggggggggggtgattagacgaagaaagaatgatttgggagtgatcagacggagacaatttctacaaaagctttgatcagatagtgacgcctgctgataaataagcataagggataaactctttcacttacagtgaaaaacgatactatactggagaagggtcaagcgagaagaacgaattcgaatgcgtctctgttgacgatacaaaaacaacagttcaaagggatccgacgacacggaactatcgcccgaattttgtgccgatggaatgggcaaaaacaagcggagagagagacggcgatcgacgacagtgcccagcagaagaagacggatgatcaaaacaaaactgacgatcagactgatcagaacgaaaacggcggatgggcgtact

SEQ ID NO: 70076 - DNA, 336 bp, Heterodera glycines
  Genomic contig location: Contig_ID=SeqID_42094; Location=196..531; Strand=-
  SCN-specific regions: Sequence locations=1-336
  Gene Ontology: Mol. function=ATP-binding cassette (ABC) transporter activity; Cellular component=nucleus; Biological process=chromosome organization and biogenesis (sensu Eukarya)
atgagaatcaaaaaaatagagattgagggcttcaagtcatattcacagcatgaagcagtcagagatttggatcccgaatttaatgccattaccggactcaacggttctgggaaatcgaacattttggatgccatatgcttcctgcttggcatcacaaacctcgcccaggtccgagtgcattccctcaacgagttggtgtacaagcaaggccaggccggcatcagccgagcaactgttacgatcacttttgacaacgacgtcccgcccgataaacagcctgctggctacaacaaatataaggaaattgtcgtgagacggcaggtgattgtaacttaa

SEQ ID NO: 70077 - DNA, 650 bp, Heterodera glycines
  Genomic contig location: Contig_ID=SeqID_42097; Location=36..685; Strand=-
  SCN-specific regions: Sequence locations=1-23,45-105,127-650
atgaacaaactttcggaaaacgctttttcggagtacaacaaattctatctaccgaaaaaagttactgatttcaactatgatgaagcagtgaaaaatttggaaaagctctttgcaaaaccacaatcaattttcatcgacagattcgaatgtctaacagctgaaaagtgggaaaatgaggacttctgtcaattcatcaacatgcacaagcaattgttaaacaatttcaaatttgtaaacctaaaggaagaacaattcaagggtctgatgcttctaactgcacttaagtcgtcaagagacacggtcctacgacagtgcatcctttcaaaacttgcgtcctacggcgaatcagtcaaatatgacgaagttgttgaggattgcataaattttatgaccactataacggaggcgaaaatgattgagtattcaacttcgaaattggtggtcaatgcgatgaagcaaaatgtcaacaaaagggaaaagggcagcaatccaaaattccagcagggccacacatcagctcatactcctaaatgctggagatgtggaaaactatatcacagttacaaagactgtctacacaagtcggcaaagtgccacaaatgtaaccaagttggtcatttggaaagacaatgcgacaaagtgcaagaatg

SEQ ID NO: 70078 - DNA, 1783 bp, Heterodera glycines
  Genomic contig location: Contig_ID=SeqID_9041; Location=92..1874; Strand=-
  SCN-specific regions: Sequence locations=1-77,99-194,228-245,295 -565,597-770,822-921,979-997,1077-1093,1119-1383,1406-1619,1641-1783
atgtgctacaaaagtgtgttgtccggcgaagagaatttcccgtggaaagtgtcgcgtcggtttcgcttcttttcctatttgttggataaaagcggaaaatgtggcaaaaaagttcgtattgcaatgaatggcacgcaattttcaatgggaagagaatgcttcaagtgggtgaccaaatgcttaaaacttattgaatttatttttacatataaaaagtaaagttaaaacggaattaccaaattcagtaaataaataaaaaataaaacaaaaagtgacttttaaatttaaaatttaggaaaatatcttatcttcaaatttcaaattcaaatgaatgaaatactttttttcatttcttttttttaatttactcggttaaacattttcaataaatttggttttataaaaaaaactgctcgttctaattatcatctgttttaattaccattattcactatcaatttcattacattttttagcataacgcctcattcgaaaatcgaaattcaattcgatgccaacaaatgttcggcacaaattaacttaaatgaaagtaataaatggaaagaaaatatataaaataaaaaattgaaaatttagccaataaaccgttgctcgattttggcaaagaattttccgaccaatttaattttggcccatttttggatgattacgccggactttggctgctcgggttggacatactcccaaaatttgggccgaaaacaacggaaatttcaatggaaaagccgaaaaattgccaattggaggtgaaaaataaattaaaatttgaaagtaaaaaataaaaaaaagaatttaatttagtgtgaaaattgtaaatacgcttcttctgcgtgtgttacattctcttcttctgccaaactccacggggttttaggaattcggccgatggtaaaaaaatggaaaaaatatgtaaaagattaattaaataatggataaattttaaaacatataaaaaatcaaaagaaaaacctaagagattttattgaaaatgatttaaaaaaattattatttgactttcaatttttaaaataaatatttttaaattctaaaattatgaaattggctattttttgattttgaaattcaatttccaatttcaaaattggccctacaattaaagaattcattttaaatctctctccctcatattttcagatggttggcggtgtcgaaattgacataaaaactgtgccgtggacagtgctatttcaaggcttagtgaaaagaaatgaacaaaataaaatgaaaatatttcaaaattgcgctagcacatttatttcgccggaatttgtgctgttagccgcgcattgttttgacaaaaccaaagagggaaaatactttcatttgggtaaaaaacaaaaacaatttaaatgctctttaaatgctttgcttataactttgctctaaacaatccaattttaattctcgatatcatacgatagactaaatgttttctattagtctgccaaatttcaaaaaaatttgttaactttcaaaaaagttatggcctcaaaaaccaaggttttttgagttcctctagtcataactagggctccaatttataattgctaaaaactgccaatataattagtttttagtttctaaaaaacccccaaaatagttgctaaaaatgggtaaatatttgctaaaaactttcaaatttaggggagtaaaatcgaaaatttcttcaaaaagcaaaaatattatgccaaatcattaatgagatacataattttcaaaatcaaaaattatcgtcaataaa

SEQ ID NO: 70079 - DNA, 767 bp, Heterodera glycines
  Genomic contig location: Contig_ID=SeqID_42106; Location=301..1067; Strand=-
  SCN-specific regions: Sequence locations=1-42,89-442,479-511,533 -633,656-676,703-727,750-767
tattatttccttttcagctgtccggacggtggcgaagttggcaaaaaaaaaaattgaaaaaatacattattaaaatttaaaaaaaaaaccaggtttggaaagagcccaacggcgctgtgcgcccatgcacaacaaatcggcaatgcccttccacacactactgtacccctgttactgtattttcgggcaccgtataccaaacaaaatcactgtgttgtccatccaaaaattttgtttgctcacaaccaaaggttaaggaaaataacttttttactggaattcttacaaaaattttaggaccaaggtgttagatgtagcagtacccgaatcacacgacattttttcaatgctgacacaaaaacttgtcaaccatttgagtataacggatgcgagggtaaaaaccacacaattcaataattatttttaacgtgaaatttaatcgattaaaaaattaattaataattaaagaaaaattaaaggtaatcggaataattttgccacacaaaagtcgtgtcaaaattactgcttgagtgaagcttgctctccgggtactgttgtggccagagactcagacaggtggattcgggaaccattttttttaaaccgaaatttttgttttataaatttcaacctaaatttttagttttataaatttcgtagagcttttagaaaaaccataaaataaaatttaattaattattaggcttattcaatgcacaaatcctggtggaacaggacgggactgatggatactcatgcttcagcag

SEQ ID NO: 70080 - DNA, 473 bp, Heterodera glycines
  Genomic contig location: Contig_ID=SeqID_42109; Location=166..638; Strand=-
  SCN-specific regions: Sequence locations=1-74,154-227,249-303,337 -368,390-473
gtcagtcctctgctcagagacagtcaatcaaagcatccgccgccttcgctgatggatttggccgtttttaaggcatttaaaaaatatatttttatttaattttaactgtaattaatttccatttaaattattaaaaatgaaataattaattttcagagtgctttgaaaagcccagcggaggaacaaaatgaagaacgacgattattggatgacgaagttgtgcaatttataattaaaaacaaattaaccctaattaacacattaattagtagggttcgaaaaaactatggagataactttcacaaaatttaaaaattctctatttcttatttaattgtcagaataagttgaaatttttcagaagactgttattattttttaattgagatgggcgacgaatggaaaacggccatccggattccgcttccgctcgccttcgtctcgcgctacctttgggcgacggacaagcttag

SEQ ID NO: 70081 - DNA, 60 bp, Heterodera glycines
  Genomic contig location: Contig_ID=SeqID_42110; Location=903..962; Strand=+
  SCN-specific regions: Sequence locations=1-60
agagcccatgaacagctgcatcggatgcaagtgccgccgttgctgtacgcctaacagttg

SEQ ID NO: 70082 - DNA, 240 bp, Heterodera glycines
  Genomic contig location: Contig_ID=SeqID_9043; Location=98..337; Strand=+
  SCN-specific regions: Sequence locations=1-240
ttaatgcccgcccttcgctgtgtggccgtcgaacgccgcgctctcagccgtccgtttggccgtcgaacggacgaaaacgttcacattggcaccatcgacgcactgcggctgtttcgctgtcccggcaccagcgaggacggccccattctctgcttgagcggcgcgcgcgaccgccaaattacgcttcggaaatgccaatgcggcgaaatgccagcgtcggtatcctcaccaaatgataac

SEQ ID NO: 70083 - DNA, 700 bp, Heterodera glycines
  misc_feature (44)..(44): n is a, c, g, or t
  Genomic contig location: Contig_ID=SeqID_42113; Location=164..863; Strand=-
  SCN-specific regions: Sequence locations=1-11,33-411,433-700
aatttggtgcgtttcagagcattttctgaaaaaatatttatganataaaaaaatcgattttttcaagtgtccgtttggggtactcaaacaattatggggagcaaaaatccacgcagaataaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaac

SEQ ID NO: 70084 - DNA, 323 bp, Heterodera glycines; identical to SEQ ID NO: 69014
  Genomic contig location: Contig_ID=SeqID_42117; Location=382..704; Strand=+
  SCN-specific regions: Sequence locations=1-88,113-246,280-323

SEQ ID NO: 70085 - DNA, 666 bp, Heterodera glycines
  Genomic contig location: Contig_ID=SeqID_42119; Location=306..971; Strand=+
  SCN-specific regions: Sequence locations=1-382,420-666
atgacaatcaccagcaccaccaagaagaacagcacaaacaacacttctccagcgtgtcaacaagtgaccaaagtgaaaaggacaaaaaaggtacaaaattaaagtgattttttaggcttgtttttggtcacatttttgccaattttttgtgccaataatctctggcgtttgtttaattcgcacatattaaatccattttgttgatagaggtgaaatttgggaaaatgagttttagactttttgttcgaatatgggtttggtttcgaatgtgtcaaaattagattttccatctcaaaatccctaaaagagctttatctcattaaaaaaaataaaagttttgattaatcaccagcacctctcatctatttatgtatcatatttaaaattgaaaagaatattttaaaccatttttaagcataggagcaatttctcggccgcaattgtccggggcgaaatgcctgcagaaatattaccgaagtttctctaattaaaagtattatttctgatggcgtaattggcattttgtttttaggaggaatgcgcgactgggtgatgccgttggactttggccatgccgacgcagaagccaagcatttgattcacattgtggcaaattgtcaccgggaagaatactcacccattacgacacattgtgagcgggaataa

SEQ ID NO: 70086 - DNA, 624 bp, Heterodera glycines
  Genomic contig location: Contig_ID=SeqID_42120; Location=320..943; Strand=+
  SCN-specific regions: Sequence locations=1-344,413-440,463-488,518 -524,546-552,611-624
atgcgcacagtcgggattcgtggacaaggacaaatgcccggcggacaagaagcagaagtacaaagaggtgaaccgggcggtcggatgtcatcccaaaaattaaaaaaataattagttactaattggggtcatttcgccctgtacaagcagcagcaaccgcagtgcatctacgacaaggcggtgatggccatcgacgcggcgcatgcgcacgcaaatgccgcacagcgtgcgcgccatgttgctgccggtgttcctgaacacgggcgagcagccgcaggtgcgcatcactgcgttcgccaacattttgggcgcccaaccaacggccgaggtggtggaccagctgatgtacgcgattggcaaggagccgaaccgggaagtgcaggcgtactgctacagaacgatgaagaccatgtccaactcgcagaagccgggcgagacgcaaatgtgggaaaatttaaaatttggcactcacaattggccgaatttagtgccaaacacgtcaaatcgtcactgaaactgttggaaaatgccgtggacgagcagcaattgcgcaccagcggaaagtggcagttcgagcagttgtacaacaatgcgcaacgcgagggcgtgtgctttgcaaagtga

SEQ ID NO: 70087 - DNA, 80 bp, Heterodera glycines; identical to SEQ ID NO: 51817
  Genomic contig location: Contig_ID=SeqID_42121; Location=439..518; Strand=-
  SCN-specific regions: Sequence locations=69-80

SEQ ID NO: 70088 - DNA, 300 bp, Heterodera glycines
  Genomic contig location: Contig_ID=SeqID_1218; Location=61..360; Strand=+
  SCN-specific regions: Sequence locations=1-300
atgacattctatgcttctcttgttggatacacgggaagaaataatagttagtccttttgttgaatttttagaaattctatccgtcaaatcggcttttggaattttaatgagtaaatcagtaaccataaatgacattctatgcttctcttgttggatacacgggaagaaataatagttagtccttttgttgaatttttagaaattctatccgtcaaatcggcttttggaattttaatgagtaaatcaggaaccgtaaatgaaattctctgcttctcttgttggatacacgggaagaaataa

SEQ ID NO: 70089 - DNA, 300 bp, Heterodera glycines
  Genomic contig location: Contig_ID=SeqID_1218; Location=445..744; Strand=+
  SCN-specific regions: Sequence locations=1-300
atgacattctatgcttctcttgttggatacaggggaagaaataatagttagtccttttgttgaatttttagaaattctatccgtcatatcggcttttggaattttaatgagtaaatcagtaaccgtaaatgaaattctctgcttctcttgttggatacacgggaagaaataatagttagtccttttgttgaatttttagaaattctatccgtcaaatcggcttttggaattttaatgagtaaatcaggaaccgtaaatgaaattctctgcttctcttgttggatacacgggaagaaataa

SEQ ID NO: 70090 - DNA, 556 bp, Heterodera glycines
  Genomic contig location: Contig_ID=SeqID_1219; Location=311..866; Strand=+
  SCN-specific regions: Sequence locations=1-556
atgaaattctatgcttctcttgttggatacacgggaagaaataatagttagtccttttgttgaatttttagaaattctatccgtcaaatcggcttttggaattttaatgagtaaatcagtaaccgtaaatgaaattctatgattctcttgttggatacacgggaagaaataatagttagtccttttgttgaatttttagaaattctatccgtccaatcggcttttggaattttaatgagtaaatcaggaaccgtaaatgaaattctatgcttctcttgttggatacacgggaagaaataatagttagtccttttgttgaatttttagaaattctatccgtcatatcggcttttggaattttaatgagtaaatcagtaaccgtaaatgacattctctgcttctcttgttggatacacgggaagaaataatagttagtccttttgttgaatttttagaaattctatccgtcatatcggcttttggaattttaatgagtaaatcagtaaccgtaaatgacattctatgcttctcttgttggatacacgggaagaaataa

SEQ ID NO: 70091 - DNA, 3361 bp, Heterodera glycines
  Genomic contig location: Contig_ID=SeqID_1220; Location=2542..5902; Strand=+
  SCN-specific regions: Sequence locations=1-352,374-407,484-1167,1189 -1320,1342-2401,2423-2503,2526-2660,2682-2726,2751-2942,2972 -3283,3305-3361
atgtctggttttatcaggagcaaaatccctctcctcaatcgagtgctaagaaaagaaatccagtcgaccaaaacaaaaatcgaggaaaacaaatttgaatttgaccaaaataatctggacgaatgcacacgggtgttcaataaaacaaaggaaatcatacaaaaaattgagccaaactttgagaaattaaaaactttacacaaaaaatggcaaaatttaatgagaagaatggacaaagaagaatggaacacagaatggaaaatccagaaaatttttcgcgaaaaacatgattatttaaagacaattaaggaaacagacgaaatcctcgacactctgaaagacataaatttggaggtaaaaagaagactcaaagtaatcaaagcaaaaccctcttcagacactgaccaagaggatgaatcaaatgatgatgaagaagaaaacgaagacgaagaaattgaagaagaagatgaagaagaaaaagaatacgacagtgaccaggaagacgattcaccggaattgacctcaaatgaccaaacaaaccgtaaacaaacaccttttgtcaattatcgatcgagaataaaacttccaccccaaactctgacacacttctccggaaaattctcccaatggcccagcttttgggacgatttcaaatcatcagtccacaatgacccaaacttagagaacatacaaaaactgaaatacttgcgaggactcttacatgacgaaccataccgaattgtgtccccttaccccctcacaaacaaaaattatcccataatcatcaaattactcaaatcccgatacggtaatccacaattgatcagagaaaatctgcacagcgaattaagaaatttaagaaaaccaaatgaatccacaagcgaactgagacgatttatcctattcattgaccgaattatcctacaattacaatcccaaggcgaagaaataaaccatccccaaatcaagcaatccattgagactaaactccccttcaatatccgactaaaactgagagaaaaattcaaactttactcgacaaaagaattaatgaattttctcaattcacacactcaagctcgtgaagacatagaacgaatggaagattcaaacagacaaataagaaatttcacccctcaccggccacctcaaaacagaccacaaaggcaatcctacccaaactattcccaaccccagctaaaagcaaaccaccgaaaccatcaaaatatgcctctctcgccatatcccatcacttctgcattaacaaccaaatcaaaacctgtccgtttggcagaatttaaaccaaaaccatcgcaacccaaaccacaaacaaaaataaaattttgtcgattctgtgaaagagacaatcacttgagcaaagaatgcaaaatttattcaaccacggaaaaaagaagtaatcgagcgcgcgaattaaaactttgtctaaactgtctgaaaaaaggacatcatttgaaggaatgcaaatcacctttttcatgtttcaattgcaaaagcaaacacaataccctcctatgtacccgaaaaacaaatcaatttaatcaaagagaacaatttacaaacgtaaacgtcacgcaaaaccccgaagaattcgaagaaacccaaaattttatgtctctagattgcgatcaaactgatgaaattttacaaaatgacgaagaagaattgcttatgaccacggaagcaccagtattaaatcccgaccaaaacagaacacaaaacgaagtaattttctttgacaatgggtcacaaaaaagttatataacagacgaatgtgctgattcccttcaattaccaacaattgacgaaaaattattggcaatatccacctttaaccaaaataaacccaaaatcatttcatcgagactagtcaaaattggaatcaaaacactaaacggtgaaatcgagtacgtaacattacagactgtggaaaaaattactgatgttacaaaaatggtcaacagagagactgttgatatacgcaagagaaaaataccaattaaccatgcctgtccacaaattctgattggtatagaccactattggcactttatgctaccaaactcacaaattcaaatactcccctccggattttactcaatcgatacaaaattaggaaaaatattatccggaaaaggtactattgaagacacaaatattaatcttgtgaaagaaaagcgaaaaaaggatgagacaaacgaaatccttcaaaaattctgggaattagaaaatattggaattaccgactctccacatttgacggacgaagatacagctctcatacactttgacaaaaatgtcatttttgaagaaaatagatactacatccgatggccatacaaaagagaaacaccgaatttacccacaaattttggattatgtttgggaagattaagaaatgtagtcaaacaattgattaaaaacaaacagttggaaaattataataaaatactgcaagagcaaatggacactgacgttaatgaaattgctgatttcaaatccaaaaatttaattcactatctcccacatcaccccgttataaaagagagttcaaacaccacaaaaattcgaccagtttttgatgcttcggcaaaattaagaggaagcaattccctcaatgacgaaattcaccaaggaccaaaattattacctgatttgtgtggaatgattctccgattcagactcaaaaatttcgtcttaataggcgacttggaaaaagcttttctaagagttggattaaatgaaatagacagagacacaacacgctttctatgggtaaatcagtcatatttggacgaaataaaccaaaaatatcgagaaatcgaaatgagagacgtagaattaagacgtttcacacgaatacccttcggagtcaatgcttctccgtttttattaactgctgttgtgaatcttcatttatcaaaaacagatgaaatgtttgaaaagtttaaaacattacaaatagatgaagaattatgtcttagtggaaaagagaaacaattcaaagagctatgcacagaacttaaagaaaatgcatacgtcgataattttgtaatgatgtgtgacgacgaaaaggaaataaaattcaaacattactggagcaaagaaatattcaaattagcatccatgaatttgagagaattcgtgtctaatcacgaacaaagcaacaaagagattcaaaaaatggaaggatcagagataccaaaaattacaaaaatgttgggtataaaatggaatgtcgacacagacgaactcgaactacaaataaaaataccactaatgagtagagacacgacaaaaagacaaattttgacaatgatcgcaaaaaatttcgacccaatgg

SEQ ID NO: 70092 - DNA, 1346 bp, Heterodera glycines
  Genomic contig location: Contig_ID=SeqID_9045; Location=1406..2751; Strand=+
  SCN-specific regions: Sequence locations=1-236,258-377,401-519,541 -544,600-732,754-780,802-1168,1214-1217,1242-1346
atgaacgcttttctgtctctgttcggcattttgctaggccttcaatttcacgcacaaatcgtttcggccaccgttacggcctcgctaaaaactgcgaccacttggaatggtggtggccaatacatggtgaacttcaagaacaatgatggctccaaaacagtgtgctctgtcaaattctctctgactccaaaatcaggggtacggtacctactgatactattgattaccaaagtttaataatacttcaataaatatattaggactggttaataacactaatcactagggtcataatttgtatgcattaaaaatgccaagtatgcgcataaaatatgcactaaaaattcgccaaatataccctaaaaacacgaaaaatgcccaaatatgcactaaaatatgccttaaaaaactgccaaaagtggtttttaaccttcaaaatgccaaaaattgtgtgtataaattaagaattgacttttaaaacaccaaaacatgagctaaggagcattttttagacaattgcaaaaatattgaatttccaaatttgtaaatttttattatatgtaaaacaaaattacattttatatacataaattttttttcaaaagttcttacaaaaattgaaaattttttcgatttttaagggtgtattttttaaaaaaatccaaaaagtcgatctttagggtgtatttttcgcttttttcgcatttttcttattgccaaaagtgaccgaattatgctctaaaaatggaaaaatgtcaaaatatgcatttattctcaaaaacctctcaaaatatgcttttatatgcactaaaaacctttaccaaatcaaaaaattttaacgtagaaatgctattttacagcctctttcttagcatatgcgcagaaaaaatatgcaaaatcatacaatttataaccctactaatcacaagtggggcaacaaattattatatctttgattaattacccccgccattccctaatagacgtccatctcgtccaagtggggctttgaagcggtcagtggcgcttccaaccagttcactctgtccaacaatgccgacatagcaccgggtgcgacaaatggaaatggtggactgaacattcaaggcaacggcgcaccgactctcaaactgattgaagcaaaatattacagcggcggtaatggtgcaaatattaaaaaaaaattcgaaattaattaattttataattaaaacgcggcatttttaatcttttaatttttctcgataaaaaaagaattaattttacattttctgcaggagtgtgcggtggatcatcttcttctggcggtagcagcagcgattcttcttcatgtaccattagcataa

SEQ ID NO: 70093 - DNA, 111 bp, Heterodera glycines
  Genomic contig location: Contig_ID=SeqID_9045; Location=882..992; Strand=+
  SCN-specific regions: Sequence locations=1-111
ataaaagtcaacatagaagcctcaaaccaagtggaaaatgtgttatttatgcttaatatatcgaaacaagtgcgcagaaaaaaaggcatatgcctcaaaatgcggtctcta

SEQ ID NO: 70094 - DNA, 68 bp, Heterodera glycines
  Genomic contig location: Contig_ID=SeqID_9046; Location=156..223; Strand=-
  SCN-specific regions: Sequence locations=1-68
atgaattggtccaacggacggtggcaagcagtatggctggttgtctccgaggagggcaaggagctaag

SEQ ID NO: 70095 - DNA, 1396 bp, Heterodera glycines
  Genomic contig location: Contig_ID=SeqID_9046; Location=1175..2570; Strand=-
  SCN-specific regions: Sequence locations=1-146,168-208,230-238,267 -350,372-464,491-571,593-643,665-834,856-996,1018-1223,1254-1396
atgcatccctggtaggtaggcttcgtttttaaggcacaaaaaaccgagaaataggcaaccaaaaggctgaaaaaaggcaaataaaaaattttattatcacatttaggtaggaatacacttataaacttaatcaaaaaacttaattcgattatttttcaatttcaaaatgaaattattgaatattttaaagctttattttcgaataatgacaaatttttaaagcaaaaactttagcaagaaaaaaaaatattttaagtaataaatttctgggaaaatgtttcatttcttaggagttgtttttttcgttatattgaatttttaaaggatatttcctaaaattctgaaatagatgttaaaaatggtgaaaaatgcacaaaaatagcgcataggcaggcattaagcgaaaaaccccgaaataggcaacaataggcattataaaagttatggtgctatgacgttactccaaataataaaaaaaaattttatataactgctcaaagcaaaaatttatttagcaataatgattatttttgtgggttctttggtcgaaataattttttgattaattatctaattttattccataaattgttaacatttttcttgaatccttaaaaaatgacaaactaaggatcaactgatcagtaaatctcaataaatcatgaaacttcagcaacagcaatcaaattctctgttgccggctctcattcttttgtttttgtgatccgcaatttcgagaagcgctttttgggtggcagtgtatcaatttgattgtcaacggttgggtttaaatcagccgttaatgacgaccataattgggagtctgctttatccgctggattgattttgttttcatttttttgttcggaattggcattgatattgtgcagcttgcttggttggaaatgggctgataaagttgacgatgaagcggatgaaaatgagtcaactcgctcaaatggcacttttgcttgtaaatggggcggtgaggcgggcgatgatgaggaggaagatgaatcggagaatgagtgtatccgatttaatgatgattgattctcggggctttgttcgggaatgacaccggattcattttgatcatctttggccacaggcatagaagtgaaagaaatttcagttttgcgtaaagggtcgcttcacaagtcgtagtgagcgcaccgatcagcaaataggcaaccattgccacaacagcaaatcgccgcttcattttaatgtttttattttattttggcaatttgcgatggattataagggtgatataacgtttgttattaatgtctacatataatggcacattcattgtaattgatttattggctaattgattttcccatgccaaaatggccaaaattttcgtttggcgatgaaaaaaaataaa

SEQ ID NO: 70096 - DNA, 138 bp, Heterodera glycines; identical to SEQ ID NO: 50950
  Genomic contig location: Contig_ID=SeqID_42127; Location=599..736; Strand=+
  SCN-specific regions: Sequence locations=1-138

SEQ ID NO: 70097 - DNA, 597 bp, Heterodera glycines
  Genomic contig location: Contig_ID=SeqID_42127; Location=1..597; Strand=-
  SCN-specific regions: Sequence locations=1-60,82-597
tgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaagaatcgattttttcaagtgtccgtttggggtactcaaacaatgaggggagcaaaaatccaacgcagaattaaagtacagg

SEQ ID NO: 70098 - DNA, 67 bp, Heterodera glycines
  Genomic contig location: Contig_ID=SeqID_42130; Location=873..939; Strand=+
  SCN-specific regions: Sequence locations=1-67
agaagagatagaaaaatcaattgttagctcccgttggcaaaccgaagggtacattggggcaatggat

SEQ ID NO: 70099 - DNA, 68 bp, Heterodera glycines
  Genomic contig location: Contig_ID=SeqID_42131; Location=1200..1267; Strand=+
  SCN-specific regions: Sequence locations=1-68
tatggcacggaaagacttccgatttccgacatttttggggtcggaattccgacttcccaaaatttttg

SEQ ID NO: 70100 - DNA, 352 bp, Heterodera glycines
  Genomic contig location: Contig_ID=SeqID_9047; Location=30..381; Strand=-
  SCN-specific regions: Sequence locations=1-352
atggatctttcggatttggctgtggagttggaggattcactaaatttgcgacatgatggagcagtgagtgaggaggattggctgttcggcccggaagatggcatcgatacatcagcagctgtaaaaacgacggaagaaaaacagaacttggacaaatggttgaggggggcggtggaaaaggtggacttccgaacgcgttcagcactcagccgaagattggagaagaaaagtgagcatttgttgtagcgagcaaagaaataacaccattttactgtcagaaagaaaggcggacaaagagaaaaggctgaaatgcagcaataacgcggagaattccctgtccatgattgaagag

SEQ ID NO: 70101 - DNA, 629 bp, Heterodera glycines
  Genomic contig location: Contig_ID=SeqID_9047; Location=1062..1690; Strand=-
  SCN-specific regions: Sequence locations=1-14,43-215,238-629
atggttttttagcctaaaaaaatttaacaaaaattttttaaagctttttactaatttttcagctggttttttaaaattttttgaaaatttaagtgttttaaaaagtttttctaggctaaaaaatccatttaaattttcttttatctaaaaattctaagtttaagttgaaaattcttagaaatttttttttgtacgagttgccattgaccctttgttttgttgatttgtgctgtttgattcgtccaagtggctattttattcgtcaatttgacatgttttaggtcgatcagtggcgccgtcgcaatgtgcggccatacaaagaggaatttgaggaagccaaacgtcattcaatccacacaatgagtgggttcattcgctttcaaaccttggaaaagtcaaaactttcgatatatcccactaattttctaaaatcagttgcccaaaagcatattggcgatgatgtggtgaacaaccgaactattgaaactgtggtcggtgcactcgtcgacttggccgccttgcaaagcaaccattccctggtcaaatggatgccccatttccaatgtcccatcccttgtgaacaccgctacaccgtttggcgaaatttgtaggcatttttattaattaaa

SEQ ID NO: 70102 - DNA, 704 bp, Heterodera glycines
  misc_feature (484)..(484): n is a, c, g, or t
  Genomic contig location: Contig_ID=SeqID_9048; Location=230..933; Strand=-
  SCN-specific regions: Sequence locations=1-100,122-638,673-704
atgtttcgttttttattgcaattttttgcctttttaagcgtaacaattgcacaaaattttgagactggtgataattcgactgttcacggctgctcgtgagttttatcgtttttattttgttttcttatggatttaactgtgccagaaatcattgctcgtacggcgaccgcgacttgggatgttggaataggagtctgttgttctttgagaaaatactccttggacagatgagaaattacgttgctgttcaaatgaatgtttgttttggtgtcatggcaactcgtacaataggcaactcgtacaaaaaaaaatttctaagaattttcaattaaaacttagaatttttagataaaaaatcttaatggattttctagcctagaaaaactttttaaaacacttacctaaattttcaaaaaatttaagaaactaaaaaatcagctgaaaagaattagtaaaaaaacttagagaatttttttaaagtttnttctagggccgggaaaaccgattctgacatctattttaacgcaattcgagccccaaacccgaattcgaacaaaaaaatacttagacatttttccgaatgttctcattgtatacacgaactaagttcacatataaaccttaaagtactaaccgattgaaacaaaagaatacaaaagcaaagtcaaagacaaaaccttgaatcactagccgattgaaataaa

SEQ ID NO: 70103 - DNA, 663 bp, Heterodera glycines
  Genomic contig location: Contig_ID=SeqID_42134; Location=956..1618; Strand=+
  SCN-specific regions: Sequence locations=1-316,348-663
atgcgcacccgtccgatctggcaagttaagcaacgattgctgactagccaaaaggtttggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggaggggggggggggggcgaaggcccaccacgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttgttttttgcataattaattcataaatatttttttcagaaaatgctctgaaacgcaccaaattttatttacatgctagtttaggcactctgatgctttttctatcaaaaagggagatga

SEQ ID NO: 70104 - DNA, 213 bp, Heterodera glycines
  misc_feature (72)..(72): n is a, c, g, or t
  Genomic contig location: Contig_ID=SeqID_42134; Location=720..932; Strand=-
  SCN-specific regions: Sequence locations=1-44,66-213
gaaaccaaaaaaatcgatttttcaagtgtccgtttggggtactcaaacatttatggggagcaaaaatccacngcagaattaaagtacaggctatagggaagctattcccgaaggattcggtctccccataaatctgggcgcatcggttcggggggactgccccgaaaacaaaaaaatcgattttttcaagtgtccgtttggggtactcaaaca

SEQ ID NO: 70105 - DNA, 80 bp, Heterodera glycines; identical to SEQ ID NO: 51817
  Genomic contig location: Contig_ID=SeqID_42139; Location=640..719; Strand=-
  SCN-specific regions: Sequence locations=69-80

SEQ ID NO: 70106 - DNA, 93 bp, Heterodera glycines
  Genomic contig location: Contig_ID=SeqID_42141; Location=252..344; Strand=-
  SCN-specific regions: Sequence locations=1-93
gaaagaaagtcgtcgacggagggcattgtcaattaaaaacgtgctgagtcgatgcacaaaaaaactcagtgtgggcgatccacaaaaaactca

SEQ ID NO: 70107 - DNA, 1061 bp, Heterodera glycines
  Genomic contig location: Contig_ID=SeqID_9051; Location=677..1737; Strand=-
  SCN-specific regions: Sequence locations=1-16,41-237,259-337,361 -381,403-556,578-751,773-859,883-1061
atgtctagcaaaaaggttaaaaacatatattttttaaagttgttttaatttgtctttagttgtcaccaaccgaagaacttgaaaaacaataccgcgattacaaagcgcaattcgaagaatggaaggaaaaaaatcggtaatttaacttgtcgcaatttaaatattctattttatgaaattagcgattccgttggcaccgaggcgtacatcaattacgtaaagcaattcgaactatgggagaaagacgtggagaagaggagggccgctttgcggcaaaaaactgaaaatgaacgattggcaacggctgaacgcgaagcggcgaaattgaaacgcgaagctgaggaaaagaagaaagctgaaggtgcctaaagatggattcatatcacatttatgttcctaaaattcagaggccgccgcccgcgcttatgccgaggaacaagcgcaatacatggcgatgcaccaacgagcacttcaagacgaacagctgcagaagcagcgagtgcggcagcaacaaagcgtacccgcacaacagcaccagtcgccgatgaaacagtcgctgtccacgacacagttggaccttttgtcatcgcctgtcagtgactgcaaagcgtcgccgacccaacaaccgcagcagaaaacaataccaaccaatgggaagccggacgaagacacttctggtgcaggtcagcgacatttggatggaggggcggtgccaaatttcgattagaaaatgacagaaccattcggatgacagtattttttattgtgttgaaagtgtgttactgtcctcttttattagtgactaatttgtgtcatctctttccacttcagatatgctttccgcgatgcaacaaatgttcagcattgtgatgggaacaaacatggcaccatcgaccaatgagaagacagtgtttgagaacagctccgaaatggaggaaaacgcggcagcagcgcaggggacgagcccacaaaaactgcagcaaacgcaactcgagcagacacagcctccgcaactttggggcaccgatgggactacctttaccaattcggtaggccattaa

SEQ ID NO: 70108 - DNA, 191 bp, Heterodera glycines
  Genomic contig location: Contig_ID=SeqID_9051; Location=2111..2301; Strand=+
  SCN-specific regions: Sequence locations=1-32,99-191
atgtcgcttgcccaagaattgctagccgatttggaggaggatggcgatgaggagatgcaagacttggaagtgaagaaggaggaggagcaggacgaagattatatagacgaagtcaccgaagagaaatcgttccccaatttgtcaaaatatgatcggataacggatgtggccaagttgaccagttcagctta

SEQ ID NO: 70109 - DNA, 1132 bp, Heterodera glycines
  Genomic contig location: Contig_ID=SeqID_42143; Location=15..1146; Strand=-
  SCN-specific regions: Sequence locations=1-27,51-193,215-685,707 -821,843-974,1001-1106,1131-1132
gcaaaacgatataacaaaaatataaggaaaaattttttaaaaaattttttctgcatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttgggatactcaaacatttatggggagcaaaactccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatctggtgcgtttcagaaccctttctgaaaaatatttaagaattaattttgcaaaaataaataaaaacgaaagact

SEQ ID NO: 70110 - DNA, 600 bp, Heterodera glycines
  Genomic contig location: Contig_ID=SeqID_42145; Location=234..833; Strand=-
  SCN-specific regions: Sequence locations=1-44,164-322,348-376,423-600
atgacacaagatactgctaacgatttaggcatagatataagaagtaataaaaatatttaataaaaaatatctaataaaaaaataggaaaaaaaatctttatttatgatataactaaatttattcgttacaaaataattcaaaacattttattaaaaaattataggtcgctcaaatctacggcgaaagaaagatggaacaattgaaacgagcgatttatgctgcttagcgccaaaatgcaaaaataacgtgtccaaagaaatggggtattccatccttaactgtggacataaatgtcactgggaagaagaatatgctaaatggtaaaaatataaattatataattaaagaatagagtaattttgacaatgataaaccaaaaatattaaaaatattaaattattatttacaatatatttaaattcagggtttctggtggacagtttaaacgatgccccaaccaaagatgcaaaaaaaatactataattaaatgctcatgctgtaaaaaaaatattggttatggattatttgagtgtggctgttattgcacaaaaactgcacaagacatggacatgcatgctgacaaacttgaaaaaatgtaa

SEQ ID NO: 70111 - DNA, 875 bp, Heterodera glycines
  Genomic contig location: Contig_ID=SeqID_42149; Location=152..1026; Strand=+
  SCN-specific regions: Sequence locations=1-76,98-108,132-157,179 -204,228-255,277-365,387-875
atggttgaaccgtttgcggtaaatgatcctgttgaacaaatacgagagcgtctggtagaagagtttcttgaccgtttgaagcctaatattaattgtgtcatacatcaatctaaaaagatagaaaaatttaattatattttcaaaatgatgtacaagtattttatataatgaagaaattagtaaaatagtttgactattatgtttgaaataataagttaagaacaaaagacaaaaaaacatttaacatttatttaaaagatttgacaaaataaagctcaaagaattgactgcaaaagttaaattacataaatgtttgactcttttaaataaaaacctacgaaaaatgctttattaaaatgataattttgaaacgatttcaaatgagcacttaaactaaagaaataattaaattgtacatatctattcttttattaaaatgtctaataaagaatttaaattcaaagtcaaacaaaaaaactaaaataataaaattttatcaatcaatgaatatataaaaaccagttggtaaatgtagcaaaacattattttcatcaaaaaacttaaatcaaataaaaagttgacgaaagtaatttaaaaataaattaccacaaaatagaagctaagatatggcaaaaataattgcgtatcagttcaagggaagtaagtaattcagaagaaattttcaaaactctcaagaagaaatacgcaaaaagaaattctggtatttcttttccttatgctaatttttatgcaaaattagaagcagttcttataacaatgaacagagttacaaaccacacaacataatacaaattttttttctatttattcatagagataacttgattaagtttaaaaagtatatttttatcata

SEQ ID NO: 70112 - DNA, 921 bp, Heterodera glycines
  Genomic contig location: Contig_ID=SeqID_9053; Location=95..1015; Strand=-
  SCN-specific regions: Sequence locations=1-111,133-615,638-921
atgtttttgagtggaaaggatgatgagtcctcgatttcggctattgataggaaactttggcaaggaaagaccacgataaaaatctctgatttagagaaagctcaaaatgatatagggaaattagaagatggagtgaacagagcttttcgctacatgaatcgttccttgaaccaaaaagtcaattgggtgaaagatgtcgtggccaatacaaatgccaattttgagacactgaaagtccaatacgaaaccttaaccgaaagagtcgagatgttggaacaagacagtgatgggacgaattcaggtgggactgttagtattactaatcagaatagagcgtcgcgtgcgccgtttgtgacaccaatgggcaatgcacagcccaatcaagttgtaccgaaccaagtgccaattcatcaattattaagcgaagacgaagatgacgggccgactctttttggcctgaacatgctctcgagcggacccacagtggggtcaggtttggaaatgttttgtgaggagtctgtttttgcatttgacgattgggctgaacgtttcaaggattacctgtccgtgtcaggcaaggcttacactgaacaagaaaaagtcacaagactcaaattggctctgagggacactcctcgggcactgtttaaggagttattgccagcacaaacggacactcttgactcagcattgagtgaacttcgacagaaattggactcccctcagcgtcgggaaattgcgaaacgaactttatcgctgtgcaaacaaagggaggatgagacagtggcgcaatttctgagacgcctaactcctgtggtggatgcgacaaattcgtcattaaccggtgacattcgtaaagagaaaatctgcgaggaatttttggatagatggaagccaaacattagttttctgatccgtctg

SEQ ID NO: 70113 - DNA, 247 bp, Heterodera glycines
  Genomic contig location: Contig_ID=SeqID_9053; Location=2576..2822; Strand=+
  SCN-specific regions: Sequence locations=1-247
atggctaggttggtgaatcaattcgaaaaaggagcaaagtgccaaaaggtaattaacggtgccacagaaagacctaattaaggcaaatttaacaatttaaatgcactaaattaatttctaatcactttgtcctaatggtcacataaattacagaagaatttaaaattattccaagtaaagcgattaatccaagtactgaagagcatccaatgagcgaccagcttgcattggcatctttgaaagtcaa

SEQ ID NO: 70114 - DNA, 1344 bp, Heterodera glycines
  Genomic contig location: Contig_ID=SeqID_9053; Location=4102..5445; Strand=-
  SCN-specific regions: Sequence locations=1-428,450-740,762-1146,1168 -1344
atgaatcattttggcttatcacagttcagcattgtcacaatgcttacgctgatgatgcctttatccgctgataacatgattattgaagtgctatatgatatatatacttaccctgttttggtgaacaagaaggatactgtggcaactttgaaggcgaagatccaagaaattgacaaatttgggaacattccgattcaaaatcaagtattgttcagtggtattagtgataatgtgcttgcagacgataaaacaatggacgaatatggcatcggcgaagaaaccatttatatggaggttgtcgcctacgctggttcgaattttcatattcacgtgaactaccgtagaaatcggatctccgttttggcgaagagcacggacactgtgaaagatttaaagaagaaaatagcaaacattgatgaacttgggaatattccgattcaaaaacaaacattgtcaaaaaaaattacttgtacattttggattgaacttgcagatgatgagacaatcgataaatatggcattggagaaggcaaagaactgtttctgtcgtcggacgaatttcaatttttggtggaatacaaagagaagatgaactccattaaggtgaaggccatgaccaccttaaaagaagtgaaggagaaaatgacagaaatcactggaattccgtccgaaaaacaaacattataccatttcaaattcggacaatgtaatgacaaggctagggtgatagatttcgtgaaagaagatatgccctttttaacaatgtcggatggatctggaattaccgtgcggtggcaagatcattgggaattttttgtgattaatgtgaacagcacagacactgtggcaacagtgaagcggaagatcagggcgatcaataaacagaggcataaatccaagttaaacggagtgatcaaactaagcaaatgcgatttcgattgtaaatatgctaaagcacttaggggcgggaaaacaatggacgaatatggcatcagagaaggaaacaccatttttatggaggttgtcacttgtgacgaaagctcacgacagtggtcatttgctgctttcgaagatggttctaattttcatattcacgttgaatacggtagccggcgggtaatcgtttgggtgacgggcacggacactgtgaaagatttgaaggataaagtacggccattcatggaggcggattggaacaaaaagttcggcgacatttccctgagcaaacaacacccatcacgagctgacattgaccaacttgtggacaatgcgaaaacgatggatgaatacggcattaaagagggagacaccattgaatcattggatgccgaagaactgggctaa

SEQ ID NO: 70115 - DNA, 1027 bp, Heterodera glycines
  Genomic contig location: Contig_ID=SeqID_9054; Location=411..1437; Strand=-
  SCN-specific regions: Sequence locations=1-141,202-273,295-511,533 -577,614-620,642-844,866-871,893-899,960-1027
atgtcagctggtgaacggagaagaattttgattttagtgttacttaaattaggttttgattcccgaaattcatattcatacttaataatttgtaaaatggcaacaattttttcattgaataaatcggtaaatattctaaagaattaaaaaaaatgatgtaaattaacaaagtttaaaaaaataaaaataaaaactttttttgccatctttaacgttaaattgatattgagaaattattacaaattccactcaacacctggcatgcgtattttatttaattgcatttgtcaaaatgtaattagtgaatttagttaacgcattcattttcaattagattttgacagagttttaataaaagtgcggacaataagtttggtttttaccatttttaaacattttctgaacttttttttaatacattttttctttttagtggcaaaacataatattaaaaacataaacgaagtttcagcatatcaatttattctcgaaaaccaccaaaaatattatcgtttttgtaaaattggattttgttcgagttcgggtcagggcatcggaattgggcgaaatggatctcaaaaaatattttaaaaaattttaattaattttttatgggattgcctttttgtacctgtctttttgtccataattaaaattgtaattaccgttcacgcactgcaaattatccattcgtttgaaaaatttctaattaacaaacttaaatgcaaaatttcatcgtcaaaattggcaggtgcattttcgaagggtaaataagcaaattgccacattggcatcattaactgaattcgtagaaacatggcatatcgtcgaaatgttaatgttcaaatttttcactaaatttttacagaggattttacaattttttaaaatacttcctgaaatttttttaaatttttgataaaattttttcatcaatacataaatatgaaaaatattttcgcgtttcaacatatgaattttcgactttaataagagtttctttctcaaaattgctaccataaataaa

SEQ ID NO: 70116 - DNA, 438 bp, Heterodera glycines
  Genomic contig location: Contig_ID=SeqID_42155; Location=155..592; Strand=+
  SCN-specific regions: Sequence locations=1-1,24-160,190-321,355-438
aaaatctataaaaaatttaaaaatgagaattcatgcgagattttctggaaataagcttaattgggcctagttaagctgtaaaaaaaatttggggcgatttgaaagagaatagaaagaaccaggttcgatgaagttttgttaagccaaaaaaaatccaaacatttaaaaatctataaaaaatttaaaaatgagaattcatgcgagattttctggaaataagcttaattgggcctagttaagctgtaaaaaaaatttggagcgatttgaatgagaatagaaagagccaggttcgatgaagttttggtaagccaaaaaaaatccaaatatttaaaaatctataaaaaatttaaaaatgagaattcatgcgagattttctggaaataagcttaattgggcctagttaagctgtaaaaaaaatttggggcgatttgaaagaga

SEQ ID NO: 70117 - DNA, 81 bp, Heterodera glycines
  Genomic contig location: Contig_ID=SeqID_42155; Location=817..897; Strand=-
  SCN-specific regions: Sequence locations=1-53,75-81
ttacagcttaacaaggcccaattaagattatttccagaaaatctcgcatgaattctcatttttaaattttttacagatttt

SEQ ID NO: 70118 - DNA, 657 bp, Heterodera glycines
  Genomic contig location: Contig_ID=SeqID_42156; Location=189..845; Strand=-
  SCN-specific regions: Sequence locations=1-580,604-631,655-657
catttcaatcactgggacttaatccaccaacattccaatcaacgggactcaacccaacagcattccaatcactgggactcaattctcctgcatttcaatcactgggactcaattctcctgcatttcaatcactgggactcaattctcctgcatttcaatcactggcactcaacccaacagcatttcaatcactgggactcaacccaacagcattccaatcactgggactcaattctcctgcatttcaatcactgggactcaattctcctgcatttcaatcactggcactcaacccaacagcatttcaatcactgggactcaacccaccaacattccaatcaacgggactcaattcttctgcatttcaatcactgggactcaattcttctgtatttcaatcactgggactcaacccaccaacattccaatcaacgggactcaattcaccagaattttaatcactgggactcaaccctccagcatttcaatcactgggactcaacccaccaaaattccaatcaacgggactcaattcaccagaattttaatcactgggactcaattctcccgaattcatatcatatatttaaatttattattaatctgcgtcaatatgtgagataaatatcgaatcacaaaaatacattttaaattaaa

SEQ ID NO: 70119 - DNA, 480 bp, Heterodera glycines
  Genomic contig location: Contig_ID=SeqID_42159; Location=235..714; Strand=-
  SCN-specific regions: Sequence locations=1-106,128-433,461-480
atggccggaacattggacaacaagctgtactcgtggggaatgcacaaatgggcggctgagggccagcagcccaaggaaaatgatggcggtgccgatcagagcgcaaaggcggcggaggacggcgccggcggcaccagcgattgctcctatctgtcctccaccgccacctcattgaccaacagcgacgggaatatggtagggagggcatccattcaatcgagcttatgcgaattttaaaattaaaaaaaacacaattagatactgtacttacggaataaaactcgggactctatttttcaacctccctcaaaatgggggcttttctgggggggggggggcttctaattcaggggtgggttctatttcagtaaatatgataaaacaaaaaaagtgaatttgcctcaggcaacacccgtcgaacaaccaaaacagcagaaggagaggaagaagaggaagaagagtaagagcacaaaaacgacg

SEQ ID NO: 70120 - DNA, 633 bp, Heterodera glycines
  Genomic contig location: Contig_ID=SeqID_9055; Location=426..1058; Strand=+
  SCN-specific regions: Sequence locations=1-445,490-633
atggacgcggtcgcattggtcgacgcgaattgtcacgcgatagtccaaatggtggaacagggagaggccaaaagcgaggccgaagatggcgaggatcagcagcagcagacgctggtcacgaagctgaaaacgctaaaccaagcacagagagaaatgatttatgacaaggagaatttcaaaaagattttcaaaacggaaaatttcgaaaaaaatttacgaattttatagacgaaagattttaaacaaaaattcaaaaagaatttttaggcatttcttctctcactgtgtgcatcggatggcgaacgccgctgaagcgttctaatgacacggccaaaacgaagctaaaaacatttaattgaatttgaattaaattttgatatatggcacaatgtcgctgcggttgagaagcaattggccaatgccacccaatgaattttggtgaagctaaaattaaaatttaaaaaatggaaatttaatttcaaatttaatgaacatgtaaaagtaggcgaatcgaatgcttttgtagaagacggagaaggaggccaaagagtggggcaacatgcagaagaggaaggccaagtcggcgaatgccatggccgagaggagagtgttggccttggggaaacccgaaaa

SEQ ID NO: 70121 - DNA, 517 bp, Heterodera glycines
  Genomic contig location: Contig_ID=SeqID_9055; Location=1120..1636; Strand=+
  SCN-specific regions: Sequence locations=1-4,26-197,219-219,241 -298,358-465
atgccaacaaaaaccaacctgattcttcatgccggaggacaaaaggacgcacaaattgatggaattgccaacgacgcccaggcaaaattggacggggaaaacgtaatgctgaaaagtgacggaaaattaattggctaagaaatgccgaaatggaacacggaaaataggtgttacctgaatgtaatagtcgacctgataaggaatggtttaaattttggcataaaaatattcacttgccatgccaacggtcagtgccattccctggacggaagtgccgttgccgacggcgctgcaattcattttttaaatatttttccaaaaaaataaattgacttttttatttttttaacatttttagctgaaaatatttgctctttagattcattgaagcgttagaatttttctcaaagcctgggaatgaattgaaacggaacaaaaatagggccatttttttgagggggagacaaaaaaaaacaaaaattaaaattaaaatgagatttaaattttaaaattaaaa

SEQ ID NO: 70122 - DNA, 1021 bp, Heterodera glycines
  Genomic contig location: Contig_ID=SeqID_9057; Location=1009..2029; Strand=-
  SCN-specific regions: Sequence locations=1-23,45-607,630-689,711-1021
gatgctcggaaggcgtacgaaacgcgtttgaaaaatgccacaaatggcaacaatcaggtggccagagagagagagtttcaaacaaattcagacgcattttgacacattttaaggatgaatcattgttattttaggccgattgtcgcataaagaatttggaaaaagagctgaaggtgcttaagcgacagctgagtgcgttgggcgaccttctcgaccagtttttggacacttcgttggccatgcgcgaacggacgcggcgaatggaggacgaattggggcgacgattggaacgattggatgcgcagatgagggcaaatttggaggcgatggggcgacagacgcacaaaaacggtgggaaattggggagaaataaatgttaggacgtctaattcgaataattcctgttttcagggaacaacgaacagaggaatgaagcggagcaaaccattgaaacgatacatttgggttggtgtgaaagagggtcggaccaggattaggatttcgactttcggtgcaattttattttatttctttgaaattttcggacgggaccgtccctggtctctaaactaaagtcttcctcagtttaaaaaatctgtgaccgctcaaaaacttttaaatttattttttggcaaaatgtttgtcattatgggcataattgtttcaaattgctatttcatgttaatcccatctttgaaaaattaaaattaagacgaactttcaattgccgacgaagttccgcttgaacaaaatatccaacagcagccgcaaccatcgaatgtcagcaattgccctgcaaatgacgagggcggcggcggggacggaattggcgacgaattggcccattttttggccggccttacgcccgtggacgaaatgggccaattggtgctgaacaagttcaaatactcgtgcgaatttgctcaacttctctacaccggcggaggccatgtcgactcggtgttctgcaacattttcagcggatatccacccactttcttcgaagaattggtcgaggcga

SEQ ID NO: 70123 - DNA, 228 bp, Heterodera glycines
  Genomic contig location: Contig_ID=SeqID_42162; Location=697..924; Strand=-
  SCN-specific regions: Sequence locations=1-92,134-228
atgggctttgacctgtggaggaaggcccagcccgagtccgcgaagaggccgagtgagtaccttcggtgcaggaaaattattaaggaagagagttcattatttatttgttttttgcataattaattcataaatatttttttcagaaagggttctgaaacgcaccaaatttatttacaagttgaataaggctctctgatgcttttactatcaaaaagggagatgaataaa

SEQ ID NO: 70124 - DNA, 830 bp, Heterodera glycines
  Genomic contig location: Contig_ID=SeqID_42165; Location=252..1081; Strand=+
  SCN-specific regions: Sequence locations=1-778,811-830
atggctgaggttaaaaatgatttcaaaacccaaaaaatctgggcatcagtagacgagactactgattctaaaggtagatatgtcgcaaatttgatcattggcattttggatggaaaattgcacaacccgcatttggttgccgtcaaatttctggacaaaactaaccatgaaacagtcgctcgatttgtcaacgacaatctgagggagttgattttggctgatgacctttggttgcttgtcactgacgctgcgcgttacatggttaaggcagcacaggttaaataaaaaatttacagaaaagtggtacaaaaaacatttttaagggcctaaaaattttctacccaaacctcattcatctaacatgcctatttcacgggctcaatcgtgtgtgcgaggaaattcgtggcctctatccgagtgttgacaaattggttgcgagtaccaagaaaactttttcaaaagcgccgtcgcgtgtggccaaattccgcgaactttgtgatctccccctcccaccgcgtccaatcatcacgcgttgggggacttggctcaacgcagcggattattactgccaaaattttaaccaagtcggagcgattattcgagacttcaacccatccgattctgatgcaatacggcaatcacaaattgccttcgactctcctggtattcgcggagatttggccttcataaaatcacattttgatattttgcctggagcgattggaaaattggaataacgcaacctcacactcattgaaagttaataaaaaaaaactcgaaaattttttattcttattttctaggtttggacatagtaagcgatgtcggaa

SEQ ID NO: 70125 - DNA, 49 bp, Heterodera glycines; identical to SEQ ID NO: 51181
  Genomic contig location: Contig_ID=SeqID_42167; Location=696..744; Strand=-
  SCN-specific regions: Sequence locations=1-49

SEQ ID NO: 70126 - DNA, 67 bp, Heterodera glycines
  Genomic contig location: Contig_ID=SeqID_42169; Location=15..81; Strand=-
  SCN-specific regions: Sequence locations=1-67
atgacacccgcactgattgcgctggtgctctatgccttgctgccgctggtgcgcggcgtggtagtcg

SEQ ID NO: 70127 - DNA, 900 bp, Heterodera glycines
  Genomic contig location: Contig_ID=SeqID_9058; Location=127..1026; Strand=+
  SCN-specific regions: Sequence locations=1-900
aggtgcgatcatccgctgcttgtccaacattgtgtttgagcatcgtgtgctcggtgagcacaaggacttgagcaaggattgcaagaagcagctgcgggtcgcctatttgcaacaagaacaggtcgatgtgagtttcactgtcttttccttcgcttaagcgctttcaacaaaaaaaaacacaatcaaaaaaccgattggaggagatgggtgtggcgctgaatttttttgataaaagctgatcaggaagcgcaaaagccatttttggattaaagattactaaaagtcgataaggtcaaacccgagaattcccaagactcgagaatctaactaaaagacgcaccctcagcatacgagaccaagaccccaaaaaagtgagacttttcctcaaggccggcactctcgagaatctctagcagcaggcccgtaaccattggaccgaagagaaaaaaaagggcaattttccatgaaaaatctgcaaaattgaaaattccaattttttttaacaaatattacttttgaatacggtgttttagttttctgatcagaatttcattgaccaatcccactgaaagttattcgcatcggccttatcagtgatcagtgattatatatttttcctaagcaagaacagcgcacatccatctcattttttaaataatgtccatatttttttcaatttgttttgttttcctgcttccgctttcggtgtgctttctaccgtatacctcgttcataaattttttgattgtttactgtagtttgatgacaagcagcacatggacgacgcggacccacaactgatgaagaagtgtgcagctgatctgcaacgctacaactgtatggcccaacaacgatttgaggacgttgtggagtgtctacgggtcaactttgacaacctgg

SEQ ID NO: 70128 - DNA, 682 bp, Heterodera glycines
  Genomic contig location: Contig_ID=SeqID_9059; Location=33..714; Strand=+
  SCN-specific regions: Sequence locations=1-195,287-366,402-504,541-682
atggataagtttacgacgggattgggtcgggagaaagtagggcaatgtacattatgcacaaaatatgaaatttgaatgctacggatacagcaaaactcaatttcccaaacaattttagaactcatgcaaatacgacattggcaaatattgcgggaatcagaagggcgacaaagtgctcgactgtttaatggtgggaaaaaaattaattaaaattcataaaaaaattgtaattaatatttaatttatatgaaaattatataaaattcaaaatttaatatttttatttcccaatttcagaatacaaaaattgttcgactgcttcaaaagcgctgtcttaaagtgagttgtttttattcagtagcgcccaaaattaatattaatttatatataattttttttttggaagggttcgaaatttttcaatttttattaaattaaagtgcataatttttaaatttatcttttttggatcgtccccaaaaatgataacttatttttttacagtataattttaatttcattttaaattttcatttttttgccacaacctccactaaaaactgcatgttggtttcaggttgtgaaggagcgtatgcttgaacgggtgaaggacgaccggctgaacccgtcactgttggaaacgtgccaaaaagaagcggaacaatagtacggcactcataca

SEQ ID NO: 70129 - DNA, 2567 bp, Heterodera glycines
  Genomic contig location: Contig_ID=SeqID_9060; Location=201..2767; Strand=+
  SCN-specific regions: Sequence locations=1-160,192-380,413-420,443 -782,804-1287,1328-1614,1733-1818,1840-1855,1879-2145,2208-2287,2316 -2371,2426-2567
  Gene Ontology: Cellular component=integral to membrane
gttgtgaaggagcgtatgcttgaacgggtgaaggacgaccggctgaacccgtcactgttggaaacgtgccaaaaagaagcggaacaatagtacggcacttttgccaaatatatttatgaagaccggacatgattggccaaaaaccgattatttaacaaactttaataaaaatgatattaatatttataaatcaattacaatgctaattagtgaaaattgaattttgtcccaatttaagttgtgccgacgattacaagaagatcaacaacccgcagtattcacagcagcaacttggcccaatcattgccacttgcctgaggacacaatttgccaaattcggcagcggcgttcacttgtcaatgggatgcaaagatgaggtaaattaaatttgaaaatttatttgcttattttttctgatccattagtaaagaaactatattttggtcaagacataaacgagagaaattgactacattttgaggaagggcggtggatggattttgaacaaaaaattttcgatgggggatttaagtgaactactgagttcaaactggtaaaaatgcttaaaatggccaacagttattattcaaaaaatgctgaatgttttggtaatcctctaactcattattgacttattaatctcaaggcttaattatttgagtggtataacaaaaagaaaactgttcacttttaattattatgtgttgccgtattatactaatttaccgattaatgtataccaattactctaattttattaattgacatgccttaattgagtatttttaattagaaaattgcttgtcaaaattttacggtagtctgcttatctgtattctatctatacatgcttttcagttgtccaagctgatcctggagagtgagttcgacattcagctggaccccgcgctgtacaaggcatgccgtagtacaatcaacaagcattgtgccaacgcaatcattgcccggggcggcaactatgacaccgtgctggagtgcctgaaagccgatttctacgctaatcaaattccggacagagattgtgcacaacaggtgggtggtggcgatcagggatgtatcggaatgccgaattccgattgtcgattttcgacatttttgggcttggaatttcgttgccgaaatttttgtgggcctcgccacacatcctctgctgctgtgatatggccattagttaattactctgtctccaaaatgagtgttgcgattaaggatatgatttctggctagaaataaacatcttaggactctgtgttctttattagcctaccaagttttaaaaatttctttatctttcaaaaaatttatggccaaaagcactcaaaaagtttcctttggcacggtaaaaccgctaaaaattataaaaaacttaattttcattgtcaaattttgctgatcatttttggtcatggaccaaaaaagcaaaaaaatttacaatagcaaatgactatgttaattggcaacacattcagttggctcgtcgaacacaagaatcgctgatcgacatccatcttgacccgggtctccacgaggcgtgcagcgtggacatccaaagagtgtgcagagatgtgccaccggggcagagtagaagtgggcaaaatattaaaagattattttaaaaatttaatatctttttttattttaaaacaaatttaaatattacaatttaaataaacaaattttattgcgattttttaaaaatagaataattattcctaatcacttaatatatcgttttatttaattttgatgttgtctgcgaatttatcagatcttacaatttattgtttatctctaaattcattaaaaatcaatttccaatcaataaatcaatttcgcaatgcttttttccctttctcagttatcatgtgccttgtggacgcggcacggaacggccaagtgcatttgtccgccgcatgtcaaacaaaactgacggatcgaaacaaactttggcaaatggcacacgacgagtaccgaatggcattgccggagacatggtctgaggtaaagacgtaaagacaattgtggcaaaaaatgtcaaaaaaccatttggagtcattttactcataacattctatatagtttttttttctaaaaattatttagcctcaattaattcgttcaagcatttaaaacataaaaaattgttcaaaattataaatattttggtttttaattaaaaaaaaattcattagcttttaaatatgggtcaattatgataagctgtgattgaaaaaaaagattccgccattttaaatattttgcgtcgtttatttatttttttaaaataatataaaggaattttttgccgacaagcgcagctgggtttttttggcttttagtaatattttgctaaaattttaatcaataatttttgaaatataattaaaaaattgaaattaatttaggcatattccatcattgtgaaccacccgaaacggaccagcattctgtcataccttggcattggtctgctggtgcttttgctgttgggctgctgcttgggacgcctcagcaaacggacgtacaacgagctgaagaacagatga

SEQ ID NO: 70130 - DNA, 253 bp, Heterodera glycines
  Genomic contig location: Contig_ID=SeqID_42174; Location=563..815; Strand=-
  SCN-specific regions: Sequence locations=1-218,240-253
atggagaaggcctgcaaaatttggagagattatatcgattttagtgcgctaggttcgatgaaactttttaaaatataagcctaaactttttggcctgtttaaaaaggaattaaaaatttttagattttttattcatctccctttttgatagtgaaagcatcagagagccttatttaacttttaattaacatttggtgcgtttcagagcactttctgaaaaaatatttatgaattaattttgcaaaataataaa

SEQ ID NO: 70131 - DNA, 757 bp, Heterodera glycines
  Genomic contig location: Contig_ID=SeqID_42176; Location=167..923; Strand=+
  SCN-specific regions: Sequence locations=1-175,197-523,545-757
ttgaattgaacgtcgaagccgacgacccacttcaaagttacaaagagcgatttgagcggtcgtacatcgaagggactgaacaattttacaaatgtcgcacagcgcaacttttggagcacgacggtgttctgaattacatggtttacgtggacgggaaactggccgaagaggaggaaagggccaaaagatatttggactcttcgtcgccggaatccatcgcaaaggcaaacattggtcattttgtcgactcatttaaacgtttagttggtggaccaatgcgttcaagtgctggtgatcgaatatcaagaccaacttttggccgttggtccgactctgatcaaaaacaacgaggtaaacaggctgaagacgctctaccgactgatcaatcggacacccgacggaattcccaatttgctcaacgtcttgcacaaacacatcacggcagaaggactcgccgccatgcatgaacacgcggcggaaattgtgacggtacatttttggaattcgatttagaaaaaatattagaaaaaatcatcgaaatttgaatttaggacagcgaaaggtacgtggaacagttgctcaacattgtactcagtgttctccgaactcgtccgagatgctttttacaacgactcgcgctttttgaccgtcagagacaaagcatttcaagaagtggtgaacaacacggaagtgttcagattggagttggacccaaaccgaacgaaaaggttgaaaatgcgcaaaagcaattttaaaa

SEQ ID NO: 70132 - DNA, 304 bp, Heterodera glycines
  Genomic contig location: Contig_ID=SeqID_42179; Location=450..753; Strand=+
  SCN-specific regions: Sequence locations=1-109,163-283
ctttttttggagccaattgttgcggcacaagactttgacgtgtttgtgccgatgatgatgcgtaaaaacattgaattgcaattacaagcactgaaaatgattgaggtagtaattcattaaatttaatcgttgattaattaaatgatactaattaattaattattgaagcatttgaacggacttttgcccaattcgctgaagcttggtcaggaggaagcggatatgtggaattcgttgactgatgaggatgatagtgaacgattcatcatgatctcagtgctcaagtaaaagatttattttaaaa

SEQ ID NO: 70133 - DNA, 554 bp, Heterodera glycines
  Genomic contig location: Contig_ID=SeqID_42180; Location=246..799; Strand=-
  SCN-specific regions: Sequence locations=39-58,86-93,169-240,308 -443,479-554
gagcctgcggcttaatttgactcaacacggggaaacctcaccgtgtcttggacaccgtaaggattgacagattgatagctttttcatgattcggtggatggtggtgcatggccgttcttagttcgtggagcgatttgtctggtttattccgataacgagcgagactctagcctactaaatagttggctcattgcttctgtgggcacaacttcttagagggattttcggtgttcagccgcacgaaattgagcaataacaggtctgtgatgcccttagatgtccggggctgcacgcgcgctacactggcaaaatcagcgtgcttgtccttccccgaaaggggttggtaaaccggtgaaaatttgccgtgattgggatcggacattgcaattattgtccgtgaacgaggaattccttgtaggggcgagtcatcaactcgctctgaatacgtccctgccctttgtacacaccgcccgtcgctgcccgggactgagccatttcgagaaattcggggacggttagtgttccggcttcggtcggtatgcagactggaaccg

SEQ ID NO: 70134 - DNA, 1041 bp, Heterodera glycines
  Genomic contig location: Contig_ID=SeqID_9061; Location=129..1169; Strand=-
  SCN-specific regions: Sequence locations=1-109,131-450,475-692,717 -1041
  Gene Ontology: Mol. function=pre-mRNA splicing factor activity; Cellular component=small nucleolar ribonucleoprotein complex; Biological process=mRNA splicing
atggaaagtgggaaatgcgtacgccgtttccgtacacacaccgatttcgtcaacggctgtcaccccgcccggcgtggtccatcgcttgtcgtctccggctgtgacggcggcaaaattattgtgcctttgccctgggcatccattacttatgcgtttgttcaggtgcacgatgttcgtcgtcggggccctgtggccacttttgaaagtgtgaacaattaccaagtgacctctgtgacattcaacgacacagccgaacaaattatcagtgggggcattgacaatgtgcttaaggtgatgcgttggatcttaaggggcgtaaattttatgtgttttctgtcggattacataaagccaacaaaatttaaaagggctattcactttcttacaatcaaccaaatgtttgtttgatttatcaattccgttattttttgtagagttaacaaccgcgagaatggaatattattcagtgttaaatgttggggccatgacctaatataaacatttgtttagatttgggatatccgtcggcttggtttgcttcatattttgcccggtcacactgacacagtcaccggtctcagtctgagtccggatggtaaccacgtgttgtccaattccatggattgtactgctcgcatttgggacattcgaccttatgcaagctcacaacgatgtgtgaagacattgactggacatcagcacaactttgaaaaggtccaattgacagtcaaaatggttcatagatgatcatatacgacgcgagttcaaaatacgtttttcaagaaattaccttcaaatttaagagaccttctccgttgttctttggtcaccagacggacaccgagtttcatgtggtgagtagtatcaagaatttcattgcttttgtttatcgtaaaatcatttgttcatttactaattttcaaggatcgagtgaccgtttcgtgtacatttgggacgttggttccagaaacattgcttacaagttgcccggccatcatggctcagttaatgcaacagattttcaccctaaggaaccaattg

SEQ ID NO: 70135 - DNA, 648 bp, Heterodera glycines
  Genomic contig location: Contig_ID=SeqID_9062; Location=188..835; Strand=-
  SCN-specific regions: Sequence locations=1-82,106-442,464-648
tccgtgtacttcggcaatggccaattcgccgaagccctcacgtgccccatcggccaatggtggactgtccaacaaacaacaggttgttgttgctgttgttttttagttattgcttgttgattttctaatgtaactttgcttatgttttgtgatttgggcattttgcacacatcttgacaattcaattaattttccagtccaaactgaccatccgtcgtcggcccgtccctttccgagatgccctcgtcgttcggagtgcagccaagaaaatggtggtcaatgtgagcggtgtttcgttcactgtcactgagtttaaaccgcgcacatcgccgcgagggcgcaagaaattgccggtcaatcaaaacaatggcaaacacaacgtgacattgtgtcatagccaagcggaatgaacgaaggacgagcaacggactgtgtcattttgtctctttttccacttgattttgtttttttgttaattatcttaaaactgtacagaattaattgtctttaacttacttttgtttaatcatttgtttaaccgatatttatacttgtgactttatgctttgtcttgttacatgtttttaagctggatttctcagatgactgaagtattcaaacgacctgcactcccactcgttcctgcga

SEQ ID NO: 70136 - DNA, 91 bp, Heterodera glycines
  Genomic contig location: Contig_ID=SeqID_9062; Location=1744..1834; Strand=-
  SCN-specific regions: Sequence locations=1-42,64-91
tgagaccccccttttgttgactaactcacagaccactaagacgaaaaaaccaacttaattgtacttggagcccaaaattgaatcgccgtgt

SEQ ID NO: 70137 - DNA, 1110 bp, Heterodera glycines
  misc_feature (1060)..(1060): n is a, c, g, or t
  misc_feature (1106)..(1106): n is a, c, g, or t
  Genomic contig location: Contig_ID=SeqID_9065; Location=47..1156; Strand=-
  SCN-specific regions: Sequence locations=1-248,270-279,301-509,531 -638,660-983,1005-1067,1089-1110
  Gene Ontology: Mol. function=RNA polymerase II transcription factor activity; Cellular component=nucleus; Biological process=brain development
ttatgtgagagaggagcgaatttattgcatcgaatgctttcttgaagtgagccacaaaagcaatatcaaatgactaattatgcaaatgctttaaactccccccaaaaagcaatttcgtcaaaatttattgtgcgacgtgcgaccggcgcattgatccgttcgtttgggtacggcgcgcccgcgagtttttctaccatttggcatgttttaaggtgggcaaaatgatcacagaaaagcgagggttctcattgcattatttcgttttgcattaattttatgaatggcatttccttttgacactttataccgtacccaccgtattaccgtaaccctcgtcgtttcgattacacagtgtgagcattgcaagcgccaattggggacgggggaccaatattcgctggacgatttgacccgacctccgcccgccatcccacgacttttgtgccaaatgcattacactgagcttgtgttgggcgaacaaagtgagagggagggaaaagcagaaactgactttttaatggcattgttttcgcaaaatttggttggaataatcaaatggcaattgggtaaaatggcattcatcagtgaatggcattttatatcatatccattgaaaaggacaatgaagacatttccaataacatttcagcagttttgaattgctattgtgaattgaaatggctaccgtacactttaggcagttcaaagcaaaagacgaaaagagtacggacgacttttggggaagatcagttgaatatcctccagcaatatttcaaagtgggcaagcaaaagaccaactcagaaaaaggaagaaaacattgttcagagtgacagtaacccggacggcgccgacttggaacgaattgcccatttgaccggccttagcaagcgggtcacccaagtgtggtttcaggtggacttgttaagggaccctaaagcaactaaaagggtcaatggcaacgcgtacaaaagacaactcatattttacaaaataaacttgtttagtcaaagcctaggcctaacctaagcaattgtacgagttctcatgacacccaactanaaaagggatccatttttgaaataatttcgaccatttgatttatganttat

SEQ ID NO: 70138 - DNA, 1056 bp, Heterodera glycines
  Genomic contig location: Contig_ID=SeqID_42186; Location=661..1716; Strand=+
  SCN-specific regions: Sequence locations=1-63,85-101,123-373,397 -421,444-760,803-916,938-1056
atgtacttccctgaggacgtggacttcactgctcgcattcgttccattgttggctcgctgcccaaggaaattggtgacttcaaagcgatcactctcaaagagtgggagggcggctctgacccgcaggtaaagaaaaaaaaattcaaaactttcgtataaaacaggcccccatcatccagaaaaaactgaaaaatttaatggctgtaactatgatgcaaatttttgcattgccaaaaatggcgccaatttgtgcattttttagtcgcatttttaaacgacgtccattttgcaggcaaaaatcgaactgttgcgcagcattgaggcggacctgaaggcggagcgcaagctgcgcgaggagcgcaatgaaataaaaaagaaatcaaaggggaaatgatcttttcgggttgaatattttttttgtcaaaaattgcaaaaacaaaatacctacggtttcgctttcctgaaacaaatccattcctaaatccctactagcccaaaattcgaaaaaaaaaatttgatctgttccttaaggttatgatgacaggtcaaacaaacacggccatgaatggcttaaaaaatgaaattttttttatttgccttacggtttgcccttcatttacagtatttgctttaattatccccagtctacgaggcgtttgaaaaataatccataatccctctgtcttaatcccccagtctacgaggaggttgaaaaataatcccccatggggaataattagagctaatacggtaggtatactaatttttataaattttaatcaacaaaaattgttaaaaaaaagttttgcataaaaccgcaacaataattcgtcatcattttgttgttgccgcctttcccggcctcttccatttgttgtttcctgcaccggtctttgttctttttgccattccgacacctttctttttcgtccttttctgcttcggctgatcattgttttcgtccaattgagcgggaaagaatggcggcaaattctgttgctgatcacttcgctgttggctgcacacaatgagaaattgtttaccgtatttattgaa

SEQ ID NO: 70139 - DNA, 698 bp, Heterodera glycines; identical to SEQ ID NO: 42187
  misc_feature (640)..(640): n is a, c, g, or t
  misc_feature (681)..(682): n is a, c, g, or t
  Genomic contig location: Contig_ID=SeqID_42187; Location=1..698; Strand=+
  SCN-specific regions: Sequence locations=1-40,62-94,128-223,254 -262,284-643,667-698
  Gene Ontology: Mol. function=microtubule binding; Cellular component =spectrosome; Biological process=body morphogenesis (sensu Nematoda)

SEQ ID NO: 70140 - DNA, 392 bp, Heterodera glycines
  Genomic contig location: Contig_ID=SeqID_42189; Location=200..591; Strand=-
  SCN-specific regions: Sequence locations=1-392
atgcgagaagcaaagccggctgagttggaggatgttgtgagcgaaatgggcatttacggctcactgatcggtgaccagtcgaacggccgaattttgcacaacgcattcgatgggcacacaattcgaagcaaagtcagttgaatagagttagttatattattattagggctccaatttttaggcaaaaggctattttttcctgagctccccgtggccttaaacgtacgaaaaacatgcttttttgggctgttgttaagctacttttcgagttattagtgcctattttctaggcttttatttttagcgcctaaaaagcctaaaaaattttgaaaaagcctatttttgcctattttggcgttttgccgaaaatttgttaacaaaaatgcaataaa

SEQ ID NO: 70141 - DNA, 899 bp, Heterodera glycines
  Genomic contig location: Contig_ID=SeqID_42191; Location=5..903; Strand=+
  SCN-specific regions: Sequence locations=1-652,674-899
atggcgagcgatgcaatgaccagacgacggaccatttcgggtctcgaatacgaggatttttcgcagaacgaggggaaaatgctcctggaagaggaggacgagggtggtgaaggaggaggcgaactgcttggaggagtagtgggccgaagaaatgtggtccaagtcgaacacgagcatcatctgctcgaagggtcggcccgtctgaagggacagagaaaagggaaaagcgacggacggagcaccgatggccaatggcaccgattgccaattcgttacctgcagggcgcgttccctgcacaatgtgatgcctttctcaattgccgcgagcgaaaatttgatgtaatccttcgattggacagatcgcaacatcccttgacaaagtcgggatgatcactcagccattgttctcccgtggtgcatcgatttgtctctaatgcacttttaagcccaaacatcgctacgttctaaaagcatcccatcattgccctccccaaccattcgcttttccatcaaagtttttgtgctttgcggatagaagtgaagaagagagtggggggggggggagaagccaaaggaaaagcgaatccatcgcaatgcccaaaaagcaatgataaagaaagcattgatttggaataatgggaccaattaagcatgttaggcttccttttcggcattgtgcaccttctacgtcagtatttccgagcagagacatcagaatgggattgccgtcgtggtcagagaggaagccgtagccgcagtatttttccaaaatctgcgtaagattgtccaaatgcattttgactgagtgtgtatcggcactcacttccggcgcttcccaatttacaattttgtccagtccccatgcttttcggaacaccaaatccttccgaatgccctga

SEQ ID NO: 70142 - DNA, 1064 bp, Heterodera glycines
  Genomic contig location: Contig_ID=SeqID_42191; Location=1..1064; Strand=-
  SCN-specific regions: Sequence locations=1-387,409-1064
  Gene Ontology: Mol. function=protein carrier activity; Cellular component=cytoplasm; Biological process=regulation of cholesterol biosynthesis
caacatcagataaacgacttacgccaaattttggacatcagcttctgaagcaagaggtggacgaagcttatcttctcagatggctgaggtcaaaggaaggcaaatttgacgaggcggccgatgtgagggcttaggggggaaaacgcttaaaagatctttattcagggcattcggaaggatttggtgttccgaaaagcatggggactggacaaaattgtaaattgggaagcgccggaagtgagtgccgatacacactcagtcaaaatgcatttggacaatcttacgcagattttggaaaaatactgcggctacggcttcctctctgaccacgacggcaatcccattctgatgtctctgctcggaaatactgacgtagaaggtgcacaatgccgaaaaggaagcctaacatgcttaattggtcccattattccaaatcaatgctttctttatcattgctttttgggcattgcgatggattcgcttttcctttggcttctccccccccccccactctcttcttcacttctatccgcaaagcacaaaaactttgatggaaaagcgaatggttggggagggcaatgatgggatgcttttagaacgtagcgatgtttgggcttaaaagtgcattagagacaaatcgatgcaccacgggagaacaatggctgagtgatcatcccgactttgtcaagggatgttgcgatctgtccaatcgaaggattacatcaaattttcgctcgcggcaattgagaaaggcatcacattgtgcagggaacgcgccctgcaggtaacgaattggcaatcggtgccattggccatcggtgctccgtccgtcgcttttcccttttctctgtcccttcagacgggccgacccttcgagcagatgatgctcgtgttcgacttggaccacatttcttcggcccactactcctccaagcagttcgcctcctccttcaccaccctcgtcctcctcttccaggagcattttcccctcgttctgcgaaaaatcctcgtattcgagacccgaaatggtccgtcgtctggtcattgcatcgctcgccattttt

SEQ ID NO: 70143 - DNA, 1020 bp, Heterodera glycines
  Genomic contig location: Contig_ID=SeqID_9067; Location=72..1091; Strand=-
  SCN-specific regions: Sequence locations=1-711,733-879,902-957,1010 -1020
atggaccaaaaatcgcgaaatatggcaataaaatatggaccaaaaatcgcaaaatatggacataaaatggcaaaaatttcaaaatatggacataaatggcaaaaatgtcaaaatatggacataaatttttcaaaattgagtgcaaaatttcttcaaatttattggttgaaattgcatatgagatacatttccaaattttttgactcggtaaggcgctctgacaaagacggctttcgttttgcaattagtcggtcaacattcggaaattggtctcgaattttttcggcaattacactgtgttgcattagaatagggacgtttttttttagttttttttaaaaaaccttgaccgcttcccatgaaccaatcgatctgaaattttaactgtacgtagcaattctgaaaatattaagattttctaataaaagtttttttgaaaaatgccaaaatatggacataaaatatggacaaaatgccaaaatatggaaaaatatggaaatatggacataaatcgctaaatatggaaaaatatggaaaatatggatatagaaatccttcctagaagcttcaaaccaagctaaaaacatgtttttcgtgcgtttcaggcctcccacagtccaggaaaaaaatatggatttccatgtaattctattccctatctatgacttctttaattatattctcatctctttgtaagtgagttcaactttgttaaaggaaaagttcaacatttttgaccgacttgaaaagattcgaaacttgcacaagaagaaaataatctttgaattattaattattagagaatcgtcatctcaagtagataagagatacaattttaatttatcgaaaaactttcggctaaaaaaggtttactattcttggcaaatacaattattaaaatttaatctttgatgctaaagtaagaatcgaaaactattttatttaaagggttctaacaaaaattttattatagcaaattaaattattaagtataattcaatttaaataagatgaaataaa

SEQ ID NO: 70144 - DNA, 145 bp, Heterodera glycines
  Genomic contig location: Contig_ID=SeqID_9067; Location=799..943; Strand=+
  SCN-specific regions: Sequence locations=1-145
gtaattgccgaaaaaattcgagaccaatttccgaatgttgaccgactaattgcaaaacgaaagccgtctttgtcagagcgccttaccgagtcaaaaaatttggaaatgtatctcatatgcaatttcaaccaataaatttgaagaa

SEQ ID NO: 70145 - DNA, 735 bp, Heterodera glycines
  Genomic contig location: Contig_ID=SeqID_9067; Location=1194..1928; Strand=+
  SCN-specific regions: Sequence locations=1-56,116-283,348-390,609 -631,675-735
atgttttggttttttaaggttcttgtaacattttcttgacaatacacatttggatgaaaattatgaaattttttataagaatttaataaaaattatcaaaaaattaacttaaaatcttttaacaatgttgcaattgttaggttattttaattagtcgttgtttcaatattatttatattcttttctttattggtttttagttttctttacatttttttaatctcttgaaccaataggtgataatatgtccagtttcatgaacacaattgtgtatttaatcaagttataaattaaattcttttatttactatttttaaaagtgaatttatttaatctataataaaattcatttcttgagaataaacaattcctttgcaatataactttttgaaaatattatgaatttaaattaaaatccgtaattttttaattatcaatttcttaattttgtatattttatttttaaattaatgttaattaattaatttggcgaattttgttttaaattattttcataagaaaaactttttatttttatagaatgataatgtttatactatatttataaattatgataatttatgatttaattgaatcaaaattaatttgtatcattaatcatatttagaagtatttctttttagtttattctattttgttttagtttttttactcgttgttgcattatcattgaaagaaatataataatacaaaaaaagtgttatggataaaata

SEQ ID NO: 70146 - DNA, 696 bp, Heterodera glycines
  misc_feature (608)..(608): n is a, c, g, or t
  Genomic contig location: Contig_ID=SeqID_42192; Location=1..696; Strand=+
  SCN-specific regions: Sequence locations=1-487,512-537,582-696
ataaatctgggcacatcgattgggggggcctgcccagaaaaaaaaaaaatcgattttttcaagtgtctgttgggggtactcaaacaattagggggagcaaaaatccaacgcagaattaaagtacagtatatagggaagattctccggaaggattcggtctccccataaatcggggcgcatcggttcggggggtctgccccgaaagacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcagggggactgccccgaaaacaaaaataaatcgattttttcaagtgtccgtttggggtactcaaacaattatggggagcaaaaatccaacccagaattatagttcagaatagagggaagctattgcggaaggattcgacaaaaacagagagaagaaaacatagggggggggtttctgttttggggggaaagaaaaaaaaaaaaaaaaaccttaaggggaaaaaaaaaaaaagtttggggggcgaaaatttttcccaangaattaaagtacaggctatagggaagctattcccgaaggattcggtctccccataaatctgggcgcatcggttcggggggactgcccc

SEQ ID NO: 70147 - DNA, 67 bp, Heterodera glycines
  Genomic contig location: Contig_ID=SeqID_42193; Location=434..500; Strand=-
  SCN-specific regions: Sequence locations=1-67
atggtagcggaatggacggggtcggaggtattctcgacggaagagtctgtccaactgtgcccaaaag

SEQ ID NO: 70148 - DNA, 47 bp, Heterodera glycines
  misc_feature (22)..(22): n is a, c, g, or t
  Genomic contig location: Contig_ID=SeqID_42194; Location=883..929; Strand=+
  SCN-specific regions: Sequence locations=1-47
atgactgcaaatttggcatggncattggacgaatcatcaaaacccag

SEQ ID NO: 70149 - DNA, 176 bp, Heterodera glycines
  Genomic contig location: Contig_ID=SeqID_42197; Location=613..788; Strand=+
  SCN-specific regions: Sequence locations=1-176
ttattttgctgacgaattcactgagcacaaccattgcagaaacattgacctgaccatttacacgccgaacccgaagctgtccaacgcaagtgcgcacctttttcttggctacgacgagcaaattgcgaaggggccgtggtgctatgtggagaaggtatacggtagcaatttattcg

SEQ ID NO: 70150 - DNA, 416 bp, Heterodera glycines
  Genomic contig location: Contig_ID=SeqID_42199; Location=754..1169; Strand=-
  SCN-specific regions: Sequence locations=1-97,120-189,213-312,373-416
atggtttttgaacgaacttttcagggtgaaatcgtcgtcaaatgccaacgccggttcgaaggtgaacgattgtttgccctcgtaagtgttgtttcgcttaaaatgatatttctattaatttattgtttcgtggtagggttgtgaaaatccgacatttttagcctttttcgggatatccccgaccacgcgccactttcaaccccctccccaacatgaaatcctgcgactcgggggagggtgttatgtcgttgctaaaagtgcaaaaatgggcgattcctagaaacgtgcaaaaatcaaaaatcaagtttttcctataatttttatcaaatttttaaaattataatatattaaaatttaattatgtatattaatgctcaaatgaacattcttctattagtttttatatctcgaataaa

SEQ ID NO: 70151 - DNA, 563 bp, Heterodera glycines
  misc_feature (471)..(471): n is a, c, g, or t
  misc_feature (500)..(500): n is a, c, g, or t
  misc_feature (518)..(518): n is a, c, g, or t
  misc_feature (521)..(521): n is a, c, g, or t
  misc_feature (536)..(536): n is a, c, g, or t
  misc_feature (543)..(543): n is a, c, g, or t
  misc_feature (549)..(549): n is a, c, g, or t
  misc_feature (560)..(560): n is a, c, g, or t
  Genomic contig location: Contig_ID=SeqID_42200; Location=142..704; Strand=-
  SCN-specific regions: Sequence locations=1-207,242-342,376-443,465-525
atgcgccgggacgtcgcatctgtgggcccgggggagactgatcagaattgggggccgattcttgaatggacgggggcatgtgagaagaagggatttgatttaaatttggcgttccgtctgatgttcattgtccattcatatcccatttatcgatttaacctttgacccagtcaacatattcccccgcccgtttcccatattcattcgtaattgttttattattttctccatgttctctcctttcccaatccgtccctcctccaaataaatatatattatttcctacttgttcccaaataaataattattctccaagtccatcgccaattgactaagtgaaccaaaccctgcaaaaacccaaacccgagccccaacggccctccctcttccctcattttcctcactccttaccaacttatttatttcatttccttaccaaaaattttctaaaaatctttctaatatatttcnacaatacaaaaaatattttcaataattcnatacttatcatcaattanaantcactttattttatntttaatnttacanataataaaatntaa

SEQ ID NO: 70152 - DNA, 312 bp, Heterodera glycines
  Genomic contig location: Contig_ID=SeqID_9068; Location=833..1144; Strand=-
  SCN-specific regions: Sequence locations=1-312
atgcatttggcacttggactttcacgcacgaataacagccttgaaggctggcatgcaatttggaatgcccatcttaaaggaaatcagcgactcagcggttttgtccggaaaatgattgaagaagatgatatgtggtcccagcgaattattgattatcagattgcgcctgctgatggaataagggggccacacgcagcaagaaaggggaaatatgtcagacaagacaacaatttaaatgctcttttacaggacattggaaaccgtgatccgcttgaatatcttcgggcctgtgcataccatttgcacttttga

SEQ ID NO: 70153 - DNA, 782 bp, Heterodera glycines
  Genomic contig location: Contig_ID=SeqID_9069; Location=122..903; Strand=+
  SCN-specific regions: Sequence locations=1-191,213-337,362-744,779-782
gtcttgttggcggctttgttctgtctctgcttgcccagtggaccgctccgacaatgggcagcacatcgatcggactgcttttcagtctctcgaggtggattctctatcggtttttccgtccgaatcccgagagtcccgacattttttaacgtccgagtctaaaccccaagagttatgaatggatggacatttttaacattttcaaacaatttttgttttagaaaaaaataaagcaattttattgtctgtttttgaatgccttgcggatttcagctaaataccattttcggcatcttaattttcagtaatttctttctcttccatttacgtccctttttccaagggcatttccttgaaaattttatattacatggaataagtataacccttttttattgtcttcataaagtatcttttttttagtttcataattttttcctttgtccttgaaagtcattttatctgtccttgaaaaccagttttctgatgctcatgttcctccccccatgttcaaacaacaattctgccttttttactgaccacttgtctcctattcttttcagtttttcgtgccactttttagtgcaatttcgcacaatatgccaatctcagaaatctgtaaacaaaatttctcggcacttttagccacgccgccgttttggtcggtgccgtctgttcggccatcgaactgtacgaaggggtgaagctgaagaatcgctgattactgactaatcgatcagaaacaggcaaaaaggacaaaaaggaagaagaagaagcttctc

SEQ ID NO: 70154 - DNA, 550 bp, Heterodera glycines
  Genomic contig location: Contig_ID=SeqID_42203; Location=281..830; Strand=+
  SCN-specific regions: Sequence locations=1-69,91-470,492-550
atgcttagcaactttttttgcggcgaaattaaaaagttacctgttccgactgccgccagtctgattctgctccttgtccttctttccgtcattgcattagttgtcatcgtcacactggtgatttgttttatacaagaaaatgaattgcgtttcgccccttttagggagtgcttttctacaaaaaatataaacagacgcgccgcacaaaggctgtctcttcaaacaaaagtgaaactccggaagtgccttcggacttggctgacgaagcggcggagtcttcggactctgatgaaggccgtggtggagtttcgacggcccctcccgacatggaatcagtagtggctgacgaagcggcggagtttttggactttgatgagggccgtggtggagtttcgacggcccctcccgacttggaatcaggacgcaaataatgccatgatggaatttaggcagtcaatattgtattgttgtatatattaagtggaagtggaaactatctataactgtctgtgactgttcctagcatcataattctgactgtatcgcccga

SEQ ID NO: 70155 - DNA, 296 bp, Heterodera glycines
  Genomic contig location: Contig_ID=SeqID_42206; Location=659..954; Strand=+
  SCN-specific regions: Sequence locations=1-22,44-61,97-140,174-296
atgtctgccaacaacggaacattatttgacaatcagctgaccattcaaaaggtggtaatggaaaaataaaaatattattttaaattaatttattttcctaaaatttagaacgattcctccgcctccacgtttgtaagcacattaaataatataaatttttatattttaaatttccataaatttcacagctgattattggactctccgtggttggcattgtgatattgattgccattgccgttttattatgctggctgattttgatcattcgccggaaatgtaggatattaaattaa

SEQ ID NO: 70156 - DNA, 861 bp, Heterodera glycines
  Genomic contig location: Contig_ID=SeqID_42210; Location=1..861; Strand=-
  SCN-specific regions: Sequence locations=1-861
  Gene Ontology: Mol. function=ribosome receptor activity; Cellular component=cytoplasm; Biological process=signal transduction
aacactgggactcaaatgtgcggcattctaaacactgggactcaaatctgcggcattccaaacactgggactcaaatctccggcattccaaacactgggactcaaatctgcggcattctaaacactgggactcaaatctgcggcattccaaacactgggactcaaatctccggcattccaaacactgggactcaaatctccggcattccaaacactgggactcaaatctccggcattccaaacactgggactcaaatctgcggcattctaaacactgggactcaaatctgcggcattccaaacactgggactcaaatctccggcattccaaacactgggactcaaatctgcggcattctaaacactgggactcaaatctgcggcattccaaacactgggactcaaatctccggcattccaaacactgggactcaaatctccggcattccaaacactgggactcaaatctccggcattccaaacactgggactcaaatctgcggcattctaaacactgggactcaaatctgcggcattccaaacactgggactcaaatctccggcattccaaacactgggactcaaatctgcggcattctaaacattgggactcaacccaccagcatttcaatctctgggactcaattctccggcattccaaacactgggactcaaatctccggcattccaatcactgggactcaaatctccggcattccaaacactgcgactcaaatctccggcattccaaacactgggactcaaatctgcggcattctaaacactgggactcaacccccaacttttcatgacattcaatctctaggactcaacccaccagcatttcaatctctgggactc

SEQ ID NO: 70157 - DNA, 1417 bp, Heterodera glycines
  Genomic contig location: Contig_ID=SeqID_9072; Location=716..2132; Strand=+
  SCN-specific regions: Sequence locations=1-445,467-634,657-657,682 -1098,1136-1417
  Gene Ontology: Mol. function=protein binding
atgctcagcttcatttacgcggacgatgtcagcggactgaacggagacaacgcaatggcagtgctttacgcgggtgaaaaatttagagtatggacccgaattcgtaaaatgtcgaaattataaaattgggtttggtttttgttagaattcagggtttggaattggctaaactaacgtcaaattcgtgttcaacggccccgaaaacaaaccatagaaacaccttttcagtgacttttgaaagttgaaattttcagaaatcatcgacagtattacccaaaacagattaaatgcatgaaaaaaaactaatattgtattatgcatatgggtggtatcatttttttgaaatttactttaaaattttttgtccttttttaatcaccgaatatttttagccagaaaatacaacattttggggggggggggggctgatccgtcgatgtatgcaaattccaattccaaatttgtccaatgttttcttggcccttgttcagacgcgtcttttcgactttgaggtgggaaaacgatgatttatcttcttaatttatgcagagttcccaagttttttgaattaagcataaacagaacaaatcatttttaaaagtgagcctgtaggctttacaagagaaaaatttcaatttttaatgaaatttgattcctttaaaaaatttctagccctcaaaattcagaaaatcatcaaacttgggaggaataaattctgaatatgagtattatataacacattgtagaattttgcccatcaatgtttgcgttacatttgtcaaaatgccggccaattgtttgaatctgaggaatttttgcaaattgatcagaatttgctgtgcgaattattcgagaatgatcagttggtggtcagaaatgaatttgaactttggcaagctgtaatttttaattttttggtattttaatttatttgtttgtttttcgtttaggcactccgttgggccgacgaaaaatgtcgtcaaaatgccatcgaatgttctgctggaaaccaacgttgtcagcttggcccggcactgttcaaaattcgtttcccgctaattccagcaattgattttaccacaagcattggtaacaaacaatttttaaaattgataaaaagaaatttatttattttgcagttccttctggcgttttgacaaacgatgaattggtctccgtttatcagttccattcccacccgaatctccgcgatgttcccgggcttcgaccattggaatttccatggcatgaacgaattgaaggcaacagagggatcctggcgatggaaattgagaaattttctaaatttgcacgagagagagtggggagtagccgattcagtgatgctgtacaaacgaagggatttgaatggaaaatattggcaatgctaatttgtaagcgcaacgaaaagcaatga

SEQ ID NO: 70158 - DNA, 1423 bp, Heterodera glycines
  Genomic contig location: Contig_ID=SeqID_9072; Location=2224..3646; Strand=+
  SCN-specific regions: Sequence locations=1-11,33-466,488-546,568 -1105,1127-1191,1213-1215,1237-1321,1343-1369,1391-1423
atggaaattggagttgcaaatgttctatcacttatcgaattgtttcccaaaagatcggaacggaggatttgtcgcagcaaaaatgtgaccatgtttttaacaaggaagagaacgactggggctttgcaactttcattctttttacggtgagtgacagcaaaatcagagttgcgatcgaagtattgaaaaaactcagtttagtacagaaaactcattcgttaaatcaccataatttgcatccaaatcctaaaacgaaacgttaaaaatcgcgcagtcgcggaaaaatacggtggtcacgctccatccctgttttgcaccaattttcaaaaaaaaattagtaaaaaccccaaaatgaggtgcaaatatcgtaactctagccaaactccttttctcatgaaatatatgggtcggggtcggggggggggggtcacttcggcgcggaccatttcggcgccgcaaattttgaaatgctataacttttttatttgtcagttaactttagccaatctggcatcatttgaaagctctatgtgtgctctatattcacatgtaaaatagaaataaatgattcaaaaataaaaaagttatggcacacggcgccgaaaaagccaagaaaaagtcaatttttgaggttttttggccataacttttttgtaaactgactacattttttgaaattttgcaatctaatagagaatctcaagagctatcgaatattaacaaaaatatttaatttggttgataatgaaaaaagttgttagcaacggcgccgaaaaggccggcgccgaagtgggcggttcccaaataaattgagaattaaggaattgatggagccgagcaaaggattttacaacaaaaatgaagacaaagtgaagctggccattgattttacggtggaataagaagggaaaaagcggaaattggccgacggataagcccatccatccaatcactcattttctgttgattactttgattaccatttacaaaacaaaataatatgtacaataaatggatattggttttttccaattgttattttttgtgtttttttataaaagtttctccaatgaataagcatttcttcccaatgtcaacaatagacaatttgttcattcattttaatttaaacgaaaaactgtattttttttgacatttaaaatcaggtgtaccacttcaatttttaaaccatgttttatatgtaaaatcattgcaaattcaaaatttaaatttattacttttttggcaaaactgccgattgttcgttccctccctctcctttttggcataagaatttttgtattaaaaagtctgattttttagctgtttttgggtcactgattacgaatatggaattcattttgttatatttaagaaattgtggaaaagaattcaaacaggaagcgaaaatgcaaaattttaa

SEQ ID NO: 70159 - DNA, 590 bp, Heterodera glycines
  Genomic contig location: Contig_ID=SeqID_9073; Location=755..1344; Strand=-
  SCN-specific regions: Sequence locations=1-31,54-178,200-510,533-590
atgacaaaagctgtaatccgcgtttcatttgccttttattttgctaatattttggaatttttcttccctcaaaatttcattcggtggcattttgacggcacttttcatcggcctaaaggtgtgtcaaatgaaaaataaacaataataattacaacaaaataaatgttaaaattacagctttccaaattgaaaattcattgctgatcaccaaaggagtacgatcaaataatatacagagcaaatctaatcaatttgcaaaaattcctcagattcgaataattggccggcattttgacaatgtgactcaaacatttataggccaaatctctttagttgcccattttttgtgcctatttaatgcctttgcgattttttctgcctttttaggtgccaatttcgcgcttttttgttctaaagaacgaaaccttaatcattaagcctatagatttcttaattattcagttaaatttccagaaatttttttattaaaaaacttagcgacaaaaatagtttttgatttttaaaattatgtatctcattcccatttttagcacctattttggtagtttttagaatcaggggcaaataaa

SEQ ID NO: 70160 - DNA, 410 bp, Heterodera glycines
  Genomic contig location: Contig_ID=SeqID_9073; Location=1984..2393; Strand=+
  SCN-specific regions: Sequence locations=1-27,63-346,382-410
atgcaaagcctgaaagtgagaaaactgaataatataaattgttattatttgttattatatttcttgattaaggatcaaaaattaatccgatcggttttcttggtaatattttcttactaaaccttttatattattaaatttaggcaatcaaacaaatccacaggccaatagtacggaaaattgtaaaattaatattaatcggatttattttaaaaaagttcagtttctcaaccgatgaaaaatgcaaagcccaaaagtgagaaacacaaaaatgtggaaattacattaataatatgtattgctttaggatcaaaaattaatccgatcggttttcttggtaacattgttttttttattaaagattttatattattaaatttaggcaatcatacaaatccacaggccaatag

SEQ ID NO: 70161 - DNA, 391 bp, Heterodera glycines
  Genomic contig location: Contig_ID=SeqID_9073; Location=2457..2847; Strand=+
  SCN-specific regions: Sequence locations=1-112,148-271,294-351
atgaaaaatgcaaagcccaaaagtgagaaacacaaaaatgtggaaattacattaataatatgtattgctttaggatcaaaaattaatccgatcggttttcttggtaacattgttttttttattaaagattttatattattaaatttaggcaatcatacaaatccacaggccaatagtacggaaaattgtaaaattaatattttaatcggattaattaaaaaaacagtttctcaaccgatgaaaaatgcaaagcccaaaaatgagaaaaatgaaaaattattattatattttaagaaaacggatatgttccacctccaccgcttccggtcggctggtagggtcttccgccagtttttgtgtaatttttattttgactgaaatttattggaaa

SEQ ID NO: 70162 - DNA, 1469 bp, Heterodera glycines
  misc_feature (31)..(31): n is a, c, g, or t
  Genomic contig location: Contig_ID=SeqID_42220; Location=26..1494; Strand=-
  SCN-specific regions: Sequence locations=1-100,122-386,408-510,532 -796,818-869,892-1176,1202-1232,1254-1282,1305-1422,1448-1469
atgcaattggcgtcggagttggtgccaaaanagccaaaagataaaacaggaaaaaactaccaaaaattaaaaagtcttatagtgaagttcaaaaaaagtaaaagtgaaaattttaatcaaaacaatcagcaagaaaattttgaaggtttgtgacaatattaatgggttaattaagacgtaaacgatgccctaattatttaaagaagcgaatttaatgaacaaagcgacaaacgatgttatttctgaaaatgatacaaacaccggacgagaacgaatttcaaaacagcagcaggtaaatgaattaaaatattatggagagaaaaattggaaatatttttgttagcgaatggaacaacagcaaacattagcaacaaacagcagaatcggacagcaaataaattttaacttgcgcaagttttcatcactcaatggcatgcattacggtccaattaagtcactttctttatcaaaaaaaaatatttttttgttcataaaaaatgtcaaaataggttttttcaaaattattgataaaaattaatggtactttcgggttttgtgtcaacaaaatttttctctttgttaaattgattttaaattaataaaaagtcgtttctatgggctttcggggtcgtagaacccgaatattatgtccgttttggcccatttcgaactccgaacccggattcgaacaattatcaaaattcaatttttttttcaaaaatgctttcccacttcattgccgactaatttccttatcagcaaattgcttcctacctacacccacacccttttccctcatttataatgcagagaaaataaaaacagaaatatttgaaggacgaaagagcaacaatcaaacgcaacaggaaaatacaaaatttaatttaaaatcgccaattgaaagcaaaaaaacaaattttaataaagatgttcataacggggaagtatcgcaaattggaaatataaacgttcataaaagggaagagaaaaaaaccggaaacataaatgttgcgcaacaaaacgacgatgttggtcaaaacacaggaagacaaaacactaatacgcaaccaaacgacgatgttggtcaaaacacaggaagacaaaacacaaatgttcataacgtggaacaaacaaaaaatgacacaggaagacaaaacacttatgttcataacgtggaacaaacaaaaaatgaaaacacaaaccttgcgcaaccaaacgacgatgttggtcacaacacagaaagccaaatcactaatacacaaccaaacgacgatgttggtcaaaacacagaaagccaaatcactaatacgcaaccaaacgacgatgttggtcaaaacacaggaagacaaaacacaaatgttcataacgtggaacaaacaaaaaatgacacaggaagacaaaacacttatgttcataacgtggaacaaacaaaaaatgaaaacacaaaccttgcgcaaccaaacgacgat

SEQ ID NO: 70163 - DNA, 159 bp, Heterodera glycines
  Genomic contig location: Contig_ID=SeqID_1221; Location=77..235; Strand=-
  SCN-specific regions: Sequence locations=1-159
cctcccgacaacaaaaatagcgtgcaaactctgcagcagctgatcgcctcgcaaaaggacccaaatgcctttgtttttggcacaaatatggcgggccgagtgggccaatggctgacgaagcgttcctttgagaaaacgatggacaccgaactgcgcagt

SEQ ID NO: 70164 - DNA, 424 bp, Heterodera glycines
  Genomic contig location: Contig_ID=SeqID_1222; Location=296..719; Strand=-
  SCN-specific regions: Sequence locations=1-204,226-424
gatggtcatgccgatgctgacattttggccaatgctgatgttgtcatcatgaacaacgtgttcacattctttgctgaccacgctgaacaggtgggatatttttaaaaaaaaatttgcgggatttttttttttgatttttcctctctcattcagtgtgactaatgataaatttttttttattttctcactaccaatttttcaatccttaatttttctcccttcgttagaattctttagttttttttaaatgttgttggatgaaaatttctacccccccctctctaaaaaggtttcgtgttggcaacatttgcgtgcccatttgcgtcctggcactctgttgttgcactcgccatcgctggagttggtcactgcccatctctgtccgtcggcacttggctttgccttcgacgattggttacaagcg

SEQ ID NO: 70165 - DNA, 282 bp, Heterodera glycines
  Genomic contig location: Contig_ID=SeqID_1224; Location=31..312; Strand=-
  SCN-specific regions: Sequence locations=1-282
atgaacgacgctaatggcaaattggaggcggcacagaaacaatttgaggcaattttggccagcttttctcccaccgccgatggcaatgaacaatcgcagcagcagaaggagcagtttttgcgatgggttcgccaacggttgcgccgtgaaaatgcgatgccaacaaaagacacactgcagcacagtgacaaacggcatccaacggatttgtcggtgcgcaagcaacttggacgtatcgcaaaacgcctgcgcgaattggtacacatgtcaatgtgcctgtag

SEQ ID NO: 70166 - DNA, 558 bp, Heterodera glycines
  Genomic contig location: Contig_ID=SeqID_1224; Location=468..1025; Strand=-
  SCN-specific regions: Sequence locations=1-168,190-267,289-421,443-558
atggttaacgtgaagaagggcaccgtcattcgttgtgacccggcaatgcgacagttcctgaagcatttggacgagacacgggctctgggcaggccgttcatcgtcaaggtggttgagagatcgtttttcgtgaaatatttcattctccattttattaaaattttcccatttttttttttttttttttttgaggcaattgtattgtaggtgttcaatccagtttctttagccatcaattttttcttcataaaggcccacatttgtaccaaacaaaagctttgtctaaaattttttttctttaattcaattctgagccattcttgaaaagctttcgttcggttgatgccaagaaagctgtcattgaccaaataagaaaaaattggaggcctaaaagtcgaattttgaaaaagggtttgagtttttgtcattttttaatttatcccgttttgacaggaccttgacgagttttgtttgttcgtggagcgtgacattgtgccaatgttggagcagagaatggatgcccttatggatgctttaacacccgacactcaaacataa

SEQ ID NO: 70167 - DNA, 776 bp, Heterodera glycines
  Genomic contig location: Contig_ID=SeqID_1225; Location=77..852; Strand=-
  SCN-specific regions: Sequence locations=1-150,175-585,607-672,698-776
  Gene Ontology: Mol. function=15-hydroxyprostaglandin dehydrogenase (NAD+) activity; Cellular component=mitochondrion
atgtgccgtgcaatgttgcgcaacgtgcaaattgttgtgctggacgaggccaccgccaacgtggacatgtaagagatgtagtggctttgttaactggaataaaagatttcttgtcaggagcagcccgtacctccccccccccctgacactcgaaaaatctttaaaaattttcctgacagaatttttctaaaatttttttttttggaaattatgaatttctaaaaattccccaaaattttctgttttttttatttggtgatatggagcggaaaatggtggtgggatgtaagttaccttatccatgtctaaaatccgggggtttttgaacttgaccaagataaagttttttttttgacccatccggttaaatttttctattttccgtcatggttctattatttattactagaaaaaaaaattccagtcaaacggacgaacgcattcaacagtcgattcgcaaagaatttgctgatcgcacagtgttggtgatcacacatcggctgaccaacgtggtcactggccttggccgtgtgttgagcatggctgacggaaaggtgaaaaatttatacgcaacgaattttgaaaaaatcgaattgccaacccctcagtttttccaattattttttttagaaaatcacaaaaaaaaaattttgtttttatagctttccgatgacaacatcaccaccaccaccaaccatcgtccaacttcaacgacatcaacggaattgccgaaaattgtggtggacgaagcgccaccgccaccctcctcaccatcg

SEQ ID NO: 70168 - DNA, 663 bp, Heterodera glycines
  Genomic contig location: Contig_ID=SeqID_9074; Location=544..1206; Strand=-
  SCN-specific regions: Sequence locations=1-20,44-138,160-261,350-663
atgttttattttattgccacatatatttatttaatttttttttcttcatttgataaatcaattcgaaaaatcgaaaatttcgtgattattctggtttgtccggatagagaggtaaaataaaaactgaaaatcattagaatttaatattttaaatctaattctatcgaatatttagataatttcttatttcacatatgaatttgtcaatttttaataccattaattaggttttaattgtgctattataatgctttactaatctaattaattcataaattttctttaacaaaatttaaaaataaatttaaatatatattaataagtatttaaatatgaatttattaaattagttcattaattacgacttttgcccatccatttattatcattatttaaattctttgcctaattactccaatttttagttgggtgccggtcgtgttggccattcaggcactgctgttttggctgcccaattggctatggaatatgctgcacaagcagacggcgatcaatgcgcgaagtgttgtgcaggaggcgggcaaaagtcgcgtactgatcggcgctgaacgggacaaagaaattgaagcgttggctggctacatcagcgattccgtaaatgatcgggggaaaatgccaaaaattgaaaatgtttcaaataaa

SEQ ID NO: 70169 - DNA, 1237 bp, Heterodera glycines
  misc_feature (373)..(373): n is a, c, g, or t
  Genomic contig location: Contig_ID=SeqID_9074; Location=1247..2483; Strand=+
  SCN-specific regions: Sequence locations=1-13,35-214,238-249,389 -563,588-636,659-708,731-930,973-989,1030-1171,1202-1237
atggatttgtggcttttaatatttattatattttgcttattttatggaagtaaattcggcaaaatccgatcaaattttgacgaaatattcggcaacggatgggagaaaaatgaaaatgaaaaaaaaatgattaaaatggaacaaattgatcataatgaaagctcagcagctgatcaaataggtggagaaaatttaaatggtcgaattgatcaacaaaaaagagaaacaattcaaaaatttgaagcaattaaagaaaggttgaagcaaaaaggaaaatatgaatggaaaaagaataacaaaattgagcaaaaaattgcaaaattattaggcacaaatcgcgacaaaatatacaaatggaaaaaagaattaaatntaaataaaaataaaattttttatgaacaaaaaaagaaagaattcattgaacgaattgatgaatttaagtatttatatggccaaggcaaacagaaagaatttgtgaaggaattgggcatttctaatatgacatttcgtaaatggaaaaaagaattaatgccaaattgtcataaaagtaagtgaatttttggtttttattttaattttatatttaagcaaaaaacaaatattccaatgatgacaaattgaaaaagatgaagcaatatttcaaaattaaagaaggaaatccaaaaattagtgacgaaataattgctaagaaattgggaattgaaagagcaacactgatcagatggaaaaagaaatttgcttgaattcaatgacatgtgaagtgaattttgctcttgacatcagggctgcacgcaattacggattgcggattacggaaattacggggttttgggagttacggattacgggttacggatttttgggatttttccgtaattttgatccgtaatttgacttttggattattttttcgagacgatttcttgtacgattatttttataaaaaacaaagttttctattttttatttaaagggctacccgtatttcgatttatttaagaattaaaatagatttataattttttatttgttgttgttaaggctatttgggtagttcgcctagaaaatagaggcatcacttttttgtcacacctatttttcacgcattttatgaaaattcataaaaccttagccaggtgaggggaggaattccccccttcccccgcccgaaatgaaaaattaaaaatttttacaggaaaaattgggacttttaaattttttttgtcgatttttctta

SEQ ID NO: 70170 - DNA, 81 bp, Heterodera glycines; identical to SEQ ID NO: 58971
  Genomic contig location: Contig_ID=SeqID_42222; Location=570..650; Strand=-
  SCN-specific regions: Sequence locations=1-13,47-81

SEQ ID NO: 70171 - DNA, 657 bp, Heterodera glycines
  misc_feature (24)..(24): n is a, c, g, or t
  misc_feature (66)..(66): n is a, c, g, or t
  misc_feature (126)..(126): n is a, c, g, or t
  Genomic contig location: Contig_ID=SeqID_42224; Location=328..984; Strand=-
  SCN-specific regions: Sequence locations=1-657
gttttcggggcagtccccccgaanccgatgcgcccagatttatggggagaccgaatcctttcggangtagcttccctatagcctgtactttaattctgcgttggatttttgctgcccataattgtntgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgttccccataaatgtttgagtaccccaaacggacacttgaaaaaatcgatttttttgttttaggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttt

SEQ ID NO: 70172 - DNA, 470 bp, Heterodera glycines
  Genomic contig location: Contig_ID=SeqID_42225; Location=141..610; Strand=-
  SCN-specific regions: Sequence locations=1-470
atggcttttgtcggtttttttcggctacttattggtcatgtgcttatcattgaacgatttattgcaacaatgcgctcaaattcatacgaaacagttccaaaatgcgtattcatttgtacatggttgagtattacggtaatggaactctaattgataaataaatacagtacgtactaattagcctaaaattttttaattatcaatcgctttgacaaacacaataataaagcagtggtcggggacatttacgcaatttaatttgatcagctcatcaatttcgacaattttaagcttgttggaatatttggtaaaaaaatatattagacaatttcaaatcgaatttttagatgattgtcataattggttattataatcggagaatatataatcatcaaattgagaaagcagcggcaaacaattatcacattggacagcgatatcaagaaaatataaaatgtcttaagaattaa

SEQ ID NO: 70173 - DNA, 661 bp, Heterodera glycines
  misc_feature (8)..(8): n is a, c, g, or t
  Genomic contig location: Contig_ID=SeqID_42225; Location=790..1450; Strand=-
  SCN-specific regions: Sequence locations=1-287,309-332,354-410,443 -561,583-588
atgccacncaccagggatgttgcaagtctcgcttatcgcttacttgctattttttttggacttctcgttcttgcattctggttcttgtattttaatttggtagcgttttaaatgcttttatcgaatttggtatttgattatgctctagcaacacccctgccatccatccctctctctattagtgccatcaaaaattttaattgctttttttaaccaaatttattttttaattcaaattgtaggtataattcaaagaaattaataaattgtgaaaatcttttaacagattttgttcaaatgacattcccatccgtcacagtcgacgtttttgcttatatattttccttttttgaactgttcacctatggcattgtgttggccattgcttttttgaatttggcagttatttgtccaaccaaaattttacatatcaacatgaaaagcattctgatcagtcatagtgttgcgcttatcgtttacctctttggccgagcaggaattattgccgaaaaattcctatcaaataatcaatttgtatcgacaaatgtcgtccttaaggtctgaaaaattattgttgttttttatgtcaaaaaaagtaattttattttaaatttctcataaaaaatcattaaaattaaattttgtttatttaactaataaa

SEQ ID NO: 70174 - DNA, 117 bp, Heterodera glycines
  misc_feature (25)..(26): n is a, c, g, or t
  Genomic contig location: Contig_ID=SeqID_42226; Location=21..137; Strand=+
  SCN-specific regions: Sequence locations=1-117
tgtccgtttggggtactcaacattnnatgggagcaaaaatccaacgcagaattaagtacaggctatagggaagctattcccgaaggattcggtctccccataaatctgggcgcatcg

SEQ ID NO: 70175 - DNA, 227 bp, Heterodera glycines
  Genomic contig location: Contig_ID=SeqID_42228; Location=40..266; Strand=-
  SCN-specific regions: Sequence locations=1-175,197-227
atgccgtcatcccccggggtgtcgacacgctgctgcacatcccggccaagctgcccgaccggctgttccccaccctctacgtgggcgagtcggcacagaccgggctgtacgcgttgcccgcctttgtggacgaacggaccagcacattggcacccaaatatctgggtcccccgctgctggaggaagcaaagccggcgaccgacggcacagcggaagtgcggcgacag

SEQ ID NO: 70176 - DNA, 98 bp, Heterodera glycines
  Genomic contig location: Contig_ID=SeqID_42230; Location=228..325; Strand=+
  SCN-specific regions: Sequence locations=1-98
gttccatccaatgcgacaaacgatgcctttctgtgcctagaccagccgtcgtcattgttgaccgacttggacgacgtttcgtgcgaccctcagcagca

SEQ ID NO: 70177 - DNA, 327 bp, Heterodera glycines
  Genomic contig location: Contig_ID=SeqID_42231; Location=663..989; Strand=-
  SCN-specific regions: Sequence locations=1-327
atgatcagaagaagtgcaacagtgattaaaagaggtgcaacaatgatcagaagaagtgcaacagtgattaaaagaggtacaacagtgatcagaagaggtacaactgtgattaaaagaggtacaacagtgatcagaagaggtacaactgtgatcaaaagaggtacaactgtgatcagaagaggtacaactgtgattaaaagaggtacaacagtgatcagaagaggtgcaacaatgattagaagaagtgcaacagtgattaaaagaggtactacagtgatcagaagaggtacaactgtgattaaaagaggtacaactgtgattgaagag

SEQ ID NO: 70178 - DNA, 2207 bp, Heterodera glycines
  Genomic contig location: Contig_ID=SeqID_9076; Location=12..2218; Strand=-
  SCN-specific regions: Sequence locations=1-152,200-368,442-622,645 -850,872-894,916-945,967-1080,1114-1243,1278-1439,1461-1461,1490 -1675,1704-2207
  Gene Ontology: Biological process=body morphogenesis (sensu Nematoda)
gaaagacacatgtataactttcatgcttgacaccaacaaaacggcggaagaaggcattgaagtgattgttgacggtcgtaaaagttggtccaaaattgggaaaactttggcaaaatggcaggaactttcgctgggctggaacagtgtttgtgtatataataaataattggttaattaataatttattttttaaataaaagcccctcggggctctattaatccatttccatttattttacagaatggcacggccgcccatgaacttttacatgcactcgctatttaccatgaacatcagcgtgacgacgcattttactttatcaaagtcaatccaatttgcagaatggacggtgttggtgtacatatacatataattaatttataattatggatgacatttactaattagtttatttaatattttttatttttcataatattgaagaattatcaaccgttcaataaaaccgacaattttggcttcccctacgactttgactctgtgatgcaatacccggctcatattgataaacaagggtaattaatatagtgtcacgggatcgggaccaaaacacggacaactgagtaccgaagtcctggttttgaccagttatgaccgggaccgggaaattcccggggtttttcccgctttacccagccaaaaagtcccggttttgccaaagttcccggtcccgtgacgctctagtaattaatttattatctatgagagaatgcattaaattatacaaaaaaacattttttcattttaatgggttttttaataaaaaataacaataagcaatgttccaaggatacaacaaaattccaagttcctgacctgtattttcgcgcttcaaaaataactgaaaattctttacattgtgagcactgatttaaaacttagagaattaaaaaatctgagctgtcttaaatcgaatttctttggtttccagctattattacctcatcacaatgggccgtttttatcaacgaacaattggccaagataaaaggctttcattcaaagattcagcaataatcaatcacatgtactgtaaaggtgtggttactgtaaggctgaaatttaaaatatatatttttttgtttttatttgggtacagattactgtaatggaacgaaaaacgagtgccaaaatggaggctacccaagtccaaaacaatgcaatgaatgcctttgtccagaaggttatgctggtgcacattgcgaccagttggcacagagttagtgcaaaaatataaatgaaaaattaggaaactcatgaaattttaaaaatttgttttctcgatagaacaataaaatatgtctttgttttttttattatgaatttttgcgttaacaattaattttttggactagtatgatgataaagacagagaattgaagattgttgtgacaaactaagacaaaattttgaatcattattgttttttgttgaatttctaaaataaatttttatgaaaaaatttttggtgcaaaacttatgaaagatttcatattggcaattgtatagatcagaattgcgttgatctgagcggcacgcccaaccatttggaggcggattggaaaattcgtgaactgaagcccaaattaaagtgtacgagtgccgaaatgtgcagctgccattggcaaattaaggcaaaaaatcggagaaatgattaattttataaaaacaataattttaagccaaaaaagggtgaaaaagcgatcatcaaactcatcaatttggatgagaaggcactcagttgcgccgggatttgcggcacgaaccatgtcgagatcaactaccgtaaagacaaacgagcacgcggtactgtaatcattcggccagcaaacaaaatttggtggcggaaaaatccgaaacaaacagactttttaaaaccaacaaaaaaccataacattctataccgtagaaaacggtgcagtcgcccaattttctcccaccggtccggcttacaattagccccccccccccccaaaaaaaaatcggaaattttcatgcatgcagaaaatgcctaaaagttcgtttccaatttcaggtgccctgctttgctgtgccaatggcatccttcagcaaaatatttcgcgcaattggatcgaggcggaggaagcggacgtggacataatcatttctgctcgtttcgccaccactgatgctacggaattatttgcgctcacctatgagactg

SEQ ID NO: 70179 - DNA, 290 bp, Heterodera glycines
  Genomic contig location: Contig_ID=SeqID_9077; Location=100..389; Strand=+
  SCN-specific regions: Sequence locations=1-211,233-290
gctaatagagaaaaagctgggatattgaatggtatcaagaatgtaaaatttgattgccaattaagcaatgttatgccatgttttgtggaaaaattcgttaaaattggcggattttatgaaacgacctagcacccttttttacacttaatttgtctaaaaattaggtaaaaaaagttttaaaaaattatatcatcatcgggattcaaatcccgattttatggggattccaatcctgaaaagtattttctcacacgtaaatatcgggatgttaaatattaattctttgcgaa

SEQ ID NO: 70180 - DNA, 304 bp, Heterodera glycines; identical to SEQ ID NO: 51570
  Genomic contig location: Contig_ID=SeqID_42232; Location=248..551; Strand=-
  SCN-specific regions: Sequence locations=1-304

SEQ ID NO: 70181 - DNA, 590 bp, Heterodera glycines
  Genomic contig location: Contig_ID=SeqID_42233; Location=646..1235; Strand=-
  SCN-specific regions: Sequence locations=1-220,242-341,363-368,393 -457,479-538,571-590
atgaagaagtattgtgaaatgtgtgaaggaaatacagtaggtgtaagtgattaagttaaaggctacctgaattgaaaatctgtgcctttttggctttgaaagtattgggtggatgtactgtaattgttcgataagaaatacggtaagaatattgcctttctctcccctcctatttgatcggcttttctggcattgtttcatagtcgatcatgttagtgtacttcacatttggttctgtttcgagattttcaccggcaaaaaatcccgaaattttgttgcgatctttgtcctttggttatcagtttttctttcgaaatttcgtttgggcactaaaatgccacacagtgacaaaattcacgtttcataagaaaaaaaaattaattaaaatatttcgatcatttttatggcattttgtgcctagttcaccctcttccgaagaatttttttccaaaaaaataaccattaaatacatattttgagcactttttgtacatatttttgatatccctacacataactcgtccactttaacaccttcaattttgatttgattttaattcatttgtataatatctttctaaattaataaa

SEQ ID NO: 70182 - DNA, 730 bp, Heterodera glycines
  Genomic contig location: Contig_ID=SeqID_42234; Location=46..775; Strand=+
  SCN-specific regions: Sequence locations=1-403,425-504,549-730
atgaacaacggatataaccagtacagtaatggatacaacccctacagcaatggatataacggtggatacaatccaatgaacaacgcatataaccagtacagtaatggctacaacccctacagtaatggatacctgaacaacaacggatacaatcaaaacagcaacggtataaaaataaatgctaatatatttcaattaatatgtttttcaaattgatgacttctcctggttaacaaagcaattaagcttatattggattttcagattgcttcaccgcgtcaatggtacaggaccaaagagcatgcagcgcaatgcaaggacaatgctcaaacccggtgggtaattaattaattaacgaaacacaaaaaattgggttcattttcactatttttgcattttattaacacatttatatttgcacttttatggccgaaaaacaacgaagaattttgactttttgtgatagtttttggcgccgcgcgccataactttttacaattggagataaaaaaatatttaaaaaaagagattattacatttttaaatttggtggctctaaatgtcccattgtataattatatcgacccatttagtaattagcgcaaatttagaagacaataattgtcaaatttatattcgcaatttccagttgatcgcccaaacatgtcgccaaacgtgctgcaacatgcaattcgcgagtggtgttgcttttcctcaattcggcggctga

SEQ ID NO: 70183 - DNA, 462 bp, Heterodera glycines
  Genomic contig location: Contig_ID=SeqID_42236; Location=253..714; Strand=+
  SCN-specific regions: Sequence locations=1-209,231-245,267-333,379-462
atgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtagtgctctgaagggcgtggggggggggggcgggggcccaccacgaggccgcgaagcggccgagtgagtaccttcggtgcaggaaaattattaaggaagagagttcattatttattttttttttgcataattaattcataaatatttttttcagaaaatgctctgaaacgcaccaaattttatttacatgttagtttaggcactctgatgctttttctatcaaaaagggagatga

SEQ ID NO: 70184 - DNA, 440 bp, Heterodera glycines
  Genomic contig location: Contig_ID=SeqID_42236; Location=1..440; Strand=-
  SCN-specific regions: Sequence locations=1-245,268-440
aatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaatttttaaaaaaatttttctccatcttcctttttgatactaaagcatcagagtgctaaaattaacttgtaaataaaatttggtgcgctttagagcactttctgaaaaaatatttatgaaataaaaaaatcgatttattcaagtgtccgtttggggtactcacgcaattatggggagcaaaaatccaacgca

SEQ ID NO: 70185 - DNA, 322 bp, Heterodera glycines
  Genomic contig location: Contig_ID=SeqID_42236; Location=821..1142; Strand=+
  SCN-specific regions: Sequence locations=1-79,113-246,279-322
atttataagcatttgtagggttctcagcagtttccctgcaaaatttggtgagcttctgatcagtctagaacgttgggtgataaaatgaaaaaaataattaaaaaaaaataatgctggtgtgctaagtgtgaagaactgtgttcttccaggcaaaaaattctaagaaaatttataagcatttgtagggttctcagcagtttccctgcaaaatttggtgagcttctgatcagtctagaacgttgggtgataaaatgaaaaaaataattaaaaaaaataatgctggtgtgctaagtgtgaagaactgtgttcttccaggcaaaaa

SEQ ID NO: 70186 - DNA, 49 bp, Heterodera glycines; identical to SEQ ID NO: 51181
  Genomic contig location: Contig_ID=SeqID_42239; Location=85..133; Strand=-
  SCN-specific regions: Sequence locations=1-49

SEQ ID NO: 70187 - DNA, 355 bp, Heterodera glycines
  Genomic contig location: Contig_ID=SeqID_42240; Location=117..471; Strand=-
  SCN-specific regions: Sequence locations=1-93,188-326,349-355
atgttctattcgaattattttcaatctgttcataatttgaacaacatttatcatcaaatattccgtataatttacaggaaaatgtttaaatggtaatttttatttatattttaaatttaattccacatttttaaatcgtaaataataataattattattattttaggacaaggaaaacaaaatataatgttattttcttgttggcattgttttttatcatttttcaatttatgtccaacaatttgcctccacatggaaacgattttgcaccagaacaaacaaaatcaaaactacagtatgtactcattacagcaatttataatcggaaaagcagactgtaagcaaaaataataaa

SEQ ID NO: 70188 - DNA, 518 bp, Heterodera glycines
  Genomic contig location: Contig_ID=SeqID_9079; Location=770..1287; Strand=-
  SCN-specific regions: Sequence locations=1-39,68-120,149-160,194 -225,287-415,481-518
atggctaagaaaaagaatggagagagtgagagagagaagattaatgaaaataaatattttttgatcagtcccatatttttgtaaaaggcttttaattagataaaaaaaaattttcccaacattaaaaatctaaaaataaataaattttggtccaaattacaattaaaaaatttaaaaaaataaataaattattcagtcaaaaagttaatcacacgaattcacgtgtttttaatcaaatttttcttatttttaaataaataaattaaaattttattgatttttaaaaggcctttctgggccctaaaagttcaatttaaccccatttaatggctggctaaatgtgtgcaatggaagttggaacggggcgcttcatttgttcggcgaaccgatgaagatcaaacggttaaattggatggaagaagaggaggaagaagaagaaagacgagtgaaagtggaaggagcggggaagacataaaagaatcggggacggggatttggggcgggggccgacaaataaa

SEQ ID NO: 70189 - DNA, 991 bp, Heterodera glycines
  Genomic contig location: Contig_ID=SeqID_9079; Location=1883..2873; Strand=+
  SCN-specific regions: Sequence locations=1-484,506-630,652-699,738-991
ctcaaattgatcacccatccccaaatgtacaaagcaattttattgtgaaaatgcttgatccatacaaacaacagcccaatttctttttgccccatcccaatcattatgatcatcctgatcagcatcgccagcgcaatcatcggcaacacggatcagccgcagttgctggacgacatgcagtcggaccaccgatgccaccaccgccgccccaacgggtgccgtccccaaattgttgctcatcatccgccgcaacatcgtcggttgtgtcggagccgatcagccttgatctggccactgaacagtattttggtgggtagtcaattaaactaatgaatcgaactattttgtcgctaattaaaagcagggctgatgaccggatcattatcacattttctaattagtattattttttgctatacggttcatatttttcttttgatcatttttttgtggagtcacaaattttaattaattaatttcggtttttatgaaccaatttttgatatggccaattaatcagtccgtatttagatggggtatacataatttattagcctcgtttaagacacatacttttaaatgataagggttctttttactgatcagtattttttttttaaaatttctatacaaaattataccaataatttaaacttttttgtcttttctgtaaatttcataaatatttttaatgagcctttaataatttaattagttaattaattaattgattgattgaatttgcccctaattagtgaaagagaaggagaattgggccgccggtcgcttttcacgtcgcgttccgccccgtccgttgaggcgcacagcatgcgctgaacagcatgggcttgtaattccgttggaccgtttccggacgaaaaatttttcggtaaaattttgagttttttttgttgaaaatttatttatttttttcagcgccgcccaaataatgatgcgtttgacagttccgatgatgaatattacgatgaag

SEQ ID NO: 70190 - DNA, 344 bp, Heterodera glycines
  Genomic contig location: Contig_ID=SeqID_9079; Location=1921..2264; Strand=-
  SCN-specific regions: Sequence locations=1-344
atgatccggtcatcagccctgcttttaattagcgacaaaatagttcgattcattagtttaattgactacccaccaaaatactgttcagtggccagatcaaggctgatcggctccgacacaaccgacgatgttgcggcggatgatgagcaacaatttggggacggcacccgttggggcggcggtggtggcatcggtggtccgactgcatgtcgtccagcaactgcggctgatccgtgttgccgatgattgcgctggcgatgctgatcaggatgatcataatgattgggatggggcaaaaagaaattgggctgttgtttgtatggatcaagcattttcacaataaa

SEQ ID NO: 70191 - DNA, 669 bp, Heterodera glycines
  Genomic contig location: Contig_ID=SeqID_42243; Location=78..746; Strand=-
  SCN-specific regions: Sequence locations=1-48,91-357,428-564,612-669
atgcatttggcacaactcattactctgcttatatttggtggtaaattcaaaaattaaaatatttttcatttaataattttcattatttttcagttattttcacgagttccgtcgttcgcccatcacaaaaattggttcggcaatgttctttcacggatgaaatgtccaatttttacgcaagttggcacacaaattgcaggtgaacgaatgccatgcactttggcattttgggttgaacgatggcattcattaaatttgaaatttggcattttaattaggggtcatcccaattttccgagatggagctgaaattactagaaagtgattagggcaaagtccagtcctaattgttttatcatttttttaaattctaatttttaaattcgtcttataaattgaaaattgaaaatttttagttttttaaaatcgaacattaattttttaaacttttctctgaagcggtctcgtcagttttgtgatcaatgccttcaattttccacgcccaaaagttccatttgccaatgggctttccgacttttcaccttactcacgcttttggattggtaaaaaaataattaaataaaaataattcaaatttaaaatttattttaggcattggcattcgcctcgtcgtaagccaaaatttaatttgacttaaaattaaataaa

SEQ ID NO: 70192 - DNA, 290 bp, Heterodera glycines
  Genomic contig location: Contig_ID=SeqID_9081; Location=1635..1924; Strand=-
  SCN-specific regions: Sequence locations=1-290
atcggaatgtccgtttgcgctcggttggattttccaacagctgttgagtcgctttatgcccagtacgcttgtgccatggactggtgcaccgtcgtgctgtccagttggcttctgctgtgggcgagcagttcatttcggcaacatttggttgacgattttgtgccaaaatgggccaaaaaatggctgctgaccaacagcacaattgctaatgataatcgcattgtggcagcaaatggggcgacaatcattttggtgaggccgaagaatgcaaaagtggtgccaacggccgg

SEQ ID NO: 70193 - DNA, 133 bp, Heterodera glycines
  Genomic contig location: Contig_ID=SeqID_42254; Location=632..764; Strand=+
  SCN-specific regions: Sequence locations=1-72,95-133
atgcagccggaatcagtacgaatgccgaaagaaggagcggacaatgtgacgaagcaaattgccattttggagcaatgcctaaagggcaccaaagaggcggagggactgaagcggaaatgggagaaaagtgacg

SEQ ID NO: 70194 - DNA, 219 bp, Heterodera glycines
  Genomic contig location: Contig_ID=SeqID_42254; Location=83..301; Strand=+
  SCN-specific regions: Sequence locations=1-219
atggcctcgggtgccgctccgtgcagtgaccagcgaaattcggcaaaagcggcggacaaagcgccgccgccctcgcagggccaccgaagtcgcaaatgggcgacggacggaggggcagcagcgcactgcgaaaatgtgggcatttcgggaacatttcgacagttaatttgcgattttcagtgcgtcgtttgcggtgatcgggcgtgcaatcaccagtaa

SEQ ID NO: 70195 - DNA, 965 bp, Heterodera glycines
  Genomic contig location: Contig_ID=SeqID_42260; Location=76..1040; Strand=-
  SCN-specific regions: Sequence locations=1-158,180-210,235-301,334 -409,474-654,693-789,848-965
  Gene Ontology: Mol. function=oxidoreductase activity; Cellular component=extracellular space; Biological process=lung development
atggtcgtaccgttggagcagtacacggacaaagtgttgcgcccgttgccattggaattggccaacgaatttgtggacaaatgctcggatgacaacttccataaccggtgggtttttcaatattcagcggattagggggggggattagaaatttcaaaaaattttgaaaaatcagttagctttagggggcagggctattttatgttatcgaaaataaataaataattttaaattgcacttgtcaaaaattagccattaattatgacttttctttaattttttagtctttagacgattgatgttaataaattttaaaaaattgaataaaattttgcggaataaaatcctgaaaagcataaataaaagcggcacaaaatgccataaacaaaataaattacgataaatactgtaaattatgaaattttttttttaattaataaaaatgatttggttttttctttttaaaaaaatttcttacaaaaaatcacatccaaaacggcgaaacatcagtccattagcctccgaatcgacgaactttttttttcaccgctttttcaaaaaaaatttttttttcagtttttggggtgggctctatatagcccaatatggttaagaaaaagcaaaacaaaaattgaattgaaacatttttttcagaaattatttataaaataaaaaaaatttcaaaatttttagcccttcgaacaccagcaattattgtcgtcaaaaaattttttcactgaccactgatttcaatgctgctgcattggcatgcgactgcaacactcagggtatttttttttataaaaaaaatattgaattttaattttaaaatttctaaaatttttaaggaagtttggacttcgcttgtgccgaatatggtggacaatgcaaatgcaagccgaatgtgattggacgaaaatgtgatcggtgcgcggccggctattacaattttccgaagggcatca

SEQ ID NO: 70196 - DNA, 388 bp, Heterodera glycines; identical to SEQ ID NO: 51536
  Genomic contig location: Contig_ID=SeqID_42261; Location=503..890; Strand=-
  SCN-specific regions: Sequence locations=1-20,42-275,297-388

SEQ ID NO: 70197 - DNA, 906 bp, Heterodera glycines
  Genomic contig location: Contig_ID=SeqID_9085; Location=228..1133; Strand=+
  SCN-specific regions: Sequence locations=1-134,159-570,592-623,646-906
atgggcaacgaggtgaactgcttctactcgacggaccaagcgcagcagcaattcgccggctttgacccattggcacaacagcagcagcactaccagcaaaatcagcaacaacacttttattttggtggccaaactcagcagcaaccgcaacaacaacagttctattttggagggggagacaatgagacgggtgagcaaaacagaaacatttaatttttgtccggtgccaaatcctcttgttttcgaatgccaatgactcgctcattgggtgggcttacggatcagcgctaaaattgttaattagggttcccaataacatattaatgtcatttcgattccgccgtttaccgtatgcttttagcccacagtttccccccgctttccatgcgtccgtccgccgcttcttccgcgccgcggcatttccccgacggcgacgccgcggccgtcgctccgttatatgcttcggaccgccccctctcagagggaattcattcgcccgcgccgcctcagaaccaaaagagtgtaattaaccagtggaaggaactccgactttagcaaagcatttaactaattattactttattttatttaatcgacccaacactttttgaattttgacacaaattgtatttgcttttctcttctaattattaaaaataaagtacattttatagaattaattggactcaaaagcacatttcaatgaataacaataagacaaattgggggggggggggtttgtggattaaaataagtaaaaagcgggggatacggtaaataagacgcaatcgcaattacttatccaacaataagccgcggaaaatgcataccaggcagaatttgatttataattatgttggaatcatacctttattcaacttttcacctttggccatttgaaacaaa

SEQ ID NO: 70198 - DNA, 1191 bp, Heterodera glycines
  Genomic contig location: Contig_ID=SeqID_9085; Location=2821..4011; Strand=-
  SCN-specific regions: Sequence locations=1-104,126-371,394-512,534 -599,626-820,842-937,961-1191
gcagtgattgagaaattgaaattggatacgcactcaatcatcgtctttttcgtggaccctctccgacttggccgtgtgctcagctcgagtaataaggtaacaccagtgtttatggtaaaattaatttcggtattcgcttgtgttcaggtaaatgttgcgatcaattgctcggcgtttgtgtacagatcgcaacttcgttcgattgagtacatggcgagttcaaaacatggccgggacatgtcccaactcgtttttccgaaactcactttcagcgaggcaataacctaaagttacgaagattcaaatattttttagagttttgagcaatttgaagagaaaaggagtaaagagattagtgggatgacattccgagaagaacaaaatcacaattacaacgcggaacaggtcaacaaagtgtcgaagaggaaaggaatttaatcggagtatcaatttgtttcagaagaatgctatttattccattctgtccaaggctcataatccatggccattcattctgtttgggccacctggtgggtagtgaaaatattttttggcagtaatattattagacaagtttcctgtggacgcatacaatcagcacctattttatattttttaaatgctttcattacaattaggcaccggtaaaaccatcactttaatcgaatctattcgacatttggtcctccaatctgatcaaaacagaattttggtatgcactccgtccaaaatggcggctgacaattttgccgaggctttattggaccacgactttttggagcccaaatacgtctttcgtatgcacagtctctgtgagttataattaatatttttgattggtcgtactttactttaattttttttccctttgactcccattttagccacgatggcatataatcggaacaaaagattggattgcatttcttatttggcgtaaattttttaaaatttaatgttcaattttattgtttttacaggaaagaggctaaaaatcgttttttcggcatcccggatcgacataatttgaagatgtttcgtgtgatcatttccacactttctacgtcttcttatttggtttcggccggtggattgcgtggctttttcacccatctgattgtggacgaagcgagccaagcaacggaggcggacacttggattcccatcggttggagaaatagcgatacttaa

SEQ ID NO: 70199 - DNA, 1298 bp, Heterodera glycines
  Genomic contig location: Contig_ID=SeqID_9086; Location=177..1474; Strand=-
  SCN-specific regions: Sequence locations=1-28,63-556,578-1298
atgcacgagtctcgaagggtaggcaatttgaagaaaaagaggttttaatacttgtttttaggagtttaatttctcggactccgaattgcttagtatgatggccatattgcatgtcggcccaaaagtggacacgaaagggctgcgcaatgctttcttcattgtctgtttcttttgctgttcacttgactaaaaatattatttcagcaaattaaagagcaccactcagacaaaggtggaactgtacagaaatctcaggttttaaccaaatccgtccgaagacatcgcagttttcgactattaattttaggaaataactcgtgcctatcgcattctcaagcagtacatcgatgcggctattctgcttccaggctcaaaaaacgaaaacacattcggcaaaaaagacaaagggcagaacgctggcccttccacgtcgcggagtgggtgccgtccaacggcgcaaggggcacaacgtccgccagacgaatttgaagattttggtgattttgaggtctatctcggatttttcatgtagttcaatttgacattaggtgatccgatatttttcaaaaattattataaaaggcagagaaataaattactattctttggggttttcggggtcgctgatcttgacactcatagtcaattatcattaattttaggatgcaggcggaaagcgaagacggagacgcggtggtggctcccgttacaataataatggtcacagagatgagcaagcgaacgacagaggaaacggagaaccatccgatgaaacgaatgacgcaaatgcaacggggaaagcaagcccagcccaaaagtttatcaacaattatacatatgcgccggaggactttagcacgtacaacgacccaatggagcgaagagaccgtcaaaaggacggcgtcagaaagtacgcattctcgacaatacttccttttaaatcttcttaaggttacgcggcggtcttcttctttacaaagactttcaaaggggacagacattgccaccagaattccaagaaatgggcaccgtttattcggaagacgacctggtggacaaccccattttcgagcatattctagtcaaattgcaaattccactggcgaatgccaattcaatgcatgcatttgttgaaaaaatgcgaacttttgtccacatctgctgggctttcgacggggtatgaaaggcttatttttttgaacattacgttatctaagggagcctcccaagacgcgagaattgtgcttcaaaaagcccagattgtccaagtttcacaagatgatgattccatttacgag

SEQ ID NO: 70200 - DNA, 479 bp, Heterodera glycines
  misc_feature (20)..(20): n is a, c, g, or t
  Genomic contig location: Contig_ID=SeqID_42262; Location=5..483; Strand=+
  SCN-specific regions: Sequence locations=1-54,131-133,288-384,416-479
atgtgcaacaattgggaatntggaggtaatatttttcacatataaaattatcaatattttactttttttattgccacctttattttttaaattattttttaattaattttcactttttttctatttttataacttattaataaaataaatgaatgttgaaaaatattattatttataattttatttaaaaaaattcaaatgtaaaagaatggtttttatagtcatttagtatatttttatttaattatagaataaatttatttatattttaattaattttaattttagattttcatcccaacgctgccaatgtgttggaagcagctgttgccatcgttttcctgggctccggcattggactattagctgctttaatgatcggcattgcttatcatttccaatcattgtttttcatcaccctgaggggatggcttttaaagcggattcagttcagcaaacaacaaaagtgatcaatcaaa

SEQ ID NO: 70201 - DNA, 140 bp, Heterodera glycines
  Genomic contig location: Contig_ID=SeqID_42266; Location=366..505; Strand=+
  SCN-specific regions: Sequence locations=1-140
aaaaagcgctcgtcggcaaatgatggcacttctcctcagctgaaaaacattgttggacccgcggcggcggagaagggcaccgatgggcagaaggagccgtgcatttgcgagagggaccaggcattggttgtgtgccgaag

SEQ ID NO: 70202 - DNA, 217 bp, Heterodera glycines
  Genomic contig location: Contig_ID=SeqID_42268; Location=190..406; Strand=-
  SCN-specific regions: Sequence locations=1-94,135-217
atgaaaagattcacttcacttgtgccaaaatggtttccaaaacgcaatggaatgtccactctttggaagaaggttcttatcttctgtctctgtgtttaaaatttattaaaaaaaaaatatttttttaatattttcccggggttttcggggtcgctgaccacgaatataaaattaatttcagtcagcagctcgatattatgtatgatattacattaaa

SEQ ID NO: 70203 - DNA, 484 bp, Heterodera glycines
  Genomic contig location: Contig_ID=SeqID_9087; Location=294..777; Strand=+
  SCN-specific regions: Sequence locations=1-232,259-340,362-484
attttttgcctatcaaatattcgcaataaatgcccatctatttaaaaaatattctattctattaaaatgttctgtattttgctatatattaagaatagccgtacatctaaaggcgtcagtaattgaacaaatttctcaaatttcaagaaaggttcaggcagtcgccgtaaaaattgtctatataaaaacaatggcgatacgcatttctgcactaggtcctttttcaaaattgatgtgcttttattgaaaaaacatgtttaacgggccacaaattaatagacaaattcaggcacattcttaaaaaattctgcttttaattagttcatttaatagattatgcttttgctttgtttgtttaaattctacgcccgcgattatctgataggacaataatatcaataaattttcttctgaagaagcgaagagttagcccaaacgttttcgttcctttctatttaatgatctatcatttcagatataacag

SEQ ID NO: 70204 - DNA, 484 bp, Heterodera glycines
  Genomic contig location: Contig_ID=SeqID_9087; Location=1349..1832; Strand=+
  SCN-specific regions: Sequence locations=1-232,259-484
attttttgcctatcaaatattcgcaataaatgcccatctatttaaaaaatattctattctattaaaatgttctgtattttgctatatattaagaatagccgtacatctaaaggagtcagtaattgaacaaatttctcaaatttcaagaaaggttcaggcagtcgccgtaaaaattgtctatataaaaacaatggcgatacgcatttctgcactaggtcctttttcaaaattgatgtgcttttattgaaaaaacatgtttaacgggccacaaattaatagacaaattcaggcacattcttaaaaaattctgcttttaattagttcatttaatagattatgcttttgctttgtttttttaaattctacgcccgcgattatctgataggacaatgatatcaataaattttcttctgaagaagcgaagagttagcccaaacgttttccttcctttctatttaatgatctatcatttcagatataacag

SEQ ID NO: 70205 - DNA, 601 bp, Heterodera glycines
  Genomic contig location: Contig_ID=SeqID_42275; Location=78..678; Strand=+
  SCN-specific regions: Sequence locations=1-33,60-131,154-601
atgaagcagcagcagtcaaaagagcaacctctccgccatcaacaagtgccccctgttttcgagcatccgttctcaatgtgtgtgtccgggtgtccgggcagtggcaagacgaaatgggtattgcgaatgttgtccaacctggacaccctcgctggccccgcacacctttcgggtgtgctctactgttatggggaagtgaatgaagacgtgctgcgactacaacaactggaaactgagacgggggaggaggaggaggaggagtacaaggggggtcaaccgcggcggcgctgggtccgcccctgccacgcgcttcccgatgaggaggcggtgaagcgggcagccaaagcgtgcggcggcagactgctattggtgttggatgacctgatggtcggcatgcgtaacaaaatccttgatctgttgttccaccgtggctccctacacttggggcgtcatgtcgttgtgttgatcacacagcatctgttcacacgagatctgaacatccaaaacaacgtcgcccagtctttggtgttgctgaggatcccggcagcgactctacatggttccgaaaatccacaaatctattcatttttcatcaaatgcc

SEQ ID NO: 70206 - DNA, 1036 bp, Heterodera glycines
  misc_feature (41)..(41): n is a, c, g, or t
  Genomic contig location: Contig_ID=SeqID_42278; Location=1..1036; Strand=+
  SCN-specific regions: Sequence locations=1-180,203-657,679-1036
  Gene Ontology: Mol. function=electron transporter activity; Cellular component=cytoplasm; Biological process=pentose-phosphate shunt
caagtaagccaaagaaagggtcacaaagggaacattcgtgnacagaaagggaccggcaaatggacgggcattgctgcactcgaatacggcattcccgtcacactaattggttggcgtgatcattttctcgcaattgacaaatgtccaatttagcggaggccgtcttcgcccggtgtttgtcggcactgaaaaaacagagaatggacgcgtcgaaactgctgccgaagccatcgaaaaaagcgagcgatttggtgaaagacagcaagaaatttctaaacagcattggcagtgtgagtttggggagaattggaaaatgattaatttacaaagggtacgacggtgccggaaaaaatttaaattctcatttttgtaaacagattttcactcagaaattgttaatttgtgggtttttgggaaaattttgcaaacttgaaaattttcaagcgatttttgaaaattttttgaaaaacctcttaaaaattttcaaaaccaatgtttttgtaggcgttgtacgcctccaaggtggtcagctacgcccagggcttcatgctaatggctgaagctagccgcgagttcgactggaatttgaattacggtgccattgctttgatgtggcgcggcggttgcatcatccgttctcgattcttggaccgtattcaaaatgcttttgaaaagaatccgtcgctggtcaatcttttgctggacgactttttcatgaaagccattggagacgctcaggcaattcaaatgcaattttagcgaaacgaactctcaaaacaccgaattgtccccgcaggactcgtggcgtgaagtcatttcgaccgctgttcagcttggcatcccaatgccagcgtttagcagtgccttggcatttttcgatggctatcgtactgaagctctcccggccaatctcatccaggcccagcgcgattatttcggtgctcacacttacgaactgctcgcccagcccggcgttgctgtgcacacgaattggacgggcagaggagggaaagtgacgtcaaatgcgtactccgcc

SEQ ID NO: 70207 - DNA, 568 bp, Heterodera glycines
  Genomic contig location: Contig_ID=SeqID_42280; Location=160..727; Strand=-
  SCN-specific regions: Sequence locations=1-196,219-245,268-385,407-568
atgcaaaaaggaagtaaattaatagcttattttaacttttttaaagaatacccaaatgctccaaaattcaaatacattgaaatgccaacattttgcacttatgataacaaaaccaaaaaatggaaatggccaaggaaaaaaacacataaagttatcggaagaatttatacagtaaatccaaaaaacagagaattatgttatcttcgttatttattgttacataaacaagcaacaagttttgatgatttaaaaattgttaatggaattaaatatacgaattatgctgaagcctgcttagctttaggattaacaagagatgattcagaatgggataagtgcttaaacgaagccagtcagtttaaatttccaagaggtctccgaaatctttttgtaaatattttaattaattgtgaaccaaaatatccgagtttgttatggaatgagtacaaggatgctttaagtgatgacctaaagaaaaactatcccaaagatattgcctaccaaatggttttatctcttttgaaccaaggccttttaaaatttgaaaaaagtttaaaagattttgaag

SEQ ID NO: 70208 - DNA, 1658 bp, Heterodera glycines; identical to SEQ ID NO: 42281
  misc_feature (1635)..(1635): n is a, c, g, or t
  Genomic contig location: Contig_ID=SeqID_42281; Location=1..1658; Strand=+
  SCN-specific regions: Sequence locations=1-211,233-288,312-377,400 -517,546-831,853-907,930-983,1005-1020,1078-1147,1197-1609,1631-1658
  Gene Ontology: Mol. function=potassium:chloride symporter activity; Cellular component=integral to membrane; Biological process =embryogenesis and morphogenesis

SEQ ID NO: 70209 - DNA, 220 bp, Heterodera glycines
  Genomic contig location: Contig_ID=SeqID_9088; Location=441..660; Strand=-
  SCN-specific regions: Sequence locations=1-177,216-220
atgcaaagcattgtgctggagcgaatggaagcggagcagcgccagcggtccgtcgccgcagcggcggctgcccatcaccacggcatgcaccagcagacgccgccccatcagccgatgggctgcaccagtgtgccaccgccgtcccaccacccattggccgctgccgcgatgatgcaggcgggcggtgccggtggaggaatgccaccgccgcagggcatgg

SEQ ID NO: 70210 - DNA, 2527 bp, Heterodera glycines
  Genomic contig location: Contig_ID=SeqID_9089; Location=512..3038; Strand=-
  SCN-specific regions: Sequence locations=1-104,130-152,176-584,628 -737,772-867,892-1547,1589-2049,2073-2127,2149-2527
  Gene Ontology: Mol. function=transcription regulator activity; Cellular component=nucleus; Biological process=positive regulation of Wnt receptor signaling pathway
atggagctgaactcggtgcccggcatggccatgtgcactgcgtcggcgggtggcgctatggacgctggccaaatgctcggcatgcacccgcaccaccatcacatgggcggcggcggtggtggtggcgggttgcccaacgggacgccgtgcaacgccggcccgggcccgccgccccatcagcagggcatgatcatggatgacggcggcggcggtggaccgtccgcgggcatggcaccgccctacggacagccgggcgcaccgcaccaggtcagtggcattaattagtgcggcgtcggttttaataattggcatagatttttttggttacgtcacatttgcgcctcgaaatgaatgatgtttaaaacaatatgcataaaatcataattattcctcaattttaacaaaaggtaaaattgtttcttggaattttttttatcaaagaattacatacctaataaagttttaaaacggaaaattttcattggtctcaaaaaattatcaatccatagcctaaaaagcccgataatgagttcaacgggcgtgtacactaatgataaatttgcaatttctatacttactctcgtaaaaatggttttttccaaaaatttaattttgaattcccagggtccgccccccgacttcttctaccagcagggccctcccggaggcgctggaccgccgatgggtcccaattttgggcctccaatgttcggcggtggaccgcctccgatgtctgcgcatcaccaacagcagcagcagatgttgatgcagcatcaacagcccggcacggcgggcttgggcggtccgcaaatggttggcggaggcggcggaccaccggcacagtaccaacaacagcaaaacgatgcggatcagcaacaacaacaacagcaccaggtactgcagatgggggtgagtcggtcggggcgtgaactgctccagcttgataaacatgtgtctgggaaaagtcaaataaatttgttgctgagttgaattgggtgtgacattgtccttgtgtgtttggtacgagtcagagctgtcacgggctccgtaaatttcatgaaatgtcgaattatggattttcaaattacggattcccgattacgattacgtccgtgtgagtaccaatctgtttaaacgatgagggccataaatgatcctcacgatcgatgtacagctttaactcgttggttcaaaaaagggggggggtatttaattgatggtttactgctcgaacttgttggccctcccgagaatttgtttttcccatttacctcaacaatttttaatgtgttgcatcctcatcacagatgatgccgcccatgcaccacccgcaccaccatccggcagcgctcgtccaacagcagggcggcggcgtcccgctagggccggcttcctcagcgcatcatcacaatgccatgggtgggccaccgcccggcgcagggcccgtgggaccgcccgtcggccatatggctccccatcatccgcaaatggcgggcggcgccggaccaggaccgctacaccaccagacgacgccgttgcccataccaccgccgcccggctccgcggcagcggcggccgccgcggcggctgctgcagcgatgttccccccgggcgctttccccaggcaaccgccgggcccctttctgatgttcccgcccaccattccgcaaccgccctttctggagtacaggctgcaagagatgaaccggcgactgttccagttccacagccaattccaccaggtgaagggagtaaagaatgtaaaatgtaaatggaggaaaattgtgaggggtaaaacaaatttggaacgtatatccgaacctcttttaatgcccttttacccaaaaatattttctttcccggatcgatttactaaacgacggtagcggatggcgccgcccggaaagaaatagaaaatttgacagatttttaagcaattttgccagcggggagattttttttgcattttatttgtgtaaaattttccagttcttataaaattttttgctttttctatttaatgacggaaattaaaaattgaaagggcgaaacaaaagaaacatttttacaaaaagtgatgcctaagcaattgatcgcagcacaaatgtatttatttatagttattgtttaacatttcctacaaattccgggtctttcatacgcttttctccccatttttttgctcaaaaaatatttagtaaatggacgagaaattcgatggtttaactcaaattgtatgcatctataattaaatttggagcagctcgttgactcccccgataattttttcaaatctaaaaaaaatcttcgaaaattattaaattttgaaaaaatcactagaaatttttcaaaatgtacccaattaaatcacattaactgatctacttcaaattgcagagttctcccgaaagtcatgagcaatggtgggaggcgtttgcgcaagaattttttgacgagagcggccgaatgagcatcacattgcccgagttctcgccggagcaaggcggacacatccgaagggatttca

SEQ ID NO: 70211 - DNA, 216 bp, Heterodera glycines
  Genomic contig location: Contig_ID=SeqID_42282; Location=31..246; Strand=-
  SCN-specific regions: Sequence locations=1-129,152-216
atgccaacgaagaaaacgatcgaaacggaggaaaagaggccaaagttgggcacgaattggaggaaaaagcagtcgaaattgctgatcatgttgcgaccaaccaacgaaatggcaaaagggacagaaaatgaaagcaaaaagacaaagtcaacggatgagccaatggccaaaagggtggcacaagtgccatggactctcctaaaagcacagaaacag

SEQ ID NO: 70212 - DNA, 60 bp, Heterodera glycines; identical to SEQ ID NO: 52045
  Genomic contig location: Contig_ID=SeqID_42285; Location=806..865; Strand=-
  SCN-specific regions: Sequence locations=1-60

SEQ ID NO: 70213 - DNA, 968 bp, Heterodera glycines
  Genomic contig location: Contig_ID=SeqID_42291; Location=304..1271; Strand=+
  SCN-specific regions: Sequence locations=1-642,664-815,837-928,950-968
  Gene Ontology: Biological process=nurse cell/oocyte transport (sensu Insecta)
atgcaattgatcaccaccagcacggccatttgcatgacgacggacatggccatcaccacgactgtggagggcaccagcacagccatggggaacggcacgagacggacggaaagagagcggcgagcactctccccaaaatcggaagggcaacagacagtgacaaaccgtacgacaaagacaggttcaaatgatgagtaatagccaagacaagctcatcacatcatatcattccatctctttcagctatttggcctttctgaatgaccccaaaattcgcctttggacgtacgccgttggctccaccgttttgatcagtgccgtcccctgctttttgcttcttttgattccgatcaaagtctgtcccttcgtccgtttgcggttattcctcctttaggaaaacactgccgaggattcgcctttgttgcgcactttgctcgctttcggtgccggtggacttcttggcgatgcgtttctccatttgattccccacgccacgccttccggccattcccattcgcactcgcacaatgctggcgaaggccatgcgcacggaccgcacgacctttcagtggggtcgtgggtactcgtcggttggttctttctcgtgctttgacttggtcagattataaacattagtttggagttggcttttacataggaaaactgcaatacattgataaaatttgttgaggatcaaacaacaatctttttgacccaatcgtttttttacccaattcatttcttatttgaaacccaaaaataggtcgagtcgtgtttcagtccaaaaaacgatttgaaatacgtttcagttattgttttaccagttattccttccattttcatacaggttttatgacattttttatcgtggaaaaatctgtccgaattattcgcggaaatgacccaccgggccacggacattcgcacggagatgagaaaaggaagaaaaagcaggcaaagttttctga

SEQ ID NO: 70214 - DNA, 104 bp, Heterodera glycines
  Genomic contig location: Contig_ID=SeqID_9091; Location=1279..1382; Strand=-
  SCN-specific regions: Sequence locations=1-19,43-104
gaggacatttcctgtcgactcaaatgggataaaaatgtgaacagtttggacgagttggattttgattacaacacggggacacaagtgattcggtgggagagcaa

SEQ ID NO: 70215 - DNA, 811 bp, Heterodera glycines
  Genomic contig location: Contig_ID=SeqID_9092; Location=2068..2878; Strand=-
  SCN-specific regions: Sequence locations=1-90,112-764,789-811
atggacgcacaaatagccgccgttttggccagatttgacgccgagctgtgcgccactgcttccggcactttgtgtcggaatgctctcaaaccgacccttctcggcttcgatatgatcgcctacaaatgcgtccgcgtgggcagcccttcactctctttgcattatgtgcccgaggaaagtaaggaaaatgaacgacccctcagggcatttggcattatgaaacctttccagcgacagatgccaagcaaatgttcaacaaattaatgttcatggacgatttggacactgaagatggaccgtctcatgacatcaatggggaggaaattgatggccaaaatgccgaggaaatcacttttgcacggacttgtgaaggcgaattgctgattagggtgagggaaaagtcgttcaacttcctcaaaaaggaatgggtaccctcaccaaatggagataatgccgaattgtaatttcactaatttggtcgtttagctctgcaacccaaacaacataagcacttcttcaacatgtttcaacgactcttcccgtccgtcccaaactgttcaagcttgtgtgccatttgctctcccttcgtctctgcttgccgcactggcggccccactcacttcacgcttaggcaaagtgtcccgggactttttgtctggacagagtgccaactcttcgcctgcttcgtaccattgcactgtgctcttttcccaacatacaaacacttctctcgctattcgtcaaacgagcgcattaatcaccgcacttagaacagaaatggaaaaaagccttgtgcctaactttaattaaa

SEQ ID NO: 70216 - DNA, 362 bp, Heterodera glycines
  Genomic contig location: Contig_ID=SeqID_9092; Location=1483..1844; Strand=+
  SCN-specific regions: Sequence locations=1-362
cgcatttggcatatgcttttgtcccccatcgccacccgcgcttccgtgagaattggcgctccttcctcggcctccaacgcaacagtcgccgctctctttggcgtcacattttactgccctcctcccacgccacgccctattcactgaacgcggcctcggcctttgacgaggagcagcagcgactggtgacagttaaaactgacattggaaacggacacagcacaacacagcaacaggaagggacgccgctgattgccgactctccccaaagttcgaccgaaacgaataattccgccgatggcaacattttaatgatttgatgattattacccttgtctttcctcatcgattccttcatttta

SEQ ID NO: 70217 - DNA, 570 bp, Heterodera glycines
  Genomic contig location: Contig_ID=SeqID_42292; Location=255..824; Strand=+
  SCN-specific regions: Sequence locations=1-216,255-570
atgttgtgcaaatgcggcgaatgcttcgaatgcgaagatgaaaagcgccgcctcaagcgcaatcgggagctcaatacccgcaaagagcaaattaagaactgcacaggcaatcatctagcaccggctatgatggaactcaaacgccggaatatggaactgtttaaaaaggcttataggccggtgaagggcgtcatcaataaaataaccgggggtgagtttaaaaaagaaattgaaaaaaaaaaaaattttttttaggcccttggaatgtagaatgtgaggtctgccatgagaccttcacatacttcatggtggagtgggaaaactcccggaccgacttctcgtggggtcccgggaggaccatggtcgaagcggataacatagtaaaaatttttgaatttttttttccagttaaaaaataattttagaatcagaaagaaattttggctcactatgtaggccaaaatgatctactccagaatgaagtggactattatcagaatcttggtaataatcctccattgaatgtgtccccaatgggggaggatgctataatgttgaccagggacgatg

SEQ ID NO: 70218 - DNA, 1252 bp, Heterodera glycines
  Genomic contig location: Contig_ID=SeqID_42293; Location=276..1527; Strand=+
  SCN-specific regions: Sequence locations=1-234,256-403,443-701,742 -833,855-864,886-890,914-1252
atgagtgagtgtactgtggtgacttttcttatgtaagttttgggtacttttaaaagtgccaacttttatctgggcggaaaaccgggtttaacgggttttaacagcgtttatttaagcgcacttttggcaatcatttgttatgccaatttttgtgccgctgtgtcaaagcaatggacattgttggatcttgacgatatggagggcatgagaaaagacacgcagcatggtaaatgaaaaaatactcttgagaattttgttattttccactattttgccacaaataatttctctatagtgccctcaaaaaaaataaataaattcgatacaacaatctggtcttgatttgtttcttgaatacacagatccagatccacacatagtttctgggcaccgtacactcagctaaaaattttaaaaaattttaaatttaaatttttaatttgttcccaacaaaaatgcattctaacttagctctgaagcaaggaaattttaactcgataattctagacttagaaaattttttgctagctatattttttatgcgctaatagcagttatgaatatttcctctcttaaagggaagtggagaaacaaacgtgacggcacagcggtcaaagaatataatgccaaaaacatcaactataccgaattttatgctcgcgttgtcgccaataaatgcctactgaccgtgaacaaaacccaagaagaagtggagagggcggaggaggaggaggaagagaacgtggcaaatggaaaagttggcattttgtcactgacaaatgagaaaaaataaattaatggaaatttcatagaaatttgctaaatctttaatcaggaggatggtaaagaaatcggccccatatcaaggaggcggaatggggaggcacgtacccccccccccccggccgccccgaaatgaaaaactttaagaaaaaattgcaatttttttgaaaatttacacgatttaatcaaaagtttgaaagaaaattttcccgttgatgccgatcgctactgccggaccccattctatcattgtttattaagaatttgacctaaacaacacaaaatatttcattctttggagcaaaactgctacaaattccttcttttttggccccggcgcgctaatagaaaaaatttttggcccgaagagcaaagagctcatcgggtgcccccacagataattttttatggatacgggccagaaagaaatacatagtatatttttgaattaaatatttgaatttatata

SEQ ID NO: 70219 - DNA, 1236 bp, Heterodera glycines
  Genomic contig location: Contig_ID=SeqID_42294; Location=149..1384; Strand=-
  SCN-specific regions: Sequence locations=1-260,283-323,346-646,676 -676,699-911,933-955,989-1236
cgttgagcggttgttgtggcaggcacataacacactgcctggggatggtggtttcgttcccggtcttacgtgccgtaactagcggtgtgtttgtgcttgctgctacgtccgtggccgtgatgagacgacgtggtagggcccgtgcttggcctagcacgtggcttaagactcaatgagtgtcagctcgggcaccgccagctttttcttttttttcattatttttttttacacttctgttgaagaatgaattctagtcttatcggtggatcactcggctcgtggatcgatgaagaacgcagccaactgcgataattagtgcgaactgcagaaaccttgaacacaaaacattcgaatgcacattgcgccattggagttacatccattggcacgcctggttcagggtcgttaccataaaatgcactgcttgtgcgttgcttcgtgggatcatgtacttgtacgtgttcttacgttacttgcttagctcggctgtggggttttggtgtgctggcgcgaacttgtggttctaattcgcgttttacggaccgtaactcgggcgcaccaatgctttgcatgctgtggcggagtgcctggattactggcattcctgctttgatttttcgacctgaaactcagacgtgaacaccccctgaacttaagcatatcagtaagcggagggaaagaaactaacgaggattcccgtagtaacggcgagtgaactgtgaagagtccagcgctgaatcgcagctcctctggggttgcgaggtgtagcgtatagaccgtgagcttgggttggcccgcttgttcaagtttcccttgaccggggctccagagaaggtgcaagacctgtccaactggcggtgcctacccatctttacgtgtcttggagtcgggttgtttgggatcgcagcccaaatcaggtggtaaacttcatctaagactaaatacggccacgagtccgatagcgaacaagtaccgtgagggaaagttgcaaagcactttgaagagagagttaaagaggacgtgaaaccgatgaggtggaaacggacagagctggcgtatctggtctgcattcacccgtttgttgctgtacgttgggctgctagcctccagactggggtttgctgtccttctttctgttcagtggcgaatggggcatttgcaggcggagtgcgctgagatgctcggagtagctgcgtgagctcggtcttgaggccagcctttcggggtctggtaccc

SEQ ID NO: 70220 - DNA, 186 bp, Heterodera glycines
  Genomic contig location: Contig_ID=SeqID_42298; Location=582..767; Strand=+
  SCN-specific regions: Sequence locations=1-73,95-186
cactcttcccaaatttgagtccgtccgaagaattgcgcctgttgagagcacgaattcagcaattggagaaaatggagcaacagcagcagcagaacatggaaatggaatcgtcgtcaaatggcaattccaatgaatttgtgcagagtgggaacggtaaaaaaatgagatacggtagaaaattaaaaa

SEQ ID NO: 70221 - DNA, 729 bp, Heterodera glycines
  Genomic contig location: Contig_ID=SeqID_9093; Location=2233..2961; Strand=+
  SCN-specific regions: Sequence locations=1-136,176-394,416-494,517 -625,647-729
atggacgcaaataaatgcccaacagcaaacatgccgataatacggggaacttattacggcaccagaagtaattcaattagataaacaatattttaaccccggggcggcggcactcatttcgcgtcaccaatggcacaaaaatagaaaaatatacttaaaaattataaaaaaaaatgttgggctatctttggcagtgtcggcacgaaaagatacaaaaaaacggaaagcgaatcatatgatgtcacgaaatatatgcttgaaaactacggtaacaaaaaaaaatgaaaaattagttcagcagattataagctggccgcgcgaaagtcgaaattttcagagacccaaatatatgtgccattttcatcaaatttgtgggccctcggttttttttaaatttcaaaaattttcaattttagttagggtctattcccgaccctggtcatctgtggcatatcaaaatcagatgagagtgccaattaaatgaatgagtttctgtttctatgattttttaaaaatctattgtctttttctctttcctgacgagcgtatttctcgccgacattttttaaatcggaaggaacaaaaacagcttcgtacaccaacatactctttaactaaaaggcaaaaaatgccaacaaaggcactcgtaataggcaatacaaatgccacttaatttaagtctcgtaaaggattagtgctgtcccgtgcactctgttaatttccaggtca

SEQ ID NO: 70222 - DNA, 630 bp, Heterodera glycines
  Genomic contig location: Contig_ID=SeqID_9093; Location=159..788; Strand=+
  SCN-specific regions: Sequence locations=1-240,269-630
  Gene Ontology: Mol. function=protein binding; Cellular component =heterotrimeric G-protein complex; Biological process=G-protein coupled receptor protein signaling pathway
gtgagcgatcagtggaaaagcgctttcttcgagattatggcgacattttggttttttacccctcactaatgaccaatccgaaatcaatacactcgattatcacaaaatcccgaaaaagctgattgatggatccatccaaaatccgataatggctccacttgcctgattctgtgcttcgtcaaaagtgtgcgcagatggactgaccatattctggggaattgaatccaaagtattaattgctaattagttaattaattaattattaattctaattagtctcacccggttgataatttcgcgcacccgcgagtccaaagacacctccttgggtgacagaatggagatgaaatcctcgtagataatacgtgccttaaattggacaaaacattattatcggttcatcaatcaatcaatgatcggtgccataattgggccaaaagcattatttatgaccatcatttctaggatttattaactaattgatcatttctagggtagtccggggagaaccggtcccgagtgggtcaagtaattcaatttggcgtagaattataaaatcctgaatctcaagccccgatcgatcccggctttccttgtcccgatttttgatgaaaatcccggcacacggct

SEQ ID NO: 70223 - DNA, 1255 bp, Heterodera glycines
  Genomic contig location: Contig_ID=SeqID_9093; Location=200..1454; Strand=-
  SCN-specific regions: Sequence locations=1-141,163-1028,1057-1255
  Gene Ontology: Mol. function=protein binding; Cellular component =heterotrimeric G-protein complex; Biological process=G-protein coupled receptor protein signaling pathway
tgccatttattccgcatcatttgcctccaacccggcaccatggccacggccttgttgtgccattgataattattccaccgttttttcagggcctcttttgaggaggtcgccgcgtggggcgtcaacttcgatcggctgatgaaaaacaaaaatggccaaaagtattttgcggaatttttgaagagcgaatacagtgacgagaacatcctgttctggtcagtgttttatggggaaaatttacggaaattttttaaaattttcatgttcaggcaagcctgcgaagagctgaagagggagcggaacacggagaaaattgaggagaaggtaaattcgcgcaaaattttgggctgatcaatttaaattggtctaagattggcatttcgtaaattttttgagcgaccgaagggtatctgttttgaattgctgatcagggttgaatatgatcagcagttggataatattgctcgagagtctcggtcttgaggtcattgactcgagaaaagtatcacttttttttgggtggcttcggtcccggaccgattccccggttttctatataagtttcgagtctcgggctaactgatcatctcgtaaatgttcggtcttcagcagcactgctgatcaaaagactgcttcgatcaatcacttataatctaacttggtataagccgtgtgccgggattttcatcaaaaatcgggacaaggaaagccgggatcgatcggggcttgagattcaggattttataattctacgccaaattgaattacttgacccactcgggaccggttctccccggactaccctagaaatgatcaattagttaataaatcctagaaatgatggtcataaataatgcttttggcccaattatggcaccgatcattgattgattgatgaaccgataataatgttttgtccaatttaaggcacgtattatctacgaggatttcatctccattctgtcacccaaggaggtgtctttggactcgcgggtgcgcgaaattatcaaccgggtgagactaattagaattaataattaattaattaactaattagcaattaatactttggattcaattccccagaatatggtcagtccatctgcgcacacttttgacgaagcacagaatcaggcaagtggagccattatcggattttggatggatccatcaatcagctttttcgggattttgtgataatcgagtgtattgatttcggattggtcattagtgaggggtaaaaaaccaaaatgtc

SEQ ID NO: 70224 - DNA, 595 bp, Heterodera glycines
  Genomic contig location: Contig_ID=SeqID_9094; Location=1..595; Strand=+
  SCN-specific regions: Sequence locations=1-431,588-595
aaatttttgagattttgcaaattaataataaacacacatatatatcgaacaacaccaacaattcttaatttgattgacagtgaacaaagttatggttcaaaaagtcttccgacgacgtttcggccgacgacgttttggggtgcaccgtttttaaatttctccagccattcccgacaaaattttggtcggggaatttcctttccgattcccgactcttctccatccatggggccggcacggcgaccaaccctaattttaattccttttaattggacaacaacaccaaacaaggggagacctttctcaagtggaggagtcgagactctcgaatagactgtacttcttcccccccccacccgactgacccgccacttccgatggacgaacagttgcagggcaacagtttcagcagcatttggcccaccgatttgtgctgctgctgttggtgttgtattgcggccgtgggttgctccgtttgttgcacttcggctgctgttgttgttgttgctgttactgcttgtgacggttgtgcggttgctgtcgccgctggttgttctacagctactgcttgcgcttgggctgccgctccgtttgc

SEQ ID NO: 70225 - DNA, 210 bp, Heterodera glycines
  Genomic contig location: Contig_ID=SeqID_42303; Location=312..521; Strand=-
  SCN-specific regions: Sequence locations=1-210
gttctccacgacgcctcttttcgtgccaatgccaaactcatccaaaagaaaattgctttgtcgccattcggtgcaaaagagcaattggtgcgttgggtggaattcgcagccgaatttccgcatctgaacgagcttaacatgccaaccgatgccgaattgggatgggtcgcttattattcaatcgatgccattctgttcaccatcagtgcg

SEQ ID NO: 70226 - DNA, 76 bp, Heterodera glycines; identical to SEQ ID NO: 51235
  Genomic contig location: Contig_ID=SeqID_42304; Location=169..244; Strand=+
  SCN-specific regions: Sequence locations=1-76

SEQ ID NO: 70227 - DNA, 81 bp, Heterodera glycines; identical to SEQ ID NO: 58971
  Genomic contig location: Contig_ID=SeqID_42310; Location=610..690; Strand=-
  SCN-specific regions: Sequence locations=1-13,47-81

SEQ ID NO: 70228 - DNA, 226 bp, Heterodera glycines
  misc_feature (207)..(207): n is a, c, g, or t
  Genomic contig location: Contig_ID=SeqID_42311; Location=283..508; Strand=-
  SCN-specific regions: Sequence locations=1-59,144-226
atgtgcgaaaaccggcttggcctcagcttccaccgatgtaaaggtgagaacaatgattgtttttttaaataaaataattgggaatttaaaaactaattaattattttttatataatttagaatttatttttattttattaattctggtcataaaaatgtttcttaaattgaacggctctcccgatttaattgaatgtaaaaagccanaatttgagtgaaaattaaa

SEQ ID NO: 70229 - DNA, 849 bp, Heterodera glycines
  Genomic contig location: Contig_ID=SeqID_9095; Location=85..933; Strand=-
  SCN-specific regions: Sequence locations=1-19,41-45,69-372,396-849
atgaaccgacggtaaaaggattttaaaagtcacacaaattcgtcatttatttagctaaactgttttcccatttcagttggatttgcaacgacgtttggatggacattttcccctcttttgaccgtcctcaactcggcctcaaattggcacttctttcgccacgtttcaatgcgttggtggacaaacatttcgatggcaaaagcgaattgacaatttggagaccaatcgaaattagcaaggacaaaggacctgaaccgaaactatctgtgcggatggatgacaaatttgtgccatttccattgccggaccgtccgctgcccagcaaaatccgttttaaatggcttcggattgagtaattcaaaagcagagctatgacaataaaagcatttatttcattttcagttacatcgatcactccgtcatcgcttttcttcgttcaaatcagcaaattttcgacaaaagaggcaccaatttatatttgtggattccatcatcacactctacgaatggccagccgattttggacatttttggtcgtgaaatttggccaattttttcggcaaatattcgccatttgtgctttccccatggtgatcatttggacaatttgcttcgtcgtatttcgccaacaattctcactgatctcaaccaattgaattcaatccattcatttgatctgttgcccgctgcgattggtgatggttttgatgggccaaattcaacaacttctgctggccaagcattgtccaaatggttgcactctccgagaaaagatggacaacccaagcgattgcgttgcgataattacaacgcacaagcgaacactgattggatcaacatttcaaggag

SEQ ID NO: 70230 - DNA, 477 bp, Heterodera glycines
  Genomic contig location: Contig_ID=SeqID_9096; Location=500..976; Strand=+
  SCN-specific regions: Sequence locations=1-66,192-257,381-393,475-477
  Gene Ontology: Biological process=N-linked glycosylation
atgaaaatagcattggggaaggaggagagacggaagagaaagagaggaaaaggaaaaattcgaagcaaggagggggagaaagaagaggaaaaggatgaaatagcagtggggaaggaggagagacggaagagaaagagaggaaaaggaaaaattcgacggaagaaggagggggagaaagaggaggaaaaggatgaaaatagcattggggaaggaggagagacggaagagaaagagaggaaaaggaaaaattcgaagcaagaaggaggggagaaagaggaggaaaaggatgaaaatagcagtggggaaggaggagagacggaagagaaagagaggaaaaggaaaaattcgaagaaggagggggagaaagaagaggaaaaggatgaaaatagcagtggggaaggaggagagacggaagagaaagagaggaaaaggaaaaattcgaagcaaggagggggagaaagaagaggaaaaggatga

SEQ ID NO: 70231 - DNA, 499 bp, Heterodera glycines
  Genomic contig location: Contig_ID=SeqID_42313; Location=416..914; Strand=+
  SCN-specific regions: Sequence locations=1-6,49-112,143-220,260 -351,374-453,478-499
atggtcaattttttttttttttttttactgttatatattatttttaatcattaccagtgatttcgatgattcacatattattgtaataaagtaggtactgacatctactaggaattttatattttttatgaaaatttttaatcgttttttagttcgtctatttatcatgcatgggtccagcacagatatatttccttgggaaattggaagcattaacaggaatatttgaaaaaatgttaaattttaaatataaatttaagaatcccatgagtgaataatacaataattttgccttactcattattccaaaattttcattggccaaaataaattgacaaaatttcttaccatgaataaattgtcatgaaaaattttttgcaaaaaaaaattctaggacatgaccaaattgacaactgcaattgaaaaagctgaaggatgcaagtgcaatcttgttgaaaaaattgagaaggaattggatgatgttgagggtattaaatga

SEQ ID NO: 70232 - DNA, 864 bp, Heterodera glycines
  misc_feature (747)..(747): n is a, c, g, or t
  misc_feature (845)..(845): n is a, c, g, or t
  Genomic contig location: Contig_ID=SeqID_42315; Location=65..928; Strand=+
  SCN-specific regions: Sequence locations=1-694,716-864
atgctgtacaatgcttttaagccccgccgtgaggcgggacagttccaaaattttgtaccacattttactgtggaaagtccaagtaccttattggacaactacgtgtcaatgagcacagtcgcctttggccagttgtggaacggaaaaatggaaatatcagatggggtgcgctcttttctaaaaattcctcttttcgtctaaccatccctcccttttgtgcactatttcgtttcaaaattgaatcatttttttggtcttttgaaataaattgtgaaaaatatacgaaaattattttagcttttaattatgctgtacaatgcttttaagccccgccgtgaggcgggacagttccaaaattttgtaccacattttactgtggaaagtccaagtaccttattggacaactacgtgtcaatgagcacagtcgcctttggccagttgtggaacggaaaaatgggaatatcagatggggtgcgctcttttctaaaaattcctcttttcgtctaaccatccctcccttttgtgcactatttcgtttcaaaattgaatcattttttttgtcttttgaaataaattgtgaaaaatatacgaaaattattttcgcttttaattatgctgtacaatgcttttaagccccgccgtgcggcggctccccttttgtgcactattttagtttttaaaattggttccggactttttggctttttgaaataaattgtgaaaaatatacgaaaattattttagctnttaattattcagtacaatgcttttaagccccgccgtgaggcgggacagttccaaattttgtaccacattttactgtggaaagtccaagtaccttattnggacactacgtgtcaatga

SEQ ID NO: 70233 - DNA, 389 bp, Heterodera glycines
  Genomic contig location: Contig_ID=SeqID_42315; Location=4..392; Strand=-
  SCN-specific regions: Sequence locations=1-389
gcttaaaagcattgtacagcataattaaaagctaaaataattttcgtatatttttcacaatttatttcaaaagaccaaaaaaatgattcaattttgaaacgaaatagtgcacaaaagggagggatggttagacgaaaagaggaatttttagaaaagagcgcaccccatctgatatttccatttttccgttccacaactggccaaaggcgactgtgctcattgacacgtagttgtccaataaggtacttggactttccacagtaaaatgtggtacaaaattttggaactgtcccgcctcacggcggggcttaaaagcattgtacagcataattaaaagctaaaataattttcgtatatttttcacaatttatttcaaaagacaaaaaaaa

SEQ ID NO: 70234 - DNA, 347 bp, Heterodera glycines
  misc_feature (54)..(54): n is a, c, g, or t
  misc_feature (152)..(152): n is a, c, g, or t
  Genomic contig location: Contig_ID=SeqID_42315; Location=616..962; Strand=-
  SCN-specific regions: Sequence locations=1-183,205-347
tttccgttccacactgccccaaaggcgactgtgctcattgacacgtagtgtccnaataaggtacttggactttccacagtaaaatgtggtacaaaatttggaactgtcccgcctcacggcggggcttaaaagcattgtactgaataattaanagctaaaataattttcgtatatttttcacaatttatttcaaaaagccaaaaagtccggaaccaattttaaaaactaaaatagtgcacaaaaggggagccgccgcacggcggggcttaaaagcattgtacagcataattaaaagcgaaaataattttcgtatatttttcacaatttatttcaaaagacaaaaaaaa

SEQ ID NO: 70235 - DNA, 522 bp, Heterodera glycines
  Genomic contig location: Contig_ID=SeqID_42316; Location=543..1064; Strand=+
  SCN-specific regions: Sequence locations=1-106,155-280,312-324,369-522
atgtcaatttcaaccgattcaactaacagtgtagaattttcatctgatgattgtggtgaatcatttattgaccagcaaaagttaaaggttaacaaaaacaattaggaaaaatatacatataattttttattaaaaatttaattcattttttattgagaaaaattttagcaaattggtgaaaagtttgccaaaatggaattggtattgaaaaacaccaaacttgagctcaaaaatgtgagttttacataaagaataattttgacaattaaatctaaattgctaattaatttataaataattaattaaatttagaagggacttcaagaaaagttgaagcagcaggaaacgaaagcactgctggcaaagatcgaagcggagaatggaaaaatgaaaagagaaattgagaaaatgccggaaaaaatggacgagaaggaggagcagtacatggacaagttggaggagttacagaaaaacgtaatttttgcaatttttttatttctgccctttgaaatcgaactttaa

SEQ ID NO: 70236 - DNA, 90 bp, Heterodera glycines
  Genomic contig location: Contig_ID=SeqID_42320; Location=11..100; Strand=-
  SCN-specific regions: Sequence locations=1-90
atgaagcagcagcagcgcttgtgcggcctgaagctgaccaaccggaccaagcagttatgcggcgactgtgtgccggtcaacatgagccaa

SEQ ID NO: 70237 - DNA, 1349 bp, Heterodera glycines
  Genomic contig location: Contig_ID=SeqID_1227; Location=20..1368; Strand=+
  SCN-specific regions: Sequence locations=1-110,132-630,652-1056,1084 -1349
atgcaaattccgcaaaatccgttgcccaagaaagtcgtcggattcgaagacattacaaaaagggaagcgaatgatttttgggtgttccctctgtgtaaaacgattccttcctctttttacagatacatcaatgacaatgtgatcacttttcttcactgttttcgtccacttttcgccgcctgccaaattaattttgccatcgacgatacccttacgatctttaacagcactttggagccgattttgcgcaacatttgggctgtgatcgcgacgaacgtttgtgccatccaattgtctgccgaagttttccgccgtttgcgtcaattcgtcccctcaattctcgacgactgtccatcgcttcgcgttttcaatgcgtattactttggtttcttcacccaatttccatgcgatgacagtgccacggcatcgaatggacaagcggtggccaaatggcttttcactccccgtccggacaatgtgccgaaggtgttcaaatgctggttgcaatgggatgatgggcatttggcgtcgagcattgaagacttcaaaagggtgattattgtttgactgatttggcacttttacgggctttgagggtcgctgacaaaaatattttggacggcattcaatttgaatttttcagtttttaattgttttcctcattttaggaatttaccatgcttcatctcccgtcaatttcatcgctgtcattcgctttccgccgacttttgctgactccgttttgctcttcgatctgaccaatggatttacgcatgaacaattgacgttgacatggatgaacgatatcggccgttttctgctgatccgtcgtccaattgtgcgcgacgaaaacaaatgggcgaaatgggaaaaggaagcgattggctggcaattttatgatcaatggaacagaatcgacattcgttcttcgtgatgcaatcaatgatcgggcccaagtgatcagcagaagaagtgaatgattgttaataagtgatcgattaatgcccatttgacttttataaaattgttatttttgttgcggtgatcacaaattgtattatatatatgtgtgggtatatgcctttaggataaattaagagatttcctgaaataccaggctcattcttttgatctaatgataaagtcggtagtcactgttccttcggtttttattttattttttgttatggtaatttttggcgctgaaaacgaatctgagattattttaagctaatatccattttatgttgagttacatgaaagtttacgtattagcgataacgggagaagcggctcaaaatcggtggcattttactaaaaatgaaaaacaatgtcatgtcgacagtaaa

SEQ ID NO: 70238 - DNA, 1138 bp, Heterodera glycines
  Genomic contig location: Contig_ID=SeqID_1229; Location=283..1420; Strand=+
  SCN-specific regions: Sequence locations=1-586,608-1138
atgtttgtcatttgttgtgccattcttttgaagtattgggaccgcttcaagaaaccaccaaaacaacaacgaggccatcgcaaaattgaaaaagtgccggaaactgtcttgacaattgaaaaagtgccggaaactgtcttgacaattgaaaaagtgccggaaactgtcttgacaatttgcctcgacgaaatgtcatcagacaaccaaaatgaagcggaggaaaagatgacaaaagcgatgtgaaactaaaattaaaaattgccaaatttcaattttaaattttattttcttttttaagcttcatctccgccgattgttggctttgtgtgttccatttgttgccgcctcgtcaacttggccttggcatttcaatgatcagtcaccgattcgacttttacgtcgatgaacacttcaagactcgcaaatggacattggattttgttcgaatttggcgcaaatttgaagcggatggcacacaggaaatggaaattctcaattgccgttggaaatcgatgcaaattccgcaaaatccgttgccaaagaaagtcgtcggattcgaagacattacaataaggtgaagcgaatgattttttggtgtttcctctgtgtaaaacgattccttcctcttttttacagatacatcaatgacaatgtgatcacttttcttcactgttttcgtccacttttcgccgcctgccaaattaattttgccatcgacgatacccttacgatctttaacagcactttggagccgattttgcgcaacatttggccaatgatcgcgacgaacgtttgtgccatccaattgtccgccgaagttttccgccgtttgcgacatttcgagccgtcaattctcaacgactgtccatcgcttcgcgttttcaatgcgtattactttggtttcttcacccaatttccatgcgatgacagtgccgcggcatcggatggacaatcggtggccaaatggcttttcactcctcgtccggacgatgtgccaaaggtgttcaaatgctggttgcaatgggatgatggacatttggcgtcgagcattgaagacttcaaaagggtgattattgtttgactgatttggcacttttacgggctttgagggtcgctgacaaaaatattttggacggca

SEQ ID NO: 70239 - DNA, 378 bp, Heterodera glycines
  Genomic contig location: Contig_ID=SeqID_1230; Location=43..420; Strand=-
  SCN-specific regions: Sequence locations=1-378
atgctcggaaaaaacattcatggcattgaattgactgccacatttttctcccttttgcgtcaatttgctccatcaattctcaatgattgtccatcgcttcgcgttttcaatgcgtattactttggtttcttcacccaatttccatgcgatgacaatgccgcggcatcggatggacaatcggtggccaaatggcttttcactccacgtcaagacaatgtgccaaaggtgttcaactgctacttgggcaaggatgatgaagcgaatttgacgttcaaagttgaagttttgattgatttggcacttttatgggcgttgggattttctgacaaaaactttgggatgccgttgaacggcgacgttttcctttatatactgtaa

SEQ ID NO: 70240 - DNA, 390 bp, Heterodera glycines
  Genomic contig location: Contig_ID=SeqID_1231; Location=394..783; Strand=-
  SCN-specific regions: Sequence locations=1-390
atgaatcaacaattgtatgagaatgccccgggtaatactgaacggtaccgacctctccgagtcgaaagaccagttgttgccgaaaaccagcatcatttggttcgacaaaacccgccacctcatgcctacgctcacaatgacgattattatgctcagcgatttaaggcacaaaattcccaacaagctccccagttccaaaatcacaaccaaaatgtgccaattagagaaaatcatccgaatcagttcgaacaatatcagcagcctgtccaccccggactggtatttgacggcatgatggcacaggccattagaagcctagacagcttctcgtacacaatgactctgaactctattccgaatttggacggcccagcggatcagacgcagtga

SEQ ID NO: 70241 - DNA, 58 bp, Heterodera glycines; identical to SEQ ID NO: 50987
  Genomic contig location: Contig_ID=SeqID_1231; Location=1851..1908; Strand=-
  SCN-specific regions: Sequence locations=1-58

SEQ ID NO: 70242 - DNA, 312 bp, Heterodera glycines
  Genomic contig location: Contig_ID=SeqID_1231; Location=853..1164; Strand=-
  SCN-specific regions: Sequence locations=1-247,269-312
atggaactcagcgcaaatgatgagcagttggagtatgaggaaatggacgcggacaacgaacaaaatgctaatggtgtggttctacaacaaaatttgagggaaaatatgggaagtcaagtttggggtgaacaaattggtggagtggtagaagttggaacagtaaatgcaaatgcgaatgatgggccaatattttctacaccgcatgactcgcgcgattttggacttttacagcgcgatcttagactgcatttttctgaaaacttgagtttaattctcgaccgaaatcaaaggcgtgacatgaatgtcaagtaa

SEQ ID NO: 70243 - DNA, 451 bp, Heterodera glycines
  Genomic contig location: Contig_ID=SeqID_1231; Location=2865..3315; Strand=+
  SCN-specific regions: Sequence locations=1-220,258-451
atggccttaaatgggacctatcttttaaacctggcttgtactgctccaactccatgcatgaagttcgagctgtacaggtttgttgcgatcccagagaccaaatctaagaccatattcgaactcaacatacccgattttccaaaaccacttttaaaacattagttacttggtggtcttgaaaaatgccgtttttggagaccactttcagtctcggctctccaataattcaatttttgtaattaaaattttatatttttgtgttcttatagtcctaactttgctctatttaatcactatttctctggctctgtatctcttttatttttctttaaatcagccatcaaaaatacctacctctaaaatgaccatttttacttacttaactctaactccctaaatacttttccattggtattgatctcttgccagaataatggcaacatcttatata

SEQ ID NO: 70244 - DNA, 1059 bp, Heterodera glycines
  Genomic contig location: Contig_ID=SeqID_1231; Location=4683..5741; Strand=+
  SCN-specific regions: Sequence locations=1-60,83-268,296-358,381 -487,528-704,726-842,865-1059
atgttaagctgttttgaggacataatcgcgatcccatgtgggactctgttagcgtaagttattttgtttttaaaaattaattggttgttatgtaatttgaatttttaagatctgccactggtgttattactaaagtgatggaatcggagaaaaaagtcagcgttgtcttggtgtgcggatctggagaaaattttgttgttactgaatttaaacaaaattctgcgaacgctcttcaaaagtacctttcagttggaaatgtaaattgttgtcataattttaaattattttgtatgtttaaggtgctgaagcttcaatctgtcaaagcccaacgcttcaatgagaaatttgatggtcaaaagttttttcagactccatttccgtttgagtttgttgtgacaaagcactcgaaaatttgtttggtcaagactgaagttttggcggccgagaaatttacgcagcttgtggcgggccgtttttatagtaatgcattaaataaaaatcttttaaattttatttttagaaattaagtgtgttttaacgactccgttttcattaattggagaaatgttcgctgctgttgttggcgatctctgtgggaagcgcgcggatttatttatttcgggcgaaaaactcccagaaatgtttgggcaattggacagcaaggaccagcttgaactaaaacgttgttttgtcaaaattgaaggtttttgcctaattgattttttgtttatctatgatttaattattttgtagatgagtgtatgcagcttaatgttttggcttctgatgttaatgtgtgtggatgtaaagtgacgattggtgataagttggtcactccggtcaagagaaagagtgatgaagcaattttgagtccgcaatcggctaagaaatagtgtgtttttttgtttttgcttttttctttttatctacatataaataagtgcatgtttatgtttgtatgtttattgtgaatttattttggatggtgttagctagatttttgtatgaatttaaaagtgttgtcagttctatgtttgtatttgtgtgatgttttggata

SEQ ID NO: 70245 - DNA, 554 bp, Heterodera glycines
  Genomic contig location: Contig_ID=SeqID_1231; Location=6072..6625; Strand=-
  SCN-specific regions: Sequence locations=1-37,60-131,154-278,301 -335,358-554
gactgaaccaccagcattttaatcactgggactcaacccaccagcattccaatcactgggactcaattctcctgcatttcaatcactggcactcaacgcaccaacatttcaatcactggaactcactcaacccaccagcattccaatcactgggactcaattctgcatttcaatcactggcactcaacccaacagcattccaatcactgggactcaattctcctgcatttcaatcactggcactcaacccaccaacatttcaatcactggaactcaacccaccagcattccaatcactgggactcaattctgcatttcaatcactggcactcaacccaccagcattccaatcactgggactcaattctcctgcatttcaatcactgggactcaacccaccagcattccaatcgccaggactcaacccaccagaatcaatcaccgagactcaattctctggcatttcaagcaacgcgactcaaattaagcaattctccgatattcttccggtctctcaatcaccagacaaaaaattgtgccaaattcatcactga

SEQ ID NO: 70246 - DNA, 760 bp, Heterodera glycines
  Genomic contig location: Contig_ID=SeqID_9097; Location=182..941; Strand=+
  SCN-specific regions: Sequence locations=1-559,590-619,658-760
cggtcaccggtcgttctccgatggttcgccgccatcaaactcaaaatcagcatattccgccgcccaatcaccagaaagtcatctctgcactcgcctcttcccgtcttcaatgtcagaatcagcaacctttgtcaaattctacgcagcaacaaacgatgccaaaaagcaatgccagtggaagccgtcccgggtcgcttaaggtgtcatatagagttagttagcgatgtgactccgtcctcttcgagactcgcttcgaatgcttttctttttagggtgaacgtccctatgggtcggctgctgataaaattcacaggcatgggaatcaggcgacgacttcaacattctctccggctgatgttgatacagttccgtcttcggctgttggtcctccagtggaaccatttctgcgtcgagtcggttcgaccaaacaccgaatccaacgacccccgccagtgccggacgaagatggattcgttaggatgagtccacgaagcatcaagcacaagcaacctcaagaaaaaccacagaaaaatgttgaagacgagggtacatcatatgcttaataaattcaaaaatttatttattttaagccattcattcccggctagaacagagcaattccctctcagtcacagcacaacaacaacaaccgcaacaatcaaaacggatagcatctggtaagaaagatcttcatgctttttcatttctgatattctgtaatattagtgataaaagacagtgccatcaatcgcaatggtag

SEQ ID NO: 70247 - DNA, 1090 bp, Heterodera glycines; identical to SEQ ID NO: 9099
  Genomic contig location: Contig_ID=SeqID_9099; Location=1..1090; Strand=+
  SCN-specific regions: Sequence locations=1-1007,1029-1090

SEQ ID NO: 70248 - DNA, 1168 bp, Heterodera glycines
  misc_feature (1158)..(1158): n is a, c, g, or t
  Genomic contig location: Contig_ID=SeqID_9100; Location=502..1669; Strand=+
  SCN-specific regions: Sequence locations=1-179,201-833,855-1014,1039 -1168
  Gene Ontology: Mol. function=protein tyrosine kinase activity; Cellular component=nucleus; Biological process=JNK cascade
tggtttaacacttcggccagcgcgagagttgtatcatcggcagacgaagcgttcactccgtccttcgaacaaagtgcacttagcccaccgctcagccaaactcatatgaattcgattaggtatttttgttcgtttatttctgttttatggttgtttaagcagccaaggactcgccgaaccatctgtgatgaacaattccaacaccaatctgcaaacatttcgcgaagtgttgttcaatgaaactgtgctgaagttgctgaggcgttacgaatttgttggggtgagaacaaacgaacggattcgtcatgcgaaaatatcattaattacttaaaccaatttagtccatagggtcgggggcacaaggattggttatgtgagtgaatgttcaaaataaaacgcaaatatagacagagtttcagttgctgcaaggatttgctgacgaatcaacgtgtggcaatcaaaaggctgacgaggcctttcgccaatgttatccatgcaaaaaggggtcggtccaagcttcgcttatgcttttcaatcgttgttcatctcatccatttagcttatcgtgagttcgaaatcatgaacctggtgaaccatcgcaacgtacgttttttgttttgtttttcctgtcttccgtcctgcctaaatttagatcatcaaattacttaacgcgtacactccccaatcgtccttggatgagttcagcgacatttacttggtaatggagtgcatggacgccaacctttgctcggtggtccaaatgggcttagaccacgaaaggctgtcctttttgctttaccaggtaaaagaggcgaaatgagcctaatttgtagatacatttttattttaagatgctttgcggaataaatcatttgcacaaagccggaatcattcatagggtaatcagtcctttaattatgccattcttttcaattatttgtgttaatgttctgtatgtattttgctgctccaggatctcaagcccagcaacattgtggtcgatatgaattgccaactcaaaatccttgattttggacttgcgagaaacagcggcgagagcatgctgatgacgccatatgtgagaagggagaggccgtacgcaccgaaggggtcggcctccataggaatattcatgatgcgaagcaagggcgtagccangggggcgcgg

SEQ ID NO: 70249 - DNA, 369 bp, Heterodera glycines
  Genomic contig location: Contig_ID=SeqID_42322; Location=916..1284; Strand=+
  SCN-specific regions: Sequence locations=1-34,56-287,311-369
atgaatgatttaacagatttattcaatgcacagtcttcaagtcaagatattttaagagaaagacaaaggaaaaatatggaaaattggcgtaaacggaaaaatgagttgcctgaagcagaacttaatgcgtttaaagaaaaggaaagaaaaaatgttgaaaatttccgtaaaagacaaagaaataaagaaactaggctttatttggcagctaacaatccaaacaaagcagttttttatgcgcttagcccatttgagataaagtgtaaagaatgtaaagctgtgcatttcattgaagaaaattcaatcaatagttgccaaaaaaacaagatttttacagttgttgtaaaaatggaaaacttacgtcattaa

SEQ ID NO: 70250 - DNA, 307 bp, Heterodera glycines
  Genomic contig location: Contig_ID=SeqID_42324; Location=476..782; Strand=-
  SCN-specific regions: Sequence locations=1-307
aaaaatggtgtaagtaaaaatcgtaattacgctcaaaaagctcctcaaacaattttagcgcttccaattccttctacaatcgctttatacatcccattatgaacgctaaaattatcagagtgccgaaaatcgcatgtgatctacgcctagaaaaaaatggtgtaagtaaaaatcgtaactacgctcaaaaagcttctcaaccaattttagcgcatccaattccttctacaatcgcctttatacatcccattatgaacgctaaaattatcagagtgccgaaaatcgcatgtgatctaagcctagcaaa

SEQ ID NO: 70251 - DNA, 184 bp, Heterodera glycines
  Genomic contig location: Contig_ID=SeqID_42325; Location=190..373; Strand=+
  SCN-specific regions: Sequence locations=1-184
gaaaacgtgttttttttactgacatttttttcagaagaaggatatgaacaatcacttataaggctcatgctgggagataaaggaatcggaaaaaaaaatatctcaacaatcagtcgtgaaacagttcaataattcggaagcagtgccatattgggaaaagatgcacaagtagagtaggctcgaa

SEQ ID NO: 70252 - DNA, 565 bp, Heterodera glycines
  Genomic contig location: Contig_ID=SeqID_42327; Location=888..1452; Strand=+
  SCN-specific regions: Sequence locations=1-265,328-343,366-467,489-565
atggttgtcgtttcaattgaagcgcaaaacggagaacaacaacgaacgctgacgataatgccgcacagaaagcaatgcttcgtggaggtgtactgtaacattgccaacacagacggtacgagtacagtactcgcctttggcaccggacaaaaagaagccggcactgcccaaattcacttgtcactttttgacggagaaaaggcaaacaaatgttttgaacaaaacattcacgtaaaaattttcgacgaaaacaaagaggtaaaagaatttaattgaaataaaaaaatatataaaaaagaaaattacagcaaaattttatttttaattcttcggaatttttcaatgtatcaaaacaaatcacaattgatttaacgaaacccaactgaacaatgagagatgaattttggcttaatcataagttagttcattttaaatgatatggtcgactttttttcattctttcgaatattttttcataaatcctttccaaagaagataattgttaaatttatttttatctttttttttgagtatttcattttgcttctttgctatttattagcaa

SEQ ID NO: 70253 - DNA, 601 bp, Heterodera glycines
  Genomic contig location: Contig_ID=SeqID_42330; Location=267..867; Strand=+
  SCN-specific regions: Sequence locations=1-601
ttggatttgcaacgacgtttggatggacattttcccctcttttgaccgtcctcaacttggcctcaaattggcacttctttcgccacgtttcaatgcgttggtggacaaacatttcaatggcaaaagcgaattgacaatttggagaacaatcgaaattcgtcgcaaggacaaaggaccagaaccgaaactgtctgtgctgatggatgacaaaattgtggaatttccattgcccgattatccgttgccctggaaaatccgttttaagcgccttcagatgtggtaattataaatcagagctatcgcaataaaagcattcatcccatttttaggtacatcgatcactccgtcatcgcttttcttcgttcaaatcatcaaattttcgacaaaagaggcaccaatttatatttgtggattccatcatcacactctacgaatggccagccgatttgggacatttttgttcgtgaaatttggcccattttttctgaaaacattcgccacttgcgcttttacgatggtgatcatttggacaatttgcttcgtcgcacttcgccgacaattctcactgatctcaaccaattgacttcaatctattcctgtg

SEQ ID NO: 70254 - DNA, 591 bp, Heterodera glycines
  Genomic contig location: Contig_ID=SeqID_42331; Location=272..862; Strand=+
  SCN-specific regions: Sequence locations=1-162,225-342,398-521,545 -547,570-591
atgctgcttgatcggaaggaattggaacggccaaagacaaggattgtaagtttttcaagttttgttcgctattttatagggctgggctatcaaggtaaattctcgttctcggtttccgcgtctcggacaattttggatctcgagcagccctaattttgtatctaatatttcttaatagattttaaaacatttaaattatatttattaatatattaaataattaagagtcaacaatgccaagacttgatcaaatatctctcaagtcaaaccgacagcccaaatgatttcgccaaaaaattggaaagtgcgcctcctgtaaaggaattgggtgatgtaagtttgttaataaaaatattttaataatttacactttggattaataaaaatattaatatttgccttcggcaaatgtcaactttcagcatttttttagatttttttggaggctttttatgatttaaagcaggcgtgcaattattcaggatcatagaaattacgggatttttagacccgtaattacggattatgaattatgtgatttttccgtaattttggtccataaaatggttttatagctgaatttctaattaa

SEQ ID NO: 70255 - DNA, 176 bp, Heterodera glycines
  Genomic contig location: Contig_ID=SeqID_42331; Location=1221..1396; Strand=-
  SCN-specific regions: Sequence locations=1-176
atgaaattattggctgcacaagttggttttccagatatttaaaattttaattgtcaaagattgtgcatttgaaactccaaagtgctgttttggtcgcaagtcgcccattcttcgctttagggataatactcagtattggtattgagtttcggaaaaattgtcaatctcgagagtga

SEQ ID NO: 70256 - DNA, 1141 bp, Heterodera glycines
  Genomic contig location: Contig_ID=SeqID_9101; Location=194..1334; Strand=+
  SCN-specific regions: Sequence locations=1-9,52-385,407-505,527 -989,1011-1071,1093-1141
ggacctaccgacattgagcatgtgcagagaatggaagcggttttctccaggcttcagcagaatgatctgcgcatcaaaaaagagaagtgctcatttttgaaggataaattgatctatttggggcatgtgatcgacaaaacaggaataagtccatcaccggaaaaggttaaggcaataaaagaaatgccggaaccaaagaccatcagagttcgaatcattcctgggaatggtcaattattacagtaaattcgtcaaagatttggcagagtgtgttgaaccattgacagacttcgccggaaggatgtcgaatgggattggagtgatgagcagacaaaagcatttaatttggtcaaggaaaagctgacctcagacaaagtgctcgtgcattatgacccaaaaaacaatttgtttttggctacggatgcttctgattacggaattggaattcaattattttcggaattgaaaaattcaagcagtacctatatggccgaaaattcgttttacaaacggatcatgagcctctgaagaaatttacggccaataggcgaaatgccagtggtggcagcaagaagactacaccgatggggcctaattctgatagagacccaaaaagacaccttgctcaaattagtcaaaaaatttgtcaaggagggttggccaaataaagtggacaaggaatttcgaccattttacattgctcggaattcgttggaaattcagtccggatgtttgatgctcggaataagaaccgtgattccagctacatttcggcccgaaatttttcaactgatacattcagcacatccatgaatcgtcagaatgaaatccttggcacgacaaaaagtttggtggccaggattggacaaagcgattgaagaaatccgaaagtcgtgccggccatgtcaaattaatgcttctgaagaacgaaaagttccgttgcatccatgggaagaacccgaacggccttggcagcgattacatgtcgatttttgtggtcctttttggggatttatgtggtttgtaatggtcgatgccaaaacaaaatggcctgaggtcattaaaatgaaaaccacgaacacaaacacgacaatttatgaaatgcgacggatttttgccatacatggactcccaaaacggg

SEQ ID NO: 70257 - DNA, 407 bp, Heterodera glycines
  Genomic contig location: Contig_ID=SeqID_9102; Location=3..409; Strand=-
  SCN-specific regions: Sequence locations=1-26,50-63,85-131,154 -227,250-255,278-279,302-348,379-407
atggtatgtggtaagagcgaaatatcttttaaaaatttaatataattttgcagtttttcgagatttgaagcaaaaaacatttttcgatgttcaaatttaatggatgttaaataacatttgaaactaaaatcattttttataaaaaataattaacaagataacgacgacagtaatacttgtaacaaaaaagtgtttatgtttatttatcaaaaaaattttgaaactcgaaaaattttccaatttttctcctattgaattttcacattaaagtttgatacattttattcttaaatttttatataacgtatgtttaaagttcagttataaaactttaaatgatatattgcgtataaaaaaaaataatatattctattaaatcgttacttaattatattatcaacaataaa

SEQ ID NO: 70258 - DNA, 381 bp, Heterodera glycines; identical to SEQ ID NO: 64831
  Genomic contig location: Contig_ID=SeqID_42332; Location=118..498; Strand=-
  SCN-specific regions: Sequence locations=1-82,116-138,160-381

SEQ ID NO: 70259 - DNA, 388 bp, Heterodera glycines
  Genomic contig location: Contig_ID=SeqID_42335; Location=87..474; Strand=-
  SCN-specific regions: Sequence locations=1-20,42-275,297-388
atgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcagcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaa

SEQ ID NO: 70260 - DNA, 58 bp, Heterodera glycines; identical to SEQ ID NO: 58553
  Genomic contig location: Contig_ID=SeqID_42337; Location=223..280; Strand=+
  SCN-specific regions: Sequence locations=1-58

SEQ ID NO: 70261 - DNA, 80 bp, Heterodera glycines
  Genomic contig location: Contig_ID=SeqID_42340; Location=844..923; Strand=-
  SCN-specific regions: Sequence locations=1-80
cagcatttattcccggatcaatcaataaattcccatggacatggacgtcaagtgttacttcgtcgacaacgtcaatttag

SEQ ID NO: 70262 - DNA, 135 bp, Heterodera glycines
  Genomic contig location: Contig_ID=SeqID_42341; Location=202..336; Strand=-
  SCN-specific regions: Sequence locations=1-135
aatgtgtcgaaaaaggattggcatgacatgttcacaaccaacaatcgaattgcctcgtgggtggtcaatggttgtgagaaattactgttggaattgggacttgaactgcttgaccacgtgacggacgcggccaat

SEQ ID NO: 70263 - DNA, 1575 bp, Heterodera glycines
  Genomic contig location: Contig_ID=SeqID_9103; Location=946..2520; Strand=+
  SCN-specific regions: Sequence locations=1-219,241-697,723-788,810 -1038,1060-1164,1186-1225,1247-1285,1307-1309,1366-1575
  Gene Ontology: Mol. function=uridine kinase activity; Biological process=pyrimidine base metabolism
ttgaaattttgtcgttaatttactatgagcaacatattaacagtcagtcaatacctaatgcccaattgtttcgtcatcggcgttgccggaggcactgcgtcgggaaaggtgtgtgggtgggaattgtaaaatgtggtcctagttccggttttttctcaggccgggttccgcgattatgatgaaattttgtaattttgctttgataatgaaaaatcagtgactttaatataaaaaattgttgaattttagtaatacctaaaaaaaatttgtgtcccccggtgaaattatgcggcaaaaaaaaataaaattccgacttccatagcttgttggggcctgaattccagaaattttcggagccgttcccgttgtttagccgaatgaatacacaattttccgctcaatgtttgcccgttcatttagtcgtccgtctgcggccgtatcatggagcggctggagttgcacggcagtcacaaacgcgtggtgattgttgcgcaggactctttctaccgcgatttgacctcggcggacgaaattgcgaaggcccggcgaggcgactttaattttgaccatccgaacgcatttgagcaccaactgatgctgaacacactgcgacagctgcgccagggcaaatcggtggtcatccccaaatacgacttgaaggagcagcgacggtgcgttttccatcgaaaaaccattcaaaaaaatttttttttaaaatatttctcattttttcgcagatttttggatctgttaattaatatggggagggcttaatgactggcgcaaagttccagatttagttcccttctttctggatacatgttcaattttgaattaaaattcaccaattgaagtccagcgggccatagtcaccgccgaggaaaattgattcaaaacaaaaatttattcatattcccataaattttttgctattctaatttaattgaaagcattttgaatcgtattccgatactgaaaatccttccccctttcagcctcatcgatgcgtcgcaccgtttggaagcggccgatgtcatttttggtggagggcattgttctccgattaaaggtttttgagtggtaccaaaattcaacaaaaacatgaaaacattttacgaaaaaaacaaacaaaatgccaatatatggagcggatttgaaaatgcttttttaaccattttctcttgtccagttgagcgtgacacgaccgagcttggccgtccgttggaccaagtgttgcatcagtacctttcgttggtgaaaccggtcagtctattatctgctgatgaagaaaaacaactaaataaaaattcccaaattccaagttttttccatcaaaattctttaataatttatttaaaaaaaattccctaattgctacttaaattttaaaaactcattaatttttgtttaaaaatcatttgaaatttttcgatgaaacgacctgtgcccctcccctttaaggcgtacgaagacttttgcctgcccaccaaaaagtacgccgacgtaatcattccgcgaggagcagaaaatgacgtggccattgatctgattgtgcagcacattcaggaaatcttg

SEQ ID NO: 70264 - DNA, 304 bp, Heterodera glycines; identical to SEQ ID NO: 53844
  Genomic contig location: Contig_ID=SeqID_42342; Location=184..487; Strand=+
  SCN-specific regions: Sequence locations=1-304

SEQ ID NO: 70265 - DNA, 352 bp, Heterodera glycines
  Genomic contig location: Contig_ID=SeqID_42345; Location=388..739; Strand=+
  SCN-specific regions: Sequence locations=1-352
gtgctttgcgttggttggttggcgtgggtgactgtggtggttgggccgtttttgcgatattatggctggaaaaaagatgcgatttcgctatggggagcgcggccgtctgggttcaagtgcttgcttgcgcttgtgctcggcattgaacggtgatggctgctgctggggtgccacctttgtcgtggcctcagtttctccagcgattggcagctgtcgaaatgaataaacatgcagctcgtctgtgtgttaaagaaatttggcgagttaattgacttgtgtaaatgtggcctaaggcacaaatgctgtggggaactcagcactggggatgctgaacctaaagttggtggtggtg

SEQ ID NO: 70266 - DNA, 1551 bp, Heterodera glycines
  Genomic contig location: Contig_ID=SeqID_9106; Location=33..1583; Strand=-
  SCN-specific regions: Sequence locations=1-559,583-1057,1111-1551
atgatgcggttgtcgcgcgactacgattgcatcaaggaaggcaccgaattgaacggcttcaaacagaggggaccagatgtgtaagtgtgccgtctttttacatcaatgccagtcaaattttaccaagacaaatgatcactcccattttcagttatttcgcgaaacgtgacattgctggatcgcctgatgctgctcaaccaattctgctgatgaagcctgaaggacacaaagtcatgttcatgattgcccatccggatgtcgacacaaattgcgatctcttgcgtattaacaatggcacatgttcgtcgacaggcaatcagaaaggggtgagcgaaagcggacatttcgttatgtgtatacatcacatcaatcactcttttcttccacagtcttccggctttccgttcatgcctaactgtggcacccattgcatatcctactacatgtattgcgctatcgaactgaaaaaagttcacgaattgccggatgctcgtcacactgtagtcaacatcggcacaaaacagatagcaaccaactgtcgctgggaagtgctcattgtgagtggtggcggcggcggcgcactttttgaacgttttgccaaacttatgttcgtgttcatcaccaattttttgttaccgttcagaaagatgcgcgtctgttggtcaagcatggtacacctgcgcacaatttgatgaaatgtgttgcgggcagcggtggtcttccgggctgggcatgggcgctgattgtaactgcaatgtgtgtgtttttgttgtgatcgcttttttggcactactgactctggcacattcatttttaaacaacatttcatcattttcccccaatttttcagtctgctgcttatcgccctgctcttggccatcacatgcttcatggtactcaaacgacgcaagaaccaactgcgacaaccgccacgctcgtactggtcaaatccatcggcgggacgcggaggaggacagtcattgtgggcgcgcaccacggggaacatatcacgcctgttgatcatccgtggacgaggacgaaaggcagcggcggcaccggctgttgctggaggaagaggaggaggaggcattgaagcattatcaaagaagcggagcgactggtttggcggcagtacggcaagaagcggctacgcagcagaacatggcattgaaacgccacagtcaactcaagagtcgttatcgaatggcaaggacaagcgggcgtctcgtggatcgtccaaaccgacgtctcgtggatcggcaccgacatcgcatggatcatccaaaccaacgtctcgtggatcggcaccgacatctcatggctcttccaaaccaacatcgcatggatcggcaccgacatctcatggctcagcacctggcgcatccaaaccgacatctcatggatcatccaaaccaacgtctcgtggatcggcaccgacatctcatggctcttccaaaccgacatcgcatggatcggcaccgatgactacaccttctggcggcttcaaagggatgatggctcgcctcatgggacaaaagactggcacaagcg

SEQ ID NO: 70267 - DNA, 863 bp, Heterodera glycines
  Genomic contig location: Contig_ID=SeqID_42354; Location=175..1037; Strand=-
  SCN-specific regions: Sequence locations=1-233,255-400,422-519,547 -584,696-705,730-730,768-863
atgaactcgcacattctccatttggtcttcactttggccggaactgtcgacgacgggtcggctgagcaggtgctgatcccggacctgctcaccttcgaggatttgctctgcgatttggacgtatggcggaaggcgtcgcgcgacgtgtggaaattgttgttggaacacttttttgagctgctcactgagtgagcctttttttgcttttcaaaaatgcgcaaattccgttggcactttcaacaggacaagtgccaccgaaaatctgagtctcattcgccgttcgccgcttctctgccgccttttggtccatctgatcgaaaatcggagcattttccccatccaaaatgacattcccttccgtctgatcgatgccattgtccaacctccgtgcgatgccaattctctgctgtttttgggccaaactatcgccgcaacggtcgcttttgacgtggacgagacggagtacccattcagcacggcacagttggaaaagcgattattggaggagacaacggagagggataaagaagaagaagaagacgaaattaagggtgaaattgggggaaggagagagtgtaaagggaagagaggaaagagagagagagagggggggggaaataaaggaagagataaaggaaaatagagacaactagaaagagacaaaaaaagagagggcgtgagaaggagagagaaagtaaactccgaaagagaggaaaaaggaaaagaggacaataaattaaaaaatataggaaataatttataattttcacagatttgcatctgtattctgtgcatatgaggaaccgattgctgaacattctttgcacaatgttaagccactcaaactcgcaaatgaacaatca

SEQ ID NO: 70268 - DNA, 439 bp, Heterodera glycines
  Genomic contig location: Contig_ID=SeqID_42355; Location=289..727; Strand=+
  SCN-specific regions: Sequence locations=1-439
aaaatggtctaagtaaaaatcgtaattacgctcaaaaagcttctcaaacaattttaacgcttccaattccttctacaatcgcctttatacatcccattatgagcgctaaaattatcagagtgccgaaaatcgcatgtgatctaagcctagaaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgc

SEQ ID NO: 70269 - DNA, 137 bp, Heterodera glycines
  Genomic contig location: Contig_ID=SeqID_42357; Location=642..778; Strand=+
  SCN-specific regions: Sequence locations=1-110,133-137
atggtttttccaaaaaactatgatttttataatacccccttggcggatttaagaaactcgctggcatttccaacaactaaaaatattaaaagtgccttaactttgataacaaaaaatgtccaacaaattttcttatg

SEQ ID NO: 70270 - DNA, 591 bp, Heterodera glycines
  Genomic contig location: Contig_ID=SeqID_42358; Location=76..666; Strand=+
  SCN-specific regions: Sequence locations=1-448,472-591
  Gene Ontology: Mol. function=transporter activity; Cellular component= cytosol; Biological process=exocytosis
ctcggttatttgtcaaaagagaaccgggtgttcgcttgtgacaaggaccacaacattgtctcgttcaaacttttgttgtctgtcttggagtaccaaacggcggtgatgtgcaaggattttgacacggccgatcaaattttaaaaatcattcccgaaaatctacacacacgggtggcacaatttcttgagaagcaggtagaaatagaaaggttactaataattttaagcattgtttttttcatagggatttaaaaaacaagcactggcgattagcaaagatcctcagcatcggtttgagttagccttgtcacttggtgatttgcccgccgcttatgaaatggtattgaatttaaatgagaaaaggaagggttttagggatttgttgaatttaggccaagcaagcggacagtgaggaaaaatggaaacaattggcacatgcggcggtgattcccttttaaactttgatcaaattcttttacaccatttaagacaatcaaatctgagctccgtttggcaggtgaatgccttgctaaggccaacgatttcgggggccttcttctgctcgcttcctgcgccggttcgaatcgtttg

SEQ ID NO: 70271 - DNA, 387 bp, Heterodera glycines
  Genomic contig location: Contig_ID=SeqID_42359; Location=648..1034; Strand=+
  SCN-specific regions: Sequence locations=1-366
gcttaaaagcattgtacagcataattaaaaccgaaaataattttcgtatatttttcacaatttatttcaaaaagccaaaaaaaatgattcaattttgaaacgaaatagtgcacaaaagggagggatggttagacgaaaagaggaatttttagaaaagagcgcccccatctgatatttccatttttccgttccacaactggccaaaggcgactgtgctcattgacacgtagttgtccaataaggtacttggactttccacagtaaaatgtggtacaaaattttggaactgtcccgcctcacggcggggcttaaaagcattgtacagcgtaattaaaagctaaaataattttcgtatatttttcacaatttatttcaaaaagccaaaaa

SEQ ID NO: 70272 - DNA, 667 bp, Heterodera glycines
  Genomic contig location: Contig_ID=SeqID_42361; Location=203..869; Strand=-
  SCN-specific regions: Sequence locations=1-414,436-541,592-638,661-667
atgatattgatatctgatcgctctggcgaatggtcagtaagtgaaagtgagtgatttcatttacctgctgtaaggacaaaacttgatcagaataagccacacctgttgacaaatctcataaaaagcaaagcttaaattaggatagacaaaaagattaaacagatctattgcgtttgctcgatggttttaatgatcagagcaatcaatgttttccaactttttagcaaatatttctatcaaattgacatgcccaaaacggcctccgaccatccgatcactggatatccgtctgacagtttttgatccgatcagaggacaaaatttcgcatttgaaaagcaaatttacggatttgaactgccaacggtgggagagaatggacgagaacaatcggttgagattggacggatcaaagcaaaaaacgcggggacacggggaaatggcacggcacgagaagaagcggatcagctgatcacttatgcgttgttaagcggaaatgagtgcgcttttcaatatttaaatggattcagaaaattaggcaccaaattttaaaaattattttagattttatttattctttaaattcatattatccattgagacatttaaatacaaaataagttaccgtatgtcaaatccgtctgactctcagctgactctaataataaa

SEQ ID NO: 70273 - DNA, 2373 bp, Heterodera glycines
  Genomic contig location: Contig_ID=SeqID_9107; Location=19..2391; Strand=-
  SCN-specific regions: Sequence locations=1-59,85-995,1017-1959,1981 -2345,2367-2373
atggatctgcggatcagcactccaaaaaatctgctgcagtatttggtcaaccaatacaacaggcagcaagcacggcaaaaccccaatgcccaacagaaaactgttgatgacattggcagtgttgttcggctttccgaacacaacgtaaattctctccaatattggaagaaaatgtatgaagattgcaacaccgtttttgcacggtgccatgacgcgaagaaagcgcgtctcttcattactttcacgaacaacagggaatggcctgagttcaaagagaatttacacaaaaacggtcaagtatttactgaccgttttgacatgtggatgcgtgtctggagcagcaaaatcgctgagttccgagaagaactttatgacaaaaagttcttcggaacaatccttggttacggtgaatcaatggagttccaaggccgaggaggcccacatgcccacattgtggcgcaaacagacctggacgcagttccatatgtcattcaggaatacatatgggcgcacattccatctttgcctgataaagatgacgacacgcccattgcaaaaatgcatcgcgaaatccgcgaaacaatgcatatgcaactgcacagatgcagtgacagttggtgtggtcctagcgacccaatttacgggcggtgcaagaaggggttcccagccccttactcaaaatgtacgattttgcgcccggacaggcccgcgatgtatttccggccttcaccaactgatggtggtgcccaattagaggtaaacggcctaatatacgacaactcacatgtcgtgccgtataatccttatattctgctacgttaccgagtacaccataatgtactgtttgcatatggtaacaaagcaaatattaaatacgcactcaagtacccttttaaagggccaggacattgttatgtcgagtgcaaagaagagtccggcaataaaatcaaaattgacgagccggctcaatatgccaagatgaactttcgtggtgcaacggaagcatatgccattgttcattcaatgccatttgcccgtctttcgcatcatgttgtcaaattggcaattcatttgccaaaccaacagcccattgtatatagggctttccagctggtgagcaaagctcaacaaatccagcaaggcgaactgccagaaacgcagtgttcagcctattggaaacaatggcaaaatgagtggaagaatgatccaaagtttaaggacattcttttcgaaaaagtcccagagcggttccgatgggcaaaggacaaatgggtcctgtacaaaaggcagcaaattaaaaggccacctatcggccgaattgttcctgtacccccatcggacccggaaaggttcgcgctctattcacttatgcgtcactttcctggagacccagaccatcttaagatggttaatgggttgctttgtacctcattcactgaggctgcaataatgcatggtcttcttgaagacgacaaaatttgggacaaaactctggcggaggcagctctgtcgcgctggccagatcagatgagatggctttttgtgagcatcctggtctatggccagccgagtaatgccatagaattgtggaacaagtacaaagaccaaatgtacaatccgcaaggcattattactctggcacagcataaagtagcagagcttgaagccctagccgacattgattggcggctgcacagctgctttaacttaagctgtgtgcattttagcctgccagacccgccaacttcaattgccaaaaatactgacgcggcaattgaagagtttttctttggcgatgatgatttgaatttgcctccagggcaaccaaatcctcgtccacagccaaatacccctccgccacttaacagcgaccaacagaaggtctttgatgctgttttgttggcaatacagtcgaaccctagggattcgactgtcccccgccgtttcttcatatacggcgatggaggcacaggaaagacattcctgtttggccaaattattaggcgcttgcgaaaggccccatacacctacaaagtgcttgctacggcatccactgggtgtgcagccattttgctgccatatgggaaaacagcccattccacgtttcgtctgggtagagaagtgtcattagacaaactcccaagcattccgctggagagcttctttgcccgtcggattcgtgaggcccaactcatcatcattgatgagatcaccatgcttcacaacacggtgattgaggtcatcgaccgagtgtgcaaagagatggcaattcgccagcacaaggatctcctcttcggaggaaaaacggtcattttcagcggtgacttcaaacagtcgctgccggtcgtgcctcatgaaggcttaaccgctcag

SEQ ID NO: 70274 - DNA, 64 bp, Heterodera glycines
  Genomic contig location: Contig_ID=SeqID_42362; Location=789..852; Strand=+
  SCN-specific regions: Sequence locations=1-64
atgaaaccgttgcgcagagaatgcgcaacaatcgcagcttcatgcccttgcgggtatggaggct

SEQ ID NO: 70275 - DNA, 672 bp, Heterodera glycines
  Genomic contig location: Contig_ID=SeqID_42367; Location=521..1192; Strand=+
  SCN-specific regions: Sequence locations=47-245,267-340,363-390,412 -431,453-672
  Gene Ontology: Mol. function=structural constituent of muscle; Cellular component=muscle thin filament tropomyosin; Biological process=pole plasm oskar mRNA localization
atggacgccatcaagaagaagatgcaggcgatgaagatcgagaaggtcattcgattgagcatttaaaaaggaacaaaaaaagacaacggaatgccaacaaactttggcattttaaggacaatgccatcgaccgggcggacgccgcggaggaaaagtgccgtcaaacgcaggaacggttggagcgtgttgaggaggaattgcgggacacgcagaagaaaatgatggtgagaggaggaggcaaatttgaatttaaaacattggcaaaatgttcaattgcaggcgacggagaacgaattggacaaggcgcaggaggacctgacggctgccaacaatttgttggaggagaaggagaagaaagtgcaggaggtgggccttttgccgattttggcatttccaatgcctttggggaggggcggcaacggcacaaacccaaaaataaattcttattttgtacctatttgatttggccaattcacttttcctccgtgtgttatccgaattcccaaaacggtgacgaaagcgagaattgcccgggcgaagaagcaaagaagcaaagactggattttcgatttgcgattgcttttccttcgctttgctttccctcggattttccccaccttcgccaggggacggaggcgaagaaaggcagcggaaaaagtgcataatttgctt

SEQ ID NO: 70276 - DNA, 114 bp, Heterodera glycines
  Genomic contig location: Contig_ID=SeqID_42368; Location=349..462; Strand=+
  SCN-specific regions: Sequence locations=1-114
tgccgaatgttccccacaaaattaaaaaacgggcgcgaagcgcccgtcctgaggccgcgaagcggcccaatgtctcaacaaaattaaaaaacgggcgcgaagcgcccgtcttga

SEQ ID NO: 70277 - DNA, 1749 bp, Heterodera glycines
  Genomic contig location: Contig_ID=SeqID_9108; Location=361..2109; Strand=+
  SCN-specific regions: Sequence locations=1-90,124-147,193-406,453 -544,566-856,885-1105,1127-1137,1159-1178,1201-1415,1437-1556,1578 -1749
  Gene Ontology: Mol. function=lipoprotein binding; Cellular component =integral to plasma membrane; Biological process=cell proliferation
atggaatggaaatgtgacggctctggcgactgtcgaaatggcgaagatgaaaaagattgccgtaagtgcatttattaattaactaataagttaattagcattattttaaaatggagaaaattgttgcttttgacaaaaaattggtcgaaaaatacatatttaaaaaatattttttataaaaagttaaaaaatccttttcccaagttaaacaggagaaagagaataatttttaaatctcaattaaattaatttagaagcatacagaatttgatttttaagtcgaacaaaatcgatgaaacactgaaattgttgtaaatgagcagtattctgtacaaatttacagttttctgaaccgtatcccatcaaaatgttcatcaaaatgcaaaaaagcaataaaataatgaggaaaaatatttgtattaatttaaaaaaaatatattttaatatttttagcccatcccggatgcaaagccgaccaatggcaatgtgacaagtacgaatggcattccgtctcctgtattgtaagggaaaaaaacaaaatgccaaatacatttacataattcaatttttttaaagcatgaataccaacgctgcgacaacatcacagactgttccgatggaagtgatgagcgcgattgtcgtaagtttagatttaaatttttgttagacattgtttaaataatgataaaattggaaatttttacagttaaataagcccctagttacggtaaaattattttaatttttagggtaaaacaaataattttcaaaattcagaatttttcaaatttcttgcaaaaattcttgaaaatttggaaaggatggagaagggggcgggcggggacgatttggacgcaataaaaataaaattttaatataaaaaacaattcaaatttgaaatcagccaagggttcaaattttatgaaaaaacaaaattcagccgcaagtccggtgaactgtgaggtgaatgatgggtcggtgttcagctgcgcggacggccgccaatgcttcccaattgcacggaaatgtgacggcaactacgactgtcgtgacctcagcgatgaaaaggattcatgcgcaacaaatcatacggtaggagatcggttcagagggtgctgggacgttagtcaaaaaccatcaaatggaaattttttgacagaaaattattcataacttcacccaaaatgaatcaaattttattatcttggtatttttagctaaccctaagtgttttctattatcctgcgaaatttcaaaaaaattcattaagtttcaaaaaagttatcacctgagaagttcaaaaaaccaagtttttttcaatatttttggtcataacttttttaaatcttagcgcatttttttgaaattttgtaggctaatagaaagcacttagggctatcgaatgacatcaaaaattaaaaatttagttgttttggaacaaagttatatcaaaaaatattttcatttgatggtttttgactaacgtcatagcaccgttcagagtacctttggtgtacggtgctattttcccctttggtattcagtatgaaaaatcctaaaaataattaattttaaaagaattgcggggacattgaaaaaatgaagaaaattaaaactttaaaaaagagaaaaatctaaatcctcaaaatcttaaataattatttctgcatctcctttaagcctttcttttcgtctccctattatccctttaaaatttattgtgtgttttgatgtgcttttagaagagta

SEQ ID NO: 70278 - DNA, 3951 bp, Heterodera glycines
  Genomic contig location: Contig_ID=SeqID_9109; Location=221..4171; Strand=+
  SCN-specific regions: Sequence locations=1-260,296-318,384-448,471 -783,805-818,840-982,1005-1065,1120-1251,1274-1277,1305-1508,1531 -1661,1687-1759,1806-2085,2396-2413,2457-2811,2845-2848,2871 -2900,2932-3064,3157-3305,...
  SCN-specific regions: Sequence locations=...3403-3412,3435-3507,3547 -3613,3636-3951
  Gene Ontology: Mol. function=calcium ion binding; Cellular component =lysosome; Biological process=receptor mediated endocytosis
gaaataacctttggtccacgcttggttgccaatctggctgtgttgcgtcgccgggcggcggtgtttgcacatgtccccagggatacaaattggacgaacgttttcaacgcacatgctcaggtgggtgtttgaaaaatagaatttttcgaaaaatttggaaaaatgcaaattttttaaattcaattttaagactaagaatttaagttttctactaattttctgtaaaataccttagagtaagtttcagttcttgcattttcttttattttttataattatcaaaataaaataatttcaaagagtccgcatttcaacaacaaaaaaaattattattttttagatttttactcaaacataaattaaatatatattttttttaaatacgaaaatttcttgtggttgaaaaaaagttttttttttttttgctaattgctgtccaccggttcccgcacagacatcaacgagtgtgccgagttcggctactgtgatcaaacgtgccaaaaccatcgtccgtcattcacctgtggctgtttgggctcctgttttcggctccaaatggtccaaagcatttcgtccgggcccggcaccggtggccactccaacatgtcactgcgcggctactgtgtgtccaatgaggcggaaaaaatgcgactgtttgtggcacggcgtgagggactgtaccgggtgaacccggccaacaaagtacgggttcgggttggcgccggcattgaattttcaactggaactggtcctgaatcctgcggcatttggatactggcccagactccccccgcccgaactccccaacttatactggtcccggaacttttttggcacccgaatgaaaaatgaatttcaatccgttcacgattgaaaatgccatccctttttttatttcatctataaaaagacatattttgtggctttttcaataacaaatcaaatgtgtccactttttttcgtatctgttttttgcacctttttgtgaaaattttgtaagaaaaatgccataaatcgatcgtgctctctaggattaatctttctaatataattaattcagctcacaataaaaataagatcaatttttttttaataataatatattatttttcttattttggcaaaatttaattgccaaattttttttttgcaaactaatagtttttgaataaatattttctttcaattattcatataaatcagaaaatattaaaatagtcatatccaactttatttttaacggcatttgggtattatttttttaaatatttttggtgttttaaatgtttaaattcatttttaaaggatgaacaggcggtgaaaattgcgtccggcgagttcatctatggcgtcgattttgactatgagcagaagaaaatgttctggacagatcgcatggcacattcactgttccgtgccgacatcactccgacgggagacattgaaaagattaaaaaattggacttaaaatcgtgagcattaaaatttttatccatgaaaaaaaaaactattttgtgggtttaaaagtcaatttttcttcattttttacaattttaatgggatgattttcaattttcatatatttttggtattttatttctattttggaattttcagaggaatttttatacaaattaatgacaaaaaaatatcatggaagatttctaaaaatttctttaaagaaagcaataattgttcattttctcaggctgatctatccacgcaatttggctgtcgattggatcacgaaaaatgtgacaataaaactaaattaaatatttaaataaatcgttaaaattaaaaaacaggttttcaaaaaattcaattaaaaatatgagaattataactggaaaatgaattaaataaaaataaaattgtaataccaaaattaaattaactaaaatgtcaggtctacgtgatcgagagtggctctcgacgcatcgatgtggtcacttatgaaggggacaagcggacggtgctgcttgcggacgcattaactttaccgttggacatcgcgttggacccgctccggggggacatgttcttctcaaatcaactccgattagagacaggtaaaattttaggattttaaatttaaatttaaaaatgaatttaatttattaactaaaaaataatttataatagtaattgaaaattaatttaaaaataaatatatttaattaaaaatattctttgaattaaatttgtgttcaatatcttatatttttatttattttgacattgaaaatggaaatatttgtatttaaaattttatattttttttattttgacattaaaaaagtatatatttgtaattcagagcatatttaaatttaaaattattattacattaggataaaattaaatattaaaaaaatgaaatttaattttaattcattcacaaaaatatgcctttaataaaaaataataattttcatttattttattttttttttgcaatgacctttttttagctcatatggacggaacaaatcgacgcgtgctaattgagtcccacactcaccaaggcaatttagttttttaacatgaaaaaatttaggcacccaaaaagttaaggatgcctctttttgagtacggtattaagaatacagtagtcaaatcatgagacggaaaaattgacagtacacagtctaattgccaaacaaacaaaagaaatttaagtgagcggtgtcgtagttgacattgcggccaaacgtgtgtattggagtgatccgaaagttgatcgggtggagtccattgactactcgggcaatgatcggcgccaaattgccagcggaaggtgaaaagttcaaaaaaataatattttaaatttataaaatatttcagcttttttaacttttattttgttgcaccccctcgatataatactaatgaaattctaaaataaaaatataatttttaaatttatatctcacgaattttgtatttcatttcttctgcagagattttgccccgcatccctttggactcgcaatgttcgaccagtttctgtactggacagactggacacggtaaataatatggtttcaaaattgtaatgtacaaaaaaaaattattttaatatataaatggtaaaaacaaattattttttttttcatttataataattatattaaaatttaatattattatatacaggatttcgtagaatttaatctttttttatgaaaattggtcaatttacagaacttctagaaataagacggaaaaatgatcacgaaaatctatgaagcatactttcatctaaaatttcatttgccaagaaatataattaattattctccaaatatttttttttttgaaaattttcttcaaaaattgtaagaaaaaaatatattaaaagatttatttttattagaaaataaaaattttaaattaaaagctatgttccataaaaataaaaaaaataaaatccactgtcctaattcagacttggcataatgcgcgttgagaagtttggcgcactgtcggaagtgatttggtttgttaaaaattaaaaaaaattaataaaaattaaaattttttgcctttgctaggtccatgaaggacagcaacgtgttcccgatgggcattgctgcttaccatccaaatgcccaaccaggccccaagcaaagcgagtgcttccagcagaccattgagaatccgtgtgccaagtccgactgcgagggcatgtgcctgctgagcaaggacagtgtcgggttcggagtcggcttccgctgcgcgtgcccaattggacaggtaaaatttatagtgccaagatggccaagagggagaggcatggacacttgggcaagcaatagtaccaaatagccaagtcggaagaggggatgatcaattggacaagtaaaatagtgccgagatggcaaatcggggggattgcggtatggccaatggacagacaggtagtagtgccatagatgaatggacaga

SEQ ID NO: 70279 - DNA, 425 bp, Heterodera glycines
  Genomic contig location: Contig_ID=SeqID_42374; Location=1..425; Strand=-
  SCN-specific regions: Sequence locations=1-275,297-425
atgtaaaaattaacagaaattcacgggttcattcgatagttgtgagaaattccccggagaaactccaaaaataatgtgaaattgattttttgaactcgcatctccaaaattttgtcatcccatcagaactcattttagcgaaggtgtaaaggtggccttcgtaagacaattttactttttgttttttggttgcaattgggttagccatttctgaaaaatgtccaaatcagaatgtacatcaaattggttaactattaaaaaataataggatttggaataagtaaaattgtaaaaaatgagcgaatgttaattaaacctaacttatgccaagtggcgagggatccctcaggcttagtttttagaatcttaatttttaaaaaaacacatttttctatttttgggttggggcccaaacgaccccgggg

SEQ ID NO: 70280 - DNA, 210 bp, Heterodera glycines
  Genomic contig location: Contig_ID=SeqID_42375; Location=641..850; Strand=+
  SCN-specific regions: Sequence locations=1-78,120-210
atgggggaaggcccaccacgaggccgcgaagcggccgagtgagtaccttcggtgcaggaaaattattaaggaagagagttcattatttatttgttttttgcataattaattcataaatatttttttcagaaagggttctgaaacgcaccaaattttatttacatgttagtttaggcactctgatgctttttctatcaaaaagggagatga

SEQ ID NO: 70281 - DNA, 704 bp, Heterodera glycines
  Genomic contig location: Contig_ID=SeqID_42375; Location=1053..1756; Strand=-
  SCN-specific regions: Sequence locations=1-255,277-391,413-544,571 -653,696-704
gtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagact

SEQ ID NO: 70282 - DNA, 1240 bp, Heterodera glycines
  misc_feature (67)..(67): n is a, c, g, or t
  misc_feature (70)..(70): n is a, c, g, or t
  Genomic contig location: Contig_ID=SeqID_42376; Location=111..1350; Strand=-
  SCN-specific regions: Sequence locations=1-285,309-483,505-682,704 -789,814-895,936-1045,1069-1240
atgagtttgctccagctgaagcacaaagagttggacctgaatgtgaggaacaaagccgggctttacnccngttacatcagtttcgtgatgcgtgaagaccttggtaaggccggactagataaatgtgctctttaaaattggcattcaaaaaaaaaattttttttcgaaagttttaatattatttactttcattttttgagaaaaaatttgttttttttcttcaatagcatggtgaagaatgaaaaatttcttaccccttcctaactttcaaaacatttctaacaatttttgagccaaaaattttaaaagcaaatcatttgctaacgttccattttaactccgatttcgatagtttaacaaagaaaaaaaaacagaaaaatgttctcaatagcgaaatgactttccaaatctcaaaaaagcatagagaattttgatttttcttataagaattttttttttaaatcttccagaatttttgagttccaggaacatacataaataagttaattaaaatgctgaatccaatttgctcaacttttgcgcccatttaaaaacaaaaaaaagttttccccattatccagggatggtgatgtgcctgctctcctacggtgccggccttgacgagcaggcggacagtggcaaaatgacggcactgcattttgcggtttcgaagcgcaatctgcagatcacgcgcttgctgctctgcctgggcgctgacccgaacgtggccaatgcgcacggggactcgccacggcatttggccgccaaattgaacgagtaattaattgattttttgggggttaattcatttttggggctacattgttcgttattctttacccatattttggaccgcgacgttttgaccaccttgccctttcgccccgccccgtggaaaaatttaacaattttataaattaaatgattaaaaaaatgccgcgcgttcgagcgaactcgaactttcattgtatttaatcggctccatcagcgtaccgactgcgctttgtgcgctgtgccatttcttttcaattattcactaatgctcgatagtctcccattttcaatttataaaaaatttaattgactcattcggttagagtccgttcaatgagattttataatgagaaatgacgtggaaaatttcactaggaaattagtgaatttgacgtagttctgccattctttttgggcgggtcctacccaaaaaatgtcacactgtctcaaaatgccacttaataaa

SEQ ID NO: 70283 - DNA, 1015 bp, Heterodera glycines
  Genomic contig location: Contig_ID=SeqID_42378; Location=162..1176; Strand=-
  SCN-specific regions: Sequence locations=1-24,46-75,109-155,177 -195,272-306,332-563,586-640,662-709,748-801,823-825,847-854,882 -954,983-1015
atgagcaaaagaaggtgaattatgttaaaagaataaaaaataaaattcagtcaaaatttatttgaaactctcagcaaattttcaaacgaattaattatgatgaaaaacgccaatttatttctctcccactttcggttgttcagcagcgactcagcacattaattacattaatttcaaagcacaggttgataaaacaaaattaaatttttaaatttttcaaactaattttaagagactattttttatcaaaatgtttttattttatttttaagacgctaaaataaatatccttaaattaaatcagtgttatttaaataattcattttaattttagtagtttaattggtgcaaccaacaattttcgaattgctgagactattgatttagtgaaaacgcttcaaaattttacaccaaaggatgaacttaaagcactcatgaaaataaagattttggatttgaacgagaaggtgaaattccacttgcttctcacatttgcaatacgattgtgtgtacaaattgaaccaaaatattttaatgtcgaacattttgttgagaaattattaaaaagaaatgaagtagaaattccaagttttattgagaaaaaaaaaagaattatgtacaaacaaaaggtgatatttaaatgaaaatgagattttaattagcgtaaaaggccaaaaatcattatctaaaataatatgacaaaatagtgtaataaatatttaaaaaaatccaaattaatttaaaattgatcatttatgttttatttaagcctggcaaatgatatagccatattttggagaaaagcttgagaattttgccaatgcagttcaacttaattacaattctcttcatggtaaaattaaaaattatatataaattatgagcgattaatgtcaataaaattgaaaatttttctcgattttgactctcgtgctctttttatgatttcgttacaataaaattaaaaataaaatttatttttcagatatacagcaaattgttggtgaattattag

SEQ ID NO: 70284 - DNA, 1606 bp, Heterodera glycines
  Genomic contig location: Contig_ID=SeqID_9111; Location=69..1674; Strand=-
  SCN-specific regions: Sequence locations=1-516,538-691,713-857,888 -903,1013-1255,1287-1475,1518-1606
atgagcagaaaacaacccaacaattttgcaaatttcgctgaactttcctcactatgtgaaagacttcgttctgaacgtttactaattgattgcgagcaaattgttttgcggaaccttaactcgaaggtattcacactggtattttccctcctttaaacattgctaaaacaggttaaaagtcaattttcggagatatgcagattggcttggatgtgccgtcatgagcaggtacaggcaccaacaacaaattacacaaaatgttttgtcatttgttgtttcaggggattttacgacaattgatcaactccgatttaagtgtatctccggacaactgttgtcaattgatcagcaatttgaattcttccaattttgttgaagcgcataaaatccttaaccaacatgccgccgagcttagtcatgtttttaaactcttaatgggtgccccccgtgcagttgcggcatttattaacgccgctgaaaagattcctacgcaggtaatacgagaatatttacactatataaaaaataaacgtacaattagtattcgagtgaagagcttggttttgcattgttcaacgtaatgtacggctcatgcgtttttcctgagaatgagaaaaatgtgctcgaactattgggccatttaataacgctgcaacttgtacaaagctcagacccaagaaaattgctgcgtaaaggcaattcggcattttcacgcatttacaaatcattttccgaggagcttttctccaacaaagtgggcatttttctaatacgatacatatcccggattattattaccaaggattccttttttggcacaaaaaatcgcaaaataggcacaaaatcctcgaataggcaaaaaaaaaaaaatatatatatatatattaccgctttttagatgggtaaataaaaaaaactttcttttgattatatttcaattgtaaatgaaattagtaaataattaaaaaaattgcttttttttgttttattgtatttttgttaaaaaaattttcgaaagtcctgaaaaaagctccaaaaatgacgaaataacaacaaaataggcattataaaagtcatcgtagacatcccaaaccaagcagaaaacgcttttttcgtgctttatctgtagcgtatcaagtgcgcaaaaaatttaggcatttgcctaaaaaaggaatccctaaccctaattatcggggggggggcgaaggcccaccacgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccagattttatttacatgttagtttaggcactctgatgctttttctatcaaaaagggagatgaataaa

SEQ ID NO: 70285 - DNA, 203 bp, Heterodera glycines
  Genomic contig location: Contig_ID=SeqID_42388; Location=1119..1321; Strand=+
  SCN-specific regions: Sequence locations=1-33,56-203
atgatctttctattcgactacgtcaaaggtgcgttttcccattttattatcatttctgaatattttgcttaagccttggctttgaacccctaagaaaaaaaaaattaatgaaattggcaacattttttcagctcacgattttgtcaaccttttttttttgtctttgatcactgatcaatggctgtgatcatcgattgatcaga

SEQ ID NO: 70286 - DNA, 450 bp, Heterodera glycines
  Genomic contig location: Contig_ID=SeqID_42390; Location=627..1076; Strand=+
  SCN-specific regions: Sequence locations=1-450
atgcacgaactaatggctaccgacaatccgagtgactatctggtggaacagtttgagtcgaagaagaaaagtgccaaaggtgagcatttggaagatccggataaaaaaagtggtgccaagaaagggtcaaagaagaataaaagtgccaatgagcaacgcaaagacaactacaacaagatcatgaagctgttgatgcagcagaagttgcacccgttcgactttttggccggcactgctcaaactgagcaaggggcggaacaatttcaaattggcggcatacagtatataattagtggacagatcgcgaacaaaaaaaaatgggagaaaaaggtgaagggaaaactgaagacacaaagtgaaatggacaaagcgaatgatacatgtggtcgattggccaaattggtggcaaacacgctgtacgacaacaacacggacccgcaggtgctttag

SEQ ID NO: 70287 - DNA, 59 bp, Heterodera glycines; identical to SEQ ID NO: 52421
  Genomic contig location: Contig_ID=SeqID_42391; Location=107..165; Strand=-
  SCN-specific regions: Sequence locations=1-59

SEQ ID NO: 70288 - DNA, 59 bp, Heterodera glycines; identical to SEQ ID NO: 52422
  Genomic contig location: Contig_ID=SeqID_42391; Location=237..295; Strand=-
  SCN-specific regions: Sequence locations=1-59

SEQ ID NO: 70289 - DNA, 59 bp, Heterodera glycines; identical to SEQ ID NO: 52421
  Genomic contig location: Contig_ID=SeqID_42391; Location=367..425; Strand=-
  SCN-specific regions: Sequence locations=1-59

SEQ ID NO: 70290 - DNA, 59 bp, Heterodera glycines; identical to SEQ ID NO: 52421
  Genomic contig location: Contig_ID=SeqID_42391; Location=497..555; Strand=-
  SCN-specific regions: Sequence locations=1-59

SEQ ID NO: 70291 - DNA, 1428 bp, Heterodera glycines
  Genomic contig location: Contig_ID=SeqID_9114; Location=5..1432; Strand=+
  SCN-specific regions: Sequence locations=1-49,79-322,344-469,491 -779,801-1100,1134-1394,1416-1428
atgacatcatccgaaaaaggaaatcattatgccatccctgaaccaaaaacaacgagaacaacaacaacaacttctgttggcggcaacaattcgaatgccaccgattattatgaaggtggtccttaattacctaattagttaacaattatataaataagtgcgcatattcgtggattaataatcaaatgatcaactgtattggtggtttttaattgattggactttttttaattttaaaaaacgggctcgggtcagtcgagcgcattcaattcgattcggaaggactggtgcggtcagtcttgaaatttgacggatggtgctgaactgatcgctctggaaaagtctgcgccgagttggacgcgttccatacaaaagcagacaaataattcattcattatctgatgataccaacgcatactttgggttaattacccactcactaaaagttgtcaaaaaagttcagcacgtggcagaagcagcagcagtgccatgccaacaatcggtgcacttttggccgagtttgatgacgaattggccaaacgggcacaaatggcactgccatcgccatcacaagcagcaaatgccatcgaatatgaagcccttttgttggacaaattggccaaaaagggtccgctgcaaagtgagcgtgaaattcggcgaagtccgcgcatcaacgacagaggcggcggcggagatcaaaaaagcttttggccactccaaaatgccaagatgttgatggaaatggatgaacaacaacagtttaacgaaatgattgtgtcggagaaggagggacgacagcacatggcaatggccaagggggaggacaacgacagcgagcagtccataaccgctggaggaggtgggatggacggacgggcggaaggctgctgaatgaatgatcagtggggggggggggattagggctggaaaaggccaaaaatggcgcggattggccatgcccgggattatacctaaaataatcttaaaattacgagatttcttagttttgccatgccatcaggtaccgggggaagagacccaaattgattcgcgatgagacaattgctaaaaaagttatccatgaaaattgcgaaaagacgaaatttttgaagtttttccttcttaaattttttccaggtttgaaaatctttaatattagtccttttttggctaaaaggctacaaattcctgttttttgctctccgccagcgttgaaaccaaaagaattgtaaaattcatttcgtatacattctgaaaacgtattgtcaaattgcagaaaacccttgtgacaacaattcggagatgacccatcgcatttggttggcggtggaaaacgcgcgactcgccagcgccgccggcaccgaacgaatgccgcagaaggcggccaagacgccgcgcgagtgtgtgcgcgtgtgcacaaatttattg

SEQ ID NO: 70292 - DNA, 149 bp, Heterodera glycines
  Genomic contig location: Contig_ID=SeqID_9115; Location=81..229; Strand=+
  SCN-specific regions: Sequence locations=1-149
atggttgcgtcgaatcggccggagaaatcgcagaaggttttggcataaaacaacaattttgcaaaaaattaattagaaatttatttgctcaaattaagagacaagtcaaatgggctccgtgcgaaggatgagaaagaaaatatgagaga

SEQ ID NO: 70293 - DNA, 249 bp, Heterodera glycines
  misc_feature (9)..(9): n is a, c, g, or t
  misc_feature (11)..(11): n is a, c, g, or t
  misc_feature (39)..(39): n is a, c, g, or t
  Genomic contig location: Contig_ID=SeqID_42393; Location=517..765; Strand=-
  SCN-specific regions: Sequence locations=1-11,33-72,111-227
atgaaaagnangaaattttatttatatgttagtttaggnagtatgatgttttttttattaaaaagggagatgaataaaatttttaaaaatttttaatttgtttttaaaaaggaaaaaaagtttaggtttaacttttttttcagaaacttatcagaagcgcaccaaactttgcagggatactgaaaggaagagaaataacctattttaaatattatctagtcagttcatttaaataatttattcaataaa

SEQ ID NO: 70294 - DNA, 896 bp, Heterodera glycines
  Genomic contig location: Contig_ID=SeqID_42397; Location=8..903; Strand=-
  SCN-specific regions: Sequence locations=1-68,91-217,239-294,359 -392,415-509,587-763,785-817,839-896
atgcccattcttgttggacttatttactatgccaatgtgaacccatttcggactgatcagaataattatttttggtgatcattccagcaatggtagaaactgatcaattattgacatgaatttcctagttgggttcacactggcaattacagtgaacagtacccaacagtaccgtataactcactctcactgcatctcgtccgacttagttccacattaccatgctttttgtttgttttcattaccgtattttgttctgctgctgctagtcgctacattaccgtacatttgtagtctctttgttgctctttttctctgctgtccttcaattttgtgctctctctctctctctcactctgtatatcgctgttgtatcgattatttttgattgattatttcttttatttgttctgtcttttttgttcgtctccaaactttgcgttgcgtcgtgtgctgttgcagtcctactatttgattgaggttggtcaaccaatgcgtgtccacttttgttttttttaaatatttaaaaaaaaatttttagacaaattaaaattaaaatttaacaacaaaaaaaaaaaattaatttccagaacctattgatgttgccgcccatcagccgatcgctattcggagcgaactgtgctgaatttgttcacacatttacaccacataatttgttgttccgatcagtcaggaatttcaatattttctaattcgaaaattttaattttattatggaatttattttcttaaaagtagtcaattgtgcaaatattaacaaaatgtcagacgagacaaaattgtcgagaatgtaaagaatgcctatgtttatataaaaatttttgagtgatcaaagcacttttagtgggtaattgatcagtttattggaaattaaa

SEQ ID NO: 70295 - DNA, 72 bp, Heterodera glycines
  Genomic contig location: Contig_ID=SeqID_42399; Location=61..132; Strand=-
  SCN-specific regions: Sequence locations=1-14,36-72
atgggcaaagacggagcggaacaacgaccaaacgaccaaccgttaggttgtcaagtaccgaaattgcggtcg

SEQ ID NO: 70296 - DNA, 506 bp, Heterodera glycines
  Genomic contig location: Contig_ID=SeqID_42399; Location=548..1053; Strand=+
  SCN-specific regions: Sequence locations=1-506
tttggcaccaattaccaccgtttttccatgtgaacgaatttcatttccttttagaaaaggagttaccaggggtaaaatgtaattttcacccatccaccattcttgtggacttgtgattttggccaaattaaggtaaaggagttgattaagcataattcgacctggactgatttcggttaattgccgggcatagatggtttgggggcgaagcatttgcgcagaaatgacggtggctgatctgaaatccccacctctgtatcgttttaagtcggttacaaaaccgggttgaaatgaaccaataaccaattttatcacctccacctttatggcaacagcttgaacgttgatcctgccttgtacgaaccacgagcgcaacgaatcgaccgggtttaagtcataggacaatctttcaaatccctccttccactcaaacttactgaccacaactgtgtctcccatttgaaggcgtctctcggcacttaccaaagtatcaggaattcccataa

SEQ ID NO: 70297 - DNA, 1074 bp, Heterodera glycines
  Genomic contig location: Contig_ID=SeqID_42399; Location=317..1390; Strand=-
  SCN-specific regions: Sequence locations=1-1074
atggaaacggcgttagccgtcgagaaagtaattgaaaccgataaaactcgtggtatttccgcaggtcttgaagaagaatttgaacgaggcatggaattgggagaaggtcagtctgtggaaagaaacacagaaaatattgaaatcgaaactattcaagacttcactgcgactcaattctccaatgtctcgtggtcagagccacgtgccatcgcttcgcctgtgccaatgtcttcaaatgaagaacatggcgcggaaggcggtgttttgaagtatttggtgtgtcaaaccgacgtgaaaagtgtcgtgggtgggaaaatgagtggacaaggtccattttttatgggaattcctgatactttggtaagtgccgagagacgccttcaaatgggagacacagttgtggtcagtaagtttgagtggaaggagggatttgaaagattgtcctatgacttaaacccggtcgattcgttgcgctcgtggttcgtacaaggcaggatcaacgttcaagctgttgccataaaggtggaggtgataaaattggttattggttcatttcaacccggttttgtaaccgacttaaaacgatacagaggtggggatttcagatcagccaccgtcatttctgcgcaaatgcttcgcccccaaaccatctatgcccggcaattaaccgaaatcagtccaggtcgaattatgcttaatcaactcctttaccttaatttggccaaaatcacaagtccacaagaatggtggatgggtgaaaattacattttacccctggtaactccttttctaaaaggaaatgaaattcgttcacatggaaaaacggtggtaattggtgccaaagaaagtctggactctttctgttttccccttaaccagttttcagtgcgattgatgggagctgcggccgctgtccaacgttcattcgaaatggagaaattggcgaagcaaactgtcaatgtccaactcgtctggcagagaccagaagtacgaccggatgaagtgcaaacaaatttgaaaaaggcacaacgcgtctctttcgaatggttgatcaacaacaaatcggcgggctaa

SEQ ID NO: 70298 - DNA, 688 bp, Heterodera glycines
  Genomic contig location: Contig_ID=SeqID_42400; Location=211..898; Strand=+
  SCN-specific regions: Sequence locations=1-63,109-688
atgaaaggtagaaagtttatccaccacaccacatgtgcatgtgtgtaatcacatgactaaatgaaataaataatttaatttttttttctcaaaaaatttctccttcttcaccaatttcctactcttttcttgaccagacccccattcttaccagtgcaaatttttaccggcggtaccggtactagacaaaccggtaacggtaatttcatttttgaaaaaaccggtaccggtaacggtaccggtaccaaaaaacccggtaattaccggccagtaccggtaccggtaccggtaccgctcaaccctagttttgaccgaaaaattcggggtcttatctccgaatagttaatcaattattttgcccaaatttattgcccaaaaattatcggaatatcatttccgatttcaatttaatttgtccaaacccatattctctaaaatttcagaatttcatttccgagtcacattttttcgtccaattctcaaaaaatcttggattcttattccgttttacatttatttgggtccaaattcattttgtcctcggaatctcatttccgagtttcacgtttattttctgtcccttcccatttgtcccaaaattatcggaatctcatttccgagtttcacatttcttttgtccaatccaattttgtcaagaaatttcggagtctcatttccgagtgcctaa

SEQ ID NO: 70299 - DNA, 773 bp, Heterodera glycines
  Genomic contig location: Contig_ID=SeqID_9116; Location=624..1396; Strand=-
  SCN-specific regions: Sequence locations=1-31,63-380,402-739
atgctattaattactacatttgttggccagcaattttttattaatttaaagtaaaaataaatgttacgccaaattattggcgaatttcgtggggaaaattggagacaaagaacctctttcttcaccaaagttttggcccacttcaatcagcacttttatgtacacatttattggccagtaattttttactgctaaaagaacattaaatatttgcgtggaattatttgcgtttaatgaggaaaaatcacagtaaaaataattaaaaaacaatgacaaaggcaagaggaggcaattggtttgtatttaagcaacgatatggccaagagaaatgccaataaagcactcactcatttgctttggaggtactcattgacatttcattaattttattgcttaattttaggcattaattttccaaccgtttcttctcatcaatcccactcttcaaatcaacgattttcaacatgaacgtttggctcgcactttggtatgttaattgaggcaactcacacaaattaacccttgaaaattgaaatcaaaaaattttgatcacgaaaaaatgatttaatcggtttcaaatagcccaaaaaaagagcgaattttaatcagggaaaacttggtcaaataatgaattttgattttggccatatttagtctgttggcagctctcattagcgcatttgactgtggacgcagcgatggccctgacgcaaaactggactcggtaaatttttagtggattttttgaaattaattaattttattaaaataaa

SEQ ID NO: 70300 - DNA, 355 bp, Heterodera glycines
  Genomic contig location: Contig_ID=SeqID_9116; Location=2506..2860; Strand=+
  SCN-specific regions: Sequence locations=1-212,234-278,302-322,345-355
atgtcggaaccaatcagaacggctttagggataatggtcgagaatttaatcggtagactgaatgaacttctaccaattgtcagagcacagcagaggaacgaagagggattaaataaattgagagaagatagaatatttttaacagatttattagaaagaattgagcaaaaaaaccgtgaatgggatacatatataagagaaataggagaagaagctcagaatgaggaaaatgaaagataccgcttatttacccataatgggcgacatttttatgaatgggcagaaaggggaagagaaatggtcagcagaattaatattattctagctaatgaagatggagaaagtttagcagaga

SEQ ID NO: 70301 - DNA, 2002 bp, Heterodera glycines
  Genomic contig location: Contig_ID=SeqID_9117; Location=19..2020; Strand=+
  SCN-specific regions: Sequence locations=1-45,67-164,186-217,239 -954,976-1004,1026-1244,1266-1384,1435-1493,1516-1816,1838-2002
atgcatcaaaagatgcatatgcgacctgtgtttatctgagaagcgaagagaaagaaacagaaattcaacttttatattcacgcagcagattaaggccacggaaaatgaaaatttcaattccaagaatggaacttttgggagtgctaattggaacaagggcgatcaaatttgtgaaaacagaaattgggataacgatagatggaatgtatttatggtgtgattctaaaccagtacttagttgggtcaattcaaactgtgaccagcctcgatttgttgccaacagacttagtgaaatcaaattaaattatgggttggaatttgggtatgtctcaactgaacaaaatccagcagatgtggcaagcaggggttgtacaccaaaggaattaaagacacacccgttatggtggacaggaccagaatggctaaaaaaggcacagttacattggccaaatgaaatgaattttaaaattatacagtcaggagaccctcaagacaattgtcaaggatgccaaaagtcatttggcgtcattgaagacagagaaccggaaatggaacttattaattttaagaattataaagaatggcataaattagtgaaaatttttgcaagaatgcttaaaattgtaaataaatgggtacagttaattaaaaaacaaacaaatttaaaagtatcggaaggagaatacatcacgccaatggattacgaaatttctgaaaagatactcttaaaattgggtcaaaaaggatggaaagaatatgtcggaaaaaacaaccaaataaggtgggaaaaggacatcgatggattaattcgattaaaaacgaggattgagaggagtgcaacaccaaagtcatttcataatccaattgtatttccaaaagggtccaaaatcctggaaatccttattttaagagcgcataaaaatgtgatgcatgaaagagttgacgcaactttaaataattttttgagtgaattttgggcgcctggagttagaaatgcaattaaacaggttctgaaaaattgtgtgatttgtagaaagaatcgaggacctccttttgctctaccacccatgccacctcatccaaaatatagagtcagaagatccaacccgtttgagtttgtgtcattagattatttgggtccgtcagtaatcaaatcaaaaaataaaggtgaaccaagtggaaaatattggattgttttaataacttgtcttacaacaagagccgtatatttagaaccagtgtttgatttaacagcagaaacatttttacatgtgttaagaagattcgcaagcagacgagggaaaccaaaaagtataatgtcagataatgctcaaacatttaaattagccgcaaaggctggagaaatgtacgaaccaaaaaacacaaatataaaaaatgaagaaattagataattatttaactaaaaataaaattctttggaaatttattccggctttatccccctgggaaaatggatgtgcagaaaggctggttaaaatttgtaaagatgcctttaagtctgcattgggacgaattattttaaataaagaagaactgtgtacttttacggcagaagtcgaaacgattctaaattcgagaccaataacacatgtgtcaattgaacctgacggagaaagagctcttcgaccaattgactttattaatcccggagcggaattgggtatatttttgtcaaaaaacgggaatgagaatgaccaagattatagaactggtcaggcatcattagaagagagactaaaagaaaggtggaaacgtacaattagagcgttagacatattttgggacaggtggaaataaagaaaatttaattatgttgagaaatcggaaccaatgggattcacaaggtcccaaaatcacaaagatcatcgggaaacaaaattgggcgaagtggggatggttgaagatgatttatatccaaggaatacttggccgatgggacgaaatgcttaaatcgaatggaataccaggggtgattagaagt

SEQ ID NO: 70302 - DNA, 60 bp, Heterodera glycines
  Genomic contig location: Contig_ID=SeqID_42403; Location=90..149; Strand=-
  SCN-specific regions: Sequence locations=1-60
atgaatcaaattaaagtagatcaggaagaaagcaccaaactttgggattggccattgcaa

SEQ ID NO: 70303 - DNA, 561 bp, Heterodera glycines
  Genomic contig location: Contig_ID=SeqID_42406; Location=111..671; Strand=-
  SCN-specific regions: Sequence locations=1-150,172-561
atgacagtggtaatgaatacgctcaactggaaactcacatttttattttttatactttcaaaaagtaattgtgaacagccgcagaatgtgccaaaagcggaagaatggcacggaagtgtttaaaaatattaaaacgaattaaaaaagatattttaagatttatttgtgtatgtctatggattattagactcggtctcatggcataatggaataaattcggcaatatttgaaggtcaaatgtcaaatgaacgggctgaaaaacaggcatttggcattatgtgcagcatgaaatatgagaagaaaatacctgccaaatttgaaaaattgcgtcaaaatttttgcgagcaaatcgaaaatggcataagtattgaacgaacattagaaaatgtgcatgaaatggtgacaaatttgctacaaaatgttgccattaatcaactaattagcgaaaatggccaacaattaacaaaaaacgaatttctgactgataaaaaccaagcaaatgtcgacaaaatttatgaacacttcaaattggaaatggtccaattttttggcgctctaatg

SEQ ID NO: 70304 - DNA, 65 bp, Heterodera glycines; identical to SEQ ID NO: 56492
  Genomic contig location: Contig_ID=SeqID_42407; Location=655..719; Strand=+
  SCN-specific regions: Sequence locations=1-65

SEQ ID NO: 70305 - DNA, 59 bp, Heterodera glycines
  Genomic contig location: Contig_ID=SeqID_42407; Location=183..241; Strand=+
  SCN-specific regions: Sequence locations=1-59
accactttccttctctagtctggctctaccaaacactcacacgatatttgaaatgctaa

SEQ ID NO: 70306 - DNA, 59 bp, Heterodera glycines; identical to SEQ ID NO: 52421
  Genomic contig location: Contig_ID=SeqID_42407; Location=313..371; Strand=+
  SCN-specific regions: Sequence locations=1-59

SEQ ID NO: 70307 - DNA, 59 bp, Heterodera glycines; identical to SEQ ID NO: 52421
  Genomic contig location: Contig_ID=SeqID_42407; Location=443..501; Strand=+
  SCN-specific regions: Sequence locations=1-59

SEQ ID NO: 70308 - DNA, 828 bp, Heterodera glycines
  Genomic contig location: Contig_ID=SeqID_42409; Location=124..951; Strand=-
  SCN-specific regions: Sequence locations=1-828
atgaccgctaaaattatcagagtgccgaaaatcgcatgtgatctacgcctagaaaaaaatggtgtaagtaaaaatcgtaactacgctcaaaaagctcctcaaccaattttagcgcatccaattccttctacaatcgcctttatacatcccattatgaacgctaaaattatcagagtgccaaaaatcgcatgtgatctaagcctagaaaaaaatggtgtaagtaaaaatcgtaattacgctcaaaaagcttctcaaacaattttaacgcttccaattccatctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaattttagcgcatccaattccttctacaatcgcctttatacatcccattatgaacgctaaaattatcagagtgccgaaaatcgcatgtgatctaagcctagcaaaaaatggtgtaagtaaaaatcgtaattacgctcaaaaagctcctcaaacaattttagcgcttccaattccttctacaatcgcctttatacatcccattatgaacgctaaaattatcagagtgccgaaaatcgcatgtgatctacgcctagaaaaaaatggtgtaagtaaaaatcgtaactacgctcaaaaagcttctcaaccaattttagcgcatccaattccttctacaatcgcctttatacatcccattatgaacgctaaaattatcagagtgccgaaaatcgcatgtgatctaagcctagcaaaaaatggt

SEQ ID NO: 70309 - DNA, 202 bp, Heterodera glycines
  Genomic contig location: Contig_ID=SeqID_42411; Location=114..315; Strand=-
  SCN-specific regions: Sequence locations=1-9,40-202
atggattttcatcagcaacaacagcagcaacaacaacttttgttggctgccgccttatggcccccgcaacgggctgctgcacttgcgacaatgttgcgcagcaacaacggcacaacagaacacaataatggcaccaacggcatcacgagcaacaacaacaatggcacagacggagtgacggcaaatgttgccgactcgtcgg

SEQ ID NO: 70310 - DNA, 667 bp, Heterodera glycines
  misc_feature (610)..(610): n is a, c, g, or t
  Genomic contig location: Contig_ID=SeqID_9119; Location=1..667; Strand=-
  SCN-specific regions: Sequence locations=1-316,341-354,376-529,552-667
  Gene Ontology: Mol. function=glutamate-gated chloride channel activity
tcaaaattatgcaaaattgcgacaacaaactcagctgcaacagaagcaaaatgaaagcaaattgcacagcaattggctggcaagagaccaacaaattttgggccaattattgcgcaattacgacagacgcgtccgaccgccaatcgaagcgggagcaaacgaaacgggtggggatttggtcaattagcatgctaattaattaaataaatatgggaaatttattcaattaggatgtttaatagcttattaccactatagcttgttaaaaaatatttaattttgtcatttgtttgaaaattgtcgctgcgggggaaggaattaaattttaaaaatatattttcaaatagagattaagtaatttattgatgttgtttttctttgtttgagctgtccgtgtcagtgtgaacattctggtgcgcatgttaagcaacatcgacgtggtggacatggagtacagcttgcaaatcactttccgcgaacaatgggtggaccgacggcttgcatatgcacaattgggcccacaaatggcattttgaaaattaattaattacactaattaactctttttcagagtccatctcccccaaaatttctgactgttccccatgtngaagcgcgaatttggctacccgatacatttttccccactgaaaaggacgcgcaccga

SEQ ID NO: 70311 - DNA, 344 bp, Heterodera glycines
  Genomic contig location: Contig_ID=SeqID_9120; Location=627..970; Strand=-
  SCN-specific regions: Sequence locations=1-47,80-208,300-344
atgacaattggacaatggcacaaagtgccaacgggtaaacaacatccattatttttaattaatattttatttttttttactctctgtttcgaatggcatttcgttcattttgtctatttgatggttgtccaagatttagttgatgagcatctgtcggcagcacttctattctgctgatctgcggcataaattgctgaataaaaattcgaaattaatttaaaaatttaaatgaattaaaattgaaaattcattttgaatgttttattttttaattcatttttagatcaatttatttatttgtttgtgggttgattttgattttgcacataatgtgaatgaataaa

SEQ ID NO: 70312 - DNA, 429 bp, Heterodera glycines
  Genomic contig location: Contig_ID=SeqID_42413; Location=237..665; Strand=+
  SCN-specific regions: Sequence locations=1-222,244-329,363-429
atgaattttggcgttcaattcgtaaaggtatattctctgaatttttttagatcatttcttaggggtgtatttttccgatttttttgaatttttaatggaatttttcgggaaaaaacgccaaaaaaggcaccaaatcgctaaaactaatctttgtggtttttttagaatcaaggagcaaacacatgttttttggctgccttttctatcattttccaaaccgtgattgttgttgctgttgtgccaatttgttgggatgaatgatcattgttgttgctttggcacatggctgtgccgaaaatggcattcgaattggtgggaaacgcggaagcggatgacgacgatgatgaggaggaagatgatggcagattgaatgatgccaatgaatgaacgggcgcagactgttgattgcctatgtgaaatgatgaggaa

SEQ ID NO: 70313 - DNA, 158 bp, Heterodera glycines
  Genomic contig location: Contig_ID=SeqID_42418; Location=1114..1271; Strand=+
  SCN-specific regions: Sequence locations=1-158
gcacccatccaatttcattggtttcgcttcatggaccgacgtattggcaaccccaaaagggagggcccggctggcaaagtgacccttcagacggggctcaagcgggtgctggtggatcagagtctgatcggttggtcaaccgttgggagactatttga

SEQ ID NO: 70314 - DNA, 220 bp, Heterodera glycines
  Genomic contig location: Contig_ID=SeqID_42419; Location=534..753; Strand=-
  SCN-specific regions: Sequence locations=1-113,145-220
atgggatgccttatcgacgatggactcgatggaagtataactcgaagcgtgtaagagacttgtgcggatactcaacttggagactctacttttgggtacaaaacgactgggggattttaatgaaaaaataaaataaaatataaacagttaagtattcagcccaattctacaaaattactcttaattatggccagagtaattcaactttgtgaaaaataaa

SEQ ID NO: 70315 - DNA, 459 bp, Heterodera glycines
  Genomic contig location: Contig_ID=SeqID_42420; Location=96..554; Strand=+
  SCN-specific regions: Sequence locations=1-3,25-231,264-431
atgaaactcaaatcaatttggatcactgatgagaaaaaggggttggtcaattgttcaaataaattcaaaataacttaattcatcttatttctgagaatttttttagggtttttcgatatttttttgaattttaattcactttaaatccagaaatacaatattaaaaatctcaaatttaaaacaaattttactgcctccgggatgccataaaaaagctattttttagcacccaaataatttttaaaatttttatgtaaatattaccgaacgagttttgagggaacacgtgggcctggccgaggaacggaaatgtgtccgggatgttgtaaatgccattggaagtgcggatgaagcgcaaatgggtggaagaaatggcaaaaatacgccaaacaacgaaaacgagcagcacaaccgcaacgaagaacagaagcatttataataatgataattataatataa

SEQ ID NO: 70316 - DNA, 687 bp, Heterodera glycines
  Genomic contig location: Contig_ID=SeqID_42421; Location=886..1572; Strand=-
  SCN-specific regions: Sequence locations=1-377,399-530,557-646,669-687
tctgggcgcatcggttcggggggactgccccgaactattaaaatctattttttcaagtgtccgtttggggtactcaaatttttatggggagcaaaaatccaacgcagaattaaagtacagactatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagagcattttctggaaaaaatatttatgaattaattatgcaaaaaataaacaaataatgaa

SEQ ID NO: 70317 - DNA, 2477 bp, Heterodera glycines
  Genomic contig location: Contig_ID=SeqID_1232; Location=2098..4574; Strand=+
  SCN-specific regions: Sequence locations=1-306,337-445,468-469,492 -497,520-623,646-655,677-896,968-974,1010-1072,1094-1261,1290 -1373,1415-1448,1482-1810,1862-2168,2190-2277,2299-2477
atgtgccgggcggacggtggtgtttgtccactggcaattttatgccaaaaattggccttcaatgttcgccaagttggcgccaattggaggcggaacaatttattttggtaaaaaacaattttttttgccaatttttcaaattagaagtaatttttgccatcaaattaaggtggcgctcgaggtgggcatccgattgtttgacacgtcattctttggccataatcgtggacaaataagcaaagcaattaaggcatataattttattagtcttttgctaattaatgtgacattttacaaatacataggaaatataatacttaattaattttatttaaagaccgaaaattctttttcggcctgttgttgctatttgggttagggctctgaatagtcaaaattgatgcaatggtttgagattaatgtcatcaaaaatccaccggtaaacaaaatttaatcacttaaatataccaaaaataaattaattaaaaatagcgtttttggttattttcaagaaatttttgccattgtttggtctgctacgaacggatgtgtttattagtgcaaaaatcaacattgttcggcctgaaaacgcccaggatttgttcagatatgggtgggtttggattaattttttattacaaaaagatgagatttgaaaaataaaatattaaaattacaagagatggacacaaaattgcaaaaatatggatttaattctcaagtggagattaaaatttaacaaaaaatccttgaaagtcgcaatattacaaactaaattctcaaaaagcgccaaatatggcattaaaacttagaagaaaaaaatacacaaataaagctaaagttttttagtttttggggaaaaaaagaaaaatatgaaaattttgccaatttgggacttattttgatataaatatttagcaatttttaagaaattattatttttttattgatattttcataaaaatttcccaaaatctttccaaagaccagattttggcattagggattacttaaaagtcagagcgtttgaaattttatgagatgtttcaactgattgcctttatgccaaagtttcaactcattctgaaaagtacgaattgaataaggaaatatgctttttaaacctaaaaaaaataactgcaaattccaaccccctgctttagaccgattaaaaaagaaattgactgcgaccaattcaattcggttttcgattacgcacattttagcgtgaaggagtgcatcgaccaatttgatgggtggcttttttattatttatattttgttatttaggaattttaaattctctaaaattataacttttttgtttttcaaatgtttcctctttttaattaaacattttggtataaaatgcattttttagtaaataaatatttaaatcattttcaacaatttttcagctatattgacttgtgcatggttcactatgcgaaggatgcttttaaaaatgtgtcaaacacttgctcaaataacagaagtgaccgtgaagaagtgtacagtgtgttagaacattacatgggtcagtggggggtcaatggcgcgacatttggggatttataacattggataccagtaatttggggacccaacatttcggggtccggaaaatccgttaatggacaacacgtcagcggacaatccgtcagtaatagacaatctgtcagatgtccttaaaataatttgatgtccccaagtcgcaaatccccaaatgttaggtagccgagtgggtcagcatcattgatttttcgataaattctgaatttttttgttcataaattggagacgagaccagttataaaatacaaaattttaattttataaatatgctttttttattttttaagaaaatgattttagatccgcccaaaaatcttttttggctcggatttcgggattttcatttcgaactagggattagctctaatatcactgcttagtacatacaaatcccctttctcgtcaacagacattggcaccgttcggtccattggcgtggcaaatttcgactcagaccatgtcgaacacttagtcaagaacggcatacattgtgtgccggccgttgtccaatgcgaaatgcatccattcctacagcgtgacgatctgcttgattactgtaaatccgcagggattttcctgcaggtggtcaaatttggaaaaataatctaaaaagtcggaagggtcagtgaaaaatgcaccagggaatcagataattttctaacaaaatttcagacgaattttttcaaattaaattgttaagccaatttgtgttttaaaaatttaccttgcggcacaaatttgcacgaagggcacaaaagccccttaaattttttctaactataacctaaatacttaaaatttcgccaattggatttgaattgtgagtgtctgtttctcatgtttgtggatatggtgctagatggtcctagaaaagtttctcattggggcgagccaggggacaa

SEQ ID NO: 70318 - DNA, 890 bp, Heterodera glycines
  Genomic contig location: Contig_ID=SeqID_1232; Location=4738..5627; Strand=+
  SCN-specific regions: Sequence locations=1-890
atgattggcatgttatgggcatattatggaaccgccccgccccctttaaaagttaagcagttgtcactttgtttcctcatgcaacgcgccccacatgttggagcagtaattgtggaacaaacggatgatttgtttctcacaaaaaatggccgtccacggcgtgtgatgtcatgtcagcagctcaggaaactgctgaacggcctggtggccagcgtgtgcaacaacagcgaccaccttgatgaggctgatgagcactacgattacgacgacattccgccaaaatcccaagaacatcagcagttgagagtaggcactgctttgacaaaaaaaggaggaatgtcacgcaaaatcggggccttcaaaatgtccggggatttccaatctgacactgcgcgcgaatataaaaatgaagacgacgattgagggaagagactgttattcaaaatcaaatcaacggtgctatgtcgatcgacgaaaagtgcaaatttggtgtatcgaaaaaagtgcaaaatctgcaaagtttatttttactaaattaactcataacttcgcaactaaattgcacaatcttggtatcatacgatagcccttgaattgcgttattagcttgtcaaatttcaaaaaattttatttaagttttccaaaagttatgaccattttttcctgttttttggcttggacttttgaaaaaacttaatgagttttttgaaatttagtaagctaataacgcaattcacgcgcaatcgtatgataccaaaattgtgcaatttagttgccgctaagaaaagttatgagttgatttagccaaaagtttagcacttttcgtcgatcgaccaaccacgtaaatcaacatctaatttatttttaagacagaggcgaataatatcaaa

SEQ ID NO: 70319 - DNA, 722 bp, Heterodera glycines
  Genomic contig location: Contig_ID=SeqID_1232; Location=6220..6941; Strand=+
  SCN-specific regions: Sequence locations=1-166,203-253,277-491,515 -628,651-722
atggaagtaaaatacggaaatgtggacaaaaacctgaaatatggaaaattaaaaactatcaatattcgaatgataccaattttgaagataactgacgaacaaaaaagttatggccattcccatttgaaattgtacgaaacgccattgtacgaactgctatcgacccatttttggtgtcatgtgaaggaatggatggatgataaaatgaagatgatgacggaaaaaaagggacgaagcggaggggaagcggggacaaaggaaggaaaaggggcgacgaataatcgcctccggcactttcccgtggtgaataataaaaacaattttagcattctgagcagcaattcagagatgtgtcctgacttttaacaatcctttttgtattattttgtttaaatttgcaagaaaattggacagttttccaactcaagctaaatttcttgggcctagtttgatgcctaggctttgttttgtaaaatttataggcgtcattgaaaattcaaatatttaaaaaatttaaagtaatctggctttcacagggacccaaaattatatagtatttaaaaaaaattcatcaggaaagtaattataatgaaaatgcattagtaatttatccgtttaaaatttgtgcggtatatttttatttgtttccaagaattcgtttgtccatttttagggtcttcgtgaccagccaatggagtcgagttagttgctaatagttaata

SEQ ID NO: 70320 - DNA, 4521 bp, Heterodera glycines
  misc_feature (811)..(811): n is a, c, g, or t
  Genomic contig location: Contig_ID=SeqID_9121; Location=892..5412; Strand=-
  SCN-specific regions: Sequence locations=1-19,49-311,333-508,530 -549,571-586,609-688,713-717,740-922,947-1029,1078-1185,1208 -1289,1350-1391,1414-1472,1568-1945,1981-2327,2359-2644,2666 -3376,3398-3753,3778-3786,3811-3814,...
  SCN-specific regions: Sequence locations=...3844-3966,3988-4299,4327 -4521
  Gene Ontology: Mol. function=protein binding
tttctcgacattcgtctcccatcctccgctgctgctgctgctgatcagcaacgacagcccattttcgggctatcaccagtgtgcgccagcgagcagcacaatttttgcaattgtaaaggtggtaattctgatcaaaaaatgccgaacaaatcacttacaaatcgctgtttttgggtcccaactcggcactgtcccatggcgcacgtcaaaaaacggccgaatgcgaactgtccgtctcgccacagaatggtatgtttcagcaacagttgaggagatcagagcagaaagcaaatccaagaacagatcagggaaattcccaaattcccaaggacattgttgacaaaatgacaaatttcatgtcaatttcaacagcaatcttgtgctatttaagggcaatcccattaattttgggttcgatttgtttttcgctctcaagggctaatacttgtttcaaaattttactaaaaatattcagaaatttctattttttaagtcttaaaattttagcttgcaaaacaaattaaattctattggtaacagaaaaaaagaaattttatagttttgaattaatatccttggcctgttcctgctgatcactcactcactgatcagtgaagattgcaaataaatttgtttcccagcttttcatctgtcgcgtgtcgccgatcgtctcgcctttttcattgtgcccaattttggcccccgttttcccatttcggtgctactgcaaagtgaacaagtatattgttgttctgattttttggcccctcgccttttgcccatatcctttttttttgggccataccccacncgttaggggtttcatttttcttacagggattaagagtctggtgctctggtgagcacttgtcacttttttgagccttaaattatttttcgaagcgattgttttttatgtaatatattcaaaaataagtatttgtttatgtaaatccgggccctgtggttagttgctaaccttgtagcctgcagtgtttgtctcttgggttccattctcgaacggaatagatttttttcatattttctttacattattttaattaataaataaaatttcaagcttttatttttctttcatttttaaacagtctaaaaacccactaattaaccaaatatttggccgtttttttgacaaattcagttaacaaattccactcaaaatttattcccggcttttttcccggttttcccagccaaaaattcccggtttttcaacccgaaaggtcccggttccgggtttgcccaaaattccctgtcccgtggcactctattttaaataataagattaaaaaaaaatttaaaatggtttaaaaaattggaaacattttaataaatgcgcgatccgcgattcgcggcatttttttttgctcgatccgcggccgcggaaattttaatgcgcggccgcgggatttttctatgcgcgctccacccctggggcctgagtgggttccaaaataattttataaaattaaaatttaaaatatttgtttattatttattttaaacatttattccccaattttattttgtatttgttctgttcttaagcttttgcgtgcacacaaattggttatgatgactgcttctgatgtgtttgaagcgatgttccgttttgatgaaaaaaatggaaaaacgaaaaacggtacaaatattattattagggcttccaattatatggaaatccatatttttttcctggactgtgggaggtctgaaacgcacgaaaaacatgttttttgcttggtttgaagcgtctaggatgactttccatatccatatttttccatatttcgccatttatgtccatattttggcttttttccaaaaaacctctaataaaacggcccccatcagctaagtgggatttcgacccttaaagaccagaaaattttccaaaaagtcattttttagcgaaatgttgtcgaaaaaattgattaaatttaaattttcttaaaaattggttaatttatgtcaaaaataagcaaaaatggaaattttcgatttttgggtcgtttttctccagaaattgcttgttttcttctaaaaacgagttcttataccttatttaaccattttagatgtattttactagaatttatgaactttaaaattttttttggaaatttacccataaattcggaaaatttatgtccatattttgcaattttatgtccatattttgatattttggcaattttatgtccatattttgcgatttgttgtccatattttatggccatatttcgcgattttatatccatatttttggacgccctaattattattattattatgtgatgaaagggtaaaattaaaaataataaaaaaactttttaagcatctgccgaaagtgccgttgtgaaagtgcccgacattgaagttggtgcgttcaaagtgatgctcagctttatttatgcggaagattcaaacggactgaatggacacaacgcaatggcagtgctttacgcgggtgaaattttttgaatttgcccttaatatattattatggtacttctgtgttttgctacccctccccataaaaatatcatgatcccgacaaaggaaaacacttttctacgataattttatgcacttatcaagtccgctataaaaagtactaaaatctatgatttgatcagattttcatcctgtaattttgtcggctcaagtccagtttatgcgtcccatcgacttttatgcgtccaatcaatttttttgtctaattttagtgcatttacaattttccgtcattgactaatctatttttacaaaatttcacaatagttcaaactatacggggtaatttatgcgaatataacgatcggtttccgtttcgtagctatattcgttaacacaacgacctttgtcatagatgttgttattgtcaggacaaattccgcaacaatgccaaggttgcgctcttcgatatccgaatttgtcaatgataaagccttgccattccatacacaaaattaaagggcaggtcagcagtaatatagctcgtcgaaacatagcaaccggagtttgaagaatggagaaaaatgccggctggctgttttttgccaacgaacggagagaaaaagcggctagtattggtttttgccgacaaattgtgagaaaaaggccggctgttacttggctattatagtgcattttttgttttaatggatttattttaatgaaaaatttgattggacgcataaaaatttgattggacgcataaaagtcgatgggacgcataaactggacttgagccattttgtcaatgatttaaaaaaagaaccagtcttctcaaatatcaaccgattctcatagtcgagatgaatcgaatggtacttgtttcagggttcttcgatgtttctttcaaaagttctagcccaacaattggcttttttgaaaaatcaccggcaaaatcatatgatgaaagtcatagataaattttatggggaggggtagcaaaacccagaagtaccttattattacatggtttaagccaaaaagtacaacatctccttgctggacaatgcctgcttggtcttcccaatctctcaattgaacaatgtgttcctcgcttatgaccaagcttgccttctcaacgagaatgtatgaaattttaaggcataaatgcttgaaaagcaaaaaaaaaggactagattttcatccccttacaaatgagatgtacccaagtgacgttgggacttccgaaccaaactttcagtttacccccttttgtattataaaattttttttttatatcttgaagagatatgaaacctttccttttgttccgaataattttatgtattttgtttttgtttaacatcaaattaggctctatggaattttcatgatttttttttctgtgaattttcaaaattgatcattaaagttaggcatactttcgcataaactttattttttcatcatctcacttgcattaaatagtatattgaaaatgtttaaaaagctaaacaatttaaattggttcggcaaattttacaaaatttcaccctttttcaaaatttccgtgcgggtgtgttaaacattaactatggctttaataatcgaaataacttagccaaaatttctttctttagaattttgcccttcgctgcttggattacattgatcgaactgcggaaactttgttccgttccgatgcatttttgcaaattgatcagaatttgttgtctaaaattcttgaacgtgaccaattgaacattagcggggaactctcaatttggaatgccgtaagtaaaaatctgagcccagaattttggaaaatggcaaaaggggttggggttagaaacaggggctttgctcaaaaattcctgactttgcaaaaatgttatttcttgcaggcactccgttgggcagacgaaaaatgccgccaaaatggcaccgaatgttccgctgagaatcgtcgtgccgcacttggcccggcactgttcaaaattcgttttccactcttcgcaaaagagcaattttcagagaaaattg

SEQ ID NO: 70321 - DNA, 69 bp, Heterodera glycines
  Genomic contig location: Contig_ID=SeqID_42422; Location=624..692; Strand=+
  SCN-specific regions: Sequence locations=1-69
atgtcaatggggccaccctcattcaccatgttcggtgatgcattattgtcactgcacagatcagcaccg

SEQ ID NO: 70322 - DNA, 88 bp, Heterodera glycines
  Genomic contig location: Contig_ID=SeqID_42423; Location=300..387; Strand=+
  SCN-specific regions: Sequence locations=1-88
ccaacggatgccatcgaagcgtgggccgaactcgtggaaatgatgttcagcaatgtccgcgatggtctgtcccatttctcatttgacg

SEQ ID NO: 70323 - DNA, 141 bp, Heterodera glycines
  Genomic contig location: Contig_ID=SeqID_42426; Location=660..800; Strand=-
  SCN-specific regions: Sequence locations=1-141
atgcaaagataaagaagatgtctcataatcgtgatctgtatttattgatgtattgtacatttgtatgcatatatcatttgctgtgtattatcactttatttccatctgtgttccgaaataaattgaattgatggtcattaa

SEQ ID NO: 70324 - DNA, 87 bp, Heterodera glycines
  Genomic contig location: Contig_ID=SeqID_42427; Location=326..412; Strand=+
  SCN-specific regions: Sequence locations=1-87
atgtggcatccgtcagtggacaatccgtcagtgaaggacaatccgtcagtgaaggacaatccgtcagtaatggacaatccgtcagtg

SEQ ID NO: 70325 - DNA, 445 bp, Heterodera glycines
  Genomic contig location: Contig_ID=SeqID_42431; Location=347..791; Strand=-
  SCN-specific regions: Sequence locations=60-131,199-334,370-445
ggccgttcttagttcgtggagcgatttgtctggtttattccgataacgagcgagactctagcctactaaatagttggctcattgcttctgtgggcacaacttcttagagggattttcggtgttcagccgcacgaaattgagcaataacaggtctgtgatgcccttagatgtccggggctgcacgcgcgctacactggcaaaatcagcgtgcttgtccttccccgaaaggggttggtaaaccggtgaaaatttgccgtgattgggatcggacattgcaattattgtccgtgaacgaggaattccttgtaggggcgagtcatcaactcgctctgaatacgtccctgccctttgtacacaccgcccgtcgctgcccgggactgagccatttcgagaaattcggggacggttagtgttccggcttcggtcggtatgcagactggaaccg

SEQ ID NO: 70326 - DNA, 1012 bp, Heterodera glycines
  Genomic contig location: Contig_ID=SeqID_9124; Location=44..1055; Strand=+
  SCN-specific regions: Sequence locations=1-1012
atgagcgctaaaattatcagagtgccgaaaatcgcatgtgatctaagcctagcaaaaaatggtgtaagtaaaaatcgtaattacgctcaaaaagctcctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaattttagcgcatccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaattttagcgcatccaattccttctacaatcgcctttatacatcccattatgagcgctaaaattatcagagtgccgaaaatcgcatgtgatctaagcctagcaaaaaatggtgtaagtaaaaatcgtaattacgctcaaaaagctcctcaaacaattttagcgcttccaattccttctacaatcgcctttatacatcccattatgagcgctaaaattatcagagtgccgaaaatcgcatgtgatctaagcctagaaaaaatggtctaacaagggaacctcgcgaactgtaactcggaaaatgggtataaatttggtaccattcgatagagcagggtcgacttctattgtgaatttttaattttacgtgcctatagcgaaaaataaaaaagttatgaggcctcaaaaaccctaattttcccctgtgttttcccttcagtgctggtggtcaagtggtgcagaatggcgccatggtgactggtggttcgactccgcgtgggttcaacaattcttattgtttttattaatcattttaaagtaccaaaaagtggtcaaaaacaagtttaaagcacgaaataattaattacaacggtgtttggcgaga

SEQ ID NO: 70327 - DNA, 56 bp, Heterodera glycines
  Genomic contig location: Contig_ID=SeqID_9124; Location=1490..1545; Strand=-
  SCN-specific regions: Sequence locations=1-56
tgctggtggtcaagtggtgcagaatggcgccatggtgactggtggttcgactccgc

SEQ ID NO: 70328 - DNA, 358 bp, Heterodera glycines
  Genomic contig location: Contig_ID=SeqID_9124; Location=1661..2018; Strand=+
  SCN-specific regions: Sequence locations=1-92,114-358
atggtaccaaatttatacccattttccgagttacagttcgcgaggttcccttgtaagtaaaaatcgtaattacgctcaaaaagcttctcaaacaattttagcacatccaattccttctacaatcgcctttatacatcccattatgaacgctaaaattatcagagtgccgaaaatcgcatgtgatctaagcctagcaaaaaatggtgaaagtaaaaatcgtaattacgctcaaaaagctcctcaaacaattttagcgcttccaattccttctacaatcgcctttatacatcccattatgagcgctaaaattatcagagtgccgaaaatcgcatgtgatctaagcctagcaaaaaatggt

SEQ ID NO: 70329 - DNA, 668 bp, Heterodera glycines
  Genomic contig location: Contig_ID=SeqID_42432; Location=3..670; Strand=+
  SCN-specific regions: Sequence locations=1-203,226-500,523-668
catttcaatcactggcactcaattctcctacatttcaatcactgggactcaacccaccaacatttcaatcactgggactcaacccaccaacatttcaatcactgggactcaacccaccaacatttcaatcactgggactcaacccaccaacatttcaatcactgggactcaacccaacaggatttcaatcactgggactcaacccaccagcattccaatcactgggactcaattctcctacatttcaatcactgggactcaacccaccaacatttcaatcactgggactcaacccaccaacatttcaatcgggactcaacccaccaacatttcaatcactgggactcaacccaccaacatttcaatcactgggactcaacccaacagcatttcaatcactgggactcaacccaccaacatttcaatcactgggactcaacccaccaacatttcaatcactgggactcaacccaacaacatttcaatcactggtactcaacccaccagcattccaatcactgggactcaacccaccaacatttcaatcggactcaacccaccagcatttcaatcactgggactcaacccaccaacatttcaatcactgggactcaacccaccaacatttcaatcactgggactcaacccaccaacatttcaatcactga

SEQ ID NO: 70330 - DNA, 408 bp, Heterodera glycines
  Genomic contig location: Contig_ID=SeqID_42440; Location=1..408; Strand=-
  SCN-specific regions: Sequence locations=1-65,87-408
atctcccttttcgatagaaaaagcatcagagtgcctaaactaacatgtaaataaaatttggtgcgtttcagagcattttctgaaaaaatatttatgaaataaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattcccgaaggattcggtctccccataaatctgggcgcatcggt

SEQ ID NO: 70331 - DNA, 622 bp, Heterodera glycines
  Genomic contig location: Contig_ID=SeqID_9125; Location=605..1226; Strand=-
  SCN-specific regions: Sequence locations=1-119,141-160,182-622
  Gene Ontology: Mol. function=polypeptide N -acetylgalactosaminyltransferase activity; Cellular component =integral to membrane; Biological process=O-linked glycosylation
actggtcgtatttcgacgtggaggaaaacaatgtgaagccgtacaaaacgccagcaatgagtggaggtgggggagaaagggaaatggtcaaaaaagggggagagggaatgtgaggagacaaagaaatgagaaaaagaaaacactcatcggttacgccaatcactgcacttaaaggccttttggcggtgtctcgcgattatttccgtgagattggcgagtacgacatgggcatggaaatatggggcgcggagaatatcgagttctcaatccgcgtttggctgtgcggtggcgaggtgctggtcgcgccgtgttcccgcgtcggccacgtgtttcgcatgcgccgcccgtaccgcggcaagccgggcgtcgactcgagcctgtacaactcgctgaggacggcccgcgtttggttggacgattttgaggttggcgcgttttttgtcccgccccccacgcagcagcgatttcagaaaaaatacaccgcaattcgaccagcagcaaaaagaaccgatcccggcgatttggcagaacgattgaaactgaaagagaagctgaactgcaagccgttcgaatggttcatcgaaaacgtggaacccaaattaaagccatcccacgacgagct

SEQ ID NO: 70332 - DNA, 436 bp, Heterodera glycines
  Genomic contig location: Contig_ID=SeqID_9126; Location=138..573; Strand=-
  SCN-specific regions: Sequence locations=1-130,152-436
atgggtgagcgacaaaatcggaccgacgagaaagttggacaaaatggcacatccgaagtgagtaacgaaggacaaacggacgaaacgaatggatatttactcgagaataatcttgaaatatcacaaaaagtacacaacgtttttgaaaaggtgcgctgagattgacttctccaaagtgcactcaaaggtcactgtggtggtcatttaccacaatgaaatgctgtcagtgctcgtcagaatggtaattgcagtggaaagaaaggccgaaaaaacaaatgcattcgaatggggcaattaattatttaattaatgggccaatggatggctaatggacgcacggagaaaacgcaaaaattcaaacggatgttaacaacttgccaattgtttacagatcaactcaatcttcaacgaatcgccggcacatcttttgactgaa

SEQ ID NO: 70333 - DNA, 817 bp, Heterodera glycines
  Genomic contig location: Contig_ID=SeqID_9127; Location=310..1126; Strand=-
  SCN-specific regions: Sequence locations=1-270,292-519,542-723,745-817
gcccaacccaaggaagtgatgctccccgtccaattgaacaaaacgcgggcagcggctgctcgtaacctttacgggttggcccccgagcagttgcttgcctacgcttcgtatatgccgcggatgccgcctttttacgggccgaccgtgtcttcgcatggccatcaccacgggcttttgaccgcttatccaacagtcaatccaggaagtaaacaaactgatattaatggtccgccatagcaaatccgggctcattttagtgttcggaaacgggttccctcatcctccgcatcagccgggcactataacagggacaaacgcatttggcatggcaacgtcgggacggagcagttcaaacaacaacggcacgacggggctgaatgcgcgcgactttgcagcggcgcaattggtggcacaacagcaagcagtttacgaggcagcaatggtgggaatacatgtgggaagcgaacccaaaataaatccaagttattgtcaggtctacgctaatcagctgagttcgttggctgggggcggtgcgggcggcgaattcggcggtggtccctcaacggcgtcacctttcggaggccgcggcggtcatcaccagcacatgccccagccgcatcagcagacggcctttgtcacgtccgctcctcaacaatcgcacgcccatcaccaccatttcgcttcgctgcctccgtccgtgttggccgccccgcccgtccacttccatcaccaccaacaacagcatctcccgccaccaccccccggcggcactccctccggcggtgtcgtaccactaaactttggcaaatcttcatga

SEQ ID NO: 70334 - DNA, 1259 bp, Heterodera glycines
  Genomic contig location: Contig_ID=SeqID_9128; Location=135..1393; Strand=-
  SCN-specific regions: Sequence locations=1-30,124-562,584-1259
  Gene Ontology: Mol. function=poly(U) binding; Cellular component =polysome; Biological process=neurogenesis
atgagtgaagacggaggtgaaaagaatggcgaggaggcgaacagacggaaggataatgagaggggggcgaacgaaaacgaagagacggagggggaggagaaggacgaggaaggacgggaggagagcgatcagcaggacgacaacttgacagtgcagcaacggcttcagcaccaggtggacgcacgacgggcaattcgggggaagttgaattttgggggttgggtggaattcagggaaggggtttgaaccacgtcgaattgcatcatttgacagttacatatcccaatattttttaattccgccatgttttgtgaaaataaaactaaccatggcttcaaaatgttaagcccaactcagtgccgaagaaacaatcggcgaaggaatgtttggatgacaaaacaaacaacaagcagaaaacgccgtcagcagaacgaaagctcggcggcggcagttcgagttccgctccattgactgaagcgacggatgcggaatcgcaggcgacgacaacgaatgtggacgaaagtggggagagcgatgcgggagggcagcagaacgagccggggttggtgggagggaggggagagagggcacggcactcgcggcactctgtgatttcaatctttgtgggtttttaaagaaaatctttcagaaaaatcgtttatcggtggcttgagttggcagacctcagccggtaattgaaatcgttttttaaattatttttaccattgctttgcagagggccttcgtgattacttttgcaaatttggagaggtcaacgaatgcatggtgagtcgctccacaataaaagaaaactatttttttaaatctagagtaatcttcaaaaattatcattttttgattttgaatgtccctttttttgcaaaatcctctaagaattttgaaatcaaacaaattacccgggaaacaatgtgaggggaagggggctttaaatacacacaatcaatcagtcagtttagttccattgcttttaggttatgcgcgacccgaccactaaacgggcccgaggctttggttttatcacatttgctgacccaacggcagttgagaaagtgttggccaatgattgtcatgagttggatgggaaaaggatcgatccgaaagtggcatttccaaagaagcagcagccgaaaatggtggtcaaaacgaagaaagtgttcataggcggtctctcctcaaattcgacgctcgacgacatcaaagcgtattttgcgcaatatggaaaggtgacaaaggactaa

SEQ ID NO: 70335 - DNA, 56 bp, Heterodera glycines
  Genomic contig location: Contig_ID=SeqID_42442; Location=553..608; Strand=-
  SCN-specific regions: Sequence locations=1-56
actatagagaagctattcccgaaggattcggtctccccataaatctggacgcatcg

SEQ ID NO: 70336 - DNA, 153 bp, Heterodera glycines
  Genomic contig location: Contig_ID=SeqID_42443; Location=195..347; Strand=-
  SCN-specific regions: Sequence locations=1-153
atggcgcattataatcgacgggctgccgggaacgccttagtgagttcatggagaagtgcagattgatgtttccatcctcaaattccccaatttttttagcgcgggatgcaaattcacggcactgctccatttcccggcttcgtacccaaatga

SEQ ID NO: 70337 - DNA, 63 bp, Heterodera glycines
  Genomic contig location: Contig_ID=SeqID_42444; Location=580..642; Strand=+
  SCN-specific regions: Sequence locations=1-63
atgagaaaaaagatgtttgatagggccagacaagagaaggcaactgttggtaccaagtttgcg

SEQ ID NO: 70338 - DNA, 232 bp, Heterodera glycines
  Genomic contig location: Contig_ID=SeqID_42445; Location=896..1127; Strand=-
  SCN-specific regions: Sequence locations=1-70,92-116,145-232
agtgaaagcatctggagtgcctaaaataacttgtaaataatttttggtgcgtttcagagcagtttgtgaaaaaatatttatgaattaattttgctaaaaaaataaaatagtgaagctttaaaaattaataaaaaattttaaattcagaattactggagttagcatcatagcagtgcttttccttgtctttttgatgccctcgcaaaatctggttcgcttctgatcagtttat

SEQ ID NO: 70339 - DNA, 146 bp, Heterodera glycines
  Genomic contig location: Contig_ID=SeqID_42449; Location=58..203; Strand=+
  SCN-specific regions: Sequence locations=1-62,84-146
gcttgggcatatcacaccgcgcgccatgcgcaaagctttaaatcggccgattgtgtctcagatttgttgtcaaaaatttttcctgattcaaaaattgcggcaaattacggatcaaaacaaaataaatgcgcagcaattattacaag

SEQ ID NO: 70340 - DNA, 1017 bp, Heterodera glycines
  Genomic contig location: Contig_ID=SeqID_42450; Location=86..1102; Strand=-
  SCN-specific regions: Sequence locations=1-249,272-449,472-723,746 -750,773-1017
atggacagcaaccaaatcaccagaattttaacgtcgtccgaaataacgagccgcaagttccttggatgcttctcatgcgatcaactacctgagccgatggccatacgatttccggcatcattgattgttaatttggaccctcatcagtttcccggctctcattgggttgcaatatttgttaatggattaaataagaaggtcgattactttgatagtctatcgttacccattaatgaattggtagttaaatcctttcttaatgtctttcctggaatttattgtaaccagaagacctatcaatcagtttcatcaaattcatgtggacatttttgtatttgttttggttattttatattacttgcactaactgtcaccctttttctatacagatatttatcatctcataatccagaaatgatcgaaacaaataatatgctgaattttcacgataaaatgacaataatatatttttatatatggcttgaaaacatttagctctctgcctgcaagatctaatgagtggaaaatacatgagtatacaatatattttcagaaagtgtcaacagatttttggaatatatatttgcaatttatcaacaattttgagaagtgagttagaaatgataaacttcacgattcaaaccaattttcgttgctctaattaaccgcgataaaaacattcgaatcaattaaatagcttgtgagataataaggtttatcataaaatttcatttaaaaataaaccctcaattattggtatgaacgatactttccaaacatgcacgcgttttgctttagctatttatcatcgggcttgtcaatccaaagcgaaacaacaaagatgctgttttgaacgaataaagggcataggttattttgaagaagtgtcaaagaacatgcagcaataagcctgcaaaatctaataagtggaaaatacatgagtatagaatttattttcagaaagtgtcaacagacttttggaaaaatatatttgcaatttatcaacaattttgagaa

SEQ ID NO: 70341 - DNA, 1297 bp, Heterodera glycines
  Genomic contig location: Contig_ID=SeqID_9130; Location=408..1704; Strand=-
  SCN-specific regions: Sequence locations=1-23,45-173,216-328,374 -409,449-482,521-537,559-736,767-805,843-1020,1078-1091,1114 -1267,1289-1297
atgtttggtaaattcttaccctgtttaaatatttccaaaatttgtaatgttcttgaattatttcccgggttaatagtttcagagtattatgtaagttttataaactcttcccctttatacaattattataaaaatagcaactaatcacaagcttcaatatatatacaaaagccttatttttgaaaatatattaataatcagaaataattaaattagcatggaagccaaaattcaaaaaacagcacacaaaaatcgaaagattaacaaaataaaaaaattaacttttatctaaaatgataaatgcaacagcaggacaaacaatgcaacgaaaatttaagaaaaattattattattgaaatatttatattatattgtaagcaaaaatcagttagactaatttataatccactaaaattttatgaaaaaaataaatcttaataattattatgaacacgaagaaaaaatgtattttatcaatgcactaaaattaaaaaagaataattaatttaattgaaaaaatgacaattgtttaatattcaattgaaaattaaatttgcaaagctaaaaattcataattttattcataaggtttttcttaattttcatcaaattaattgaattagatttgatattagatgagggagaaagttggaaagcagttatttcttacaatatatgaccaataaataataaaaaaaattcgtaagtggatattttacgccttctcattaatgtcattaaaataatataaaaagataaaatattacaaccttgaatcaataaatataaataagttgtttgtgtgtaaatataatgaatttaaaaaacaattaaataaaaaagacaaagaagctcgaactatttaagttatgtggcatgctttggaacgagattctgagcataataatgaaaacaaataaatgcggaatagtatcagcgaatcatagaccatgactgtttaataaaacttttttcaaacgtaaactaaaaaacctttaataaaattttttaaatcaaattagaaaaaaactagactaaaaaaacaaaaaagaaaaaaaccataaataacaaaaaaaatgattgattcaatattgttgtttttgaattaataaagattaatcgatttgtaaagttttcttaaatcatatttttatagctaattcaataaaataacaattaattattaacaaactttttagttgttatttattacagatttattcctaaagtgaaactttgaagccaaaaccagtattgagattaataatttttaaaatctgaaattcttaccaataaa

SEQ ID NO: 70342 - DNA, 78 bp, Heterodera glycines
  Genomic contig location: Contig_ID=SeqID_42452; Location=93..170; Strand=-
  SCN-specific regions: Sequence locations=1-78
atgagttcaattagtcaaaacatttcgcccgaagagatggacaaaatccaaactcttcgtgaaatggtcaaagatcag

SEQ ID NO: 70343 - DNA, 449 bp, Heterodera glycines
  misc_feature (56)..(56): n is a, c, g, or t
  Genomic contig location: Contig_ID=SeqID_42453; Location=1..449; Strand=+
  SCN-specific regions: Sequence locations=1-305,332-414,436-449
ctccctttttgatagaaaaagcatcatagtgcctaaactaacatgtaaataaaatntggtgcgtttcagaacccttctgaaaaaatattgaagaattaattttgcaaaaaataaataattaatgaaaaagtcagaatttcgaaaaattttaaaaacaacaagcgttggcattttttcaggttaagttagtcctttacaatggagaaggcctgcaaaattaggagagattatatcgattttagtgcgctaggttcgatgaaactttttaaaatataagcctaaactttttcgcctgtttaaaaaggaattaaaaatttttaaaaattttattcatctcccttttgatagaaaaagcatcagagagccttatttaacttttaattaacatttggtgcgtttcagagcacgttctaaaaaatatttatgaattaattttgcaaaataataaa

SEQ ID NO: 70344 - DNA, 54 bp, Heterodera glycines; identical to SEQ ID NO: 53113
  Genomic contig location: Contig_ID=SeqID_42457; Location=112..165; Strand=-
  SCN-specific regions: Sequence locations=1-54

SEQ ID NO: 70345 - DNA, 174 bp, Heterodera glycines
  Genomic contig location: Contig_ID=SeqID_42457; Location=1068..1241; Strand=+
  SCN-specific regions: Sequence locations=1-113,136-174
ccaacgcagaattaaagtacaggctatagggaagctattcccgaaggattcggtctccccataaatctgggcgcatcggttcggggggactgccgcgaaaacaaaaataaatcgattttttcaagtgtccttaaagggactcaaacaattatggggagcaaaaatccaacgcag

SEQ ID NO: 70346 - DNA, 657 bp, Heterodera glycines
  Genomic contig location: Contig_ID=SeqID_42458; Location=131..787; Strand=+
  SCN-specific regions: Sequence locations=1-565,589-657
gcggaaggaacgaaatgttttctgcgaaaagcatttcccaacaaatgcgaatgccgttttcgctgtggctgacaatgaaccgcttgaaacacatcccaaaactccaacagcggcccccgggggaatgaccccccagccgaatgggagagtatcgccggtggcctgtaatatcatacaaaaggggtaagaccatcaaaaggctaggaatctgtttcgttaagtattatgtaacaaagttaccttttaaggtcggtaaaggcgaaggattgggacagaatagtgaaaatcacacaaacgccgttgtctctgcgaaaaagtatgggcgacagcagcaaatgcccactcagacaacaacgctcttttgaacgagctcggactattttgtttccttgtgaaacgacaccgcaaaccacgggcaaaaaaattgttacgcgttcagttacgaaaaaattggacagaaaaaaagaggacgagggacaaacgacgccaacacgaaaaaagacggacgaagacagaccaaatgagaagtgcacgccaccaacaacaaatgtggacagacccaccgcacttccattgtccattctgaagtcggacaggaagagatcgcgtctccccacggactcattatgtatttctggaccaaggacaattcgtatc

SEQ ID NO: 70347 - DNA, 903 bp, Heterodera glycines
  Genomic contig location: Contig_ID=SeqID_42459; Location=139..1041; Strand=-
  SCN-specific regions: Sequence locations=1-111,153-406,432-516,538 -869,891-903
atggaacatcagagtttcccgtctaaaaaacttccgagtgaattagtctcagagctgatcatgtgcctcccaatgatgcgattgtttgacggaatagcgggtattaatgactttttattttattttttgtaattaattatatagaaaaaaatcgatggtcctcgaagattgacccagttaattggaaatttgagattttgcgtcagtcaagagaaaaggagtacaataaattcaagaatcgactggttggtcattagtttccatacatttttgaaaaaaattttaagtctgtcattaatgcgaaattcaattctgcttgtgaagtgaggaaactgaactttgagcaagactatttggattcggcgtatttccctgtcaatgagcaggtattttcggccgaattctttatggaaattctacagtatttatgctttggaaaatacaacaaaaatttggctccaaacgacattttaattcatacgacaaataatgatgtaaggaagagagataaatattattttggaattgaatttttaagtgcgctgcggtctcgaaattatgtgggcgggtgattgagtacgtcgttgggtcatcaaacccattcagcgtccgcaaacgcatcagcttgggcacaatgcagccaaccgatctacccgcatgtctgaagcagccggcgagagtgatggtgcgcggtggaatccatcctcaaatccgttcagatgaaaacgaagtctaccacctctacaattcaaatctcatgaagaaagttggatacatttcgatgttctaccatgtacgaattggtgattgtgtttggctcagtatagacttggtattgtattattaaaagacaaatctctttcaatttatttccgattttattttattttgtcgcctaataaa

SEQ ID NO: 70348 - DNA, 490 bp, Heterodera glycines
  Genomic contig location: Contig_ID=SeqID_9131; Location=689..1178; Strand=-
  SCN-specific regions: Sequence locations=1-421,444-490
atgattggacttgcgaccaaagaaatgccattgtacggaagggttggcacttatcctaacagttacggacaccgaagcgatggccttttttgggtcaacggttcctgccaaattggcagtcaaagtgccaaatttggcatcggagatgtcatcggctgtggcattattttggcaacgcaccaaattttttcacgaaaaacggacaccgtttgggttgacaaatgactaaaacggcatttttaatgggattttttcagattccgtcgattttgtggcactttttccttctgaagatggccctcttttcacttgtgtcactttgcacgattccgaagacaaaattgaggcgaattttgggccggaattcaactttaatcttaacactctctgaagaaacctttaaaaaacataatccatttgtatttttcattttgtaaacaaacggctgactaaactcggcacgcatgccctcagacgcctagttaataaa

SEQ ID NO: 70349 - DNA, 1620 bp, Heterodera glycines
  Genomic contig location: Contig_ID=SeqID_9132; Location=974..2593; Strand=+
  SCN-specific regions: Sequence locations=1-65,142-148,170-473,503 -587,622-652,679-800,829-852,889-929,952-1023,1047-1195,1217 -1350,1391-1457,1479-1538,1567-1570,1604-1620
atgtcttcaaatttgatgggttcgccaagctgctttttccatccaacagctgagcagggtaagagaaattatttaaaaaaaaattacgaaaaatggaaaatatttttttaaataaaaataaatttaaaataaacattttatcactacaagcagcagtggcagcagaagaagtggacaaatatgaagtgttcagttggcacggagatttgagcgaccaattggcagcacaatttttggtcactgatcagcagctgttgaaggtgggacaattcaaaacggacaaatgagcaaagagagaagaggacaaatgagcacagagagaagaggacaaatgagcacagagaggggaggaagggggaagagaccgatagattcagtaccgggcaaaaggccgacttattccgagagcaattaggaggcattttgccaaaaatcattcaattaatgagtgaatggaaattggaaattatttagtggattgaaaatattttttaatttaaggaatgccgcgaaaaacttgccaactccgaattgagagagacgaaattgctgtgcaaaaacggggaattgaatgcagagaatgtgagaaaaataaaaaataaaaatgaattatttaaaaaagaaaaatggcaaagaaggggtaaaaaacagaaactttcaaatttttaaataaaattcagaaggcgcttaaagcagagttggagaagcagaagctgatgacggaacacagtcaaattaaggccaaagtggacaaaatggagcaggaaaatcagcagcaattggacaaaaaatacggtaggaaaaatttaaaaaaaaaacaaattatttccattaccgtattcggtcctactgttaaaatgaatatttcaaaatgatttcagtttcattcgatgtgttcaatgcattggtggagcgaatcaaacgtttggagaaccagcagctgaagcagaacaaagaggaggacaaaaagggtaaaaataaattaattaacggaccgaactttacatatattgattagttaccaaattttaaattaacattaattagctaatcagttccaattattttcatgttttgttgttcaattggatactcttttagcagaggaaaagcagcagaaggaaagtgttggtcaacagaaattggatggaaaatatgccgtggtggacaaaaacaatgttttgggtgggcacaattggcaaattattttaaaaattgtcattaataaattggcgctatttaaaaaatgcggtttttgagagggggctaaaccaaggttctgttctgttgaattttaacctgtttcaaaagcgtttattagtcaaaatacactatctaaatctaaatgttaatgagttaatttaactttttgaaaatgttatttgaattgctttagtgacgtcatcgggcgaccaatcgccgccggcggttgtctcagcgaaagttgcaaaggtgggaaggaaacataattatttcacaaatgccattttaatttcaggaagtgcctaattcgaagaaacaaaatgattgggatgccaaagtttgccacaaagacatcgaaatcattggggaaaagcaattgacgatcaattgcaagggcaacagatttggtaattaaaa

SEQ ID NO: 70350 - DNA, 1263 bp, Heterodera glycines
  Genomic contig location: Contig_ID=SeqID_42462; Location=178..1440; Strand=-
  SCN-specific regions: Sequence locations=1-655,697-1044,1066-1263
atgaaaaatcactatgacaaacacccaaaagtgacagcagacaaattcaaaatcggcgagagagtaatggtcatatttccgggcgtaaatacccgcgcagcccaccgaaaacttctttggaatcagttcggtccatataaaattttggatatctctgattcgtcagcaaaattggttccagtcgataaaccgaattttgaacctataagtgttccaatcgagcggctagtgaaagttccggaaggtgtaccggatattagtactctccctcggggtaaaaatcccttcaaaaaccaattgaacgcattgctgagtgtagtttgtttggtgtatcgtgaaatggatattgagacgtgtgaagaaaatggacaatttacacaaacaaaaagtgttaaatttggaaatggaaccataaaaatggacgaatttcaaaaaacggaaaatatgggccagctttttattgggcaattgaggacaattgcaaattcagctgacggcgaggtgagagtgaaggacaacgctgaccatcctttggtctgggagatgcaatgtggcggactcggcacggaacatcgaaattgtgtccaattaacggctgccgacctcgacccagtgcttgagaaggccggcctaggccttaaagtgattggaagagaagaaaagatggaaaatgttgaaggaaaagttggttttaaggtgatcggtacgccaatgaaggctctcctcagtaatttcttactgaaatcgggcgcagtttcatcagtcgccggcggccaaaagttgacacaacttgtgatcagtgcgcccgtcggcttcgaactgatcgcttacagtggcggacgcgaagacctggtgaagaatggctttttcccgacggaaaatgacattgagagtgcctttacggcatgggtcgaacgatgtgcggtcacgcgagagaagctgatgaagacgggctacacaccaattgaagtgccaatgccgaacgtcgtcgccgaattgcccgaatcagagaagatgggatggcacgaaatgctgaaaaaagccaacttcattcttgaaaaagtgcgagccacaatcatccaccggaaacagctgttggtcgagacggcgacagtgatcatcggcgattcctcagccaaacaactgatcaaactttggcccaaatcgcaatttatcggtgccgaaaatggaacaatcaccgaagtgatcagggcgtttgacggcgccattctctcctccaaagtgaaggttgccatcgtgatg

SEQ ID NO: 70351 - DNA, 711 bp, Heterodera glycines
  Genomic contig location: Contig_ID=SeqID_42465; Location=1..711; Strand=+
  SCN-specific regions: Sequence locations=1-9,39-90,213-215,243 -250,289-289,326-397,465-600,636-711
cctagttctgaccgtaaacgatgccaactagcgatccgccggcggatttattcgccctggtggggagcttcccggaaacgaaagtcttccggttccgggggaagtatggttgcaaagctgaaacttaaaggaattgacggaagggcaccaccaggagtggagcctgcggcttaatttgactcaacacggggaaactcacccggcccggacaccgtaaggattgacagattgatagctttttcatgattcggtggatggtggtgcatggccgttcttagttcgtggagcaatttgtctggtttattccgataacgagcgagactctagcctactaaatagttggctcattgcttctgtgggcacaacttcttagagggattttcggtgttcagccgcacgaaattgagcaataacaggtctgtgatgcccttagatgtccggggctgcacgcgcgctacactggcaaaatcagcgtgcttgtccttccccgaaaggggttggtaaaccggtgaaaatttgccgtgattgggatcggacattgcaattattgtccgtgaacgaggaattccttgtaggggcgagtcatcaactcgctctgaatacgtccctgccctttgtacacaccgcccgtcgctgcccgggactgagccatttcgagaaattcggggacggttagtgttccggcttcggtcggtatgcagactggaaccg

SEQ ID NO: 70352 - DNA, 103 bp, Heterodera glycines
  Genomic contig location: Contig_ID=SeqID_42467; Location=934..1036; Strand=-
  SCN-specific regions: Sequence locations=1-13,35-103
ctcagcaaacttagaacacattttctaatcagagaacaaatggacggcaccactcaaatgatttttgatttaatttgcaccaatgataaattctacagcaaaa

SEQ ID NO: 70353 - DNA, 135 bp, Heterodera glycines
  Genomic contig location: Contig_ID=SeqID_42471; Location=248..382; Strand=-
  SCN-specific regions: Sequence locations=1-135
cagatgatggaattgttggcccatgccaatgttaatgaattgcgtaaaactaacgaagtcactgactttactcattgtggtcaacaaattgaaagccaaactgatgaaagcgaaacagaaagcaacagccaatga

SEQ ID NO: 70354 - DNA, 1078 bp, Heterodera glycines
  Genomic contig location: Contig_ID=SeqID_9133; Location=68..1145; Strand=+
  SCN-specific regions: Sequence locations=1-488,510-891,914-1078
catttcaatcactgggactcaattctcttgcatttcaatcaccgagactcaaccctccagcatttcaatcactgggactcaattctcttgcatttcaatcactgggactcaaccctccagcatttcaatcactgggactcaattctcttgcatttcaatcaccgggactcaaccctccagcatttcaatcactgggactcaattctcttgcatttcaatcactgggactcaagacaccagcatttcaatcaccgggactcaattctccaggacttcaatcactgggactcaagacacctgcgtttcaatcacccggactcagtttttatgcattccaatcaccgggacctaacctcacctggtccttcggcatcgcaatcatcgagactcaattctgcgaaattccaatcaccggaactcaattctgcgacattccaataactgggactcaaccctccagcatttcaatcactgggactcaattctcttgcatttcaatcactggtcaattctcttgcattccaatcactgggacctaacctcacctggtccttcggcatcgcaatcatcgagactcaattctgcgaaattccaatcaccggaactcaattctgcgacattccaataactgggactcaaccctccagcatttcaatcactgggactcaattctcttgcatttcaatcactgggactcaattctcttgcattccaatcactgggacctaacctcacctggtccttcggcattccaatcactgggactcaattctgcgatattccaatcaccgggactcaattctgcgacattccaataactgggactcaactaaccagcattccaatcactgggactcaattctccatcattcctattcccgggactcaatcccaccagcattccaatcactgggacacaattcttcacttttcacggattcttcggcatcgcaatcaccgagaactcagttctccgacattccaatcactgggactcaattctccgccattccaatcaccgagactcaatccttcactattccaaacaatgaactcaatgttacggattcatcggcat

SEQ ID NO: 70355 - DNA, 917 bp, Heterodera glycines
  Genomic contig location: Contig_ID=SeqID_9134; Location=1667..2583; Strand=-
  SCN-specific regions: Sequence locations=1-359,382-917
atggcaatcccagtctctaatgcatttgtggaacgagctttttcactttgtggtgcccaatggactgataaaaggaattcgctcgaagtagaaacagtgaaaagtctggtgcaagtgaaagtgaattttgatcaaaaatgttcggaaatgtttaaatttcttttttcacgtcctgaattgctcaaaaaaattgctggaggtgagaaatatttcgtaaatgctcattttattgaataaaatgcaaaaacaagccccaaaacaacgttttaaaaatgtacttaattttgaccctaaaaacttattttttactactgatttacttatttcggaaaattttcgatgcgacctctggtataaaaatatgtacatatgtaatatgtagaaaaatcccgaaataaaagtcccgatttttgttcgcaaacacaaaaaagaaagtgtttttcccactatttagagcatggagaagccaggaaaaaaatatgtatttacataaaaatggaagccctgtttattacatataatagccggattttttgaattaaatgcacaaatcagtcctttaacttttgcattcctatataataaagtttggtgtccgtatccggtgggggtcggtttagtctggccggtttagtctggccgttttagtctggccagtttagtcagagggtcggtttagtctggccgttttagtcagagggtcgttttagtctggcaagctgtttttgccctacattgattcaattcggatttttttttccgaaaatctttaaaattaacaccataacatatttatcaatgtattaccaacgaaaaaataacaaaacattgaaaaatgaatacgggcatatttcatatttcgagaaataccaacgagaaaattgatgatattatcgggattaacattggcatggtaa

SEQ ID NO: 70356 - DNA, 364 bp, Heterodera glycines
  Genomic contig location: Contig_ID=SeqID_42473; Location=355..718; Strand=-
  SCN-specific regions: Sequence locations=1-364
agatgatggaattggcggagttggagaaaatgaaaacgaccatttggttgatgaaatatggcgaagggtattttgcacgaaatcgcagaatttgggaaaactaaaagccacccaaagcgatggaaaggaggcaaaagcaagaaaggtgaaagaggaacagcagcaacccgataatgaagttcaattagggaaaattaaaattgaaccacttgttaaacaggaagacagaatgccacaaacaaatttccaaaaaaaagtgccaaaaactgacgcgcaattttgtgatgacaattttgaaaaccccatgaacaaattgcacataccagtagaatgtgaacagcagaagcagaataatatatgcaaa

SEQ ID NO: 70357 - DNA, 130 bp, Heterodera glycines
  Genomic contig location: Contig_ID=SeqID_42474; Location=109..238; Strand=-
  SCN-specific regions: Sequence locations=1-130
atgtgtaccaatgttcatcatccccaaacagaacgatgccatccctttcagtgaagtcgccgcgcacattgccaattctttggtcgtacttcgggcgaaagtcactgctcgaagaggaaggcgacgcatc

SEQ ID NO: 70358 - DNA, 926 bp, Heterodera glycines
  Genomic contig location: Contig_ID=SeqID_42475; Location=478..1403; Strand=-
  SCN-specific regions: Sequence locations=1-219,260-480,505-511,576 -763,785-852,874-926
  Gene Ontology: Mol. function=zinc ion binding; Cellular component =nucleus; Biological process=regulation of transcription, DNA -dependent
atgacaacacccctcaacttcgattctcctgattcgccgccgccgcatcagtcaccgcttttgcgtcagccgcccttagcgccacaacaacaacaggacatgggccgccgcgttgtcgtctacactccatctgaaggcacgccatcgccacagcagcaagatctgcgtcagcaagtgctggcacggaatgcacaagtccttgcagagaaccaaggtttgttggatgtgatttgcttattattttgcatctgtaactaaagcttacacttatagcgggtcttcgagactctcctttggtgcaacaagcgcacgacttggaactgcccaacgagttccacactccgcaaatcgttgttcagactcctgcacccaggcgtcagcttgagcagcagccaatattccgcaacatactgcagctcacgcctcagcgcatggcccagcttatggtgttgcgtcagcgggccgaggacttgcgagacagagaagaagacgaggaggaggagcgagtctcggaggagcaggttgaggaagaagatgaggaggaggagcgtgacgaggaagaagagggggaagagcgtggcgaggaagcagttacaggtaataagatttataaaaactcaactgtaaacaatgcttacagttgagtgtaacgggatcattgctttttgttaataacaattatatttatagacgaatcgtctgacactgaatccaacgccagtgaacagggcgccggtgtggcggtggctaaggcaagaaaccgggtctcctcctccacctcctctgaatcttcggcgtcggcatcaccatcgccacctccgagcaaaagggcgaagacatcgaccgctagcacatcggcagcagcagcatcgaagcagcagccgccaaaaaacaagcgaaaaaagaccgccgtaaaggtactatag

SEQ ID NO: 70359 - DNA, 771 bp, Heterodera glycines
  Genomic contig location: Contig_ID=SeqID_42476; Location=31..801; Strand=+
  SCN-specific regions: Sequence locations=1-58,83-322,348-726,748-771
atgccgatctttttcacattggtcatggaagttgaactgttacaaatcgcagaaagcgctgatgacgaagatgaagaggagaataaaaatcacaaagaaaaattggcaaaaattcttaatgatttaactcaaacaaatgacattggccaaatgcttctcgcggcccatattaaaatttacaaaaatgaattggatgcaaaaaaagcacttattgatgaaatttctatcaatttgaaccaaatcaaagcaatagccggcatttttcagcaaaaatttttgaaaatccgagaattgatgagctttgtggaagcagaatctgtcgtatattttttaaattaaattttatagtaatctttttttctatcattttttaggaaattaaacttaagaaattgaatgaattggctgaaaaaacacagaaaatagtaaaacaattgaaaattgtgaaaaagttggctgcggtgctaagtaaaaaaacgacggaagattcactgagcaaaggttagttttcgcgatttacttaaatttaatcgtttttttcaaagaaaaaaaaacattggaacagtttcttccctgaatcggcgatttttttttaacaatacaaaaacggagaacctttcgaaaatattttttgcgcattgaaattaataagaatttctaagacaaaacttttaattcgtatcaccaaaatatagagaaaaaataattattatttttccccctaataaattttctttaaaatttcatgtttaaggtctttggatagtttaa

SEQ ID NO: 70360 - DNA, 713 bp, Heterodera glycines
  Genomic contig location: Contig_ID=SeqID_42479; Location=191..903; Strand=-
  SCN-specific regions: Sequence locations=1-400,422-553,580-662,705-713
gaaggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaaaaattaattttgcaaaaaataaataaaaacgaaagact

SEQ ID NO: 70361 - DNA, 847 bp, Heterodera glycines
  Genomic contig location: Contig_ID=SeqID_9135; Location=38..884; Strand=-
  SCN-specific regions: Sequence locations=1-847
cattccaatcactgggactcaatccaccaacattccaacagcatttcaatcactgggactcaatccaccaacattccaatcaacgggactcaatccaccagcatttcaatcactgggactcaatccaccagcatttcaatcactgggactcaatccaccaacattccaatcaacgggactcaatccaccagcatttcaatcagtgggactcaatccaccaacattccaattaacgggactcaatccaccagcatttcaatcactgggactcaatccaccaacattccaatcaacaggactcaatccaccaacatttcaatcactgggactcaatccactaacattccaacagcattccaatcactgggactcaatccaccaacattccaacagcatttcaatcagtgggactcaatccaccaacattccaatcaacgggactcaatccaccagcatttcaatcaatgggactcaatccaccagcattccaatcaacgggactcaatccaccagcatttcaatcagtgggactcaatccaccaacattccaattaacgggactcaatccaccagcatttcaatcactgggactcaatccaccaacattccaatcaacaggactcaatccaccaacattccaacagcattccaatcagtgggactcaatccaccaacattccaatcaccgggactcaatccaccaacattccaacagcattccaatcactgggactcaattcaccaacattccaatcaacaggactcaaccctcctgcattatatcactgggactcaattcttctgcatttcaatcactgtgactcaatccaccaacattcccatcact

SEQ ID NO: 70362 - DNA, 167 bp, Heterodera glycines
  Genomic contig location: Contig_ID=SeqID_42484; Location=762..928; Strand=+
  SCN-specific regions: Sequence locations=1-167
atgttcaccgaagtgctgggccaaatcggcttccgtctttccctcgtcttcggcggctccgtcctctcccaaatccttggccaaatggcctatggcattgcgtccgcctcggaggtggcatttttctcctacatttacgctcgtgtggagaaatctcagtacaggag

SEQ ID NO: 70363 - DNA, 499 bp, Heterodera glycines
  Genomic contig location: Contig_ID=SeqID_42485; Location=165..663; Strand=+
  SCN-specific regions: Sequence locations=1-97,134-263,292-499
atggagaaggcctgcaaaatttggagagattatatcgattttagtgcgctaggttcgatgaaactttttaaaatataagcctaaactttttggcctgtttaaaaaagaattaaaaatttttaaaaattttattcatctcccttttgatagaaaaagcatcagagagccttatttaacttttaattaacatttggtgcgtttcagagcagtttctgaaaaaatatttatgaattgattttgctaaaaaaataaaatagtgaagctttaaaaattaataaaaaattttaaattcagaattactggagttagcatcatagcagtgcttttccttgtctttttgatgctctcgcaaaatctggttcgcttctgaccagtttataaaaaaaaagttaagcctaaaatttttcgcatatttaaaaagcaattaaaaatttttagattttttattcatctccctttttgatagtgaaagcatctgagtgcctaaaataacttgcaa

SEQ ID NO: 70364 - DNA, 122 bp, Heterodera glycines
  Genomic contig location: Contig_ID=SeqID_42487; Location=813..934; Strand=-
  SCN-specific regions: Sequence locations=1-18,40-122
ggatatcttatttggtcggtttgatcgaaggatttttcggtcgaaggtcttcgtttaacttttgtgtgtccaatgcgatgaaaaatgacttggaacgtcgctggggtgtgaatgctatctcc

SEQ ID NO: 70365 - DNA, 614 bp, Heterodera glycines
  Genomic contig location: Contig_ID=SeqID_42488; Location=384..997; Strand=+
  SCN-specific regions: Sequence locations=1-614
atgagtcatgaaaaaatttcgctgatttatttgcatgcatgtgcacttagactgaccacagaactcggcattttgatcaacgagttggaggaaattggcacagaatggacgagtgccgacgcaattgacgaggtgttgaagtcggctgctgagcttgaaatgaatcgtcttacaattttaaaaatgtgataattatgcttctcaatttattagggattttcatttttaggattggataattagtacagttcggcctggatccaggtccagttcatttttcggcaacctggctttttcctcgatttttgtccaacaaatccaggacaaatatgaaaaaatcccggtatgggtccaggttatgccacgaaaaacctggatttaaatttcaaaaatccaggcccccaagcctcgaaaagctttgtttttcctggacctggtttttcctgcgtttttgtccggaattcataaaatccaggttcagatttttcaaaatgcccagctctactaatgagttgttaattgaaatgtgttgtgttcaaatttgttgaatcacatttaatacgctagtagattgttatttaattgatttgatttttttttgatttgttgaaaaa

SEQ ID NO: 70366 - DNA, 1168 bp, Heterodera glycines
  Genomic contig location: Contig_ID=SeqID_9138; Location=545..1712; Strand=+
  SCN-specific regions: Sequence locations=1-70,93-191,213-390,412 -431,458-726,748-859,895-957,981-1062,1159-1168
ccgtgttcacgggttaagtcgacgacgttcacggatcagcaacaccaccaatgttgttgtcaagggcgagttcagcagtggtggtggcagcacaaccgccgccgccgctggggcgttgaaattgtcagaaaaaacaacgcttgttggtggcaaatcaccactaccacaaccgccatcatttgccgccgctcaatgggcaaaacagtgctgtgtgaatgtgaacttggacatattggcccaacgaagtcgcaatgaagtgggacaaaacaaaaaaaaatttttggttgagctctggtcgaatgaattggtcccaagtgtcgagaaaagtctcggtttttttggtttctctaatcttcaaaacaggccgattccgtctgattgtgtgccaaattttcgggcaataattttttgaaaaaaaatcgctttcgaatgatgcaaatttttaaaaaatgactgatttgaaaaatgccgtaatcgccttgaacggaaaatttaactttattgctgttttgtaatttattcgcattaaaaatgcatattttacgcaatttttttttcttacttctaccaaaaaaaaaatcggagagaagttccgatgaactttttttttacttcccttaacaataaaaatctcacaatcagtatcttctccttaatcctgctttcccccgtagaaggtgtctatatcctcaccaacaacagtgttcaagccgattaatagcagtaacaccagtgccagtgccatcaatgctggcagcagtagcaccaatttttatacaaacaaattctgttcaacggttgctgatgtggcaagattggtgaaccaaatgcatgaacaacagctgagaaaccaacgcaaggcggcggaagaggaggaggaggaacgacggagaaaaaacggaattggaaaagctgagcaaaagcatcaacaaaaacagggaagacgaaggagtaccgtgatggaagcatgtgatgatgaagaaaaaaatgaggagaagaaggtggataagaagaaggatgggcacaaaatttgtggccataatgatggtatgccaatacttgaaaaacaacagcaacaacaactgctcgaagaacggcaacaactgccgcagcaacaacagcaaagcattgatgataataagaatatcacaagcaacattgttaatgg

SEQ ID NO: 70367 - DNA, 389 bp, Heterodera glycines
  Genomic contig location: Contig_ID=SeqID_42493; Location=38..426; Strand=-
  SCN-specific regions: Sequence locations=1-389
tatgtcgacgatattcgtgtcaccgtccgtttggtttcgcccgcattcacttgcaattcccaaccaaaaaccgcgtcttctcagttcataagttttgcattccatctttttggccattttcagaagcaaatcctactcttttgctgaccgggtgatcgaaacactgagtctttatgttcagtcagttgagattttctttgagtcggacagcggcacggactttgactttggcggctccattagcgtaagaatgctcctttttatttattgtttgcccattgttcgtctttttcaagctgtattcactcgctttggagagcattagccccaattggagtgaggagaaggacgtcgacaccaacttgactcgtcagtcagttccaagaagg

SEQ ID NO: 70368 - DNA, 403 bp, Heterodera glycines
  Genomic contig location: Contig_ID=SeqID_42493; Location=476..878; Strand=-
  SCN-specific regions: Sequence locations=1-403
aagatttcatttgtattttatgctttatctctttgtgaaatgacttcgattttgaagaatcaaatcattaagcatctttcggcgtaagttgatagatgccattaattttcaacaaaacatttttttcttgtttaggtttgcgcgaaatttgaaaccggaacaaattacgatggaattgttacgggggaaaggccaactgcgagacttggaactcaatgaggaagtgttggctgaaaaattagagttgcccccgtggctaaaaattgtcagtgctcgttgcgataggtcattttttggcatggatgtattcccattggccatttgcgtttatatttgggtttgtttagagtcagcattaaaattccaagttggaacaaactgaggagtgctcccatccaattgg

SEQ ID NO: 70369 - DNA, 468 bp, Heterodera glycines
  Genomic contig location: Contig_ID=SeqID_42496; Location=177..644; Strand=-
  SCN-specific regions: Sequence locations=1-468
gtttcaaatatcgtaagattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaaaagaaggcaactgttggtaccaagtttgcggtaaaaaaatgagaaaaaagagatagctattttttggtcaagaattttttttgttgcgtttcaaatatcgtaagattgtttgatagggccagacaagagaaggcaactgttggtaccaagtttgcggtaaaaaaatgagaaaaaagagatagctattttttggtcaagaattttttttgtttgcgtttcaaatatcgtaagattgtttgatagggccagacaagagaaggcaactgttggtaccaagtttgcggtaaaaaaatgagaaaaaa

SEQ ID NO: 70370 - DNA, 70 bp, Heterodera glycines
  Genomic contig location: Contig_ID=SeqID_42496; Location=826..895; Strand=-
  SCN-specific regions: Sequence locations=1-70
gtttcaatatcgtaagattgtttgatagggccagacaagagaaggcaactgttggtaccaattttgcggt

SEQ ID NO: 70371 - DNA, 207 bp, Heterodera glycines
  Genomic contig location: Contig_ID=SeqID_42497; Location=651..857; Strand=+
  SCN-specific regions: Sequence locations=1-207
atgtctccagcagaaccctttttggaaagcggcgagtccgaccttttcgccatggccgtcaaattccaaacggacaatgggcaacccattgagctgaaggccgtttaccaagttgccttatctctttttgatggattattcccaacgattcccaggacactgacccatcgccgaaagccattccgacggaagggaaaagccgacaga

SEQ ID NO: 70372 - DNA, 824 bp, Heterodera glycines
  misc_feature (761)..(761): n is a, c, g, or t
  misc_feature (763)..(763): n is a, c, g, or t
  misc_feature (789)..(789): n is a, c, g, or t
  misc_feature (806)..(806): n is a, c, g, or t
  misc_feature (821)..(821): n is a, c, g, or t
  Genomic contig location: Contig_ID=SeqID_42499; Location=44..867; Strand=+
  SCN-specific regions: Sequence locations=1-447,470-519,542-706,740-824
atgaaaaacccattcaatatgccaaaaccaataattgccaacccgaatgatgtgccaaaacagaaaaatgccaaaaagaaagcatcaaaaaatgatggggggcaaaagaaagaaaaacttgttgttagccgaccatcatcacccaatggagtgccaattgagtttgaattggaaatcaatgaatacactaatggacaattgatcaacaaaaacactatttctggacaatgggacaaaaggaatgagaaaatcattgatgaaatgttaaaaaataaaaaagttggtgtcacacaattggggcccattcagtcaaaagcaggtatattagcacaaagatgaaaatcagaaaagccgcgtatctcaggcaaaaaagccatttttcagaaaaaattatcatataaccagatctaagatggattttgccgcttaaatggcaatctttgaaagttttttataaatttttatttaagccacaaatgagggcaaaacctcttatattggggcaaaggtaattaccgaaaaacaatatttatatttccatgtttcacgggaaaaattattttttaaagtataactgattgataaactttttagacattttgccattaaaaccaggacagttcgaaactgaatcccattttttctctgataaccatgcgaacagtcagcaatcaactgttgcatcaacatcgaaaaatcaagtcagaaatttttaattaattaaaaaataattattttagaaatctaaaaaagtccctgancntctattaaaacattccaagtcaatgnccgaatttaaaagaacncaacactcaaatgantca

SEQ ID NO: 70373 - DNA, 643 bp, Heterodera glycines
  Genomic contig location: Contig_ID=SeqID_9142; Location=339..981; Strand=+
  SCN-specific regions: Sequence locations=1-71,93-104,126-134,157 -327,353-643
atggcctcccaaattcccaaaattctgcccactcttctcttcatcgccgccgcatttctgctcaactttggctgctgtcagcaaaatgagaggtgtgtgaataactctttctgctgctgctgctgtacgtgttcaacatttaatttgttctttttcgctttcagccaaacgacggaaactcttcgcgccagaaatgcttcttcatcaaccgaaactcttccactgaacatcacaaccaccaaaaaagaaacgacggttgccactccttcgactacagaagctggcactgaggcggcgacaactgatgatactaatgacgaacaatcattgctgttttggattttgattgggtccgtgtcattttgttcaacgcttttcacagccattcattcatttttctcctcccatttttagcgtcattgtagcaattgtgctcttcttggtcctgctggtgtgcattgtgtgctgcatgcgaggaggaagccaaaaagatgcgcgcgaaaccgtcaatggcaagagcggaggggctgtgaccaaattaacgatgaatggggacaacgccgacagtacctgtgcttcacaatcagcatccgtgcccgacgaaggatggttcgcgccggaatcattacgggtaatactatag

SEQ ID NO: 70374 - DNA, 741 bp, Heterodera glycines; identical to SEQ ID NO: 42504
  Genomic contig location: Contig_ID=SeqID_42504; Location=1..741; Strand=+
  SCN-specific regions: Sequence locations=1-384,407-741

SEQ ID NO: 70375 - DNA, 573 bp, Heterodera glycines
  Genomic contig location: Contig_ID=SeqID_42505; Location=89..661; Strand=+
  SCN-specific regions: Sequence locations=1-151,175-343,380-384,407 -442,464-546,570-573
atgtgcagcagcagcaatggcgtagcaaccgaggcagaggttcctctgggttttgtctcgtttaaaatgacgctttttaaggagtccgaatcggacaccgccgcgttgcgaaaacgtcgcgaggacgcgtcgacgccacggccgcggaacacggaggaagaaacggacgattgggaagaatgtgagggcgaggccgacaatgaggcgaaggcggcggacaaagcgaacgacgggcaatgaaaggcacaaaaagcggtgaaacgaattttggacgctttcccctcaaaatcaacgtaatttcgtgtaattaaaattctattcaaagttttgagttgaattttcgaaaaataatataatattgattttaatgatttaaaaagtcaacaactcaacatccatccatctatacattaattaataagtccattcctatttttgtgattgaaaactttcaataattgttttaatgaaaattatgtacacgattatttaactgaaaaatgataacattaatttaacttattatacgacaaaaattaaaggaatatttggcaatataaaaagatcaaatga

SEQ ID NO: 70376 - DNA, 361 bp, Heterodera glycines
  Genomic contig location: Contig_ID=SeqID_42505; Location=669..1029; Strand=-
  SCN-specific regions: Sequence locations=1-361
tcctcggcccattggtcaccagcgaatcttcgacccttttagggtcgctaagtccgaaggagagaattccgctccatcagacgaaattcgccattgaaatgcaagtgccactcctcaaatcatgttcaagtcgtgttttaaaagaacaatttaagcggtgacaaagtgaagtgcctcagttacagcgaagtgcgcaacacttacaaagaggaattgttgcagtatttcgaggaaagggccaaaatcgacgaagagtaaagcggaaggaaaagccacgcaaaagcactcacaaataaattagcatcgctcaactcaactcgaattgaccctcactatcccccgatgtttccgttctctctca

SEQ ID NO: 70377 - DNA, 64 bp, Heterodera glycines
  Genomic contig location: Contig_ID=SeqID_42507; Location=424..487; Strand=-
  SCN-specific regions: Sequence locations=1-64
atgcgttttggcatttcagctatgaagccaatgtttcaaagcgatgaaacaaaaccaaagtatg

SEQ ID NO: 70378 - DNA, 239 bp, Heterodera glycines
  Genomic contig location: Contig_ID=SeqID_42508; Location=1045..1283; Strand=+
  SCN-specific regions: Sequence locations=1-239
ccaggactcaaatgtcccgctgaggccaaaatttttttctatttccgggaaaaaatcgaaatttttccgaaaaaaataccagtcgatagagctcgaaaaactatgttttggaagtggtctccgtttctctgagaaaaatcgttaaaaaatcctaaaattcaaaaacccgaaaaccgttttttaggcctaactcgaaaaatttgaaaattttcgaaatttaaaagactctagagatcccc

SEQ ID NO: 70379 - DNA, 255 bp, Heterodera glycines
  Genomic contig location: Contig_ID=SeqID_42510; Location=808..1062; Strand=-
  SCN-specific regions: Sequence locations=1-255
ttcacaattttttgacctgctcgactgggccgaattggtcaaatcggctccccccgaatctgccaatacggttgcaagccgtgccgcactgctggtgaatgccatgtatgaacagcatggagtcttttatgtgtagatagtgccgcttatcttcttcgattctcattgctcttttgtgtatttgccttttttacctctcagattgtttcataatattcagatgtttattctttctccagtatgtctttcaataaa

SEQ ID NO: 70380 - DNA, 2820 bp, Heterodera glycines; identical to SEQ ID NO: 9144
  misc_feature (21)..(21): n is a, c, g, or t
  misc_feature (2772)..(2772): n is a, c, g, or t
  Genomic contig location: Contig_ID=SeqID_9144; Location=1..2820; Strand=+
  SCN-specific regions: Sequence locations=1-45,67-344,366-1540,1563 -1565,1587-1741,1763-1938,1960-2090,2112-2233,2255-2286,2308 -2332,2436-2489,2511-2537,2564-2675,2697-2726,2750-2820

SEQ ID NO: 70381 - DNA, 582 bp, Heterodera glycines
  Genomic contig location: Contig_ID=SeqID_42513; Location=166..747; Strand=+
  SCN-specific regions: Sequence locations=1-95,138-219,247-433,476-558
atgcagggatactccccggtaaaggactaacttacactgaaatgagcgccgagctagctggctcaaaaaaaattttcgaaaatctgagtctttcgtttttatttattttttgcaaaaattaattcataaatatttttcagaaaagggttctgaaccgcaccaaatttttattacaaggtaaataaggctctctgatgctttttctatcattattgggggtaaataaattttaaaaattttttaattgctttttaattatgccaaaaaattaaggcttactttttagtgaaagtttgatcactcatatttttgctaattgagcagaagcataccaaactttgcagggatactccccggtaaaggactaacttacactgaaatgagcgccgagctagcttgctctaaaaaatttttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaa

SEQ ID NO: 70382 - DNA, 65 bp, Heterodera glycines
  Genomic contig location: Contig_ID=SeqID_42517; Location=300..364; Strand=+
  SCN-specific regions: Sequence locations=1-65
atggctgtctcttttttctcttggggatttgaccgcaaacttggtaccaacatttgccttctcta

SEQ ID NO: 70383 - DNA, 59 bp, Heterodera glycines; identical to SEQ ID NO: 52421
  Genomic contig location: Contig_ID=SeqID_42517; Location=478..536; Strand=+
  SCN-specific regions: Sequence locations=1-59

SEQ ID NO: 70384 - DNA, 59 bp, Heterodera glycines; identical to SEQ ID NO: 52422
  Genomic contig location: Contig_ID=SeqID_42517; Location=608..666; Strand=+
  SCN-specific regions: Sequence locations=1-59

SEQ ID NO: 70385 - DNA, 59 bp, Heterodera glycines; identical to SEQ ID NO: 52421
  Genomic contig location: Contig_ID=SeqID_42517; Location=738..796; Strand=+
  SCN-specific regions: Sequence locations=1-59

SEQ ID NO: 70386 - DNA, 935 bp, Heterodera glycines
  Genomic contig location: Contig_ID=SeqID_42518; Location=1..935; Strand=+
  SCN-specific regions: Sequence locations=1-789,811-935
aattttgaatttagaaaacatgcaatattaaccatgcatccctcccagaaatgaagccattcaaaattaagaacaaagacggcctttccaatgattacacaggcaattttgaaaaaaataattgaacaatcaatgccttctgccaatatttcagatttttgggtggattacgagccgatccgtcactgcacttccgatcgaccaatttgcgagtcgaggttacccaacagaatgccaaaaaagattgaactgacgccaaacttcacgcaccttccctctcacagattccttttctgtgatcggtccgtttggcgctgtcgaagtcgaattgtgttaggcggcaattgtacaggctttgcgggcactgaaatatgctatggatcagtgtgcattcaggcaagacaccaaaagtgaatttagcgtttgatcgaattaaattctcagccgaatcattggcacaccagtgatcagtcagaacttaaacgaaaaaaaggggggggggtgacctgtaaattgattgtaatgatggtatgggttacgtaccgtatccattcatcccaattcgctggctgatactgtagttaatttcctgcttatctccttgggatcagacatcctcctacaatttctgtgctgaatttggtatttttcagaatgtttgccgactgccggcgacggaaggcaatggatttttgaggcgcgaagtttgtttcggcatatcgaaagtgaatgatttgatcgcttctccgttctttcgttgacagcgtcgcccgccgatcagcgaagttgtgtgggcaaagagttggctgttggaggagggcgcacggccgacgagcagcggaattgcgcacgtcgtggtcagagaggagggggcggcaatggaaggggaaagaagcgcttttgtgccccggcacactcagtacccggagttgccg

SEQ ID NO: 70387 - DNA, 498 bp, Heterodera glycines
  Genomic contig location: Contig_ID=SeqID_42519; Location=484..981; Strand=+
  SCN-specific regions: Sequence locations=1-408,448-476
atggagaacaaaatggcaaaaaatagtaattttttggcgaaaaacgactaaaatttttgtaaaatacactccataattcgggatttcaaaaaacgaaaaatacacccctaaaaacgactgaaaaaagaaaaatatacccctaaaaatcgagtttctgatttcagccccctccgaagccaagggtctggctacgcccttgccctcccccttgtccacctataccgtatcatttcctttattaatattcaaaatctcagaactgtccctactcgactaccgtatcgacaacagtattcgcttatatgatgaaattaaatctttcaaaaataggcaaacatccaagcaacggagaactgatcgaagtgcaattaaattcaattaatttccaaaagaattattcaatgaatcttaaattaaaaaataatactttttaaattaataatttttcttcaattattcatttcgccctaaaaacattttttaccattttataaaata

SEQ ID NO: 70388 - DNA, 647 bp, Heterodera glycines
  Genomic contig location: Contig_ID=SeqID_42521; Location=22..668; Strand=-
  SCN-specific regions: Sequence locations=1-9,52-292,314-647
agtctttcgtttttatttattttttgcaaaattaattcttaaatattttttcagaaagggttctgaaacgcaccaaattttatttacatgttagtttaggcactctgatgctttttctatcaaaaagggagatgaataaaattgttaaaaatttttaattcctttttaaacaggccaaaaagtttaggcttagcttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttactatagcctgtactttaattctgcgttggatttttccagtgggataattgtttgagtacccccaacggaccaccttgaaaaaatcga

SEQ ID NO: 70389 - DNA, 1410 bp, Heterodera glycines
  Genomic contig location: Contig_ID=SeqID_1233; Location=721..2130; Strand=-
  SCN-specific regions: Sequence locations=1-41,65-70,142-173,195 -858,910-1115,1139-1203,1227-1258,1281-1307,1332-1354,1377-1410
atggcaaaattaatgaaaatggtcaagagaataaagtgagcacaaagcgaaaaaaggaccaaaacggaggtaatttaaaaaagaaaatataatttaaagatttaattataataaatatttataagtaaataaataatttttgattattcattcacaaagaaacgcaacaaaatcacaaatttctaaaaacggtcaaagaagaaaatataatcggagaaggaaattcgaataaaaatgaaattgaaattttgccgcacgacccgggcaaaatcgaccgaattattggtgactttgctgagtttcgattgcaacgaatggaactgatgaatcgcatcattcgggcacaatcacagcgtgaaaaggcggaattgcaaacgatttcggaccaaacaatggcaaacgcaaaaattgtgcaatttaggtgaaaaagtgccaaattcccaccccgccccctttttgtgtgatctgttaaaattgagtgccttttttgggtttggctaattgtgtcgcttcaagtttagcctgaaaaaactgagtgttttctccgccgccaaagcattggacacggcacttcttggcatcgaaattgccttttgtccgtttgccaatgtttggcacaatgcgcaaggaaagcacgagggaatggccaattttgtggtgcagaaattcgcttcattggcatttgccattttggaaataaaaaagccggccaaagatttaatcaaagagacaattaaagcgatacgaaaacgatttgaggagtcggacaaaaagcatttgacaatggcaatcgaagtggtggaccaaattgaggtgaaaagtgaaggaaaaggaaaatgcaaacggaaaaacaaaatgttttaatttattaattatttttagaatattattagcaaaatattaatttttccacgccctgaaaatttgcaaaacagtgaaatgcttgtgaatttggatttttacattaattatttctctcaaattatgctcatttgttccccgtcggctgttgcggcacttacggacagtgcgccaatgttcaaaaaattgcacgacaaaattcaatttttttccttttcgctggtcactcagttcaaaggaattgcggagaaactgagaaacggagaaaaaagaggcaattagggacaatcagctgatcaatttgcatttttgtatttgaacggcataaatcaaaaaattgtcattaaaattaaaatttattttttgagaaggcacgtgccgtgccacaaattcttttgggagggagggaaggaatggaattcgatttgtttgtggtcactcaaacaaaatccttcttctcatttttattcgttcacaaaagaaaaacaattcgtgattaaatatttggtgaaaaacaaatttaaacgaaaatatatcagagaaaataaa

SEQ ID NO: 70390 - DNA, 401 bp, Heterodera glycines
  Genomic contig location: Contig_ID=SeqID_1234; Location=344..744; Strand=+
  SCN-specific regions: Sequence locations=1-71,96-168,198-332,369-401
gaaatgccaaaacgaagccgaaggacaaaacgggcaatttggacgagaaaaaggaagcgaaggggcggcagagggagaagcagcagaaggagggaaaagctgaccatcggaatgcgcagtttcatgaagctcagaccgtacgcggagcattattgtgcgtttttaaatcaaaaagacaaaatgaaaacaatggaaaagaccccgaggggaaataatttgaggaaacttaattaggacaatagtaattaataataatgacatatggtcaaaattaggacaattagaacccttataatttattttgggaattcgtcataattggaacacaaataattttttggttttgtaaattccgaaagaaaatatgggaatgaatgccatgccaatgtaaagtggtgaca

SEQ ID NO: 70391 - DNA, 1330 bp, Heterodera glycines
  Genomic contig location: Contig_ID=SeqID_1234; Location=944..2273; Strand=+
  SCN-specific regions: Sequence locations=1-976,1013-1114,1136 -1227,1249-1268,1316-1330
atgtcggcctttttcgccatcttttcgcccgcttttattttcgcaattgtcgccactgttgtgctcggactgatcactggtgagtggggccaatggctgatcagcgtgactcattgggcatttgagtattgttgattagacacacaaaaagggcagacgatggcccaatggttgaactgccaatgggaagaatttgccgattgggttcgattcccatccgccgccggtgcctgacacttacatatttaatcaaaatgattaatctctgttcatcaacaaccactaatttctaatgatccttgtcaattatgacttcttctgtttaggagtggtcacaagtgcgtttatgggcaaatgttccgggcccggcacaatgggaggagcatatgccggctattatcaacaaggtcgagcaagttgaaaacattgattagtgccaccaaattcgtatttgttcccgttaggtcacggagtgccctattctgctcacaatcagaatatcgtcggttttagcggcggacacggtgacggctttggcggcggctttaaatttaaaacgcccaaatccaatcacggatattcctccgcttggggaattccttctcagcacggtaattagtggcaatcacaaacggataaaccgattaacaaaattatatcaatttgatttgcctcacttttatgctatcatcacaatgccccaccgcccgaagtgtatttgctggaggaggagtatgagatgaaacgcggacgcggcttctcctcctccgcttcgtattccgcttcttactcagagtccgacgagtacagcggcggaaggtcagtggagcgcagaaaataccgacggggaggaggaaaacagtacaaaagtcacttcagggagaggagttacggtaaggagggagacacatacggtagactaacaaaacaaatgaacaaaaggaagaacatattaataatggaatactatagtgggaaaataacaaattttaaattaaataatgaaaaaataccgtagggtatggggggagggtaaatccaatggttaaatttggcaaaatgccattccaaatattttcagatgattccggcggggcggaaaaacgcgtggaggaaagtgaggaggagaaaaaagttaggcgaagaacggtgaccacttattcacgtgtacagtactgacaaaagagaagagaaacggtgtcacataagcaaatttactacctttagagagttcaaaggcattttcatccattttattcatttttcccattttatcataaatttgttttaaattttaaatcttaaaaattaaaaaggaaaatgcctaaaa

SEQ ID NO: 70392 - DNA, 1042 bp, Heterodera glycines
  misc_feature (14)..(14): n is a, c, g, or t
  misc_feature (23)..(23): n is a, c, g, or t
  misc_feature (54)..(55): n is a, c, g, or t
  misc_feature (162)..(162): n is a, c, g, or t
  Genomic contig location: Contig_ID=SeqID_1235; Location=44..1085; Strand=+
  SCN-specific regions: Sequence locations=1-454,482-627,651-678,700 -878,900-1042
  Gene Ontology: Mol. function=extracellular matrix structural constituent; Cellular component=collagen type III; Biological process=histogenesis and organogenesis
atgtatatttttgnaaaagtgtntcaggcacttaaaatgtatgcaatcggtacnnccttagtaatataattacggcatttgtttgtaattgttgcatgacgaagttgttttttttaaatttttgagttgaccccgccaattgaattgcagggtccccccggncgttcctggcgaagccggcgagcccggacgccccggcaacgaaggacttccgggagctcagggggcaccaggcgccccgggctcagccggatccccgggccaacccggcgaaagtggccaaccgggacatcaggtgaggacgaccaaagcaattcggaaaacaaatcccaaaaatcctttaggggcctcccggcgaacgcggcatttgccccaaatattgtgccttggatggcggagtgtttttcgaagacggcacccgacgttaaaaacaacgaaaaataaaatttatgcgatttgacaattggaaaaaacaaattttaattcacaatagtaaagaatacacataaaagcataatatccattttggtcatcgaagaattaaatatttgccttttgagattgtctccatattggtaaaaacaattcctgaaaataggaatctaatttagaagcgatttcttaattacatttttaggaatttttgaaaatgaatctacccaaaaaaaacttcttaatataattaaatgaattcaaagaatattggtcataaattcgatataaatttttaaaaaccgaaagatgtttgtatttacctagggagcagcccgtttccctctctccctccgagattttctaagatttgttttttaaatttcctcgggtggaactgagccggggggggggggggtacgtagtgcatgcacccatttacccaatttttgtttgttcgtatttgtgcttattcctcccggtcgcggttttttgagtaaaaaccgggaaaaggactaaaatccctgtcaatttcgcttcaaaattccagtctaaaaatgcttgaacaaagacaaattctctggctttttcggcattcccaagtgtttaa

SEQ ID NO: 70393 - DNA, 635 bp, Heterodera glycines
  Genomic contig location: Contig_ID=SeqID_1235; Location=1439..2073; Strand=-
  SCN-specific regions: Sequence locations=1-107,130-635
  Gene Ontology: Mol. function=3'-5' exoribonuclease activity; Cellular component=nuclear exosome (RNase complex); Biological process=35S primary transcript processing
atggagcgactcggcattcgtttgaattcggtgcgcgaatttgctttcgatttggagcacacattgccaaatcataaaacgcaacaaacctgccttcttcaggtaattaaatttatattttcagctgaatcgtgtaattttacataaatttaataaatttccttgtcacagatttcaacacgtcgcgaagattttatcattgacattctcaacccgcaagtgcgcaacagaatgcatttgctgaaaaaggcttttgagaacgaaggaattatgaaggttaatcatttccacttaatcttagagagcttgaccattcctttatttttgtgaggtctcccggggcgacaatacctaataaaattagtgaaagatttttgtgaaaaagccccgaaagacagttcgtgataattattagcgccgctgatgagagcatttatgattagctttttcaggtggcccatggccaaaatgatgttcattggatgaagcgcgatttcggcattttgactgtgccacttttagacactttcactgtgggccttgccaatggtaacaattcaattaaaaagagcattgctccaacttttattcttaatgccatcgttcttttacagtcgaacatgtcaatggtctga

SEQ ID NO: 70394 - DNA, 1033 bp, Heterodera glycines
  Genomic contig location: Contig_ID=SeqID_1235; Location=2783..3815; Strand=+
  SCN-specific regions: Sequence locations=1-78,101-236,258-281,303 -342,364-690,712-726,883-962,984-1033
atgagcattttgtggaacgtgtcaaagaagagccgaatgtgtggcttaatggggccgatggtcagttgcataatttattcccttttattcaatataaaattcttgacatttaatcctgtttcttgatcatattttcgcaaaataaaaaattataattgccgtttttataatttagttgggctaaagtcctttaaatactcgccaaaataattttgtcaagacattcaatcaagtgtaaaagtgggaacaattttcctcgaccttacagccatctcaaaaaatcataaaaatgaattaattaataattaacctttgagtaaaattaaacagttccaaaactcagattttcccctggccaatgggtcggatggaaaggattcttcgcaatttgtcgctggctgtgagtcgtcctctgtgaagcaaacagtcacggaagactgctatattggcaccgcatatactgagcaggaattggccacactttgccacgaacattgcctccgggcaccgcccaatggcacaattgagggcttaaaggtgggctaaccccccacttttaattcctaatcctccatcattttgtttacgatttagcgtgtccatttggtttgctcgtataactctcggccatggctttgcccgtgtcttgcggaatgggtggcggacacgggggcactttacatgcgcggagaacacaacgaacacccaacagaagccaaacccacgggagaagaggaggagaaagagaaagcagagaacaatgaaaacggaaaggaggaaaaggaacggcaccgaagaggagagggggaaagaaagaaatggggcaaaagaacactgaaaaaagagaggagcagcagcagagaggacgaggaacagacagagggacaatgcacggaggagagagcgcgagggaggagagagaaaaacaaacgacaaaattatggggtgaagaaagagcgggtaaagaaagagaggaatgagggcactgctgacaatgaacagatgggacaacacaatgaccagcagagaaatg

SEQ ID NO: 70395 - DNA, 1126 bp, Heterodera glycines
  Genomic contig location: Contig_ID=SeqID_9145; Location=207..1332; Strand=+
  SCN-specific regions: Sequence locations=1-86,114-198,236-758,780-1126
atggatttgctgcaacttccttcgatttcggatggtaatttaattatggattttttaggggggtttattttgtaaccctttgttagcatatttttaaaactgaaaatatttttgttttcgaaaatatgtctctatgaaataaaactgactagggaaaagggaaatagcaaattggaaactatgcgggaaaacaactagaaatttttattaaataaggataataaataaaaaaaatgtcagcgacccagaaaaacggaaaaaactaacggaaaaacttgctaaaattggtccttttgcttaaacatagtcaatttaatcgcgcacaagttgaagaagtattttaaacaaaacgaaattttcacagacgaactcgattacgacttggatgttccggccgatggtgtcaatgccacgctcaaaacccaaagggcctccaataacaacgaggtaattagcatatcataaagaatgcaagacgattggatacaagcttattttttaaatttggttatttaaaagtcaaaagttgttccaggctggacgactttgcttggtttcctccgttttccaaaattcccataagtttgtccttatttcgatggtgattcgtcggttctttaacttcatctcaaaaccattccgaacgatgatggcaaggcattagcaaaggtcacattttgagaattggggtggtcgaccgaagtttttttagggtgcatttgattcaccataaattcactttttctttaaagttaactaaattttaagtataagcaaaaaacccttggtatcttctatggcgtacattaaatattctcttttcgcctgtaaatctttaaaaacttattttttggttttggctgtctattttgatgcgacaaaattatataaacttattttgcggcgctatattcaccgttcatccttcctaaaaatcggctaccgataagcaaaaaaggtcgtcgcctttggtactcccctccccaaagtttacgtctctgattttttgtattatgtacaattgtgtttacattctgtcatgatgcgttttgagaattgtcttgatagcaatggaacattccgaattatcacggccaaataattttaaaaccacttatactgtaga

SEQ ID NO: 70396 - DNA, 388 bp, Heterodera glycines; identical to SEQ ID NO: 51536
  Genomic contig location: Contig_ID=SeqID_42522; Location=401..788; Strand=-
  SCN-specific regions: Sequence locations=1-20,42-275,297-388

SEQ ID NO: 70397 - DNA, 853 bp, Heterodera glycines
  Genomic contig location: Contig_ID=SeqID_42523; Location=1..853; Strand=-
  SCN-specific regions: Sequence locations=1-192,216-358,380-853
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggggtactcaaacaattatggggagcaaaaatccaacgcaaaaattaaagacaggctatagggaacctattcccggaaggattcggccttccccataaatctgggcgattcggttcgggggggatggccccaaaaacaaaaaaaatcaattttttcaagtggtccggttggggg

SEQ ID NO: 70398 - DNA, 568 bp, Heterodera glycines
  Genomic contig location: Contig_ID=SeqID_42525; Location=326..893; Strand=+
  SCN-specific regions: Sequence locations=1-134,156-266,302-568
atgatctcctcgtcttattttgaagaatgcaatggcaccgaatgtctttacgcgcttttttccaaaccgaaattgcaaaatgttagtgcatttgcttatagcaatcaatcgcttatgcattaattatgtgataatttttaaatacctaataaatggctcataatttggggggagcgtaaaattaggctcattaaactgacatatcaattaaactttttattatctacttattttctttaattaataagattttccagtgaaaacccatttattttaaattgataaattatttttaattttagttcatttttttgcataattactgaactttcaggaggatgatctgccctataaaataatggaggacaaaaccttttgccaaaaggcatcagaaaaactcaaaaaagtcatcaagataaaatctgagaacgaaaatgcgagagaaatgtttgacaaagtcatgaaagagatgtctgaaaaggcgaaaaagatgtacaaagagcagaagtatatcggtaccacttattttaccaaattcatttggaactcgccttttttgcaaggatag

SEQ ID NO: 70399 - DNA, 386 bp, Heterodera glycines
  Genomic contig location: Contig_ID=SeqID_42526; Location=159..544; Strand=-
  SCN-specific regions: Sequence locations=1-39,62-114,140-386
atgactgtgattgtatttctgattgacaccagcgcatcgatgatgcaaaagcaatatttgggcacaactctgctcgactttgcacggctgacagttgaacaatttttgaaggttaaacaaaaataaatgaatgaaacagttgaaaaaaccaaacctaattgggaaaaaaaattagctgccaattaggagggaaaatgagggcattaaatgcattaatttggaccctttggccgtattttatctgccgctgaatggacttgtggacattttaatttgccttttttcagcagcgccaacgcgaccccgcctcctccggcgaccgttatatgctgatgacattcgaggagtacccgtgcaacatcaaggttatttgttgtcatttttga

SEQ ID NO: 70400 - DNA, 281 bp, Heterodera glycines
  Genomic contig location: Contig_ID=SeqID_42530; Location=204..484; Strand=-
  SCN-specific regions: Sequence locations=1-40,82-281
atgccatcacttattttttattcactcccttttcttatggtatttttacatttaaaatttttgaattaaatttttattttaccattttcagttagcgaatttggccattttctttggccaagctctgttccgttttataccgcacattttgttcgtttttgtatcaatttttattgtgggaatggtcaacggcgcatgttgcaactttttcggcaaaattcaccaacaagtaaagctttctttgtaaactatttaattagaatgtttaaattaaaaataaa

SEQ ID NO: 70401 - DNA, 571 bp, Heterodera glycines
  Genomic contig location: Contig_ID=SeqID_42531; Location=207..777; Strand=-
  SCN-specific regions: Sequence locations=1-571
atgtctgacgataaaaaggtaaaacgaatctgggcgggtgcattcttatggcattgtgccataacattcatttttgtacatttgcttttcagcatcaagcattcaacatggcacgcactttggtgaccagcagaaaagacgtaaagtaaagggggagcaaaatttaaataattttacaatttttagtcgcccaaattctatgcaacagttttggacgacatcggctcgtatttggtccgcgcagtgcctttgtacatcaagaaaatcgcagacgaaccttctcctcctgcggacaatgagaatgacacaattacgaggaaaagagtatgtgtgccaattttggcagctttcccctcccccaaaattgaggcgaaatgagttaacgcgaaaatattttttttcattttcagcggttccgacgagcctgttgtctgatgtatctttagccgaacagaaggtcaaactgcccggcaacactaagaagtgattgaggagcgcgggggcagtatcattgaagactttacggtaaaaaaagcctttttaggataattcaccgcgttatacaaataaa

SEQ ID NO: 70402 - DNA, 439 bp, Heterodera glycines
  Genomic contig location: Contig_ID=SeqID_9148; Location=470..908; Strand=+
  SCN-specific regions: Sequence locations=1-130,153-439
atgccaattgcgccatttgaattgatgaacgaagtgacaaatgagaagctgacactgattaagggtggagcttttcgttggctgttgaaacggtgcccaattgttggggagacggcggcggtggttcagaaacagcagaagaaagacgagaaattggaccgtttgaacggagtctacttctgtctttacgatgccattttctcgactcccgggcacattgatcagcggaagaaaaagtgatcatttgagaaatcgccgaccattattgatttttgataattgggttgattgatgctaattgtttgctctttgaactcatatcacttttgtggtggacttttcaatgttactataactgaatctctagacaatttctattgatactaaagaaatttcccaacaaaaaaatcaacaatggtttatataattaacgaaagaa

SEQ ID NO: 70403 - DNA, 792 bp, Heterodera glycines
  Genomic contig location: Contig_ID=SeqID_9148; Location=999..1790; Strand=-
  SCN-specific regions: Sequence locations=1-338,361-689,725-743,768-792
acatttgggatgttttggcccgagaaatttggcctatttttgcgaaaagcattcgtcatttgggctttcgcaattccgatgctttgaacaacttgcgcagtcgcacttcaccaacgattctcactgatcttgatcaattggtttcaatcgattctggtgctctgttacccgatggaattgctgacgatgggccaaatgcaactgctggccaagcgttggccaaatggctgcacactccgacaaaaaatgggcaaccgaagcaattgcatcgcaataattattttggtccaccaaagctggaatgggtcaacaacttcaaggaggtgtgtctagccatattttcgtcaatttgtttttattttaccagtttttttagacatttcgccgtgccaccacttctgtcagttacacaattcaactttatattattgtggaaccaatgccaattgaaccatttgaattggtgaatgaacggacgaatgaaaagctgacactgacgaaggagatcgacgaattcgacgtaaatgtgtgtaattggctgttgcaacggtgcccaattggggagacggcgacggtgccagcaattaaatgggaagaaagcgtaaatccgagtgccaatttgaacaatgtcacttttgatctgtggagtttcgataaatccattgggtgagcagcagcaatagcatttgattttatagaaaaataaaaacaataattaattttaggccattgtcgccaccagcggaagaaaaagaagaagaagcggatcaaagcaatgaaaatgtcgtctga

SEQ ID NO: 70404 - DNA, 1371 bp, Heterodera glycines
  Genomic contig location: Contig_ID=SeqID_9149; Location=579..1949; Strand=-
  SCN-specific regions: Sequence locations=1-267,296-592,614-763,787 -905,929-1371
cgacgtgtggatggacattctcccatcttttaactatgccaaactcggcctcaaaatggcattgctttccgaccgtttcgatgttttggttgacaaacatttcgatggaaaaagcgaattgacaatttggagacgtatcagaattcgcaaggacaaaggaccaaaagcgaaactgtctgtggcgatcgatggcaaatgcgtggcatttccatttcccgaccatccgttgcccaacaaaatccgttttaaggaccttcagatttagtaaatcaaaaaatatacagaaaaccaatcttcatttttccccttttcagttacgttgaccattctgtgctcgcatttcttcgttccaacaagcaaatttgggacagaagtggcatcaaattggatttgtttctgcctttatatatgaccgacgtcaagctcatttgggatgtttttacccgcgaaatttggccactttttgcgaaaagcattcggcatttgagctttcatgccgataatttggaaaatttgcgtcgccgcatttcaccgacacttctcactgatcttgatcaattgtattcaattgattctggtgctctattccccgatggaattgctgatgatgggccaaatgcaactgctggccaagcgttgtccaaatggttgcacactccgagcaaaaatggccaaccgaagcaattgcatcgcaataattattttggtccaccaaagctggaatgggtcaacaacttcaaagaggtgtgtctagccatattttctataaattcagtttattaaatagtatgcaatacgttccatgttaaaaaaacaaattctgcataaaaaaaacaaaaaaaaatttttccaaaaaaaagtgaaaacattttcaaaatagtgctctttgcaagtagcgccaaaattttgtacttttgagttttttgttcgagtccgggttcgagattcggaaataggccggaatggataccggattcgtggtcagtgacctcgaaaacgcaaggaacttgtttttaagacaataaaattcgctgacgcattttctgctgacgctttttccactgacgcattttccgggcgccatttgatttacgctcccttttttgtttagacatttctccgtgccaccacttctgtcgcttacaatgttcggcttgaacttctagtggctagccaaatgaatattgttgagccatttgagttggtgaacgaaatgacccaagaaaagttgacactgacgaaggacgaagagatttggctgttgaaacggtgtccaattgttggggagacggcgacggttcaatgggaaaaagacgaaaatttggacaatttgaatggagtgatcttccatctttatcatgattgtattgg

SEQ ID NO: 70405 - DNA, 817 bp, Heterodera glycines
  Genomic contig location: Contig_ID=SeqID_42533; Location=5..821; Strand=-
  SCN-specific regions: Sequence locations=1-143,165-817
atgtcatttgccaaacttttagccgaaagcagttccgacgacgcggaagagacatcacattcgaagagtgcggttaaagctgaacccgatgagtcggacgacgaaatcgacacggaataccacaaaccatccgaagtcgcgaacaaacagagtaaaaagaaagccatggccgacttattgagcaaacgacgcaataaaatacaaggcaattggagagaaagaagagtcggtggatgaattgaaatgtaattgaaactttttaagccgaagaaaagcggaagaaggagacattgaaggcgactctcgacttggacgaaatatttggcaacgaaaacgaaggtggaaaatcggccggcagcagcagttcgtcgacgagttcttcgcgttcctccagccccgacttgaccaagtcacgttctccttctcccgaagtcaaacaagaggtggtccaacgcatttcgaatttatattttggcattcagattaaaacaagggatgaaattatccgttgccaacttttccggcgaaagctcgcgaaatttgttcatgctccgttcttcgctaaaacagtggtcggttgcttcgttcgcatttcaatcggtcccaacaaatcggatgggaagcaagtgtacagagtgcgtcagttatattaaacggaaataatcttagcgaactgtttggaatttaggcggctcaggtagtcgaagttgtggagacagcaaaagtttacgaagtcgagccgaacagtgacatccgtacaaacaaaggctttcgcctcaaggtaatggcaagtgaacacaatttacccaaaaataaa

SEQ ID NO: 70406 - DNA, 75 bp, Heterodera glycines; identical to SEQ ID NO: 54636
  Genomic contig location: Contig_ID=SeqID_42535; Location=170..244; Strand=-
  SCN-specific regions: Sequence locations=1-75

SEQ ID NO: 70407 - DNA, 481 bp, Heterodera glycines
  Genomic contig location: Contig_ID=SeqID_42536; Location=202..682; Strand=+
  SCN-specific regions: Sequence locations=1-97,119-302,324-481
atggatcgattagacacagtaattgcttctcttctgaactgtcccgcacgtaacttgtgcgactgcttaaatcacccggatgagattcaaaaagttgaaaaatacctcaaatgaaaaactctacagacaacatacaaaaatcaactagatgaatacaaagattttgagtacggtggaattacaagagaaagtgcccgtaagcaaatggcttacaatggtttcaagaatgtgaccgtcgaccagcatttttatgtacggcaccgcatttgtcttcgctattcaagcaatccttgcgtgatcgaaaaacacaagaatggcaatgaacgtttctacccacttgaacttgtgaaagtgaaggacaatgatataatttatttagggcaaaattttcctaaacctttaattcgtgatgataatatgtttattgatgatcaacaatatttgaattggtaacttaatgcttaaaattacataataatga

SEQ ID NO: 70408 - DNA, 422 bp, Heterodera glycines
  Genomic contig location: Contig_ID=SeqID_42536; Location=261..682; Strand=-
  SCN-specific regions: Sequence locations=1-158,180-363,385-422
tcattattatgtaattttaagcattaagttaccaattcaaatattgttgatcatcaataaacatattatcatcacgaattaaaggtttaggaaaattttgccctaaataaattatatcattgtccttcactttcacaagttcaagtgggtagaaacgttcattgccattcttgtgtttttcgatcacgcaaggattgcttgaatagcgaagacaaatgcggtgccgtacataaaaatgctggtcgacggtcacattcttgaaaccattgtaagccatttgcttacgggcactttctcttgtaattccaccgtactcaaaatctttgtattcatctagttgatttttgtatgttgtctgtagagtttttcatttgaggtatttttcaactttttgaatctcatccgggtgatttaagcagtcg

SEQ ID NO: 70409 - DNA, 860 bp, Heterodera glycines
  misc_feature (794)..(794): n is a, c, g, or t
  misc_feature (796)..(796): n is a, c, g, or t
  misc_feature (823)..(823): n is a, c, g, or t
  misc_feature (846)..(846): n is a, c, g, or t
  Genomic contig location: Contig_ID=SeqID_42539; Location=455..1314; Strand=+
  SCN-specific regions: Sequence locations=1-629,651-756,779-860
atgtcgggtcctattagaatgcggataaatccgtctttaagaaaattaactgaaagactggtagaaattagaccagtaattgatgcgcaacaaagagaccctgaggggattgatttattaagaaattcgttggtaaaaataaaaagatcagtgacgttcattgatgaaagaattgaacaatggcgcacatatatgacagaaattgaagttgatgaacgagcagcagaagaagcactttttgtaaatatgaacgcaaatcagcgccatgtaactgaatggttagaagatgcaagagaagcaattgatgaaatagaaataattttagtaaatgaagcagatgatggttcggacacattatcagttgaattaggtgcgcaaggcaaccaacaaagaataaatcaaaatgaaaatgaaaggaatgaacaaagaattgtaaatagagaaagagttgaggctcctccagtatattatccgaaactcccatggccaaatttttatggagacacaatgtcttggccagttttttggcaagcatttcaagccaatatgggcgataaaccgattcccgaagcacaaaaatgtacttatttattgttaagcctaaaaggcaaagcagcccgagcaatgagagggtatcaaccaacagcagaaaattataatttagtaataaatgcgctaaagcgactttacggtaatgaaaaagtcataaaagaagcactacagaatgaattattgaatttaccgcaggccaatgaagctgctatttcactaagaatttgtttagaagatgttgnanaagagtgtgcgtcaattaaataatttngggatttcgctgagataaagatnatgtgatgatgaca

SEQ ID NO: 70410 - DNA, 940 bp, Heterodera glycines
  Genomic contig location: Contig_ID=SeqID_42540; Location=554..1493; Strand=+
  SCN-specific regions: Sequence locations=1-186,208-508,543-628,653 -708,731-815,849-940
atgttaagctttcgaagggtaccaaaattgtttgctttggttggtcgacaaagaaaaaagttatagtgcaaatacatgctaccgtgccggctcaaccgtaacggaccaactgagggaaaccgcattcatttcgtatataaattgaattcaggaagtcacttggccaacaatttcgcgcgcatatgcaaaaaataaaattggtacaacggctattgttgagggtgaagccgagtataaaaaagtagcgcagagggtaaaggaaaagcttgatataataggccaacaaaagtaagtaaaattttagagcggatgtgatgctcgtacgaaaatcattaagaggaatatttttagagtcagaccgggcttctggtactgaacctgtcataattcaaataagtcaacaaataggcaatgaaaaattgaaaaaattgtcaaaattcaattttattacttcagtctgcaaaatttcagaaaaattcatttgatttaagtcaatttcatgatttggccaaagttttcttgaatattttcacttatatgtattttatgctgcccttttgcgttttaatttcaaatttaaacatttacggtttattggatttgaaatattcccaagttattaaaagtgatattattatttttttaataaattgggctttaaatggttcatttttcagtgcctaatttcgtttttttatctttataatttcctaaatttagatattttcacacggtcatcgttttcccaaattggagtaacgcttttcagttggcaatccttgctaaacaaagtcactatttctttttggacggcgaaaatgaaatcaaagaaaataaaatcaatgtgatcgttgttcggtgtgaaaccgaccgttttggaagggctatccaagcggggcagtggtttacccaaacagttgaaaaccaaatgaagacatga

SEQ ID NO: 70411 - DNA, 919 bp, Heterodera glycines
  Genomic contig location: Contig_ID=SeqID_9150; Location=221..1139; Strand=-
  SCN-specific regions: Sequence locations=1-170,192-322,361-517,545 -547,593-786,830-919
tgcgtgccgagatgcgcgacggggacggcgaactgttgggaggtgccgagcggggggcacaccaatcattgagctgaactcgttgggcaacagcaaacatcagctgctgttcacaccgcccagggccgccaagtacaagctgtacttgtactgttcaggtgggaaataggtttttttaattatttattaatcatgcttaaattcttttagaattggtcgtgccaagtgcttaccctttgttggcaattgctgaaaaaaatggccaaacggcggcggaggagagagacgaactaagcaaagtggggaatacagaagaaaaacgaataaaaatattgaaataattaatacaaaatattatttgccttttttgttcaggtggttttgcgtggtgaaggactgacgacggcacgcgtcaaagagtcggccgaatttatcattgacgcatccgaaatgcatgaacaagtcggcaaaatcaatgcggcattgttgggcgaaagagcggacgtaatttgaacaaaattaataatcaattaattaattaattgcgaataattatttacaaataattaactattaataattttttttaaaagattcccgtcaaagtgtccgccctgaggaatcaagtctacaagagtgtagcagaacaaaaaatcaccgaaactgggtaattaataaattttagggcatttacacgccattgatgggcggcacttatcaattgattgtccaaattgactccaaaaatgtgccgggttcaccgagcacggtgattcacacattttgattttaaattaactaattattttaaacatttttcattattttaggttcaagttcattaccatcaattgcctgctgagttaatctctgtcgacgcgaaaccgctcaaatttggcgtgattaatgaggacattag

SEQ ID NO: 70412 - DNA, 1539 bp, Heterodera glycines
  Genomic contig location: Contig_ID=SeqID_9151; Location=889..2427; Strand=-
  SCN-specific regions: Sequence locations=1-61,87-103,125-132,155 -171,193-240,262-297,319-327,365-534,558-630,667-759,781-896,918 -1056,1078-1197,1219-1335,1358-1512,1536-1539
atggtgttcccggtgctcttcctgttcggttgcattttcctcgtcgcgttccctatgtatgtaaaaatttaatttatatttatttagaaaacctcaaaaattgcatttttatgccattttgccacagcgagccatatcaaatttaaaagctaatatatttttttctattactttttacaaaacaatttctgattttgacttttgcttcacaacaaagcaattatgtttctaacttttgctttccacaaaactatttttgttttgtacttaaatattttttgcgaattttgttggcaaagcatttttaaaaaattggttagcctaaacaattttaattacttttaaaaaaacaaatttaaaaattgccccattttttgccagcatttgcctttgccccgtgctgtccgtcacttccatctttggcgtctgcacttttttgtccaaatatgtggcttttgtgtcactgatgtgagttctaaaccaattcacggaatttgggattgttttttaatgccataaaaatgtctttcttcccacaacaaaatttgggtttggcaccgggcgacgctaacattgttaaaaaaggtttccctgccaaccatcaaaaacataataattcccattttttgcttatattttttaaaaaacttttttaattttttatttgtgttccaaaaaactttttctgtttgttttttgtattttttccggaaaactatttccgtattttttgtattcttacacgaaaaataatatctgttttttgttttgaaattttccagaaaactattcctgtttttggtttgtgttatcaggaaatcaaatactgaggcccgacggtgccggtaggcgccgtcaggaaaaaaattttaaaacttgaatgcggtttgttaacatattttgacccaaaattttgaatttcaccaatgcaaccaaaaatgctaccactaaaaatacaaacttcagtggcgagaaacaacaaaaattacgtcaaattttgcccattttttggcttacaatttgcaaacaacaaaaggattaatattattttggcacaattttttgggaaataattttacaaaaaaactggttaaccttaggaatttatattcatcaaaaaaacgatttataaatttgctccattttttgccagcatttgccattgccccgtgctgttcgtcacttccatctttgacgtctgtacaattgcgggccatctcacaaactctttgatgctgatactgccatttttgtgggtgccgttttttggcatttcagaatttgaaaatgttccctttatttgtccaaaatatgtgacattgatggcaatgctgtagttccaaacaaattctcgtctttgaggagatcagcccttccatcaacatcaccacggtagggatttaattaaggctaaaatttagttttacaaactctacatttcttaataatgtaaaacttcttgggtgaacaaatgcttcgaacatagttttggtaatactgtcgatggtagcgccccttttttgaaaaatttttaataaa

SEQ ID NO: 70413 - DNA, 293 bp, Heterodera glycines
  Genomic contig location: Contig_ID=SeqID_9151; Location=2654..2946; Strand=-
  SCN-specific regions: Sequence locations=1-183,259-293
gaaatttctcaaattttgccgaggccgttcggtgtgtgcgatgacgtggacattccgccgttgcccaagccgctgaagcaccgcaacaatggcgcacactgtaaacgtcaacactgatgatttccatggcacactgccgaagaacaactcgaatcatttttgccaaaaaatttggtggaacactttttattatttacaaaataattatatatatactttttaattcattattttgcaattcaataatttaaaaaaattgcttttttccacatttttctgcaattattaataaa

SEQ ID NO: 70414 - DNA, 639 bp, Heterodera glycines
  Genomic contig location: Contig_ID=SeqID_42547; Location=170..808; Strand=-
  SCN-specific regions: Sequence locations=1-137,163-199,240-257,279 -514,536-639
atgaacagaaaggcagacacaaaaaatcacaagtattatgtaaattcagaaacatttaatcaaataaatcgtcaggtgagctttcggttttatttatgcaaataattcagcattttgccattcgtggtttttatctcaaaaaattaattaaataaaattaatcaaaatgaatgacaacacaacgtacaatacggtagtcattaattgaaatatttataaattgtttttttttaatttttgcagttttatttggccttcaaagatgtccatcccagctggtcattaattggatgcgcactgatttttggaatcattgcggtaattggcatcattttcaattcttctgtcattggtgtaacctttttaacaaagtgcgtaattagtgtagataaattcttggagtaagcagtattaatgagttataagtgaaccttaattaccttaattaggtcattccgtggcactgttaattacctcttggcactttgttccttttttgaaatcctccatcagattggccattttttgtttgtttatacagaattttctggacaaaattttattgagtatcgtttggcggcaaagattttaatgattcctttgtttgggttaggtaatttactcaaactaataattaaa

SEQ ID NO: 70415 - DNA, 102 bp, Heterodera glycines
  Genomic contig location: Contig_ID=SeqID_42550; Location=122..223; Strand=+
  SCN-specific regions: Sequence locations=1-102
taggctaatagagcctgtgaagagctttcgaatgatatcaagattgtttgattcggtcaataacttcaagagttatattgactcaaagttggctcagacgga

SEQ ID NO: 70416 - DNA, 516 bp, Heterodera glycines
  Genomic contig location: Contig_ID=SeqID_9153; Location=169..684; Strand=+
  SCN-specific regions: Sequence locations=1-516
atgatttgttcgtcgttccttttgcttgtcgacacagtcgccgacggagaaagcgccaaaatagttcggcacgggtgtgcatcaaagtcacttcagaaagcagtaagtccagctcaatggcatcgatggttgcgttagaattttgctgagtttggaccaaattcgaggaaattggtcgagtgttgtcaatcaaagtgaacaccttcatttacgggttaacaattattgtaaatagttattacaaaatactgcagatattctcgcaattaaaaaaacacctgctgagctttctcctcaaaatgtcttcgttggatgaacgtgttcaacactcggacgcactgtttgtcacattcgggctgaatcagctcaatcagcaacagtaatttttctgggccatagaaattttcgattatcggctgatgcagctcaatgatacgtgcaacgccctcgaaaagcattgtcaaagtgtccgcataaagtacgtttttgcgtttgtcgtcagtcccaccggcctaa

SEQ ID NO: 70417 - DNA, 2018 bp, Heterodera glycines
  Genomic contig location: Contig_ID=SeqID_9153; Location=1929..3946; Strand=+
  SCN-specific regions: Sequence locations=1-408,430-598,633-891,913 -1798,1822-1878,1900-1983,2005-2018
  Gene Ontology: Cellular component=mitochondrion
atgacgatgccttccaacaggcgatttcctccaatgcaaactctcggttgttgcttgtctgtgacttttttgcaaattggtaagtcattaatctgaaaatgtcatttcatctgtttacctaaactctcaataggtgtggaccgtgtagggcaattgcgcctctttttgattcactttccattcgatacgctgaaaaggcagtgtttctgaaaattgacgttgatcgctgtcgaggtgggactaaacagaaaatcacaagggacaaattaatgcttttttttactccatatttaatttttaaaggagaagagttgaaattaaatgatcgaatattttttgtcagctatgtactttcaggttcctgccaacaatacgcagttcgtgccatgccgacttttgtgattctgttaaatggtcaggaaatgggcagagtacagggcgctgatcccgctggacttgaacatttgatcgccagcttagcgaattccccggacattgggaaaggatctaccacaaagaaaactttggaagcgcatgttgccaattcagaagaaaggcgatggttggaaagattggtgtcacaatcgcaaagggtgcgccaaatgatttttaattatttgagtctcgaatttcagatgtcgatttatgaggacgaagtatcccaaacattggcactttcgcttattcccgctgaagaacttcgtgaaaaggcaacaacaaatggggaagtgaaccaatatgatttggccaaagggttgcttggctggttccatggcttcttcagctgggtaaaccatccaaaatgcgaaaagtgtggcgttgaaggaaaacccggtgatcgaggcgtacctatctatttatgtgagtttttaagagggcggcggaataccctcggaggaggagcgaaggaacggggccgatcgagttgagctgtttcgctgtgataaatgtggcgaccaaatccgtttcccacggtataacgacccgctcaaattgttggaaacgcggaaaggtcgttgtggagagtacgcaaactgttttacgctttgctgtcgatcaatgggatttcaaactcggtccagacaattttattttttaaatcgtttaagatttagctggatttctgacaatttggaccatgtttgggttgaagtttattcggaccaacttcagcgctggttgcattgtgatccctgcgaaaatgttattgacactccgttgatgtacgacaaagtcagtaggcaaataaggaaaatatattcgatgataattgtatgtaataaaaattagtaatttatatttctacccgtttaagggatggggaaagaaacatgcttatgtttttgcctttgccattgaccatgtccaagatgtcacatggcgttaccattttgaccaccgagcagcgatgaaaaggcgtaccagcgtgagagaacctgttcttcgcaactttttaaatgtgagcggagattcgatttagtaacatattttgtttgctaaagaagttgaacgcacgattggctcgtcaattgacaaatgatcgaactgccgggctgaaaaagcaaatggcctttgaattggtggagtttctcactgcccaccctcaacttcgtgatggaagcgaagcacagaatcagggccgtcgctcgggagctgaagcatggcgaaaggcccgtggtgaaagcaaataaagaaatttttataggatggacaaaggaagattattccccccccctccatttatgtataatcgtcgcacggtcatactgtatacactactgtacacctaaattagatttatttattgtctgaaaatgttaaaataaaactgaactgttctcttcaaaagcattaatttattttagtagtgacgccgttaaatttcttttgttatataaataatcaaattggaaagcatttcaagaaaccgaaaggaatggaaatcgaagaaaatggcaaagcgacttcatccgaggactccaacatgaaatggaaaactgaagaggataatttgtccg

SEQ ID NO: 70418 - DNA, 463 bp, Heterodera glycines
  Genomic contig location: Contig_ID=SeqID_9154; Location=1142..1604; Strand=+
  SCN-specific regions: Sequence locations=1-160,201-314,336-426,448-463
atgggaatgaacgctcttttgaacgcggccggaataagcggcggacaagcttttcctaacattggcacttttcctgtacatcagcaccaatttgacttacaatctgtgcgtatcccatcccatttcaacaatttatcatgcttttgtttgttcagctcgccgcggctgctcagccacatcatcaccaacagcagcagcagttgtcctccgctttgaacttgcaggcgttggttggggctggagcagtgcaccaaccgccgactcccatcacttccgccgcggcacccaataatattcccggcatttcgcaagaacttttattccaagcgactcttcttgcggcagcaaatttgaagtatcattcaggaaaagaagcaaaaatataataaatgctgaaatattaagcaatcccggactaattacgtcgaacacaacaccacaacagcaacagagaccaaaatga

SEQ ID NO: 70419 - DNA, 380 bp, Heterodera glycines
  Genomic contig location: Contig_ID=SeqID_42552; Location=43..422; Strand=-
  SCN-specific regions: Sequence locations=1-37,59-222,261-380
atgcctaacaatactctcatgggaagtaaaagctatatttatggatttttgaataaaaggccggcgtatgtaatggcagacagtggtaagtatctaaaattgcttaaatgttttttttttgaatataattaacccgaattttgcaggggtgttatttctaaattttagtgtatagctgccttacggacatttgcggacggacatttgcggacaattcctgagaaaaaaattaaatgaaaaaattttttttgttataaaatctctaatggaagagtgggcctcgtcagtgcggctcttccaaaagaaaacaaaaaaagtaaaaaaagtgtgtttcggccctaccgcagacacacaaaactaaagaagcacacatcaataaa

SEQ ID NO: 70420 - DNA, 759 bp, Heterodera glycines
  misc_feature (26)..(26): n is a, c, g, or t
  misc_feature (49)..(49): n is a, c, g, or t
  Genomic contig location: Contig_ID=SeqID_42554; Location=365..1123; Strand=-
  SCN-specific regions: Sequence locations=1-303,325-759
ttacatcgatcactccgtcatcgctnttcttcgttcaaatcacaaaatnttcgacaaaagtggcaccaagttgcgtatggggatgctttactcagatatggcggatgaccggcagccgatttgggacgtttttgttcgtgaaatatggccaatttttgcatcaaacattcgccacttggactttatcgatgctgatcatttggacaatttgcgtcgtcgcacttcgcccacaattctcactgatctcaatcagttgagttcaatcgattccgttctattgctgcccgatgcaattggtgataattttgatgggccaaatgcaactgctggccaagccttgtctaaatggttgcactctccgagaaaatatggccaacccaagcgattccgtttcattgatattaatgaacatgtgagcctacatttgatcaacaatttaaaggaggtgcggcccaacattttcggcaaataactgatttttggaattgtttaggaatttatgcgtgccaccaccatttcttccgtcagctacgaaattcatttttctgttcatgtgccgacaaagccaatggtgccgtttgaattggtgaacgaacgaacgcaagaaaagctgacattggccaaatcaaatgaattggacaacatttggataatgaaacgatgcaaaattggggaggccgcggcggttcagcagcagaagaaagatgaaaattggaactatgtgtacttttggctttatagtggaaccaattgcatcgg

SEQ ID NO: 70421 - DNA, 788 bp, Heterodera glycines
  Genomic contig location: Contig_ID=SeqID_42558; Location=209..996; Strand=-
  SCN-specific regions: Sequence locations=1-475,497-531,553-628,655 -737,780-788
agtgtccgttggggtactcaacatttatggggagcaaaaatccaacgcagattaaagtacaggctataggaagctattccgaaggattcggtctccccataaatctgggcgcatcggtcggggggactgccccgaaaacaaaaaaatcgatttttcaagtgtccgtttggggtactcaacaattatgggagcaaaatccaacgcagaattaaagtacaggctatagggaagctatccggaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtattcctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagact

SEQ ID NO: 70422 - DNA, 156 bp, Heterodera glycines
  Genomic contig location: Contig_ID=SeqID_42560; Location=203..358; Strand=-
  SCN-specific regions: Sequence locations=1-32,59-156
taagcctaaactttttggcctgtttaaaaaggaattaaaaatttttaaaaattttattcatctcccttttgatagaaaaagcatcagagagccttatttaacttttaattaacatttggtgcgtttcagagcagtttctgaaaaaatatttatgaa

SEQ ID NO: 70423 - DNA, 553 bp, Heterodera glycines
  Genomic contig location: Contig_ID=SeqID_42561; Location=923..1475; Strand=-
  SCN-specific regions: Sequence locations=1-31,208-212,330-553
atgacggcacaatgggaaaggtgaaaaacattaaaaaaataagaatttaaataaaattcaaataaattatacataaaataataatttaataaattatacataaataatcatttacataaataaattttgcaaaaaaataatcatttgataaattatcgataaaataataattaaataaattatacataattaataatttaaataaattatacataaaaataagaattttaaataaattttgcatgaaataataattaaatacctaaattatatataaaataataattttttataaattttgcataaaataataatttaaataaatttttgcatctaaatttattggattgaaaaaaaaacaaattattttaggaacaaagttacaacaccatcaaatgtgcgcaacgcaaatatttgggtgacgaatcaacggatatttgccgtaagttgtaaatccattaacagttaatttgtagaatataggaaaaatgattttttggagatacgaaatattggttgcctatttttgtacggactaattactttaaataaa

SEQ ID NO: 70424 - DNA, 132 bp, Heterodera glycines
  Genomic contig location: Contig_ID=SeqID_42561; Location=1478..1609; Strand=+
  SCN-specific regions: Sequence locations=1-132
atgcacctgtccattcggctcccggacaatcggacagtggacaattggacagtggacaatcggacagttgggcaatcggacagtgaggacaatcggacagaggtggacaatcggacagaggacaatccgaca

SEQ ID NO: 70425 - DNA, 983 bp, Heterodera glycines
  Genomic contig location: Contig_ID=SeqID_9155; Location=391..1373; Strand=-
  SCN-specific regions: Sequence locations=1-478,512-646,669-757,779 -820,842-983
atgagcttgggcttcattattaaagcccttgcgagaaagtaagaagcgagtagcaacattcatgttaatgtgcccccggggaagagaaagacccaggggggttgattgtccaaaaaatagatataaaagacccaaaaaatcaagaattttttttcggcctaagggtcgagagaatgttgattgctctcggaaaaagcgtcagtgatatactgaataactaactataaatatgaatataacccaaccataagaatttttcactgtttgcatttaaattttataaaaaccccaattttgtttttaccatttttcattgaaaattcattataaatattatgggacacaattaattaaaattatgcgcatcattcagtcaaaaatatatattccaactaatgattggctgtgttaattaccataaccccaaatttgactgacccaatgggatttgccggacgacgaagaaggaccttttttgaatttaaaacttattttaattttattttttaaacaacacctcagccaatgcttttgttagcacgggagcgaccgtccgagccaaatagaggccattgtcacttctttaattaattaattcgtgcaattaaaattaatgagttaaatcactcagtatatcaaggtcccgttattctataaacattaaaattgatttttttttcttttgggttttctgatagctttttcttgaaataaatttcgggctaggcaaaaaaagatgtcattccaaaagccttcgtatatatttttaaaaatttacgttggcatgtccaatttttcatgtaacagccgttcaaagcgccgtttctccatgtcctcctcttcatcgtcgccgtcccgtcgtcctgtgtccacgccggaactgtgccaagaaaaatatgtaaaaaggtatacaattcaagagttttgagacagtaatccataatattcaatccatgacttgctgtattacggtaattaataaa

SEQ ID NO: 70426 - DNA, 477 bp, Heterodera glycines
  Genomic contig location: Contig_ID=SeqID_9155; Location=1410..1886; Strand=+
  SCN-specific regions: Sequence locations=1-43,72-84,106-238,276-477
atggttggtccgttacattgaaaccggcgaggactattgaccctcgggggacggcggcggaggcgctgatcggagagactgacagaagcaaaacaaatccatggatcattaacacactttaattggccaacatttcattgtcccgctgactaattagtaaacttattgtattttaattatgtttggatatattcaatttgtaaattattttaaagtaaacaaattcgctatttgccagaattttgtaacatttttaaaattgtaaaatataaattagagaataattaaatcgtaattaattgacctccctcccttcttctgctgcccattattctcaccattgtttcagtgttttattgttcaattaatgtggggtcacgcaaagctcaacaaatgaaaaatctctcaacaaatcataattttttacttaaaaaaatgagagacaatttaaagaaactctaattaattttcatttga

SEQ ID NO: 70427 - DNA, 1672 bp, Heterodera glycines
  Genomic contig location: Contig_ID=SeqID_9155; Location=2405..4076; Strand=+
  SCN-specific regions: Sequence locations=1-36,58-66,107-252,321 -903,928-1672
atgtcggacaaaccttcagcagaagatggagagcatgaacaacagaagaaaatgaaatgggaaatgtaattaatttaaaattttaattttaatttaaaatttattacttttaacagttggtcacaaaattttggggaaaaactttgaatgtaaaatataaaagcaaaaaattgtaaaacccaaacccaaagcccgaaaaatcccgacttttcccgcccgagggcgaaacctcgaatttaattatactggtagaaatatatatcaaatttatattttaatttgaataaaattcattatttgaatttgaattttattaaaaagtgccaaattttagcccaatttgtgccgacgattggctggcggtgtttgctttgctgccgccgcgtcaacttggccttgaaatcgcactgctcagcccgcgctttgaccgcatggtggacgaacacttcaaaacgcgtcgttgggcattgaaatattttcgcattaaaagcaaaattggcgagaatggcacgaaggaaatgcgaatcaaaaatttcaatcgaaaagtggcaccgattgtgccaattccgcgcattccgttgccggacaaagtcgtcgacttctccggcatttcaatacggtaaataaaacaaattgatgggaatattacttaatcacgcgggatattagagaccggataattggggccggaggaatcccgaccgacggaatcccggtccccatcaatcccgatgaattacaaaacggctcgtgacggatcctaaggttgggacccgaatttaatcaaatggatccctaaaaaatcccccggaatcccgattctcgacccgtccgttctctagcagaaatgaaaatgccaaaaatgggaggaccacagaaattatttagaaagggcaaaaagagtaaaataatataataaatttaaaagatattagggaaacaaagttggggtcgtgttttgtcggggacaacaagttcggagttgcccaaattggtccggcgtttatcagagttggaagcttcggggtcggaggcggggtcaggaataagttgaaaatgccaaaaaatgccagagtttttacctgtgataaaaacccaaaattcagccaaatttccccaactcaattttagttacattgacaatgatgtgatcacttttctccaacgttttcaacgccttttcgcctcttgcgcaataaatctgagcatcaaaacaaaaagtggccgcaatttaaaatccattgaacgtttcatttggccaatgatccgacaaaacatttgtggcattattttttgcaaagccaaagattttcgccgtctccgaaagaatgccccgtccattctccgtcacattttccgcatcgatgacgataaaagtccgcggaaaataccactccaatcagtgtactttgataagggcgaattgcccaaattgccaactgccgttgaaagtgcccatgacaatggcaatgccaatgccaaagtgccgttgaacgaaagcgaagcgttgaccaaatggttgttctcctctcgtccggagaacgatttgccgcccaaagtgttgcgatgccgtgtctataactctgatattgagagttggattgcgagaattgaacaatacaaaacggtgatggtcaattttggttttaaatttgtgctgtttgtagtttaa

SEQ ID NO: 70428 - DNA, 440 bp, Heterodera glycines
  Genomic contig location: Contig_ID=SeqID_42566; Location=187..626; Strand=-
  SCN-specific regions: Sequence locations=1-440
aaatctgtatgtaagtaaaaatcgtaattacgctaaaaaagcttctcaaacaattttagcgcttccaattccttctacaattgcctttatacatcccattatgagcgctaaaattatcagagtgccgaaaatcgcatgtgatctaagcctagcaaaaaatggtgtaagtaaaaatcgtaattacgctcaaaaagcttctcaaacaattttagcgcttccaattccttctccaatcgcctttatacatcccattatgagcgctaaaattatcagagtgccgaaaatcgcatgtgatttaagcctagaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgc

SEQ ID NO: 70429 - DNA, 138 bp, Heterodera glycines
  Genomic contig location: Contig_ID=SeqID_42568; Location=24..161; Strand=-
  SCN-specific regions: Sequence locations=1-138
atggaaaagatttactatttgtcggttttgttcattttctgttttgcattcagtgcattttctgtcataagcttattcatcacggctgaagcattgccttatttgaaaagtagtggctttgaagctgatttatatcag

SEQ ID NO: 70430 - DNA, 265 bp, Heterodera glycines
  Genomic contig location: Contig_ID=SeqID_42568; Location=411..675; Strand=-
  SCN-specific regions: Sequence locations=1-172,195-237
aacattaaatagcccgacaaatcgtttattggcatttaatgcggccctcgaaattgcgcatcaatcatcgtatttcacatttttgttcctcagtttgaccggccaaacattcattgactataaattggccgttaaaattggcacactttcaatcattggttataatggtgtgtttcctgcaatgctttgtactgcaattgaccgactcttttgcgtcatattcccttatttataaccaattttttaattaattaatataaataaa

SEQ ID NO: 70431 - DNA, 1066 bp, Heterodera glycines
  Genomic contig location: Contig_ID=SeqID_42571; Location=60..1125; Strand=-
  SCN-specific regions: Sequence locations=1-175,197-929,951-1066
aaagagacgaactgagaaatgagaaggaaactttgagcaatttgcaaacgcagcggaaaaaatcggacgaaaggcaaagccaaacggacgatgaaccgaagcaaagaatgacggagcagcaaattgcggaaatggtcgagcagaatgtgcagctgaagacggaactgaacgagcgagaggaggagctgtacaggctgcgcaacgacaaagtgttggccgaaattacgacgtcggagggacatagcaaagtcagtcagtcggggaaaactacggagaaaaacgggggaaagggaagggggcggggacaaacgcgacatatggaggggacaatgccatcagagatcattcagtccctacttcctgcaaaattcactctaattttaactcaaactcagaggcctcccagtgacacggactcagcgacttcaaacaacgattgggaacggatgggcaaagaggaaatcgaagtcgaaggggtgagcagcagtgccggcagtgaagagaaggaaacggccatggcaaatagacgcaaaaaatcttcggaactgagcgatttttccactcaaacggacgaagtatcattttcaataagaaaaacgagaatagtcaaaaagatatttttgggcatgtttaagacgcaatttggcgaagacaaatccgaagaacgtttgaatttacttgaggaagagttggacaaagcaaatagcaaatgcgaaggaatggcgacggaattggcaaatgcaaatttgagaattggggatgccttcaaaattaaagagcaattggaagcagaagcggacttaattgtattggaccacctctttttcagactccccttagatttgttctcaaaattcgatgattgacaaagacgaggatgcgctgagaaggcgcgaggaggaaattgcattgtaaaacaataaatgaactttgaataaaaggaatcattactatttctaatttcgtatttttcaattttgagggaccgcgagagaatggcgaagttgcaaggcgatttgccaagactccgcgaacacttgctcattatggtggagcattcctctaa

SEQ ID NO: 70432 - DNA, 2490 bp, Heterodera glycines
  Genomic contig location: Contig_ID=SeqID_9156; Location=26..2515; Strand=-
  SCN-specific regions: Sequence locations=1-30,52-469,491-2490
atgccttctaaagatcgtgagttgaaaagaaggaagcaagaagagcacctgcgacggacggagcaatctgtcattccaggtcgctcacctatcccaaattgccctcctcagggcaattcaaactgtcctattctggacaacccattgagtgcagatgggaatggggcggcatcgccccggggttttaacaccccaaatttaagtgctttgcaattgagcacgccggcttcttccattggaagtaaaagacggggaagacccccgaaaaccggagcggagtctatcacggcttcgcaaaatagtgtgtcatcaattgacacacaaatcactccggccactcaaaatattgggacatcgccgtgcagcaaaaaagggaaggtcgccgaagttaaccgacccaagtttgctactgaagcaattgcttcaacgccagtctccacgcaaaaaagccgtggacgacccagcaaaagaagtggtggtccaggcaggtccaaaacagatgcttcaattagcgaaggctcgtcaatggatcagagctctgaagctggcacaaatgtggcggttttgcctaatgtggctgaaaaaattgatttcaacactgtgcaaatcaatttcgcaaccacgcgaaatttttcctgcaaaatttggaaatgggcagcaattggcctttacgaacgtgatggcgaaacaccgcttgcccctagatctggtccaagatacattgagacctgttggaatgatctgacccagtttctcaatgacggctttgctgccacatacttggcatacttggcaaccatatcacaacgaaaagtggtcgttgttgacccaatggtatggagcaatggcctggacagagtcatgccttacaaaaatatgacatttgggtacgaccctaatgttccggcagaagttatacttttgccagtacatttccctggacattggactctcattgtccatgatgtgcaatttggcactcattttgccgattctttgcctaccacatatggcaggttggatccgcaactgacgaataaaattaaaaatatcatttcggatattttgccgtcaacagttttaaccgggatttttaatgccgtaaatctgacggcccaacacgatggtaatagttgtgggtacttcgtgtgcctgtatgctgagtcatggcttatgaacaatcgcacatttgttctgcctgatttatccatcaattatgaaaagcggcgcatattgtggcacattaacgagctttatggcacagacaatgtgccatatcatccgagggaaggggtaccaactccttgcccaattgtctatcgacatgcggatgaggtgcagtcgacatccaaggccgctgagctaatggaagttgatgaacatgatgatataatgatcatcgaaccacagacaagtggacaggcagttgatgccattctcacccaagcccaagtggccggtgaaaaccaagctgacacgcttggtttggtgtcggagtcttgcatcccgcaagagccaattgcgcaggctgatgatgtaattttcatcagacctaagacgccaccaaggcgatcaatgcgcgttcaaaaaaggcattcagcttctgttagccgttcgccttcaccggcgcctaaacgccccccgccagcaaattcgctgggagtggcaacgccgatcacacggcgttgctctgcatttcacaaggggtggcaatgcgctgcagcagcagccaaacatttcccggaatattgtgactccgggaaactcggtgacaaaaaatgcgccgattgcgctgcacatctcttctcacatgaagacagtagcatttgctgccggaagggaagagttgtactgccaatgcttaacccgcatcctgatgagctcaaacagctgattgtggggaataagcaatcccgtgaagggaaagaatttgttcgacacatgtcgcgttataacaacctgctccaatttgccagcgtttccgctggcaacaaaccaagccctgctggcggtccgatggccgttattcttaacggagaattccatcgccgcataagcagcatgcaggctggtacaactcagattcctggctttggccagttgtacattctggacccagtcgaggctatggaacagcgtcgaaacaaccccaggtttactggggagaaaatcacaaacgaagatgagtttgtgcagggtcaccagctaaatgagcagactcttgagatcttagaacaaatgatccaattgcatcatcctgctgcgcaggcatataagcaggcgcgtgagcagctcactgagcttctccaacaacaaactccggaagagcttcgcttctttcgcatgactttgttgaatgagcgcagggctccagctggtctgaaagacccaaaattgcacccacaccaaataatcaccccttctacgggtgaagggatgttcgctattcatgcggaccccactggtgctcctccgcccaaaggaatttgg

SEQ ID NO: 70433 - DNA, 843 bp, Heterodera glycines
  Genomic contig location: Contig_ID=SeqID_9156; Location=2826..3668; Strand=-
  SCN-specific regions: Sequence locations=1-437,459-739,782-843
atgggattgtggtcaacaacgacctgccccttatgggattgtggtcaacaacgacctgccccttatgggattgtggtcaacaacgacctgccccttatgggattgtggtcaacaacgacctgccccttatgggattgtggtcaacaacgacctgccccttatgggattgtggtcaacaacgacctgccccttatgggattgtggtcaaaacgacctgccccttatgggattgtggtcaacaacgacctgccccttatgggattgtggttaataacgacctgcccgttatgggattgtggtcaacaaggacctgcccgttatgggattgtggtcaacaaagacctgcccgttatgggattgtggtcaacaacgacctgcctcttatgggattgtggtcaacaacgacctgccccttatgggattgtggtcaacaaggacctgcccctcatgggatagtggtcaacatagagctgtccctcacgggatacatttaaatcgtctttttattatatatcaatgactgcattagggcacttccggtttccattatatttacaatgtaatgtgtcagcttctcaatgaagtgaaaccaagtgcatgtcgggcgacgcaaagaccctaaagaaaataaggacctgcccttcttgggattgtggttcgaggacctgccttttgaggattgtgggccacaacggtttacaatgatgatttccttattgttaccggccaacatccggcgcgaagctggtcccgcactttgccaagaccagtggactggtgagaggtaacataggatatcggagttaaccaaaacttatcaagtaaaaccttggtgacaataaa

SEQ ID NO: 70434 - DNA, 323 bp, Heterodera glycines; identical to SEQ ID NO: 69014
  Genomic contig location: Contig_ID=SeqID_42572; Location=940..1262; Strand=-
  SCN-specific regions: Sequence locations=1-88,113-246,280-323

SEQ ID NO: 70435 - DNA, 66 bp, Heterodera glycines
  Genomic contig location: Contig_ID=SeqID_42574; Location=50..115; Strand=+
  SCN-specific regions: Sequence locations=1-66
atgcttttcggattgaagcatttgattgatgatgatgattgtggaaggggaggctcaaaacgatgt

SEQ ID NO: 70436 - DNA, 382 bp, Heterodera glycines
  Genomic contig location: Contig_ID=SeqID_42576; Location=1..382; Strand=+
  SCN-specific regions: Sequence locations=1-104,134-269,299-382
taatagggcctagttaagctgtaaaaaaaatttgggggcgatttaaaagagaatagaaagaaccaggttcgatgaagttttggtaagccaaaaaaaatccaaacatttaaaaatctataaaaaatttaaaaatgagaattcatgcgagattttctggaaataagcttaatatcgcctagttaagctgtaaaaaaaatttggggcgatttgaaagagaatagaaagaaccaggttcgatgaagttttggtaagccaaaaaaaatccaaacatttaaaaatctataaaaaatttaaaaatgagaattcatgcgagattttctggaaataagcttaatagggcctagttaagctgtaaaaaaaatttggggcgatttgaaagaga

SEQ ID NO: 70437 - DNA, 285 bp, Heterodera glycines
  Genomic contig location: Contig_ID=SeqID_42576; Location=786..1070; Strand=+
  SCN-specific regions: Sequence locations=1-52,82-217,246-285
taaaaagagccaggttcgatgaagttttggtaagccaaaaaaaaatccaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaatccaaacatttaaaaatctataaaaaatttaaaaagtgagaattcatgcgagattttctggaaataagcttaata

SEQ ID NO: 70438 - DNA, 928 bp, Heterodera glycines
  Genomic contig location: Contig_ID=SeqID_42577; Location=155..1082; Strand=+
  SCN-specific regions: Sequence locations=1-622,647-705,727-810,833-928
atgccaattgagccatttgaattggtgaacgaagtgacaaatgagaagctgacactgacgaaggatggcactggtgaattcaattggctgttggagagatgcccaattattggggagacggcggcggttcagaaacagcagcagaagaaggacgaaaattcggatgccaatttgaacaaagtgttcttccgcctttacgatgacattgggtgagcagaaaggaggccttttttgtatgaaacacggatagggaaacggtatcccatgtacagtactttcccagaatcttggcagggccatgggttctgttaagacagaacttcagtccttagttttgtcttttttgctctggtccatcccgaaaaccctgctggtccgggtttttccaataattacgggctgtactttcgaaaaagttatccgattcaaattgcgcttaatttaggccgctgtctccgccaggtcaaagcaatgaaaaagtgttctctttttccgggtccagtgatcagcggaataagaaaaagtgatcattttgggaaatggccgatcattatcgagttatgatgtattggattgattgatgatgttttgtttgctctttgaattgttcaatttgacgctgacatttttgctattaaaaaaatggaaaatttggcactttttttttactttagataatccgatgttttttctttaggcaactgatttttggtcgtgttttttgtttgtgttcaagtttcaaaaataatttttttagagtaactaaacttgttttgggtctcggttttaaagtctcgggattttatagaggcaagaaaagaacaaataccaagcattcataaaaaaattacaatgagaaaacacgaaattcaactttgttttccgagtgtatttgcgaattattttttccaatagccttaggtaaaaa

SEQ ID NO: 70439 - DNA, 343 bp, Heterodera glycines
  Genomic contig location: Contig_ID=SeqID_9157; Location=100..442; Strand=+
  SCN-specific regions: Sequence locations=1-163,185-343
ggaaatgtctttgttcaccaaatgccccgatggctttaccaatctgcagctgatcgaactgtttcgactcgactggcgccgcattcgatcagaggaggaccttctcgcccactccgatcatttgcgcgacggtccgttgggccgcggctgtctgatcggcccgaccaactccgccgactgtttgcactgtttcgagcgtctccgacgggcgattgagcaggtggaagccgtccactgggcatttgccaatttgctgaaccgttttgactgtcgtctcgctaaatttggcctcgcttccgcgacacagcccttctcgcccaacacgacgtgccacaattgcgcg

SEQ ID NO: 70440 - DNA, 234 bp, Heterodera glycines
  Genomic contig location: Contig_ID=SeqID_42582; Location=492..725; Strand=+
  SCN-specific regions: Sequence locations=1-55,90-132,167-194,216-234
atgaaaaattttacaaaatgcattaatttaaaaacagtaagtaataccgagaatgaaattaatttaaacaaaaataatataaaattttagtcaaaagttatatttttgatctcatcccaaaaagaaatgaacttaattaataaacataaatttttaaataataattctacgatttatcaacttagcgtattcatatggaaaaatttgaaaaataagttatgaaatgataattta

SEQ ID NO: 70441 - DNA, 520 bp, Heterodera glycines
  Genomic contig location: Contig_ID=SeqID_42585; Location=32..551; Strand=-
  SCN-specific regions: Sequence locations=1-436,463-520
atgaacgctgcgcatgtggaatgtcagcgacttataactggattcaagcgacgtgctgctgagacgtgcgaagcacctgtgactattcgtgctcaagtggtgcaaaacacatgcacacctgtactagcagcttttccgagcaaaatcgccacaaaaagtgggtttatatccaaaaacaattttgttattttttggttttttaggtgatcaaacgataaaagaagtatcgcgaagccgatgcacggattctccgactcttctaccgttataacgacatcaataacaatcacttcccccaaaatgatcacaattatgcaaatgtcaatgtgaatcccgaaaacgctaacaattttctcactggtgtttccctaaactatgaaatgtgcgaccttagtttgttcggaaatttgatattttttgttatactatttatgtgtttttataaaattttaattattttttccgtttgacgcacatccgaccaaactgacaaattattgaagatactagccgcaataaa

SEQ ID NO: 70442 - DNA, 111 bp, Heterodera glycines
  Genomic contig location: Contig_ID=SeqID_42587; Location=283..393; Strand=+
  SCN-specific regions: Sequence locations=1-52,74-111
atgttagcgaagactgaggagcttgacgagtctttgcggagcattgagaagctgctgcagcagatcaaagacaccaaaagacttctggacaaattcgaagagcacattgtc

SEQ ID NO: 70443 - DNA, 1035 bp, Heterodera glycines
  Genomic contig location: Contig_ID=SeqID_42588; Location=229..1263; Strand=-
  SCN-specific regions: Sequence locations=1-955,979-1035
agtatcattggcactgggaatcggctaccctaaccaccagccgaggattggtgatggcattgccgaaactgcaaataaatgaccactggttttaggagctgagcgcgtctgaccaagtgcgagtacgaagacaagcagctggtcagtgcaattgaaaaggcaattaatccgatcaatttgcttttaactttcagctgcttggcaagtcactttggtgtgtcggcatccctttgtccccctccccctatccgccatttccccacttcctccccccctccaaaggtcatgtcccaagtgttccatctgttcatgtgcaccacccgtcgcatttccatcttccaacacggcatcaccaacttagtcagcatatttgccatcatcatcgagattctgttgttgaatttgtttgtctatacggtcagtgatttgggaaagggacgagaataattgatttaaagtaattcttctaatttacagaccaaatttcatatacattttaagaagcatttttagagtaaaaattttgacagaatatgaagctcttgactaaatatttttagccgggaattttcccttacttaaatttacatagcattcctgaaaaacctgaaatgccttatcggtcccaacggcggtcacccgagatttttcgatgccggagaacccaaacccgggctcgggatttaaaaagtcgtccgtatgaattttcagaattttatgtctgaaaaattatgtgtgtgtttgtctcgtaaattagaagagtaccaactccccccccccccccccccctcttgacgatgcatagtcacaatcactgtttagcctgccttccaatatctgatgaatatccaatctccgccgatgttcgtttggcttttcgcccccgtcgtcggcctttaccttctcatttttaacgaaaggttaaatccatcaaatgaaagataaattgttaaggattaattcattcattcatttagccgtaaatatttcattcgcaaccacccaaacaacagaatcgtgcgattattaaagttt

SEQ ID NO: 70444 - DNA, 653 bp, Heterodera glycines
  misc_feature (627)..(627): n is a, c, g, or t
  Genomic contig location: Contig_ID=SeqID_42589; Location=149..801; Strand=-
  SCN-specific regions: Sequence locations=1-653
atggccgatgccatgcaggacggcgcacgctggaagaaggcgaaaacagcaatcaatgtgctcggcaacctccttttggcggaatcgctggacaccacctccgctactccgctgaaaaatgatgtcgcggacatcaaaaaagaagaagaagcaactgtggcggaagaacacaaagaagatgatgatgaccaacaaaaagaggacctcggagacattgacaaaacgcttgacgatttcttcaacagtattaaagcatccacagcaaacatgtagaccctcattttgtgtaaaaatgttaaacagccaagcattcagcgataaagacatttgctttaaattaccatttggtctaatcatttcggggccttcgtcgtcgggaaaaactcaatttttgctaaaattcattgccgaatcagaccacttaatcacaccaaagcctgtgtccatgctctattgttttggtgaaatgaatgcggcggtgcctgtgcttcaaaaggcaggagttgatgtgtacgcgggagtcccatccgaggaattgattaagcgcctccctaagcctcttttgctcgtccttgacgacttgatgctgtccgttgatgagcgatacttgtccgatttgttcactanaaaggctcaccaccatcagttttgca

SEQ ID NO: 70445 - DNA, 837 bp, Heterodera glycines
  Genomic contig location: Contig_ID=SeqID_42590; Location=512..1348; Strand=-
  SCN-specific regions: Sequence locations=1-93,193-224,246-378,400 -428,496-706,735-810,832-837
atggcctccgtttcaaacgattatcgacaaatgaaaacagtcccaccaccatcaagttcaatcagcagcagaaaacccaatgtttgtgatttgttatttaaataaaaaatttataaatttatagaatatttttttgacaaaattaattcatttataaagacattttattaatttgtaattcattttaatttagcaacataatagtaaatcaatattattttaaattcataaagaaatttcataaaagcagagaactgctaatgttaacttttaattacgaaatttttttgagtttagttgaaaatgatttatttttttagccaaaaaccaaaaaattaatgaaaaattcgatttttatgcgttcttgcttcaatgatctttttaaatgccataacagagtattttttaaaaggacgtccttggcttacaaaaattcaatttttcttatattttattaataatcaatttttaactgttttctatttaaattttaaacccaaaattttgctaaggcagaatatcagccaagcaatcagacgggccaaggcaagcgaattgtggacagtttatgggatttgcgattggattcaattcttggcgatcaacaaatcacagaagcagtgcatcaattaattgtggcaattatcattattgcactcatttcagctgttttggtcagtttctttttttctttttgtttttttggaatattttaaaagttttatttaaataatcattatccaatcaataaaatttacagtatttagaagtctaattttagtctcgagaaaagaatctttattagcttaaaatataattaattttgcaaaaaataaa

SEQ ID NO: 70446 - DNA, 713 bp, Heterodera glycines
  misc_feature (11)..(11): n is a, c, g, or t
  misc_feature (21)..(21): n is a, c, g, or t
  Genomic contig location: Contig_ID=SeqID_42591; Location=159..871; Strand=+
  SCN-specific regions: Sequence locations=1-73,95-324,346-713
atgtttgggcnacagcaaacnggtttgataaagtgagcacaaaaaaaataattgcctaattgactgacaatgaacccattcaaattttgcttttattttctggtttgtattaaaaaacaccattggaacggatttttgtaaaaaaaattgtaccaattataaggctaatcgaagaggacgacacggacaaattggcatcatcatcctcatccttcagcaaattgcggcacaatgttgtcgccagtctgctgttggtgctgaactcgttgatgcatgattttcggacaaggtatatttgtttctaaagagtttcggacattaatgaaatcctgaattttcttttccattcttattcattgtcagccaatccgccttccttcgccaattggactcgcggacagcaaatttggacacttttgtgctcaaatcatccacaaatgttgtgccaactgctgcttctgtttgtgccggtgacagtgggaccacggacggtgccatgacaagttgcacgagagacgctgacaagcaacagcaggaagaattgacaatcgaccaaattcagtacatcatgcaaaatgagcacgtgtccaaggagcgcgaacaggaggtgcgaagaacaacaagatccccatcccctgttgtttcccccgatttttttatttctaacttttgttagaattttttcaaaaaaacctatgagcttttggtcacta

SEQ ID NO: 70447 - DNA, 709 bp, Heterodera glycines
  Genomic contig location: Contig_ID=SeqID_9159; Location=1005..1713; Strand=-
  SCN-specific regions: Sequence locations=1-498,520-597,619-626,648-709
atgtggagcttcttctttgcgatgattgttctctctttgctttgttttttgtctctttttggtgccgaagtgaaaattcgcaaatatttgccgatggttgtgcaaaattcgcgcctctttagaagagaagatgtgagcgcaacaaaaagaaaacttattcaaatccgcgaaatcggaaaatcattctgccaacggcacgacagttgccaaagtcgtgccgtgccattcactcccccggcatcattctcattaaaccattgtcccaccttaatcccactaattctctgctcgccactaatccccttcccccgtcgttgctcagcaaagcccattaattatgcagctaataataaattgactggaacaagcatgtcccaggaaggagctgtctgactggctggaaaagctgttgccatttggaatggagggaattaattgcttaatcaaatttgagccccgggggagaaagcactcgctccaatgccctcgagggatgccacgaatggtttatgaatatgggagggggcggggggaagggaagacgcaaatgtatttatttgtgtcattcattcacagccgtaaaattgggggaaattgggaggggggagaacggaagaacagaccccaactcaattaacaccaccacagcttaagaaaagtgtttaatttgtcgtcattgaccgagtgaagcaacattttttttaataaa

SEQ ID NO: 70448 - DNA, 1071 bp, Heterodera glycines
  Genomic contig location: Contig_ID=SeqID_9161; Location=9..1079; Strand=+
  SCN-specific regions: Sequence locations=1-415,470-609,786-861,1038 -1071
  Gene Ontology: Mol. function=pre-mRNA splicing factor activity; Cellular component=nucleus; Biological process=mRNA splicing
atgaacaatcatttcatagttttggtatactatccaaaaatacaggttatttcttttccaaataaacataagattcctcaataaaggagacgattcctatcatcgagatatcacataaagtccaattaaacaacgccattcaggcagttgcgtaaaagtgtcagtgtttcatctcttaaacataatggcagaaatcggacaagaataaatcggtgagcagatgtcgggggtcatttagtggggggggggaggggaaattgcgcgaaaattggccaattgaacacggcggcaaagcttttgatcactgaaaaacattcccttggggcaacaaaatcattcccacggcctcatgagaaaaaacagcgaaaagggacgaaagatcaaattgcaaagaaaagaacagacagagggacggaacatcattactcaacacaatcaaaacagaagaaaaagaggagggagagcaaagcgaaccgaacggacggagaaagggagacaaaccgagaaaagggaaaagccaatgtcaagaaaagggacaaaggagcaaaaaggggcaaagtcaatgccaagaaaagggacaaacgatcaaaaaggggaaaagccaatgccaagaaaagggacaaaggagcaaaaaggggaaaagccaaggaaaaggaaagggacaaacaatcaaaaagtggaaaagccaatgccaagaaaagggacaaacgatcaaaaaggggaaaagccaatgccaagaaaagggacaaaggagaaaaaagtggaaaagccaaggaaaaggaaagggacaaacaatcaaaaagtggaaaagccaatgccaagaaaagggacaaacgatcaaaaaggggaaaagccaatgccaagaaaagggacaaaggagaaaaaagtggaaaagccaaggaaaaggaaagggacaaaggagcaaaaaggggaaaagccaaggaaaaggaaagggacaaacaatcaaaaagtggaaaagccaatgccaagaaaagggacaaaggagcaaaaaggggaaaagccaaggaaaaggaaagggacaaacaatcaaaaagtggaaaagccctatga

SEQ ID NO: 70449 - DNA, 698 bp, Heterodera glycines
  Genomic contig location: Contig_ID=SeqID_42593; Location=221..918; Strand=-
  SCN-specific regions: Sequence locations=1-189,274-489,512-613,636-698
atgccaacatttgcgcgccaatttggaactggcacggaaggaggtcagagaagcggaggagcacgagacagtgctgcgcgcagacatcgacaaattggagagagagttggcggaccagagacgcacgacagtgccaatgcaaacgcaccaattaacggtggacaaattggagagcacagaacggaaggtagagagagagagagaaagagaaagagaagggagagagagagcgggaggaaaagaagagagagaaagataagggggagagagagaagaaagttggcataatggcattggtgccattttgttttttttaattttctgagttttatttttggaaattcagtgaatttttgattttttataatttcttggcgtcagcccaacccttagcttgttagcgctataatttttccataaaattaaactaaatttgagttaaaagtgccaattgaaaattaaacgaaattttagctaaaagtgccaattgaaaattaaaggaaatttcagcaaaaagtgccagtttttaatttcggaatttttttccacaatttttaaattgtttttcttgaaatttatagtctaaaaaaggaaaaaattataaaatggagtcattaaaattaatttttattttagagccaacaattggagcaacgtttcaccgctcagttggacacgttacagcgcgaaaagtttga

SEQ ID NO: 70450 - DNA, 344 bp, Heterodera glycines
  Genomic contig location: Contig_ID=SeqID_42595; Location=720..1063; Strand=-
  SCN-specific regions: Sequence locations=1-66,96-231,261-344
cgatttgaaagagaatagaaagaaccaggttcgatgaagttttggtaagccaaaaaaaatccaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaatgcaaacatttaaaaatctataaaaaatttaaaaatgagaattcatgcgagattttctggaaataagcttaatagggcctagttaagctgtaaaaaaaatttggggcgatttgaaagaga

SEQ ID NO: 70451 - DNA, 150 bp, Heterodera glycines; identical to SEQ ID NO: 61611
  Genomic contig location: Contig_ID=SeqID_42596; Location=168..317; Strand=-
  SCN-specific regions: Sequence locations=1-57,87-150

SEQ ID NO: 70452 - DNA, 156 bp, Heterodera glycines
  Genomic contig location: Contig_ID=SeqID_42597; Location=1..156; Strand=+
  SCN-specific regions: Sequence locations=1-156
gagcaaaaatccagcgcagaattaaagtacaggctatagtgaagctattccggaaggattcggtctcctcataaatctgggcgcatcggttcggggggactgccctgaaaacaaaaaaatcgattttttcaagtgtccgtttggggtactcaaaca

SEQ ID NO: 70453 - DNA, 69 bp, Heterodera glycines
  Genomic contig location: Contig_ID=SeqID_9162; Location=845..913; Strand=+
  SCN-specific regions: Sequence locations=1-69
ttcacaaatcatgtttcaaatgtgccatttgcgacaaggcgcttgaggttggctcttgttcgcttgagc

SEQ ID NO: 70454 - DNA, 851 bp, Heterodera glycines
  Genomic contig location: Contig_ID=SeqID_9163; Location=1229..2079; Strand=+
  SCN-specific regions: Sequence locations=1-122,146-271,294-434,456 -463,511-572,595-764,832-851
atggggccaaagatagtaatctatttgcttggcattggggtactgtggatttttgccgtagtccaatgtttaccggtcaatggaatgtctgcctatggtatgccaaaaatgtttaaatagagaaatatatataataaaaaaaaatgataaaagcatttaaaaaaatgctcaaacaatgcaaaggcaacaaatattcggcgcggttttaaaattttatgaaatagagacgaactgactcccagaaaaaattatcgtaagtttcacccagtaattaatttttgtttcttttgatttatattgtatgaagatttcttgtcccggccatccagaaccggtccggaccgttaaaattcagacccggcccagcctttcagtgcttaatagcatgctgaactaaagcaattatccttaaaatataccgtaattaaatattatctcttttgtttaatttttatgcaaattctattaaataaataattcatttattattattttttaaattttttaattggctgcagttgttgacgaccgtcctgtccatttgtcgctgaagcgtgccattggaatttactggaatgccatccaataccctggaatcgaaaaacgtaccgcctacccctatccaagtccgacggatatcaaatacattggatttgggcgaaaacgtgcaacatttgatggtgccgacaaatgaatttaacaatttttttaaggatgaacaacaaacaagcaaattaatgtgtgaattgtgagattgcgattagaaaaaaaaaagtttttaaaattattttaaaaataatttgatttcattaaaaatttaacaatttttttgacaatgtaattatgactga

SEQ ID NO: 70455 - DNA, 321 bp, Heterodera glycines
  Genomic contig location: Contig_ID=SeqID_9163; Location=1..321; Strand=-
  SCN-specific regions: Sequence locations=1-82,119-139,163-321
tttcaaaagcccgttgtgccaaatatgtgaaaaagatgtgccgccaacagacaaaattgtcgtggacagactaacaagtatgttaattaagtttttatataaaatttaactttattatcggctcccgctcaatagcacttttaataatttttatttctcaaagattggacccaaaaaaaatttaaaaaaagaaaacaaagactttatctatccctgccaaagggagatttttttattcgcatcaatttagtccataaatcgtgcttcaaatgtgctatttgtgacaagccactgcaacagggttcatgcaattggagcgcg

SEQ ID NO: 70456 - DNA, 536 bp, Heterodera glycines
  Genomic contig location: Contig_ID=SeqID_42605; Location=261..796; Strand=+
  SCN-specific regions: Sequence locations=1-73,102-250,275-327,350-536
atgagtagtcagcaacaacagttggatgtgcttattgtcatagatggtaccaacattgataagccttgtgtattttttgatcttttcaaatttcaacatttaacttatttaatttaaaggttgatattttttcgagttctggctttgttgcttcttgtctcaattgggtttcaaagcttcattctcctaatgtaattgttgcgttacccaatcaaccgaatgatgtagcagccgaacttttaaagtcggtttatataaatgaaataaaaaatgtttcaataacttacagaaaatgggcttctaaattcaagcagcttcaggtactacttttattttaaatttattaaatgttctaaatgaacttaattttgcaggcatttggtgtttcaaattgccaatctttaaacgatgttcttcgtgaagttgattttcgacaaattcttagaaatgatttcatgctcatacaaaatttagccactttttgtttttcctatctgacgcgacaaatcgaaaaatttcggttatttctgaattaa

SEQ ID NO: 70457 - DNA, 60 bp, Heterodera glycines
  Genomic contig location: Contig_ID=SeqID_42607; Location=32..91; Strand=-
  SCN-specific regions: Sequence locations=1-60
aaagtcataagcacccgtccgatctggcaagttaagcaacgattcctcagaaggcaaaag

SEQ ID NO: 70458 - DNA, 659 bp, Heterodera glycines
  Genomic contig location: Contig_ID=SeqID_42607; Location=276..934; Strand=+
  SCN-specific regions: Sequence locations=1-659
acaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaataaatcgattttttcaagtgtccgtttggggtactcaaacaattatggggagcaaaaatccaacgcagaatttaagtacaggctatagtgaagctattccggaaggattcggtctccccataatctgggcgcatcggttcagggggactgcccccgaaaac

SEQ ID NO: 70459 - DNA, 905 bp, Heterodera glycines
  Genomic contig location: Contig_ID=SeqID_42610; Location=84..988; Strand=-
  SCN-specific regions: Sequence locations=1-464,611-777,810-905
atcactgacgcaatgattgacttcctgccgattgacaatgccgaagcgattgtggcccaactttctgatccggcaatacgaattgtgtcgatgaccgtgacggagggcggctatttcatcaactcggccactggcgaatttgacccaacccatccggcaattgttgctgactcaaaagatccgggtaaattggctttaatttattttgccattattatgtttttaattggatccattaacctgaatttcacgtattttttagaaattttgcaatttttttttagcgcttaaatgttttttgaatttacgtgattttgtcagcataatgaaacacaaaattcttcaaattagccattgcatttctttatatttcatttgacgtcattttcaggaaaaaagaaaaaatgaactaaatattccattatttatcataattttcaaaacttaatgcatgaacattgatgaaaattaaatagaaaatataaaagatatataagaaacttaaaaattttataatgtttcttttaaaaataatatcgaaaatactattaaatatgttatcattttaatatctatttttttaaaaacaagaataattttaattaattttcatagccaatcctcgccctgtgttcggactgattgtccccgcgctgagccgtcggcgtgcaaacggccccgatccattcactgtgctgtcatgtgacaacataaccaaaaatggtgaaatggcacgaaatgcgtgtgttggcatggcacgggcactgggacaacaggtaaataattttaaaatattttaaagaaaatttgaaatttcaaaggaattggccgattggattaacgaaagatgtggcattcccgaacggaatggtcgatcggatcactccgatgaccggggatattga

SEQ ID NO: 70460 - DNA, 807 bp, Heterodera glycines
  Genomic contig location: Contig_ID=SeqID_42611; Location=63..869; Strand=-
  SCN-specific regions: Sequence locations=1-273,295-361,397-524,548 -713,750-807
  Gene Ontology: Mol. function=general transcriptional repressor activity; Cellular component=nucleus; Biological process=negative regulation of transcription
ttccgacagtggcatcatgagcgacgagggcggcgcgtgcagtcactccaactcgccaaccgaaatgggcacgcgcagtgtgccattgctgcacgcgaacgccgaggcggtggcaccggcacgtgctgcacagttttcggcaaatgttaatcaccaacaaattatgccaaataatcaatccttttaatctttgcagcttttccaattccctcgacccaccgctcaaatgccgacacttgcgcagcaccaccaccgggtccaagcagttcattcgcccgccccaacccccgcgggccatggccacgcgcagagtcagctgagtccgctcgaattagtcctccaaatgcagcaccaacacaaccagcaacaacaactccagcaacagcaacaacaacaccttcatccgttcgcttctctccagcaattttccccaattcccaaatcggattctgttgccgcaggcgttgctgacgaagtgaacagcgcaccggctgctgcttcaacaccgacactgatcatggtgagggagggatgaaaagggaagggaaggtaattttatttaatgtttagccgaacgatgccatcggtggtgccgccgccaataacaacgcttttttaccttgcgaattgcaacaactattggcaattgcggcacttactcagcaacatcaccaaccgcaacagcaacaacccatggttccggtgtctgcggccaacggcaccaacaccaacaacaacagcaacaacaatttgccatcatttcactcactgccaccaccagcggcgccggatcataatacgatgacg

SEQ ID NO: 70461 - DNA, 1614 bp, Heterodera glycines
  Genomic contig location: Contig_ID=SeqID_9165; Location=1..1614; Strand=-
  SCN-specific regions: Sequence locations=1-790,812-818,840-939,961 -969,992-1614
  Gene Ontology: Mol. function=GPI-anchor transamidase activity; Cellular component=integral to endoplasmic reticulum membrane; Biological process=proteolysis and peptidolysis
tctctgagtgattttttcagccgttcaactcacacaaacaattggtcattggttttcgtctttgtctttaaaatttttcatccttccttagggctcttttggtttgctcttcgcgcttttggttcaattatcgccacgttgccaatgtcctttcgctgtaccgttcgttgaaacggcttggcatgcccgacaggtgttgttccctttaattcaattggttataacttaatactgattccctttagcaacatcattttgatgctttccgataacattccatgcaatgcgagaaacccttcccccggttttgcccttttctcttcattcgttaatttttcttttccaatagcgtctattttcaacaatgcctttgcccatcagaatttgtatttggaggacactgaagtggactatcgcgggtacgaagtgactgcggaaagtgtcgtgagaattttaacgggcagaacacatacggacacgcccagaaacaagtgaattttacggtaatactgagatttatatactccaacggttttatgacaactcactatcatctgggcgggagcagcgcgtttcccagccgccttccccccccccctatcagtccccccggcattcctgacttatccgggggatttttaaaacgatcgaaacctgacaaatttggtatcattcgaagctcatgatgagctaacaatgtgagtctaaaaatcagaggatgaatcggtccgacgccaacaaacagggttttaagccgattaaacccacgaaaactgaccctaaattagacaaaaacaagtgaaaataaaaaattttcaacaaaatatgtgtcaatcgacagttctcgacgagacaaatcgaactagctatattaaaagttgatcagatgtcattttgacaataaacaactgagtaccgaagaaaaaaagacgcttcagttaaatacaaaacaaattcatagacttttagtaaaaaaaattttttaatttttcgggggggggggaacgatgcgggagggaactgagcttcggaaaaacgtagtacaccccatctgggcactttttaagaaactatcattaattagtttatggtgtttattttaggcgtttgctcagcgatagccaaagtaatgtgcttatttatttgaccggccacggcggcgatggctttttgaagtttcaagacgcggaagagttgacaaacgttgacttggcagatgccattgaaacgatgcatcagcaaaatcggtgatcactgctggggagtgctctcatttcgcgttcccttcttatcctttccccccaattctgaacagttacaatgagttgctgctaattgccgacacgtgccaaagtgagtcgatgtatcaacgagtgtactcaccgcgggttttggccacttcgtccagcttggcaagcaccaaattcgttttaaaattggcatattgaaataggttggcgaggattcgctctctcaccacgtcgatcgctccattggtgtttacataattgacaggtgacctccaaccaagcggcactttgtattttctaattaggtatgcctatcacatgcagcaattcctcgacactcgcgtcaccggtctaaactccaaca

SEQ ID NO: 70462 - DNA, 1665 bp, Heterodera glycines
  Genomic contig location: Contig_ID=SeqID_9167; Location=283..1947; Strand=+
  SCN-specific regions: Sequence locations=1-946,969-1665
atggtggccaacggtctcttggacaaccccgcaatgtttgctggtcattcgtcaactcccaaacaatgcgttcgtgattgggtccgttctttttctgtttcgcatttcaatttttatgtttattaatttagcttaatttggaactttccgaatgcattcccttcgatttgtttcatcaacaactcattttcatgctccgttcctctctcccaaaacagcaacgaaacattttcaacgcattgaaaagttcagcggcggtgagaaatttcctcgtcgatttttatttgaataatgtcgattgattggattgtccttttcgacctcacaatcagccttaacattgcacttcacgttaatatttttcttattaattaatacacgtttacgttgaataccttaaattacaactaacggattccatttttattgctttttgcccacatgatggtgctagttgatcagcttttaagtgcttttaaaagtgctcttcgtgaagtcaatccgagtgcgtctgttcagaaagttgggcttcccacaatcgcggctgatttcgaccaaattgtgcttttaaggctctatccgtccgcgatggaaaactttttgtgcagaatcgcggcttcgaactacataaaaatgtccatttggtcgctttcggaaaggcagcgccggcgatggtacatggggccgaaagagtgttgggcgaacacattcttagaggaatcgcatcagtgccgatgaagatagagtatgagaacgaagccaaaatattttttgaaagattaatttaaaagcattccctccggcctaaaaacggagttttgcacgggtgccgagcacaatttgcccgatgaaagagcattggaaaatacaaaaagaattgaacaatttgtttccgaggccaattcggcgccggaccaactcattctgttcctcgtttcgggtgcccttctttgtcttcatcactccgtcctttccctcaaaatttaaaggtggcggctcagcccttttaacagccccaatttcgggtgtcagtctgaatgacaaagtggctttgatacggcaggtgcagaacagtggtgctggcataaagcaactgaacgtgctcagaacggcactctcgagagtaaagggcggtgggctggccaaacttggccgatcgtcgaaggttttaacagccgatcacagtccgcccatttcccaaatgcacagatgataagcttggtgatctccgatatcgtcggcgaccctttggaattaatttccagcggtccaacaatgtctcagggaggtcatgtgcagaccccaatagccattctgaacgacttggaaattcttgacaaagtgcccattcgattggtcgacgcgctccgatccgcacatttagaaaaggatcagtgtaattttacattcctccccgaatgagactgattttagtcaagcatttagacgacccttctccaactgatgcgcttaatgtgatcattgccagcaattccattttgcttgacaatcttgctaaccaaattaacgattcactttcgatttctcctttcatcgtaaccaatcggttggagggcaacgccacagaattgggaattcgattttccaaactgataaagcaaagcatggtcaatggcaaattggacaggtcaataatgattgcag

SEQ ID NO: 70463 - DNA, 602 bp, Heterodera glycines
  Genomic contig location: Contig_ID=SeqID_42613; Location=5..606; Strand=+
  SCN-specific regions: Sequence locations=1-452,481-489,524-529,556-602
atgtcaaaaatgaattctcacccagaacaaggtatttatacaattctgatagtatgatcttttgtacctttctatgacatattttcgactggtgcttttaagtaattttttattcggtaaattataatgtttttgttaaataggtatttatttttaatttctgaggactttgaatttaattgctatttgaatttatgatttcaaataacaatctaaccgtttttgaagctaattttatttttgcatatttaatttaaggaattactattttttgtttcttctaaataacactaattatggcattggtttttaaatggactgaaataaattaaaaggcaaaaataaagtaattgcttttttacctttaaatttttacaaataaatgaaaacaattttaaggaataaaggaaaaacatgaagcaaatagcttaagaaaatttaaatgcgaaattttattttaaaacatttcaaaaaagcaaatgaaaggcgtaataaaaattattttaaaattaaacaaaaaattgaagtgtgtaaaatttaaatataaaaaggttttcagaaagtgttgttaacacatgtaatcttgtttaaagaattaatca

SEQ ID NO: 70464 - DNA, 615 bp, Heterodera glycines
  Genomic contig location: Contig_ID=SeqID_42614; Location=163..777; Strand=+
  SCN-specific regions: Sequence locations=1-552,574-615
atggaaattcgaggcaaaattggagagaatggcacagaggaaatggaaattgtcaattccgatggaaaagaattgccaacccctcattatccgttgccgaacaaagtcatcggattcaaactcattttgatcaagtgaaggatttgaaaatgatttgtgcccatcaatctactttttttgattttcagcttcatcgaccaaaatgtgctcacttttcctggccattttcaccgttttttcgcgacatccacaacaaaattgttcattcgcactgaaaatattcaaattttggagtttcttatgcgcaacatttggccaatgttcaaggccacaattcgtctgatatattttcactccatcgcttttggtcaaatccggcaatttgccccgttaatgcttaacgattgtccgtcccttcatgttgtcgatttcgatggtggcattttgcccgaatttccgcctgatgacagtgccaatgcgtcggatggccaagcggtggccaaatggctgttcacgcctcgtcccgacaatttgacgaaggtgctctctgtcaaaattacatttgttgaacaattgttggcaacagtggaacacatcaaagcggtgattaattaa

SEQ ID NO: 70465 - DNA, 667 bp, Heterodera glycines
  Genomic contig location: Contig_ID=SeqID_42616; Location=126..792; Strand=+
  SCN-specific regions: Sequence locations=1-464,496-609,664-667
cccggcaaaaagaacataattgctgatgttttgtcacgatcgggaactggcaacgaaattgaagaaggcgaacaaaattccgaagaaatcgcattcatcggtaaaattcggacaacagaaaatgatttggagaattttggtttgatggaagaaagacaagaatgggtcgaacagaccaaaattggcgaaatgaagccaatttacgagtttcttgaacgtaaagttttgccaaatgaccaaagagatcagcaaagagtcattggtaaatgccataaatttgtcgtcttcaaagaccttttgtacctttccgagaaggaaggcaaaatgagactttttgtcccacaaaaattcagaaatgagttggtgaaaaatcgccatgaaggaatttgtgcaggacatatgagtggataacaagaaaaaggtatgagaaacggaggttactttttaatcaatttttttggctcatatttttatttagataataattttttatttgatttactattgtgattagaaaaccttctgaaataattttttatttgatttactattgtgattagaaaaccttctgaatacacgaaaaatttaaattaatgttttgacgatttgtttttatttattattttatcaaaaaatttatattagatttataatcataaaaaaggta

SEQ ID NO: 70466 - DNA, 217 bp, Heterodera glycines
  Genomic contig location: Contig_ID=SeqID_42618; Location=865..1081; Strand=-
  SCN-specific regions: Sequence locations=1-179
tttaaaaaccctcctcattttcagaggcgagtcggctcggattttcagcgattggctcaacgacgccaaagcgcacttggaagtgcggctgctggttgagctgctctttgcccatgctcaggcgacgggaattaggacgacctattgaaaatggacaaacgaacgaaggaatcaatcattttattttgatgtgttttcaaaataaattacctaatta

SEQ ID NO: 70467 - DNA, 335 bp, Heterodera glycines
  Genomic contig location: Contig_ID=SeqID_42621; Location=1..335; Strand=+
  SCN-specific regions: Sequence locations=1-106,191-197,220-224,255-335
gtaagctttttccttttttcacttgtaaattatttaaattttcaattttttagcttttttcgaaaaaatttttgtcttttttcggcaggcactgcctctgacaatgttttttatttatttagaaaaataaattgatttttttctttttgatttattttaattatatttcatccttaaattttttaataaacattttcaaactttcaccttattaatttaaggcgaattttgccttttttaataaattctcttgtgaaaaggcaaaaaaataggctcttttaaatatgcctatttaaattactttcattgctttcctttcgtttacgaccatacca

SEQ ID NO: 70468 - DNA, 354 bp, Heterodera glycines
  Genomic contig location: Contig_ID=SeqID_42621; Location=417..770; Strand=+
  SCN-specific regions: Sequence locations=1-42,72-127,210-216,239 -243,274-354
ggaatcgaaggtgttgtaagctttttttccttttttcacttgtaaatttatttaaattttcaatttttttagctttttttcgaaaaattttttgtctttttttcggcaggcactgcctctgacaatgttttttatttatttagaaaaataaatttttttttctttttgatttattttaattatatttcatccttaaattttttaataaacattttcaaactttcaccttattaatttaaggcgaattttgccttttttaataaattctcttgtgaaaaggcaaaaaaataggctcttttaaatatgcctatttaaattactttcattgctttcctttcgcttacgaccatacca

SEQ ID NO: 70469 - DNA, 1362 bp, Heterodera glycines
  Genomic contig location: Contig_ID=SeqID_1237; Location=414..1775; Strand=+
  SCN-specific regions: Sequence locations=1-151,175-555,608-609,631 -692,718-886,909-1362
  Gene Ontology: Cellular component=AP-3 adaptor complex; Biological process=ommochrome biosynthesis
atgctcggctacgacatttcatgggcagcatttaacatcattgaagtgatgtcgagcacgcgttacagcgaaaaacgcattggttatttggccgcggtgcaagcattcaatgacgaaaccgatgtctgtgtttagggccctgggtttttccaaaaaattaaaaaaaattttttagaaacatacgacacataatgcaagggggtagccagactttttggtgcaaatccgttcagaatttttaccaaaattatcaaattgtttcctggcagcgtctgccggacccctcctttcttgagtttttttttagaggccgaaaagcaaaaaaaaaaaaaaaaaatcgccacccaggacggcctacctccccctccaaagctagggccaaccccctcctcttttgcttttttcacccttttaatttttttaatacgaaaaacccaaaatttaaaaattatgtagggtgcctaatacatacatatccattgtacctcaccttcacccctggaattttcctttgttggccagctcatttcccctcgtatcgccccccccttctccaaatttttgtttttttaatttcaaaatattattttaataaaaaattttttttgcaatttttcccacaacaattctatcgcagtgtcaacaatgtcaccgccgttttggacgcaatgttacgcatcaaattgtccgttgtgcccggcccgttgctcagcgtgttcgtgcaaaacattgccaagctgtacaccttccaactgtgcaaattggaggcggacgacgattgggacagaattgaaacgttggacaatttgctcacctccaaattgcccgagtagttttgcatgatttttggtgtgtgaccccaaggaaattatcttttgggaggtccatgttttaaaacgaaaatcagtggcctaattaaaaaattactattataattctttcagaacaaaaaacccaacccgtcatgcagaatttgtagcaattgacgaagccgatgaatggtgcaaattgcacaacaaaaatttcactcaagtgagtttttgtagagtaaacaacaaaaattggccttgaatttcgctgtaatttgtgagggtaatttgggagattaaaatcagtggcctaattaaaaaatcattgatttttttcatttggatcatgaggcaagcaactgttttcgtgaatcttgagccgtgtgtcatgtgtgccagcgctttgtatcagcttggaatacagcggttggtgtttggcgcaaaaaacccgcgtttcggtggcatttacagcgtggcaagcaacacggactatggccatgaacaccaaattgatgtgcggatttgcttattttcaaaaaaaaattaacaccca

SEQ ID NO: 70470 - DNA, 221 bp, Heterodera glycines
  Genomic contig location: Contig_ID=SeqID_1238; Location=61..281; Strand=-
  SCN-specific regions: Sequence locations=1-221
atgggaaaaagaaaattattacctaaaattcacggcaaaaacggagtgaaagagcgtcaaaagaagcgggaggagaggaaagcgcaaacggccaaggcgacagaagctcgtctggtaaagaaaagtgagtttttctattgctttttcataaaatccataatttttcagtttttagccgctgcccagcccaacaccgaagcagaaatggcacaaccatctga

SEQ ID NO: 70471 - DNA, 1640 bp, Heterodera glycines
  Genomic contig location: Contig_ID=SeqID_1238; Location=2216..3855; Strand=-
  SCN-specific regions: Sequence locations=1-99,121-509,535-663,685 -914,937-1006,1028-1071,1117-1184,1206-1538,1579-1640
atgccattgtcaaatgccgatgccatcaatttatgttttcacccctcttttttcagcgaaaaccgactggccaacatcaaactcgtcatggaatatgtgcaaatgatcaaaagcattttggtgttgcgacaaccggcggcgccattcgaactgaaggtgtggtgaacacagtgtgccgttggtgatggtgatgttgcgtttcatgactcgctgttttttcaggaagtcatctccagccgtaccaatttgttcgctgattcgttccaacatgactgtcaggagttcatccaattcttcgtggacgcactgcacgagacgatgaagggcgttctgcgcaaaaatgacggcgcgggtggtggtgctgctcaacgggacgaccagaattggcgcaatgcaatcgacatgatgcaacagcattggagaagtgaagtgctcgcaccaaagaaaggcagcgtggtaaggaagaggagcaccactcgattctgacggcattttaaacaatggcatttatttttcagattttcaatttgttcgccggacagtccgtctccgagctcagatgcacagagtgtacatattcgtccaagacgttcgagctgttcacaatgctgtcgttgcaaatcccaattccggagaacaccgcaattacattcaacggcatgcaaaaacaaacaaacattggcattttcaaataaaatttctccccctttttcagtcatctcccgagaaggagaccccatcaaatgttcgtcccatgaaatacgccttccactcgccatgaaactgagcaaagtgaagaagatcatctgcagacgagcttacatcagcgtcagcaaagccatgttcatcacgctcaacaagaacaacaaagactacaatgtacagccatcaccaaaccaattcaattttcggcacaaatttttgttgagattttgtccgtttttttgagtccattttgaaggcacagaatttcatgacatcatggccgcaaaatggaaaagtgccgaaatattttgatttgaaaaacgattgctaaaaaagcggggccccaaaatttaattaaattggtggattttttatttttctaattttaataatgattatatgtaattaattcccatcccctttttcaacaggaggaattttcgcaaaaattcaacgacgcaaagacgaaacggtcatccgatgaggacgacgatgatgagccatccgctgaagagagactgcgcgacattccgctcgacaaaattgacatttggcgactgttcaagaacgaagatggacacggcgaccgactgatttgtatcagcctggcccaggtggagttcaagcagtgccaagaggacaacaaaaccccatttgacactttgccgttgtttagcgcttcactgatgagtcgcattacattatgggagcgtcggacgctggtcaactgcccatggatgtgccgaaacagccaacccgtttccgtgctgctccaaaatcggctcgacttctttccgtcaaggcgttgttcaccggatttctttttttggtcaattttgtaaacaaaataatattttacttcatttaaagatgggtacaataatcagctacaaaaactataggactgaatgtgcctttttgcgataagaaataaa

SEQ ID NO: 70472 - DNA, 718 bp, Heterodera glycines
  Genomic contig location: Contig_ID=SeqID_1238; Location=4728..5445; Strand=+
  SCN-specific regions: Sequence locations=1-271,294-505,536-718
  Gene Ontology: Cellular component=cytoplasmic vesicle; Biological process=ommochrome biosynthesis
atggttaagatgcaattggtccctgatggcacttttcgcaaagtccgtaacaacattgaccgattgtttgacaaaaatttgaccgatttaatccgcggcattcggaacaacaaggaaaatgaggtgatgattgattgactgaatgcaaaagccatttgtacatttacaatttgggcacttttgctgggcctctgaaaaaaaaaattcaagggctcaaccaattacaaatccttacaaaaaagcccccctttggaattttctctcgtgggcctccaacaacagccaaagtgccataatttatttacccaaaatgttctaggcccgttatattgcggcatgcattgacgaaatcaaagtggagctacgccaagactctatttttgtgaaggcaaatgccatcgaaaagttggcatatgtaagtttttaaatggacttttttatatccattaacacaaaacggagtcgggaggggtggggcagtgaaatttcgagggaggaacgagtgaaattatgaaaaaattttttttttaaatttcctcatttgttagtaaatcaaaaaaaaggtgcatttttttagttgcaaatgctcggctacgacatttcttgggcagcatttaacatcattgaagtgatgtcgagcacgcgttacagcgaaaaacgcattggttatttggcggcggtgcaagcattcaatgacgaaaccgatgtctgtgtttag

SEQ ID NO: 70473 - DNA, 2790 bp, Heterodera glycines
  Genomic contig location: Contig_ID=SeqID_1239; Location=535..3324; Strand=+
  SCN-specific regions: Sequence locations=1-238,260-493,532-540,564 -585,608-908,933-987,1015-1093,1115-1204,1234-1858,1886-2035,2061 -2316,2338-2534,2580-2790
  Gene Ontology: Cellular component=AP-3 adaptor complex; Biological process=ommochrome biosynthesis
tgcattaacactgtgatcgccattctcataagcatttcatcagaagggcccggtgattatactccaagtattcaggtagatttttgcataattttttcaacccctacgggaattttcaaaaaaaaaatccaagaaatttcccaattactctcaatttctcaaaagtttcccattttccttgaaccgcaaaaaattgcatatagcaaaaacattgtgcagttttaattatgcatcaaggaaaatcaagaaaaaatttttattacccaattaacacaccaaacatttgacaaagtgtgaaatggttggtccaaaattggggcacaaaatgattgaacaaaaattggaattactcctgtttttgttacccttacttgtgagaaaatgttcgaaaagtgattagcaccactccccctaaaaaaaacttgaaaattctaactttcttacaaattagaggttttttcatattgtgagatttttcaaatgaatttcttccaaaaaaaaaaaaaatttctacatttttttataaaaaatcctacagggattttttgaatttgtttttaattgtctctcctttcagctctgtgtgcaaaagcttggcattttgattgacgattcggaccaaaatttggtgaattcatcattccgttttttttaaatttttcctacttttttccagaaatatttgggtctgctggcgatgggcaaaattttgttgacccatccaaaagcggtgcaagcacataaggacattgtgttgcgctgcttggacgacaaggacgagagcatccgtttgcgtgcgcttgacctgctgtacgggatggtgtccaagaaaaacatcatggaaattgtgcgccgtttgatggaccacgtggacgcggccgaggcatggcacggaagggaagggggagagggcccaaattttttggggttttgaaaaaaaaattgcatatttttcccataaaatttgcttttgaatggtggtggcccaaatttttttttttttttttaaattttgtccggcatttttttttcattggacaaatttttttgtaaaaatgaatattctttcggtaaatttcgatttttgattgctaataactcgaattttgggaaaaattgataggttttttttttgggacggggactggtttttattgttatttgctcgattgaattgagcaaaaattatgtaaattttgtgtcgaaaaaaaaaattttttttttcaaaatttacgctttgccatattttaaagggctcattttatcgggacgaactgctccgacggatcatcgcaatttgttcgcatgacaactacaaatacatcacaaattttgaatggtctaacaacaccgttttgaaagaaaatttacccatttccccatctcattttttgtcaggtacatttccgtgttggtcgaactcaccaaggtggagggcaccaaacatggcattctaattgctgaacaggttgaccattcattcacaatttttcattttcgttcaccatatatacatgcacacagatccaagatgtcactgtccgtgtgcagtcaatccggcacttttccgtctcccaaatggcacttttggtggagaatgcccagccgttgttgaagggcaatggcggccagcgcaacaatgtggccgaagtgttgttggccgctgcgtggatttgtggcgaatttgctcaacagttgcgttttgaaattggcaaatttcggggaccggtggtgacagggcggtcccaaaaatttcggtttggacggcggagggaggggggggggggtaccaaccaaaaaattatgcagggagatgcttagcccagggattttccatgtgaaagcagctcgtttcacttgtatcttttattttcaaatattatttaccatatttatggggcgaggaaacgtactgctcccgtcctcggggtgggacgaattaaccggtcaaaattcattttccccacatttctaccccagtgtcaacaatgtcaccgctgttttggacgcaatgttacgcatcaaattgtccgttgtgcccggcccgttgctcagcgtgttcgtgcaaaacattgccaagctgtacaccttccaactgtgcaaattggaggcggacgacgattgggacggaattgaaacgttggacaatttgctcacctccaaattgcccgagtaccaatacactgaccatttggaggcgcaagaacgggtcagcaacaaattaccgactaattactaggcctataattaggcaaacaaaaatggggcaaattagccaattttccgcatttctttcgctttgaataagtgccattgaggaaattttgataaactcatttccagacatgcaatctgattgccatgctcaaatttgcgtccaaaatgcacacgacaaatgtgaaaattggtgaagcgctcaccaaacattttgacggcgaactgaacccggtggcggcaaaagcgcaacggaaagtgccggtgccggacggactcaatttggacgagtgcatcaatgaaattgatgactcatcagtggaggatgagatggatgaggaggaatacgatgaggaggaagaggaacatgaacaaaaaaaacaccatgatggcattatgccaacatcgacggcacaccgtcaaaatgatcatcaacaacagcattatgccattggtaattcgtcttcgtccattggacgtgccaaaggccagcaaatgaagcaccgtgaacagtctccggatgacgcgtaccatggtggtggtggtggtggcgctccgcgagttgcctcagaataa

SEQ ID NO: 70474 - DNA, 1064 bp, Heterodera glycines
  Genomic contig location: Contig_ID=SeqID_1240; Location=453..1516; Strand=-
  SCN-specific regions: Sequence locations=1-270,292-589,621-698,790 -1007
atgtcggcccaatttcgtgaggtaagacaagtcaacttaatgttaaaaagccggaatttttggataaagcaaaatcaaatctgccgagaaacccgaaacaaaaacccccgaaattttcgaaaccgaatttcgcccaaatttctggtccaaagcagtttaaaaagccgggattttggggtaaatagagggattctcggaattgatatccacgattatggcatccgtttcgaacccaatttcgaaaactctgtaaaactgattcgaacaaagtttaaaatattcattcattttaaggttgtcaagcaaatgttggccaagcggaaaatgttgttccaccacttttcgtatggaaaattgggttccggcatcgcaatgggaagcggttgtggcggaggcgtccgaccgcgcgtgggaagcggtgcgcgaagaagtgaggaggcggaacggagcagcacgagtatgatggcacggaagacgtcctcctccaccgcaaccatgggcctgattgtacagcagaaacagcaaaaggacaccgtaatatggcggaacggtgtgggcgccggtgccatcggcagcggcggtggaagagatgaaatgacggcaaaactgatcaagaacaacaatggtggtgaaaacaataattatgttggaggagggggatatttggcgagacaaatcacaacagtgacaacaattggggaggaaggaggaaaagaggaggaggaagaggaggaaaaggaagagaaaaatgatgatgtcattgaggaggaggaggaggaggaagaagagactgatgagatggatgaatgcagattatgatgaaaaggaggaggagaaagaggaagagaaatgagtgaaaagggaaaaagcaatggacagaaaagaaaaacgttggaatggacaactgtgataagcctgatatctgataacagagctgcagaaacattactttttttgggtttactccaattcgtcatcaatgatgactcatcattaattcttatctgttttattattattatttttttgtatttatgaatttcaaattatttataattaataaa

SEQ ID NO: 70475 - DNA, 1517 bp, Heterodera glycines
  Genomic contig location: Contig_ID=SeqID_9169; Location=478..1994; Strand=-
  SCN-specific regions: Sequence locations=1-168,191-247,269-340,363 -411,435-488,517-620,663-1380,1403-1517
  Gene Ontology: Mol. function=phosphoenolpyruvate carboxykinase activity; Cellular component=mitochondrion; Biological process =glucose metabolism
atgctcaacaaaaatttggcacaggagcatttcatcgctgccgccttcccgtccgcgtgcggcaaaactaatttggcaatgcttgagccgacactgcccggctggaaagtgcgctgtgtgggtaagcaaaaaggcacaataattagtggcgctaattagcgtccggtcgagagtctcgaatcaagagttaatcatgatcatttttttgacattttttccatgacataaaattcgacaatatattcaggcgatgacattgcgtggatgaaatttggtgaggacggacgcctttacgcgatcaatccggaggcaaaatttggctgttcaattttttttgaaattttctaaaaattttcatttcaggccggcttcttcggcgtcgctccgggcacctccaaaaagacgagtgagcagcgggggaggcgagaaaacgataaaaacaattccaacaaaaattaaattgaaaattgtcaagctcgagtttttcgtataattttttttgtttattttttatttcctggctcttcgttttcccaggcatcaattttttcgttttttttttgaaatctttggcctccctatttctttgggttttcaaatccaaaatgcctggctttttgaataatttgtatattaatttttctcaaaataaaaaaatatttcatttttctgatcagatccgatggctgttcaaacgttccaaaagaattccatcttcaccaatgttgccgaaacttcggagggcaaagtgtactgggaagggttggaggtgggcattttgtcttgaattgtccttggaattcttgaaaattttgtccaggacgaaatctgcgaccgcaatgacgtcaccataaccgattggatgggcgccccgtggaaattgggcagcccaacgccggccgcccatccgaactcgcgcttctgcgcgccggccaaacagtgcccgatcatccatcccgactgggagtcgccgagtgagtctcgcgtgttggtattttgccagggttttagtggcactttttccacgcctcgagagtggacagcgacaaaaatatttttgaaaatttttttcagatggtgttccgattgatgcgatcattttcgggggacgacgtccgcagggtgtgccgttggtgtttgtaagttgtttttgtgttcctttttggcacaatttttgtcggaatgtttggcttttccgagactcgaaatcgagaattgaccccgggaaaatctcgactgtaacactaccaaattacatttccgctccgtgatgtagcaaattttcggtttttggcatgccaatttaaatgttacccatcatcaaggaatcattctcctgggagcacggcattttcactggcgcatgtttaaagtcggagacaacagctgctgcggagcatcaaggtgaattgttgttctcttttttttgtgatgggattactgtagttacaaattttgtgggattactgtaattaaagcatttcaggaaagacagtgatgcacgacccgatggcaat

SEQ ID NO: 70476 - DNA, 1808 bp, Heterodera glycines
  misc_feature (1738)..(1738): n is a, c, g, or t
  Genomic contig location: Contig_ID=SeqID_9170; Location=1..1808; Strand=-
  SCN-specific regions: Sequence locations=1-40,62-296,317-553,575 -787,816-1244,1273-1282,1304-1808
  Gene Ontology: Mol. function=phosphoenolpyruvate carboxykinase activity; Cellular component=mitochondrion; Biological process =glucose metabolism
gccacgatggaccccgccaagctgacgccgttcaagcagacgcccggcgtgtcggcctcgctgcgccagatcagcgcggacgctttctacgtggtcaacgaagtggtgatcaaacggcttgggcccatcccaattttgaaggtgtggtggcgtcggctggcagcaattttttaaaattttttgtgacagccgccgttttttacccatttttccccctaaagggtgacttccatctgttgcctttcaaagtgcaacgctttgtggcggagaaggcggaactgtgccggccacgggtaaatgaatgaatgaatgaatggcactttggctggcgctgaattgacattgtgccaaaataaactttgaatttccctccagggcattttcatttgtgacggttccgaacatgaagcggaggagatgactgacctgcttgttgaggtgggcaaaaaatgaagaccgatggaccaatttctggcctcaagactgacacgggcaggcagaagatagagatgcttttattgaaaacctaattcgggaattccgaggacaaaaatctgttcataattttctttttgacccgactaaatgccaaaattagtagcgatttttgagaccgacaattttccgagacagatagagaagtgccgagatccaaaaaactcgagaccaaaaaaaaaaactgcaacccaaaaaacaaactcgagaccgaggacgaaaaaaaccgggatttttctcgagcggccgagactcctcgagaccagggactctcgctaaaaatcattaatagttaattaaaacaaaaatgggaaaagcatggcaaaaatggcattttgtatgtacatggtttatcttgttctgctgacctctgtgtttgtttgtgtagcgtggtgtgctgacaccgttggtggcctacgaaaacaattatttgtgccgaactgacccgcgcgactgtgcccgggtggagagcaaaacgtggatggtcacacgggagaaatatgaggtgaaaaaatgggtgtgatcagatgagatggggggggggcgattggctatatgccaacttttgatgggatttttgaatgcgatcgattgcccattctgatcagaaacggcacggcattcggaactcgtctctgatcatacatttaagagcgaaaattagaaatgcttttccactttttttgtggcgccttttatttcaaaaaacttttataggcgccgacgggaaaattttcgaatttttatggatttaaaaaaaattattaaaattttaaagttttccaatttcaaaaagggggcaaaaaggcatttccctgaccggtacacctgaatctgctgatctcttgaatctgattttgatcagttatttagtatgtcgttcgtttccgatcactcaaatttgttcgacaattctgatcaaattttttattggctctaagttttttaccgttaaaaaatcaattaagtgattgatccctgattacataattaaacattgttgttgcactttttcacggtttttcaaacattcctcccccccccccccgatcaagacggtcacccatacgcccgcgggcgtggagccgatcatgggccattggatgcctccggcacaattcgcggacgaattggacacgcgctttcccggctgtaattaattagaggattcggattaaaaatcattataaatttaatgaaggtatggccggccgtattatgtacgtcatcccattttccatgngaccgttgggcagtccgttgtccaaaattggcattcaggtgcaaaaaatgcaattaattaataaatttta

SEQ ID NO: 70477 - DNA, 360 bp, Heterodera glycines
  Genomic contig location: Contig_ID=SeqID_42625; Location=693..1052; Strand=+
  SCN-specific regions: Sequence locations=1-45,88-156,178-247,277-360
gaaagagaatagaaagaaccaggttcgatgaagctttggtaagccaaaaaaaataaatatttaaaaatctataaataatttaaaaatgagaattcatgcgagattttctggaaataagcttaatagggcctagttaagctgtaaaaaaaatttggggcgatttgaaagagaaaatttggggcgatttgaaagagaatagaaagaaccaggttcgatgaagttttggtaagccaaaaaaaatgcaaacatttaaaaatctataaaaaatttaaaaatgagaattcatgcgagattttctggaaataagcttaatagggcctagttaagctgtaaaaaaaatttggggcgatttgaaagaga

SEQ ID NO: 70478 - DNA, 795 bp, Heterodera glycines
  Genomic contig location: Contig_ID=SeqID_42627; Location=95..889; Strand=-
  SCN-specific regions: Sequence locations=1-223,245-795
atgcaaaaactcaaagacttggtcaagaagaagaagttggacaacaaattcaagaagttgggcggtggtcgccagctgggcggcccagcgcaacaacagcgaacggaacaagcggcgggacgtaccacgagcagcacacggtcaccgtcgccagccgctcagcaggttgacatgggttaactgtttttttcaaaagacgaatttttgaaacgagttggagggagagggggatttggcgatggtgcagaattaaaaaaaaaaccgcaataaaaggcgttgtttaaaaaccaccgatatgaaaatttggcaaaaaattattcataactgctccaaaacaagcaaaattttaatttcaacgtatcagtcgatagccaaaagtgatctctatcagaatgtaaaattgaaattaagtttcaaaaaaggtgacaaaagaactcaaaaaactcttgttttccaaatatttttggcaatactttttcgaaagttaacaaaaaaaatttttttgaaattttgcagcctaatagagaatacttagtactaccgaatgattccaaggattaaaagtttgtttttagagcgcccattataatggtttttaattaatgacataatactcttggcgatgggccgaaataaaaattcccatttacggcaaagccaaaaaaaaaatttttctattagcgtcgctctgatgctgaattgattgcggctgcggcggagaagcgaatgcatggcaagcaacagaacgacccaaatgctgggctgacaccgatgcaaaaaatggtccgaatgcag

SEQ ID NO: 70479 - DNA, 1144 bp, Heterodera glycines
  Genomic contig location: Contig_ID=SeqID_42629; Location=126..1269; Strand=+
  SCN-specific regions: Sequence locations=1-718,740-924,970-978,1001 -1026,1048-1048,1078-1079,1105-1144
atggaggtccgaattttctggcaaagtgttttggcccagtattccaacaatgacttttggcgaagagcttattgttgcggaagcaccgctcgcgcgaacatcgggcgttcaatttttaaactggaggtgggaaaaaatgtgtgaatggaataatcgggaataattggacaagacttgtcaatcaagccaaagatattactgatcagtgttgaacaagaaattgatcagcattattggacttgatcagatgaatcaatgtgtctgatcattgatcacgcaatgacatggttgatcagtctgatcattatttgaattggtcagatcacaccatggcatgatcagtctcattctttgacttgatcaaatgaactaatatgtttgttcataccatgatctaatcagtccttgatcaaattattacatggtctaatcaatcacattttattggacttggtcagaccaaccaatatgtctgaacacaccatggcatgcataatcagtctcaccattatgtattggacttggtaaatgaaccaagacgtctgatcacttatgataggattagtcttgtacaaggaccgggcaaaacaaaatatgtcagttgaacacgttctgatcaaaaaacgatacttatcagtagggccgcaacttttagtgaaaaacttttttttttgctctattgttttgaagaaaggcgctcaaaatacgcatttctgcattaaaattttttgattctgatgtcactatctgtcactagaaatcactattttggggtttcgtcactaaaatagttaaaaatcactattttggggttttgtcactaaaatagttaaaaatcactattttggcgttttgtcactaaattagttaaaaatcactattttggcgttttgtcactattttttcactatttcgacattttttggaaaattccttaacaaaaatgcaataaaaccaaaaaatacacccctaagaatcgagctaaaatttttcaaaatatactcctatgaaatgaaaaaaaattttctcaaaaatttactttcttggcaaaaatttttaattttaaaaatttttttaggtaactattttgggttttttggtcttaaaaatcccagtcctactcatttgcaactgcaatcagtga

SEQ ID NO: 70480 - DNA, 622 bp, Heterodera glycines
  Genomic contig location: Contig_ID=SeqID_42630; Location=290..911; Strand=-
  SCN-specific regions: Sequence locations=1-379,401-462,484-622
atggattggatgcccgcgttagtcaccgacattttgctgtccatggacgaccgttttctgttcctttcgtgttggcttcatggcgacgttcgccagtacgacatttcagacccattcgatgtcaaattggtcggacaggtcgaaaattaattttcgggaaaattcggcaattttttggtattttcagtttttcgtcggcggatcaattcactcaaaaagcggcgtcgaagttttggaggacaaagaactgaaggtgggcgagagcaaagcaaagcgcaagtgtttttttttggccaaaaacgatggaccattcatttgccgttatggtgcattattatgcccttaatcaaatgcaacaatttattttcggcaatttttaatcttttcaaaacctaatgatgatggcttatgcggaacagctttaattgcccctcctccgaagtgtttccattttcaatttgacttttcccaggcccaacccgacccgctaattgtgaagggccgtcgcgtggaggggggcccacaaatgatgcagctgagcctggacgggcgtcggctgtacgtgaccaattcgctgtattccgtgtgggacgcgcaattctatccggaactgatcaagtca

SEQ ID NO: 70481 - DNA, 96 bp, Heterodera glycines
  Genomic contig location: Contig_ID=SeqID_42631; Location=732..827; Strand=+
  SCN-specific regions: Sequence locations=1-96
atgcgaaaagcgaaatgcgaaacgccaaaaaatgcgaataatgcgaaaggcgaaatgcgaaaagcgaaacctcggcccatccctgatctaaaccat

SEQ ID NO: 70482 - DNA, 506 bp, Heterodera glycines
  Genomic contig location: Contig_ID=SeqID_9171; Location=1083..1588; Strand=+
  SCN-specific regions: Sequence locations=1-140,162-385,407-506
atgtctataactcaaaataaagttcatattcatgatcagcgacccaaattacgtaagaaaatatgttttttttaaattttagagcaaaaaaatgtgtccatgaaatttccaaaggggtatccctttggattttggctgcaaaagcagttttaattttataactctttttaaaaaagcgataaaaatgccaaataaaatttatataatagagcaaaaaattgcggattttatcaatatttttgtgtaccttagcacattgtttggagtgagttctgaattttattatgaaaaatcgaatttttcatctttttcaggaataacatttttcattttaataatagaaatgcacaataaaaaccataaaattctcccgatttttctgcattttttgatcatttaatcttcacatttgacccatttcaaagggagttattaatttttgaacattcccccaaattttcactgggcgaaaaatgaaaaattcaaacacacccaaatttggtcaa

SEQ ID NO: 70483 - DNA, 1116 bp, Heterodera glycines
  misc_feature (43)..(43): n is a, c, g, or t
  Genomic contig location: Contig_ID=SeqID_42632; Location=138..1253; Strand=+
  SCN-specific regions: Sequence locations=1-161,183-208,298-399,478 -633,672-693,733-1116
atgcgtaaccgttcaatgtttttgcttaatcctcacggattgntgagaggcgacgactgcaaatggcaaaaacggctgctgctgatgtgcgaggtgcgtttacttgtcgcgtttcacatttttgatcaaatgacgggcaaagcgataaagcatgatttattagcattaaaaagtaacaaaaaagaagccatcttcgctacctaagctcaaatatatttaatagaaataatacaaacataaaaaaggaataaaaaaagaaaataattaattttcaaaaaaataatgaattttaaaaatctatgctgttcaaaagtttgtgttaaaagattcatcggtcaaatcatcattaggatcattttcaagatgttctctcaaaggaaatatttgattaatttccccaaaatttttttattatttttcactattcaaatatgtatttttgtagataaataaataaaaaatataaaaataaaaaatcgcacgatgaaggataaatcaaaaaaaaaagaaattttgtcaaagttacattgggtggaaggaatggaaattattctcctaattaattaaaaaactcaatttctatcgtttatttgacaataaatgttttcacaaatctctttgttcttattcttatgtttagtaatcagaagaaaaattgtttgacaaatctattgaaattcaaaagataattgctttattatgtaaatttataaattttattgattaaaatatccagtaatgattatgtaaattcttaggttttactgaacattaattgtatttatgttacacagcgactgacgaattaaacattgcgttcgtgactaggaaaaaattgaaacaaattagcatcatgtgcattaatcccgaaataattttcaacaattatttatttgctaattgaaaaagcatttttaaaactgagtcagttaaatgcatgcatcctttcagtcttcgatcagttttttgacttcagcagcacttcacactttcgcattttgaagcagtacaagttggaccagtcgactttgcttctccagcaggacaacggacggtgaccacacacttttggtcattgcagctcaaacagacgcaacagcagtcgccactctccgt

SEQ ID NO: 70484 - DNA, 251 bp, Heterodera glycines
  Genomic contig location: Contig_ID=SeqID_42632; Location=1010..1260; Strand=-
  SCN-specific regions: Sequence locations=1-251
agctaacacggagagtggcgactgctgttgcgtctgtttgagctgcaatgaccaaaagtgtgtggtcaccgtccgttgtcctgctggagaagcaaagtcgactggtccaacttgtactgcttcaaaatgcgaaagtgtgaagtgctgctgaagtcaaaaaactgatcgaagactgaaaggatgcatgcatttaactgactcagttttaaaaatgctttttcaattagcaaataaataattgttgaaaatta

SEQ ID NO: 70485 - DNA, 760 bp, Heterodera glycines
  Genomic contig location: Contig_ID=SeqID_42634; Location=691..1450; Strand=+
  SCN-specific regions: Sequence locations=1-382,404-476,499-760
atgtacattaactttacatttccgaaaactgtcctacttctgaagatgaataccttggaaattgataaaattttatcgacaagcccattcacaaaacagacttatatcggctgttttgcggctgaccagataccaaatatggaaatggtaaaatttccaaattgtctggtaatgaatattgacccaatcacctctaaaggatcacattgggtttgtgcttacagtccttctccgtcacacattgaatactatgactcgttgggcatttggccaccacctagcatacacattgcaaattatttgtcaagattcaaacaaattcgttatagtataattctacttcaatctcccaattcaagtgtgtgtgtggtcgtcatgtgctcttctttttgtttaatagatgtctgggaactccctttgaaaagattgtaagatttttgcattttggaaaaacaacacctgacacacttgtgagttcttttgttacaagaataataaatataaatagttgaaaaaatatagttttttcacaaaaatgcatgtcgattttgatccccaccaagtggattggtctacattctcgcacgaatttattcaatatggaggttacaatatttttcgtggtgtaccatatcagcgcggtgctggtatcggttcagtatttagaagcttaatgagatttaaaggaccgatagggaaacaaattggatcgtcaattgcatttaaagggcttgaaagcgggaatcgagtgttaacaaat

SEQ ID NO: 70486 - DNA, 860 bp, Heterodera glycines
  Genomic contig location: Contig_ID=SeqID_42635; Location=10..869; Strand=+
  SCN-specific regions: Sequence locations=1-130,154-315,339-860
atgcaaaaaaggaaattggcgcctgtgcccgcatccgaaggaattgcagtggcggtaattgtagtggatgaaaaagcagttgaattagccagaaacggagcatctgcaaaagtaattgtttatttccgaataatttatttacaatttaaaatgcagattaaaaattgcaatagtttgctggggcggtgccaatgtttaattcctaacaataaacctaaaatttgtggccttttttgctctttttcacaaattattttttgcaatattttttaaaattttgtgtagggaatgaaccggcggttgggttggcggtgcgtgttacagaagaaaaaatctaacagttttaatgaaaatattaggaagattggccaaatttccagaactcttccctcccttttttaccaattgctgtgtttggtttcgtcgtcatcgttggtgctcccccaaacagaggggcgttggcgattgaacttgtctccgtcaatgaactggacgcagttctctttccatacggcgaaatgtcatcgactgattgtgcagccgatcgcttacgagatcgaccgttaacttgtggttgtgagcctgaaaaggagggaattggagcaggacgggagtccaatagtaaaaaagtcttacaataccccgagtttatttcgaaaaaagccggtaagcctgaaacaattatgttctattccgcgctctttcgacatggcatcccaggggaattgggtgggggcgtctctctcaccattactcccccattccaaacccacaaatggaggaaaaactatgcaaaagaaccaacttttgtagaaaacgaaggtggtttttttgttgttgttagttttggtatcaaataa

SEQ ID NO: 70487 - DNA, 1233 bp, Heterodera glycines
  misc_feature (8)..(8): n is a, c, g, or t
  Genomic contig location: Contig_ID=SeqID_42635; Location=1..1233; Strand=-
  SCN-specific regions: Sequence locations=1-886,910-1071,1095-1233
ttcccccnggcgccaccacaaccaccgcctcggccactctcccgcttctctttggcactcagcagaaaacgacggcacccgccgctgtgccttcctccgtccccgccttctctttcggcaccgccaaattcccttcttttggctcctccgccgccggtggcactctcttcggttcgaccaccgccaacaccctcacgacaagttcgttttttgctaaattataaatacaaatctccgaatgacaaaccacactgtgtgatcattcctttatcaacgaggttttgcagtgggttacaacttggcaatagaccggttttaaggggtataactcatttcataattgaccgaattaaacaaattgttattatttgataccaaaactaacaacaacaaaaaaaccaccttcgttttctacaaaagttggttcttttgcatagtttttcctccatttgtgggtttggaatgggggagtaatggtgagagagacgcccccacccaattcccctgggatgccatgtcgaaagagcgcggaatagaacataattgtttcaggcttaccggcttttttcgaaataaactcggggtattgtaagacttttttactattggactcccgtcctgctccaattccctccttttcaggctcacaaccacaagttaacggtcgatctcgtaagcgatcggctgcacaatcagtcgatgacatttcgccgtatggaaagagaactgcgtccagttcattgacggagacaagttcaatcgccaacgcccctctgtttgggggagcaccaacgatgacgacgaaaccaaacacagcaattggtaaaaaagggagggaagagttctggaaatttggccaatcttcctaatattttcattaaaactgttagattttttcttctgtaacacgcaccgccaacccaaccgccggttcattccctacacaaaattttaaaaaatattgcaaaaaataatttgtgaaaaagagcaaaaaaggccacaaattttaggtttattgttaggaattaaacattggcaccgccccagcaaactattgcaatttttaatctgcattttaaattgtaaataaattattcggaaataaacaattacttttgcagatgctccgtttctggctaattcaactgctttttcatccactacaattaccgccactgcaattccttcggatgcgggcacaggcgccaatttccttttttgcattggggcgtc

SEQ ID NO: 70488 - DNA, 548 bp, Heterodera glycines
  Genomic contig location: Contig_ID=SeqID_42636; Location=1..548; Strand=+
  SCN-specific regions: Sequence locations=1-238,260-391,418-507,530-548
ccgaaggatcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagagcattttctggaaaaaatatttatgaattaattatgcaaaaaataaacaaataatgaa

SEQ ID NO: 70489 - DNA, 592 bp, Heterodera glycines
  Genomic contig location: Contig_ID=SeqID_42637; Location=301..892; Strand=+
  SCN-specific regions: Sequence locations=1-153,196-275,301-455,509-592
atgtttgcattttttttggcttaccaaaacttcatcgaacctggttctttctattctctttcaaatcgccccaaattttttttacagccacgaggccgcgaagcggccgagtgagtaccttgggcgcaggaaaattattaaggaggagggttcattatttatttatttttgcaaaattaattcataaatttttttcagaaactgctctgaaacgcaccaaaatttatttacaagttgaataaggcactctgactcttatattatcaaaaagggagatgaataaatattttaaaaatttctaattcctttttaaacaggccgaaaaagtttaggcttaactttttcagcgggtttaaaaaatctagaaaaattagtaagcatttgtagtgctccgatacgtatctctgcaaaatttggtgagccgctgatcaattacaaattatttatggacgatcaaattttttgaaatttttattaattttgcaaaattaattcataaattttttttcagaaactgctctgaaacgtaccaaaatttatttacaagttaaataaggcacactgactcttatattatcaaaaagggatatga

SEQ ID NO: 70490 - DNA, 886 bp, Heterodera glycines
  Genomic contig location: Contig_ID=SeqID_42639; Location=21..906; Strand=-
  SCN-specific regions: Sequence locations=1-179,206-262,284-344,515 -770,792-886
  Gene Ontology: Mol. function=voltage-gated potassium channel activity; Cellular component=mitochondrion; Biological process =potassium ion transport
atggccatatcccaaattacggaatttttcccaatttcccaaaagacttttgagagcactttacgccgtttccccgactcgttgctgggaaatccggagaagcgcaaggagctgtggaacgaccaattgcatgagattttcctcgaccgaagcagtcaatggtgcggtgtcaatttgccaaattaaaaaaattaaattaaattttcttagtttcgaagcgattctgcacgtgtacagatcgggcggacaagtgatcagacccgtgagttttcttgacgaaattattttcttttaactaataaacggaaagatataaactgattgtttttttaataaaataggtcattaatttcttaatttaaaaattaaaatatttttttatgaaattaagtctaatatttttgaatacttttataaaatatatttcataagtaaattcaaatatttttgtgccaaaatatattttttttaattgctagttaatgaaaaatataatatttttaaattaaaaatacctttttactcccattagaaattttcattaaattttaatttaaatgtttggctttaacctttaatctttcttttgtctttgtcaggcgtccatcccggtggagctgttcatcgacgagttggtgttctacgaattgaaagacgacgtgtgggcaaatttttgcgagagcgaaggctgccgcgttcagtcggcatatcggaagccgagtaacaaattccagcgcaaactttgggatttggtcggcacggcacaaatgccaaattcaaacatttaaatttgaattttttgctaagatggagcaccccgacaatgtccgttggcccgtatcatcgccacactttccgtcggggagaaataatgtgccttattaaa

SEQ ID NO: 70491 - DNA, 1534 bp, Heterodera glycines
  Genomic contig location: Contig_ID=SeqID_9172; Location=1944..3477; Strand=-
  SCN-specific regions: Sequence locations=1-691,714-965,987-1327,1350 -1380,1412-1534
atgacaccgatcaacggcacaattactgtttcggttgtctgtccatttctatgtacaattatgactttgctgttccctgaaattgcggtgattctgaacagattacgcgaattagcggaattggcaccaccaaaataattggccgaattttccaatttaaaatttgaaataaacttttaggctgccccctctgctgctgatcagtcctcgcttattatgaagcaattttttgattttgtctacaaaaataaagcggaagagttgcgtgcactgctcaattcgctcccgggcgacgaactcagtcacttactgtacatacagtacgccccaaagggcaccgaaaagcggctgactccgctgctgatcgccacagtgggaaacaagccggaagttgcggcagttttggcatgtcaacagcaaattcgaacattggctcttaaatctcaaaaagacaaaaaatgtcttggcacactaagtcaaagacatggtttatgtccgagtttctgtcaaatcgggcgataagcagcattttgatcaccaatcaaaaaaaacagctgatcatgccatggaacagacagaaaagggacattaggcctgatcagtgactaattgcattatagaagaaattctgttaccctaaaagccgagacttttccaccgttgggcccggaacaaattccaatgattggcactcatttgactatttttctcagttggagaagggagccgacccgcaccaaatgagccttcggaaaatcaacggcgattacaaatattgtgagccaaaatggctttggaccttttcaaaacgaatttttattagatgggactctcctttgggtcgccgcttcgtacggcttttttgggagtgtgccgtgtgctgcttgcgcacggtgccaacgtcgacttgggcctggaagttggcatgactccgctgatgattgcgtgcgatgcgggacacattagcattggttcgttcattcatcggttattattaatgggtatgcgccgcttaatggggattcgatgggttcggttgtgtcagaagagggtgtgctttcttggccatcatttttacaatttccattctttttccattggttttattgtttaaacttctcttgtagtccaccactttactaacctaattaggaataattttatgcttaagtcactttactcgtcgagaatggcgcgagcattgaacaaacgaatagcaacggacacaccgcgctaatgttcgcatcgctcgcggggcatgtgaggcccgccaaattcggacttcccccaaatttttgttcattcacttaggcgcacgttgtgcgctttttgttggacaaaggggcacgaactgatacaaagaataactccggtaaggccaaggcacagtttcttttcttttttggcaaatttgggggaaatggcggagtcgaagtgccgacgatatttggcgatggatggtccatggctttcattttaaccgatgagtcatcccaccactctcaacaggggtttagagcgataaacaaataaa

SEQ ID NO: 70492 - DNA, 116 bp, Heterodera glycines
  misc_feature (91)..(91): n is a, c, g, or t
  Genomic contig location: Contig_ID=SeqID_42645; Location=1..116; Strand=-
  SCN-specific regions: Sequence locations=1-92,115-116
gctgtaaaaaaaatttggggcgatttgaaagagaatagaaagaaccaggttcgatgaagttttggtaagccaaaaaaaatgcaaacatttnaaaatctataaaaaatttaaaaatg

SEQ ID NO: 70493 - DNA, 2199 bp, Heterodera glycines
  Genomic contig location: Contig_ID=SeqID_9174; Location=130..2328; Strand=+
  SCN-specific regions: Sequence locations=1-143,229-279,345-425,467 -1085,1111-1387,1465-1626,1704-1954,1990-2113,2166-2199
  Gene Ontology: Mol. function=anion exchanger activity; Cellular component=integral to membrane; Biological process=bicarbonate transport
atgttttcctcaattattttcctatattttgcttgccttttgccggctattgcgtttggtgtgctgaacgatgacaacacaggcggtggcatcaatgttcgcaagggcattttggcacaggtgaaaaattggaggggggggggaattattaaaatttttattttaaaaagctaaatttaattattatttttatttataatttattaaaagaaagtttttttttaatttgttaagaaaactggctaaaattccaataataattcattagcatttcccttctttaaaaaaatattttcattattaaataattttttcaatatttccaatttattctaattaatttacttttttcattaaaccaaaatttggcgtttggaattgttttttaaatattccatgcgaaaaaaacaaaataaattttccacataaatataaaaaaaactaatatttttttttaattaattttcttacgcctaaggcaatcggcggcattttctttgccatctttggcggacaaccgatgatcattctgctaacaaccgtaccactagccatctacatcaaagtaatctacaggatatcggagtcgcttggctacgatttcttcgccatgtacgcatgtgtcgggtaagtttttttttaaactttttagcctataaatttataggaaatgtttaacaacaggctagagaatacagtatgggcgtattgtaaatgtgtattgggtgggaatactgtaaaattctgaaattatcgtaacctctataagtgctatatgggaagcagcataccgtacatttcagtgggggggggggagtactgtaaattctgaaattatctattcccacgaaaagcttgcttgaaggacgggcatacagtaactgtataggagctatgcatacagtaatttcctgaaattaccgaaaatgcttatgactttgctagaatatgggagtacttactgtaaattttgtatgggatctgaatactgtaaattactagaattaccggagatgcttaagaaatatctagaatatgtgaacagggttactgtaaattgtatgaatgaaacacactagcaattctaatttttttttttaattttaatttcgttgaaactataccgaggtttaacttcctcggtttttacgaattttccattttttatgcctaatgccttgtaaattttaaaaaaattcacaggttatggtgccaattcttcctgatactgtacgcggccactgaactgtgctcattgatgaagttagctacacggtcggcagaagaaatgttctccctgttcattgccattgcgttcactgtggaaagcatccgtgccattcatacaagtgaattttcatttaggaacggaaattaaaagaatgtgaaaatttattttcaaaatttcataatttttttcagtaaaaatttaagattttttgaaaaaaaaatcttttattttttctgatattattttgcaattttttaagaagaaatttaaaaaaagaccaaaaattttcgatataaattcaaaaaatattttgtttaacttaaaaactatgaattttttaaaactaaaaaactttcatttttataagtaaaatccaagtttttcgaagaaattccaaaaaatattattttttttaattgaagaaactatgaaattttttaaactaaaaattttcattttttttttaatttttgtcttggaggggggcataaacttgtgtttttttctgataaacaaacgaactgctgagctttaaaatttaggctttatgaacaactacgaagtttgtgaggatgcacaggccgccgctgaacaagccgaacttgcgcatcgacatcaacagcagcaactggtgcagcaccaactgaacctgtcactgctacagaaaatcatcaatccggagttgcatcacaacctcacacaggtgatgatgattggattgggaaataattaatattattttttatattattaatattcggaaattaattaccgtattccaataatacaaaagctctcgtcaccgtgagggctgaaaaatcgaaggcatcctcccccaggggctttattagaagaaatatactgtgtgtattgttttttctgtaatttatttttcattttcaaattttttcataaattttattattgtatttaagtgtatgaccaaatttcagattatttcattttta

SEQ ID NO: 70494 - DNA, 1288 bp, Heterodera glycines
  Genomic contig location: Contig_ID=SeqID_9175; Location=459..1746; Strand=+
  SCN-specific regions: Sequence locations=1-83,106-171,205-296,323 -342,366-694,718-779,888-1166,1264-1288
atgcgtccaaatgtgccattgtttcgagtgcccgaattttggcgtctttcttggcaggccattctcgtctgttttctgctcggctttttcctctcctttttgttttacatggaccaaaatatttgttcagcaattgtcaacaacggacaaaacaagtggaaacttttgatcaattatttaatttaaaaaatattatttttttaacacatctatctataaaatgggggttaaatggcaatttggcgcccccacaaagtgtcaaagccacgaaatgtccaaaagagtaaaaacccacgaaatgtccaaaatttttcaaaatttataaaaacaaaatgagtctaatttaggatttttagggttttcggggtcgctgaatacgaatataccctttatattacccgttgcctaaccttaggtccatccgaataataaaaaactcaaattcgagacttggacattttgtgggtcagcgggcaatttatgacaaaaaaattttttttgtttatcccttgtgctatagaagtgccatttttaaagtaaattaagtctttttggccagcgatgccgataagcgggcatcgccggagaaagttttgaaaattgagtataaaccaagattatacaaaacaataatattttgggtcaaattttgaaaaaaaaaattttaggtgaattttaagccaccgggtaaaaattttaagcatttttaatgaattttgttaagaaattggctaatagtgccagcgcataatttttgcattatgttatgaacttaattcaattaatttattttttcgtaaattttatattaatatttcgcaaattttaacatttaaaattttaaattcataaaaattagttgttttttgtttaaaaaagattaaattgacaacccaattgcatcaaattctatttttttcatttttctattttatttcctttattcaatgtaattttcataactattttttcccattaaacctttagactaaaaaaaggctctgcccagcacttggacatattcgtggtggccttgctcaacatgttcctgtccattgttgggctgccgtggatgcatggcgcgctgccccattcgccgctgcatttgcgcgcgctggccgacgtggaggagcgcgtcgcgcagggccacgtgcacgaagtgtaagtgattggctgataagggaatgattgattaatttgagattgattaatgattggcggattttggattaattgattgacttttgattaattaattgcttgctaattgcccgtcttgtactaaata

SEQ ID NO: 70495 - DNA, 129 bp, Heterodera glycines; identical to SEQ ID NO: 58094
  Genomic contig location: Contig_ID=SeqID_42655; Location=689..817; Strand=+
  SCN-specific regions: Sequence locations=1-129

SEQ ID NO: 70496 - DNA, 173 bp, Heterodera glycines
  Genomic contig location: Contig_ID=SeqID_42656; Location=46..218; Strand=-
  SCN-specific regions: Sequence locations=1-59,82-89,111-173
  Gene Ontology: Mol. function=ATP binding; Cellular component=muscle myosin; Biological process=cytokinesis
ttgaccaacaaggacgacgttggcaagaacactttcgagctggagaagtcgaagcgtgccatggagaaggagatggaggacttgcgcatgcaggtggaagaattggaggaagcagtgcaattggcagaggtccaaagacttcggatggaagtgaacattcaggaaagaggctg

SEQ ID NO: 70497 - DNA, 704 bp, Heterodera glycines
  Genomic contig location: Contig_ID=SeqID_42659; Location=168..871; Strand=-
  SCN-specific regions: Sequence locations=1-55,77-82,104-260,283-704
atgaaggaaggctttctgctgacccgagctgttcgcgcaaattacgaggacaagtgcccggcgggccccccgggcgatgccggtcctcccgggcccgcgggtccggccggagagcccggcaaatgcccgccatcgcccggcgatgacggcgatacctatcagccaacagaagacggtggcaaaggcgtaacttatgaggagggcgaagaggagcacgatgaaaagttggaacaggacaagtaccagccccggcaccatctcaaccattaccacaacaacaaacatggaaaaggtggccataggtatgcagggcatggacacggcggacgagggcacaagcatcggcatttgtacggaaataaccgacacgggggagggggagacgaaagtgacgaaagcggcgcacacggcggtcgggacaaagacggaagttacgaaacaagcagcaaaacaggccacaacaacaagaagtacggcagctacgaacacggctcagcggaagagggaaaagcgggacacaagcacgggtacggctatggcgaaagcagcgcttccgtgggcggagacggaagctacgaacgcggaagagcacacaaacacggagggggacacaaacgcggcagctatgagcgcataacggaagcaccgccagcggacggcaatgacgaggagtacgagcgccgtgtgcgcgtggtgcgcgccag

SEQ ID NO: 70498 - DNA, 960 bp, Heterodera glycines
  Genomic contig location: Contig_ID=SeqID_9176; Location=1179..2138; Strand=-
  SCN-specific regions: Sequence locations=1-226,257-344,367-508,543 -670,709-709,731-854,910-960
atgagccgtgactattcgacacttcgccgtgacctcttcagcaatgaagaggagtacctacttttcattgcaattcgcgccggccagaggactgccgatttgggtcgacgcatccaacgaatgcgtgatgggcttcctcctccaacactgttcgtaaatgaccgcgatttatggacggtgttagaacataaagaaatcaaatataaaacacgaatgacactggaggtaaaaaattaaaaagaaaaaatataaataaccaatttaaaatttgtcaaaaccattggaatatgtcaatggcaaggataaaataaatttggggctcccaactttgaaccaaactcgaaatcagaaaaaatttgaattttctagtttttgttcgaatgcaggtccgggttcgaactttgtcgaaatggattaaagagtcgatttttccaaccctcaaaactcctaaaaagctacattgtgcaataaatgtgaatttggttattcataaagaagtttatcttgcaaaaaatttaaaatttatttacataaaaaataatgaaaattctgacctttctaattggtgatttcacctaacgaataagcacgactgatgaaggcttatactggtcattattccagggttccattgaaactactagcttccaagggcggctatactatttacaaatttaattatttttatatttaattaattttatttttcggaatatattttttccaatgattttgagtttaaatgcacatttaagatgatccacactatgcataaaaaaatcaaatggtggcaagatcctctaaatgccggcgttttccgagacggaattgctacggtatattatttgaataattttataatagcaagaagaaagtttttaatattttcaatattaaatttataaaaatgctaaatattgataattctacaacacaaatgtaaaattcaatttaaataaa

SEQ ID NO: 70499 - DNA, 959 bp, Heterodera glycines
  Genomic contig location: Contig_ID=SeqID_9176; Location=3223..4181; Strand=+
  SCN-specific regions: Sequence locations=1-93,127-238,260-407,445 -579,602-725,747-829,854-907,944-959
atgaaattttcaaaaaaattcacatttatgcaacaaaaacggccaaatggacttaaattaaggtacttaacggttctctatgtacagattttcaaaaaattttttaaataaaatatacttattttaggggttttcagagtcgggataacatagaactgctatttttaccccttattcaaagtaaatgcactttatgtggctttgaagttcattttaatgtatagacctagttcgacccaaaaactgaaaaatttaactgtttgggattagaaattggtcgaaatgaatgctacatcagtgatcagtgaccttgaaaacccctgcatacttgttttcaggactagaaaaaaatttgaacaataaccaaaaatgtagacccaaatagggaacacaattttcgttaaaaaatttctttctggtttgttttttaaaatttggtttggcgccgaaacgtgggcgccgaaacgaccccgacccagaaaccttgagggccgaactgagataaaccggaaaaaattaccagtttattttattctcttgagtgataatacccaaaatttcagagaaaattgttaaaattgggcaaaatttctatttttcctcatcagacggcgccgatcggcaccgccgggcccccccaaaacttattttttttataaaaaatggaatagggcaaccgggaaaccagccttttttgtagaaaatctgttaacgaaccacacactaattttcaaaatttcccccggcggcgcctataggcaccgccggacccccttcttccgcaaaagttgtttggaaaaagcgcacagaaaaaaagtgatgttaaaagcaaatctgaatttctattaatattcgatcatttggtccaaaaatgattaattgtttaaaataactgaagtaaattcgatttttgagaattttcattaatttaatttagctttaacttttggattttataa

SEQ ID NO: 70500 - DNA, 249 bp, Heterodera glycines
  Genomic contig location: Contig_ID=SeqID_42663; Location=39..287; Strand=-
  SCN-specific regions: Sequence locations=1-249
atggcagttgtcatcgatcattgtgcagttccggcagtttatggtttactgcccagcaaaactctcgccacatacacaagattcttcgaaacaattcgtcagtctgttggcaataattggttcccgtaccgtattatgagcgatttcgaatcgggagcgatcactgcagctggcaacgtctttccaaattccataagaaccggatgcttgtttcactttggacaagcaatttggcgaagaattcagaga

SEQ ID NO: 70501 - DNA, 552 bp, Heterodera glycines
  Genomic contig location: Contig_ID=SeqID_42666; Location=313..864; Strand=+
  SCN-specific regions: Sequence locations=1-342,364-552
agacttttgtttgcctgaacaagctccgtcccagggcttccgagcagcgggacaattgttcctcgtacagcttcggttggccccctccgccttcggacccattggcggaggagcgactgctcgcccaactgttcctctgcactcgcacgacggcgcgcgttcggcaggactcgctgtacggcgattacacgctggcggccagtcccgcgagcacgcaactgcgcaccactcactcgtcattttggacacaacaacagcagcaactcaaagtgagtgagaacgagcgagcaattgggatgatcaatcattcccattgatcatttattggccaatcaatcaatatttgattggctaattattatttgatttatcggtcaattagtggataattcaatgaccaattcataggcacaacagcagcatcatgcccagcagcgcgacaatccgctgcagcagcaacaattggcaatggaagtcgtcgaaaaggacgaaacgccaaaaagggagccgacactgtcagacagtaagcagcgaacagcagctgaacaataa

SEQ ID NO: 70502 - DNA, 784 bp, Heterodera glycines
  Genomic contig location: Contig_ID=SeqID_42671; Location=150..933; Strand=+
  SCN-specific regions: Sequence locations=1-87,109-131,153-155,208 -221,243-433,463-501,527-547,569-707,729-784
atgagcaaatgtaagagttataaaagtcttttttatttcggcatttaattcctctaattcggggattattttcgtgtaatattttttctataaacttaattatctttcatctaaaattgtttgaaatcattaaatcaaaaatcttccaatttgtcataaattcataaaagtattttaatttttattaatagtaatttaaaattaatagagttcgacctggacctggatccaggcctggatttttcctggatccaggtccaggtcattttttgacaacatggatttttcctggaactggatttttgtccaggaaatccaggtccaggtcaatttggaaatccaggtccaggtccaggcttgaaaaacctggatttcctggataaaatttttttccatcttttatggcgaaatgttttaaaatgggtgtaaattcaaaaaatttaatttttttttaaaattttacacatgttaatgaaaattctttttgtttttaggcattaatgaattcttaatttggaatataggcttgttcgaaaaaaataaaattggcaaagttgggatttgcttagtgtgcaaggagcaaaacagacaaaagtctgaattttcaatcaacgacagctcaacgaaaagcctaattgtccatctcaattcgtcgctacacaaaggatcggaatatgacaaaaaattccagcaacttgagacagaatggaaaaacgcaaaacaaaagaaacataaggagcagccaaaaatcgccgacttgatgaacattacttcatcccggtaa

SEQ ID NO: 70503 - DNA, 514 bp, Heterodera glycines
  Genomic contig location: Contig_ID=SeqID_9179; Location=334..847; Strand=-
  SCN-specific regions: Sequence locations=1-236,260-342,374-514
atgaataaattgtgtcatatttttatggtgatacaaaaatgcaatgtcgtttaaatgcatgaaaattgttgaaacttcaattaagtcatatatatcactttttacgatattgatatgatagcccaaagatttctcaattcgtctgttaaatttcaaaattatttattgagtttcaaaaaggtcagggacaaaattattgagtctaaattttaggaatttttttgttacaacacaactttttataaatttttgctaatttttaacctatcgctcaatatcaagattgtttaatttgaataagtttgagctaacttatgatatattattattcagcaaatacacataaaataatgattaaatttaaatattatttccattgatactttttaggttcgacttattgttagcatcatttttatttattttttcattggaccaatttcatcactttttagaaagcgaaacattatcatatcatcaacaatcagcaggtagtaattagtgtaataataaa

SEQ ID NO: 70504 - DNA, 69 bp, Heterodera glycines
  Genomic contig location: Contig_ID=SeqID_42679; Location=845..913; Strand=+
  SCN-specific regions: Sequence locations=1-69
atgccgtctaccagtgaaaaggtagcagaagtgcatggaacaaaagagccaatctgtcccatcaaaacg

SEQ ID NO: 70505 - DNA, 939 bp, Heterodera glycines
  misc_feature (408)..(408): n is a, c, g, or t
  Genomic contig location: Contig_ID=SeqID_42680; Location=552..1490; Strand=-
  SCN-specific regions: Sequence locations=1-286,308-323,345-374,396 -611,635-774,800-939
  Gene Ontology: Mol. function=structural constituent of cuticle; Cellular component=basement membrane; Biological process=cuticle biosynthesis (sensu Nematoda)
cggccattttggctactctgatcgttgtgcctcagctgtaccaacagatcaacgaggtcaactcgcgagtgttcgacggtgttcaggtggacaattcgtccaaaattcgattggaaaagtttccgtcgtaggctttccgcgtgaacaccgactcggcatggacagagctgatggacgttcaaatcagcgtcacccctccggcccgtccccgtgagaatccgttcaattccatctttctgcgccagaaacgtggcaacggcgggttgccgcctcagtgtgtgtgccagctgcagcagccgcaatgtccgcccggaaccccggggccccctggcccaccaggacccgctggacagcccggcggaccaggacaacccggaaggccctggccagcccggacaacagcccccntccttgccctcaagcttccgccgggtgcccttcgtgccccgccggtccgcctggacaacctggaggccaaggaccgcccggaccccctggaggcgatggacaaccaggacagccgggacaaggcggaggacagggaccgcctggccctcccggacctcctggcccgggaggaaacccgggacagcccggaggacctggccagcccggacagcctggagccccaggaacgaaaaggtaccgacacagaaacaacaaaattatgctgtttgcttcagttcatcagtgcccggcccgcccggacctcccggacagcctggtggacccggacaacccggaggacccggacagcctggacagcccggaggccagggacctcccggacctgctggacagccgggaggacccggacagcctggaggccctggacagcccggagccgcgggccaagctggtcagcctggccacgacggtgcttactgtccttgcccgcctcgcaccagcgttttcgcgcgccgaagccgcgtcaaagtg

SEQ ID NO: 70506 - DNA, 1020 bp, Heterodera glycines
  Genomic contig location: Contig_ID=SeqID_9181; Location=149..1168; Strand=+
  SCN-specific regions: Sequence locations=1-193,217-354,378-421,443 -771,793-1020
atgcgcattgatgaggcgggaagattcttgaaaggtgtgtttcacaaattttgagatgatttcggctcattttgatctcacatttccaaattttattccctttcattttagtggtcaaagaattttcacagaattttccgactgtccgaggcttattgccatctccatcaaacgagacggtaaacatcagcagaaaacattgtgtaaattaattaattttcaaatttcctttttttagttggacgagcttttgcggtgcgctcgtgaatcggttaaaattttgatcgaatcggacgccgtcacggactatgacatgacgatgcttcgtgggggtgagttcgatgagattaatgtgctttatttaaaaaatacatttcgcacttcgggtcgttaagccggatggcatggaagggtcctgggatttttggttttacctccttttttacttatcacgccaatttttgtgcctttttaagaatttggttaaatttgagtgagtgagtgagatggaggagcggggggggggggtaccaaaaaggaaaaccggaaattttaagcgtaaaataccctctcccccatgggatcttcccaactggctggtagttcatgtcaattggtaccaatgaatttacaaaatttggtacactaataaacttttagcttaattttaaaagttttttgttgtttcagcccttttcggcatctattactacgtcatgtaccactttccgacgcctgcctaatttttgatgagagattttattgtggacgaaaagaaaaacaaattgttgttgatttctctgttgatcctgttaaattttatgcaattgagataaatttctcaaattaatcctatagactaaagtgtgacatcaaaattttcgactgacctgccctcaccccggtagaatgttgttttaaattgtttttttgacaaatgagacaaataagtcagcgatggcattcacatcttaatgaggcaaaatgccatctccgacgaatggctgggaaattctgaca

SEQ ID NO: 70507 - DNA, 766 bp, Heterodera glycines
  Genomic contig location: Contig_ID=SeqID_9181; Location=1315..2080; Strand=-
  SCN-specific regions: Sequence locations=1-201,223-766
atgcaggacacaatgtgttcatcggtggagcacagtccacaacagatggcacgcgcgagtgccaacggtggcggcggagacggcggtggtcgcgttgcaatgctcgccgctacgctggcggacgagaggggcgacagtgggccagcaagcgttggcagtggcattggtcgcggtcgtcgtggcgcaccgccgcgccatgatccaccgccgccaccgggcgcaaacgctccgccggcgacaaatatcgcgggtcaacgccagcaacaggcggcgacaatcattggcacaaaaacgcggcggggacgtgatcagtgaatggaatgggatcaggagcagaatgcgatagtgatctggcaaaagatcaatgaatgatatgtacacaatccgatcacacactgatcagagatcaaaaattatcagttggtaatgccggaagaggaattagatcagataaccaaagttggacaaattaaagaggcaattaaaacgcaaatttaattcgggtggaaatcaatgagtaagcaattagaagttttgccaactttgatgctgatctgttccgcagatattaagccaaacttttcccatgaactcgtcagttgagtgcccataccaaaaaatacagtaaataatttttgatccgtttcaaattttgattcgattattgtcacccaaattattggcgctcaacaaattatgcccattttctcggtgttttcagccgataattcacttttttgtcttcatttcagtgcctttgaataaa

SEQ ID NO: 70508 - DNA, 3190 bp, Heterodera glycines
  Genomic contig location: Contig_ID=SeqID_9182; Location=83..3272; Strand=-
  SCN-specific regions: Sequence locations=1-92,184-522,544-785,807 -1331,1357-1824,1846-2381,2404-2698,2819-2890,2912-3141,3169-3190
atgccacggtcaagaccacataagcagaaaatgccatgccacgaccacataagcagaaaatgccatgccacgacgataactcgcagcgttatggatgagttgggtatggatgagttgggtctatggatgagttgggtatggatgagttgggtctatggatgagttgggtttggtgagtttgggggtgactctagatttgtcattttaatttttcacaatttgcaaatcctatacactttttcaacagaagcttccaaaatgatgatggcacatctgctggtgatgaattttgtatgaatgtgctggtcaatgacgggcgacacgtcgccaaagcgccacttttagtcagtgatcaatttggaagtttttgatcaaaattccgagtactgtaaaccatcacgggttacgataaccgattttttggtacttactggagtctaacacagacaatggactgcttgtaatcaaaaattgaatgggtacttcaagctctgatcaatgaccagatgggaccaatccccgacgatcattttggcagctgggattacccattttttcaaattttaatcctgacaatgcacccccattttgatcagatatacaaactccagccgggtacaaacattgtgctattggtgatcaatcaaccagctgatcaggtggacgttcttcatgctgttcggtatgtctcgtgttcctcattattttctgatcatcgccgcccgtcaaatattctaatcactatgccgatcaatctcacatccaaatctcaggcacatgaacgcgatgctgcccggcatgggtgcggatgtgctggtcaagcaggtgttcatcggtgaggacgggcaagcggacccacgacgcacccatctgctggtgtacgcggttgactcgcgcacgcgcttgccggttccggcggcaaaactcaaagagtatacacaattttttaatccgtaattacggctatttttcaattaagaaaacataattgtagaaggcccaaaaaggcggtcatttcataatccataattttcaactaaaaaaccctttcttttggaaatccgttaaaatatgaatttacagatattctctttaaatcaaattagaaaaaagcctttgactatttgaaaaaaaatcatgcaagaaattagctcgaaaaattatctaatcttctatttatggaccaaaatatgttaatccgtcatccgtagttatggggtctagaaaacgccataattcccagtaattgcttgcagcactgttcgagagtctcgagacccaatgacatcattatcccccccccctgttcacagactgcttgacggcgcgtttggcgctgctgctgctggtggccgctccgcgtcgtcaacgcctcctgccggggctgagactgtggcggccgactcacccctgcgctatttgaccagcatttatgtgccggaggactacaccggtgccatggagcacaacaacagcacattccgtttgacaacagcggaaattgtaagtttttggtttttctggcattctgatttatccattcaaatttgataagctgaaaatcggattctcaagcactggaaaaaatctgactttatccttggatgcctctctgtgtacacagtccttatggaaatccaagggcaatcaaattaccttcacatgggtcatgattttcgaggatggaaatccaagggcaatcaaatgaccttcacatcctgacatcctggaaaaggtcatgatttcgaggatggaaatcctaggacaatcaccaaatgatcctgacgaaattgcatctaattagtcattggggcaaattgcgcttttccactttcagtatcaaatcgctaattatcataccgatttttttaatttacctttttccttcaaataattcagcgattggcaaatacgaccctcggaagatttatcgccacttaaatgagggggataattatgccataattatctctaatggatttaataattgttcatttctacagactctgttggccatcagtgtactgcttgtgttcggcgtgtgtgccatgcttttcatgctgttacgatgttgcaaaaagtaattaaaaataaaaaaacggcacaaattttgccatttcttttcccatttttttccagcaaacaacagcagaccatcaccaaatcggacgttgaatacatgctggacgcacaacaggctggtccacgcccgtacaacgtggagctgatcacgcgcaaaatggcacagagcgatgccgcggcggtggcccgacgcatgcccaaggcattggagcagtgcaccctgtcgtaagtgcatttcaagcggacgggggaagggaggggggaggggtaaaaacgaaaattctggtaaattcaacggtatacagtacctacagtacagggggttgccgcagggatcacatttttttcttctcaccaattctcgacctgaaaataattttttcgccttcctgaaccgactcctggaactttttcatgtcccgcttaagaaaaaccctggtacagtaccagggattcaactgatggtttaaaatttcttttttttttggggaggggggaagaacgatacgggagggaggaagcgtagtgcacctctcaagtacagaatttttaatttggctcttttattttgaaggcccgaatcgcgtgccacaatggtcgcatcggctggcatttacagtggtggtagcgtcggcggcgatggcagcgcctgcgctcgcacagcagcgacaacaatgccaagcgacacagcggcaacggcgagtggtcagcagcgacgcggcggcggcggtgccggacagcacacggacacggcgactgaggcacgcgcagtcgttggcagccaccacccagtcgctgactcgtccacaaccacgacaaccacaacaacgactacgacatcggcgagcagcgactgttcatcagaggaggctggcgaccgaagcggcagcggtggcgagttttcgccccagcaacagcaatcacagcaacaacaactgaagcgtgctggtggtagtggtgaggacagcagaagcgagctgcagctgctacctacaacctgttgctggtacggagacggaacagccggggcggaaatggcggcggcgctcgcgcggtggacaaacaaaagcagcagcagcagccacaaaagcgacgcgttgtccacccg

SEQ ID NO: 70509 - DNA, 886 bp, Heterodera glycines
  misc_feature (838)..(838): n is a, c, g, or t
  Genomic contig location: Contig_ID=SeqID_42682; Location=38..923; Strand=+
  SCN-specific regions: Sequence locations=1-131,153-285,323-464,499 -508,532-624,662-886
atggacgaagtaagtaaaaaatattcattgattggtgtagggcttgctcaagaccaaaaattcttgagactcgagaccgaggcctaaaaagacaaacccttctcgagtcgagactcaaggccgagagactcatgaacactaataatgctaatgaatagggatgacattttttggcacaaaagtcgcgaaataggcacctaaaaagcaggaaaaaatcgtaaaataggcaattacataggcagaaaaactctcgaacagtcacaaaaatagttaaagtctttttcgaataaaaataaaatgttaaattaaaaattttaattaagaaaacaaaattgtaggtaatcaatatttgtgaaaatttttaaattgttaggggcgaattttctgaaaaatttcgggtcattattagggtgtaaatcgtttttaatgcttttttgttaaggatttttctaaaatcctttttagtcatttgcctaaaaatgcaaaccaatgctaagtcgttattgacgccccttttggtggtttttattctgtataacggtcccatcaccgtattcagcctagagaaaccgtaaaaaattaatttaaaattgtaaaaagattacatataaacaatcttatgggaattttaatttaatattttattatttttttaatatttcagatagttttgtcaaaaatccgcaatattggattcatattgcggctaatgaacaaaatagaagcgaatttatggtgatatcgctcttacaaaaatacagaagagaagagcgacgggtcaaattgcaaatcggattctctgtttttcgtgtggtaaaatatgtcaggggtccgggtntttaggggaaaatatcaaaaaatagggaccgaaataagggcgaaaata

SEQ ID NO: 70510 - DNA, 936 bp, Heterodera glycines
  misc_feature (24)..(24): n is a, c, g, or t
  misc_feature (50)..(50): n is a, c, g, or t
  misc_feature (54)..(54): n is a, c, g, or t
  misc_feature (90)..(90): n is a, c, g, or t
  Genomic contig location: Contig_ID=SeqID_42683; Location=1..936; Strand=+
  SCN-specific regions: Sequence locations=1-124,193-193,223-274,397 -399,427-434,510-581,650-785,821-936
cgattttattggttttgctgacgnagataatggttaccagagacaaaccngggncccctcgtattgtacgtgagagtgaaattctggacncgtagcaagacggactacaagcgaaagcctttggcaagaatgtcttcattaatcaagaacgaaagtcagaggttcgaaggcgatcagataccgccctagttctgaccgtaaacgatgccaactagcgatccgccggcggatttattcgccctggtggggagcttcccggaaacgaaagtcttccggttccgggggaagtatggttgcaaagctgaaacttaaaggaattgaaggaagggcaccaccaggagtggagcctgcggcttaatttgactcaacacggggaaactcacccggcccggacaccgtaaggattgacagattgatagctttttcatgattcggtggatggtggtgcatggccgttcttagttcgtggagcgatttgtctggtttattccgataacgagcgagactctagcctactaaatagttggctcattgcttctgtgggcacaacttcttagagggattttcggtgttcagccgcacgaaattgagcaataacaggtctgtgatgccccttagatgtccggggctgcacgcgcgctacactggcaaaatcagcgtgcttgtccttccccgaaaggggttggtaaaccggtgaaaatttgccgtgattgggatcggacattgcaattattgtccgtgaacgaggaattccttgtaggggcgagtcatcaactcgctctgaatacgtccctgccctttgtacacaccgcccgtcgctgcccgggactgagccatttcgagaaattcggggacggttagtgttccggcttcggtcggtatgcagactggaaccgatttaatcgcagtggcttgaaccgggcaaaagtcgtaaca

SEQ ID NO: 70511 - DNA, 589 bp, Heterodera glycines
  Genomic contig location: Contig_ID=SeqID_42683; Location=378..966; Strand=-
  SCN-specific regions: Sequence locations=1-146,182-317,386-457,533 -540,568-589
atccagcagcaggttcacctacagctaccttgttacgacttttgcccggttcaagccactgcgattaaatcggttccagtctgcataccgaccgaagccggaacactaaccgtccccgaatttctcgaaatggctcagtcccgggcagcgacgggcggtgtgtacaaagggcagggacgtattcagagcgagttgatgactcgcccctacaaggaattcctcgttcacggacaataattgcaatgtccgatcccaatcacggcaaattttcaccggtttaccaacccctttcggggaaggacaagcacgctgattttgccagtgtagcgcgcgtgcagccccggacatctaaggggcatcacagacctgttattgctcaatttcgtgcggctgaacaccgaaaatccctctaagaagttgtgcccacagaagcaatgagccaactatttagtaggctagagtctcgctcgttatcggaataaaccagacaaatcgctccacgaactaagaacggccatgcaccaccatccaccgaatcatgaaaaagctatcaatctgtcaatccttacggtgtccgggccgggtgagt

SEQ ID NO: 70512 - DNA, 75 bp, Heterodera glycines; identical to SEQ ID NO: 65584
  Genomic contig location: Contig_ID=SeqID_42687; Location=601..675; Strand=+
  SCN-specific regions: Sequence locations=1-75

SEQ ID NO: 70513 - DNA, 920 bp, Heterodera glycines
  Genomic contig location: Contig_ID=SeqID_42689; Location=1..920; Strand=-
  SCN-specific regions: Sequence locations=1-920
  Gene Ontology: Biological process=carbohydrate metabolism
cacaattaataaatttatttgacaaatgccactttttcttggcattgacctcggcacaacgtcagtgaaaattgccctaatcgatggagacaaaaagtgttcttaaaagggattattttgagagtaattaaaagttgcaggacatttttggaatgggacagaaaacacaacgcattaattgagagagaggagaaggacaaacacgaacaaagcccaaagaaaatattggacaccgtacagaaattgatgggagagatggaaacggacaaattggcacaagtgaaaggcattggcatttcgggacaaatgcacggagtgatgctgtgggaagccgactcaattgggtcctttaattttaaaatgaaaacggaaaagtgagtgaagtttgggcgtggaccgttgccactgctcccctctgatcacgtggatggactcgcgctgcgacgagcaattcctgcggaaactgccaaagtacgcttttgagggaaactggtcaggtggacccaaaatgcagatggttggacggaaatgacccacaaaaggaaaaaagaattgccacggggtacggaatggcgactttggcatggctaaaagaaaaaggccaattggacggagaaaagtgggacagagcgggcaccatcatggactttttgggtgaccgttgcaaccaaacgattacattctgccgtccgtttaagcatccctcttgactcagtccaaaagtgcgtttatttcctcacaaaatgccgagtcgtgggggtttcgtctccgacttcatttggaccgtccaacagataagctgattgatgccctccctctgtttcccatttcattttgcttttcctcacgcccatttccccactcatttgctgccctccatcgtttcccccggcactttcattggccgcacttcgcttccc

SEQ ID NO: 70514 - DNA, 75 bp, Heterodera glycines
  Genomic contig location: Contig_ID=SeqID_42689; Location=1267..1341; Strand=+
  SCN-specific regions: Sequence locations=1-75
cttaattcctcattttgctatttgagttaaatcccaaaaactcaatggaagctgcttcaagtttgaatgatttaa

SEQ ID NO: 70515 - DNA, 237 bp, Heterodera glycines
  Genomic contig location: Contig_ID=SeqID_42690; Location=69..305; Strand=+
  SCN-specific regions: Sequence locations=1-152,174-237
atggtcgctcagctggaggcactgcccgagagctggggcgaccggcgcacgctgctttggctgcgccaatacgaacagtttgatcgccgtaccgacaaattctggcgctcacttggcttcgccaagcaccgccaatacagtcccggctatgagaatttggcattttttctcgaccagttgggccatccgccggccatcaaaacggaagaggtcgcgcaaagcgttggtgatgccaag

SEQ ID NO: 70516 - DNA, 577 bp, Heterodera glycines
  Genomic contig location: Contig_ID=SeqID_9183; Location=905..1481; Strand=+
  SCN-specific regions: Sequence locations=1-90,113-390,422-577
  Gene Ontology: Mol. function=RNA binding; Cellular component =cytoplasm; Biological process=reproduction
atggtggcgaaggttttccttttgtatccaaatgcgacggttccaacgctaatcgaaaaattctttgtcacttattcgacatggtaagtcaaaataaatttattttaaaattgtaaaatgccaggaaatggccaatgccaattcaattggcacaaacggacttcactcagaagggcgaatttctgagttggacgccgggccgagaacacttcgtaaagaggcaattttcgccaagaccaatgctcagactgatccgacccgtcctggccatggctatcattaccccaacattccccgagcaaaacttggcacagaatgccaatctttccacccaaaagtgcctaagaaatcatatgacaaaaggtaaattatttgagaaaaaatagttcaattaaatcataaaaaattaattccatttttagctttggcaaaaatacgaaacggaaatgaccaacaaaaggcattgtttgctcctttggagtccaaaacatttctcactatggtggggcgtttgtttgttgttgagatatttgtgggcaaaattatggcgacgccaaaacaaattgggcacttttag

SEQ ID NO: 70517 - DNA, 380 bp, Heterodera glycines
  Genomic contig location: Contig_ID=SeqID_9183; Location=1690..2069; Strand=+
  SCN-specific regions: Sequence locations=1-76,98-103,168-260,282-380
atggatcaaattttgccatttgttccccgctcggatttcggtgggccaatgcaatgggccaaattcgcagaattctcagaaaaagtaaaaagaaatatgtatgataaatataaaatattggataaataaactcaaaaaatagaaaaataatataaaaataaaattaagcggctgtaataaaatttggctgattggaattgaaatgaacgaatcgccaaaggaaatgagcaaatttaagagcaaaataaaggcaaatctaaagaagaaatttgacgagaaaataagcaaagatttcggcggatattctgctcagattgaatcggaatatgtggacgaaaggggaagaattgagcaaatatttgggtaataataagaaaaaa

SEQ ID NO: 70518 - DNA, 376 bp, Heterodera glycines
  Genomic contig location: Contig_ID=SeqID_9183; Location=2739..3114; Strand=+
  SCN-specific regions: Sequence locations=1-219,241-310,332-376
atgaatattcgttccaatttcgtcctctttttcttcatcgttttaacactttttgcgctctctcgcggagttccgctcgacgaaggcgttgacgaggagggactgtaagagaaaccatttaaaagttcacgagaatatgccactccattaaatagatctgatttaaagcatttaggcaatggtaattatctgttgaacttttatatgcttttgcagtgatttgaagccggtgcctgcctcaaaagtgacggaccgtgccgaacgcatcgcgcgacgatgcgttcgatgtaagcggcacggatggggccgatggagcagctcaaattggggctggggctgatcagcattaacggaaattgagaatgtggaagtgaca

SEQ ID NO: 70519 - DNA, 124 bp, Heterodera glycines
  Genomic contig location: Contig_ID=SeqID_42692; Location=1095..1218; Strand=-
  SCN-specific regions: Sequence locations=1-124
ctgttcacttccgcccacctgccaatccaattggctgttctcagttagccgtttcccccaacgtcgtcgcgcccatccatccgttcactacacaaccaacaaaactcaacccatcccgcactcc

SEQ ID NO: 70520 - DNA, 233 bp, Heterodera glycines
  Genomic contig location: Contig_ID=SeqID_42693; Location=135..367; Strand=-
  SCN-specific regions: Sequence locations=1-74,103-233
atggctaaaagtgacaaatttagtttaaaaatgaaaaaactaaaaacaaatcattcatcggcctctgctggtgatcattaattaattaattagttaaacaaacaaaacgacgtgcagacagacagaatgagaaatgtgcaaatgcataattaagggagaaaattatcaacacggaaggagggtttagttgggtaattgggtacattttcggtgattaattattttcgattaaa

SEQ ID NO: 70521 - DNA, 363 bp, Heterodera glycines
  Genomic contig location: Contig_ID=SeqID_42698; Location=286..648; Strand=+
  SCN-specific regions: Sequence locations=1-24,46-71,93-155,182-363
atgattacgacaccaaacaaaatgattaagcaaggtaactaattactaaaattagctaaaactttttaaataatcagctgatcagagtgaacaatcagttttttgtctcttaccgagtttttacgcgaaaaatactgcacatttgggctgatctgatcatcgtcctcctcctcttcgtcattctcttcctgatcagaacggacggcaccgccaagcggcactccccgtcgtcggttggcatcgtttgtgtgctgttcccctgccaaatacacacgagtcactgtggcagctgatgctcggcctaattagtttttggaataggtaattagcaaataattaatagtgatttgacattcaagaaaa

SEQ ID NO: 70522 - DNA, 872 bp, Heterodera glycines
  Genomic contig location: Contig_ID=SeqID_42699; Location=148..1019; Strand=+
  SCN-specific regions: Sequence locations=1-872
atggacggcacaactccaattggcagtcgacaaacccttgtcgaacagttcaacaaagttattgctgcttttcttacaatcctcactttaattctaaggatcccgatctttttgtgtttttattgacgacaaaagtcggtggacttggcataaatttgaccggagcgaatcgcgttttgatttttgaccccgattggaacccgtccacagatgctcaagtcgatttgctcaattttacaaattaattttccttatttttttggtcttaggcccgtgagaggtcctggcgaattggacagcatagggcggtcacaatttacagactgtgcgttacaaaattattgcccaattaaacaattaattaaggttgacaagcggaacgatagaagagaaaatttaccaacggtgttgtttttcatcggttttcgttaattaatataaatttattcgtttaattattacctttaaggcaaatattcaaacactttttggccaatcgcattttggacaacccaaaacagcaacggttcttcaaaaccaacgaattgcacgaattgttcaccctgggctcgtcaaaaagcgaccggaagtatggcacaggtaaaacaatctgtaaaaatctcatcaatttcactcccaaattttagaaacggcggttatttttgccgccaacggaagcgaagtgagcagaaaaaagttgaagaataacatggataaaagaagggatgaaaaggaggcggagaacaaagcgaaagtggcggaacggacggacgacggcggaaaaatgccctcggctgattttaatgacagtgcactttcggacgaggcccgggaaaggcttaaaatggtcgccaaacgattagcggcgtaaa

SEQ ID NO: 70523 - DNA, 284 bp, Heterodera glycines; identical to SEQ ID NO: 62736
  Genomic contig location: Contig_ID=SeqID_42700; Location=354..637; Strand=-
  SCN-specific regions: Sequence locations=1-153,196-284

SEQ ID NO: 70524 - DNA, 171 bp, Heterodera glycines
  Genomic contig location: Contig_ID=SeqID_42700; Location=550..720; Strand=+
  SCN-specific regions: Sequence locations=1-86,116-171
gctgtaaaaaaaatttggggcgatttgaaagagaatagaaagaaccaggttcgatgaagttttggtaagccaaaaaaaatgcaaacatttaaaaatctataaaaaatttaaaaatgagaattcatgcgagattttctggaaataagcttaattgggccttgttaagctgta

SEQ ID NO: 70525 - DNA, 277 bp, Heterodera glycines
  misc_feature (4)..(5): n is a, c, g, or t
  Genomic contig location: Contig_ID=SeqID_42700; Location=1258..1534; Strand=-
  SCN-specific regions: Sequence locations=1-77,99-138,161-277
  Gene Ontology: Cellular component=26S proteasome
aatnntagcattggatataattgccgcaaataaattgcaatcttaccggaaagccaatgatttggttggtttgctttaacattgtaaagtgcaaaatgctaactaacttatgtatttgtatttcattcttacttagtgttgacaattcggaatggatgcgaaatggcgatcttccgcccaccagattcaattgtcagcaggaggccgttcgcgcacttattcatcttaaattgagaagtaaccctgaaaatgctgttggccttctttcgttggcgga

SEQ ID NO: 70526 - DNA, 737 bp, Heterodera glycines
  Genomic contig location: Contig_ID=SeqID_42701; Location=207..943; Strand=-
  SCN-specific regions: Sequence locations=1-168,216-267,289-561,584 -584,606-737
atgcgcagtacactcaaagaaatattctcaatttattcggtggacagttttttgggctctccaaaaaaaggagtgcttgacttccaaattgtaatttggcattttatggacgtcgtcgaaaatgcatttagacacataaaagaaatggaagtaactaactttttaagcaaataaataataattgaaatattaattaaaaatatttttttaatttacctaaactttcgttttttacatttttatttttcaagctttttgacggaaaattggaagaaatcagaacaaaatttgaaaaggaatgggaagaattaacggaaaaatggcaaataaacgaagatttcaaattcaatgtcaaaatttgtcttctgcatggatttacgcaccgaattatacggcacgaaacactgaacgggcacagcgagtgggcaacatatgccaagtcggtgtccaatggcattttcagcatcgaaggcggacccgaatttgacagtgtaagtacggttggtatgtacagtacagggggatactaccgtaatgcatacaaaatgggcgaataagctaaaaagaaataatagaatttttcctaaaaaatggtaaatttatgtcaaaaatattccaaaacttttgggttttaggcagttttttcgcaaaaaattcatgaatatttgtattttttctgaaattattttaataccgtattgaaccatttgaaataattttttactaaatttaataaa

SEQ ID NO: 70527 - DNA, 291 bp, Heterodera glycines
  Genomic contig location: Contig_ID=SeqID_42701; Location=1124..1414; Strand=-
  SCN-specific regions: Sequence locations=1-242,264-291
atgcaatccgttggacttcttctgtttccattgtttattttcattgcattattaatcattgctgctgtcacacaaaatgaggtacaataattagcggtgaatatttaaaaaatgaattaatcaaattttcgaaaatttattttattcacagaaaaaaattctcgaatgcccaagagaagaagcgcccattgagcaattaagggaactggataagaacaaattgccggataaaggtgaaattgaaagaccaaagaccaaattttgccattagaacaatccccaaaaaataaa

SEQ ID NO: 70528 - DNA, 844 bp, Heterodera glycines
  Genomic contig location: Contig_ID=SeqID_9185; Location=10..853; Strand=-
  SCN-specific regions: Sequence locations=1-128,152-666,689-844
atgtcgaaagcaagggcacacgagaaatatttgccccaattcagctcatccacgtgttcaatcacacgtcgtggtttcgactttcagtgtgaatggtgcgaccaaagaatggatatggatttcattacaagtcaatggccaccagatcaaacttgcagcccattcgtgttcacatttgtcgatcatacagcttccggtttggcaaagtttgggtgaaccgaggttggaaaaagttggtaaattatgggttccttttcgggccacaaattgaagttgttgggaagtttcaagtgtgacgttctgttcagaggagtcacaatgcggcttgaactttcagtggcagacaccgaagcgccgagcatcatgggattggattggatcatccctttcgagcgtgccacccaacagccaattgccacgactttggagcagcagtcgctcattgtcaacagtgtgcaaccaacaaatgatccggtcaaattggaggggcaaatcaaggcttccttcccgaaggtgtttcaacctggcctcggacattgtgtgaagacgaaggccacgctgcatttgaagcaaaatgtgaagccagtgctctgccgtgcgcgacctgtgccgcatggagttcaagcagcagtcgacgaagaattggaccgacttttggactcgggagtgctgaagcccattgatttttcgcgctgggcagctcccgttttggcagttcgtaagaaaagtggtaatgtgcggatttgcattgacttttctacgggactaaacgatgcgctggagttgaacaggcatccccttccgcggaccgaagacatttttcatgctctgcgtggagcccaaa

SEQ ID NO: 70529 - DNA, 1261 bp, Heterodera glycines
  Genomic contig location: Contig_ID=SeqID_9187; Location=924..2184; Strand=+
  SCN-specific regions: Sequence locations=1-117,139-1047,1070-1261
atgataattcgttcaccgcgtagaaatccatttccaaggcgtttggctggagaaaatccagagcaacggaggaatgagaacaatttagaaaacgaagcaaatgcattcgtttttccagaacagaacgaaggaaacaatccgcaaaacagccgaaacaaccagcattcacgacaaatgatgggagaggaagaaattcaccgcgcacttttggacgtgaatggtcagcagaacgagcagaaccaacagctcaacgcagacgaggagcaccgccttttggatcaaagtaatttgaatgtgctggcaaatttgggtggaaatttcgacgcaaatttgggaaacaatcggcaaactgaagttgctgcaaatatggcgcagcgtcaaaacaattttgtgacgtccacgcccaacattagtcccggtcaccaggcgcgacaaaattttaattttgttaacaaccgcgttaacaggcgcgttgtagataggcctagggatgcactcggacgttttattcgtattgaaaataacaatgagcaagaaatgccaaattttttgcaaaatccaccgcggaacccgcaaattccgccagtaaatcagcagcagggtaacaatttgggaaatttcggaatcccaaacaaccccaatctcatgcaaccgttacaattcggtatgaacggcatgtatgcgccagtcgcttggcctcaacaaccgatgatggcttatccaccaccaaattttcaaatgttttgtccgccaaattttgttccacaaatgccggttcaaaattttgtgccatttatgaataatttggcaccaaatgcgtttcaaccacaaattcctcaaaacgcaattcaaccaatgagagctcagccaacaaatgttgtgcaacaacagcaaaatccgccgctgacaaatcaggcgatagcacaacacaaccctcagcaggaggtgatccggcaaccaacagggttaagtggcattgaatatgctatgatcctggacaggctgcccgacattaaaggaaacgagggaagtgattcgatccgcaactttttcaaaaaattttcacaatatacgagtgaatggccaaacaaaaagcgaatcgaatcattagaagccaaattgagtggccgagccgaacgtgcctacaatgctgctttagcgacagagccgttcgcgtacgaaaacatcaaacgaaacattttgcagcagttggaagaaacggattgtagggagatgagtgcttttgacgacctcatgaacg

SEQ ID NO: 70530 - DNA, 468 bp, Heterodera glycines
  Genomic contig location: Contig_ID=SeqID_42702; Location=168..635; Strand=+
  SCN-specific regions: Sequence locations=1-105,127-143,165-386,409-468
atgctgaagaaactgcgcaaccggggccacgaggaccacgaaatacacgaacaaatccacgaattttacgaagtgtccccggaagaagtgaaagcaactgccagaggaattctccagagaggctgcgaatccatcttcaaagtgtgtgagggaagagagaaagacgaaaagaatgacaagagagactaattaattaataggttaagcaattaattattgacattgattaagcgtatctttggagaatacaaagcggaggaaataatccaggtaattagagatttaatttaatgagtgtcgatgacgtcaattgtttcatttgattgtttgaagatgcgcgacgaaggagcatccaatgttgaaattgaggagaaaatcacagaggcactgaaccaaattcgaagtccgcagaagcgacaggaggccggccgatttgcgatgtcatgtcgccgaatattcgcaatgatt

SEQ ID NO: 70531 - DNA, 689 bp, Heterodera glycines
  Genomic contig location: Contig_ID=SeqID_42703; Location=269..957; Strand=-
  SCN-specific regions: Sequence locations=1-24,46-425,447-689
atgaagcgacttaataaatcgattatggatttgcaagagttaatttctcaactcacactagctaacacggaatttgccgagtgtaggcgtaaaatgagccattatgaattacaagcgtatatcttggtccacattgagtgtgtgggcgaggttaagtaattttctgaaagagctcaaaagcagctttcgaatggtgtattcaattaattgtttacttgaaaattcacagagatatgtccaaccgaatcttgaaatgaataatggcgtagtattctataaaaaaaaatttttcttaggaattttacagtgcccagggatttgaattatccataaacacatcatagggtaaatatctagcaaaaacaaattttttttacacaaaatcctagtccagcaaacagatgaagcgacttaataaatcgattatggatttgcaagagttaatttctcaactcacactagctaacacggaatttgccgagtgtaggcaaattcacagagatatgtccaaccgaatcttgaaatgaataatggcgtagtattctataaaaaaaaatttttcttaggaattttacagtgcccagggatttgaattatccataaacacatcatagggtaaatatctagcaaaaacaaattttttttacacaaaatcctagtccagcaaacagatgaagcgacttaataaa

SEQ ID NO: 70532 - DNA, 202 bp, Heterodera glycines
  Genomic contig location: Contig_ID=SeqID_42704; Location=571..772; Strand=+
  SCN-specific regions: Sequence locations=1-46
ctataaaagggggggtcaaacatgccaaaatcacgttcatttcccaattggcccccaatcgccggacacaaaaacccacccgaaaatgttccatttggccgccatcgttgcgctagcggcgctcgcactgcccctggcatcttcagacaagttcagaccatgcctcgagggctacgcacaatacggcaaatactgctacaag

SEQ ID NO: 70533 - DNA, 98 bp, Heterodera glycines
  Genomic contig location: Contig_ID=SeqID_42705; Location=895..992; Strand=+
  SCN-specific regions: Sequence locations=1-41,64-68,90-98
taccgtatttgctctaattaaggcccctgggggattatttttcaacctcctcagaaagggggacataattggagacagggcctttaaaggagacgggg

SEQ ID NO: 70534 - DNA, 1154 bp, Heterodera glycines
  Genomic contig location: Contig_ID=SeqID_42708; Location=270..1423; Strand=+
  SCN-specific regions: Sequence locations=1-80,116-239,294-387,411 -458,482-572,602-716,738-1124,1146-1154
atggctttcgatttaaaaatttatcttcatctatttatttcatttacttttgttggactgatcactgaggtaagtcagtgaatttttttttttttgatttaaaaaatattttttagccttaattttattcatcaattttcaggcttccatcaaagttgttccgatcagttatttgatcaaatttaatggaattgatcatccacaaccacaatatttgtcatacacaaataaacaaaatgtaaatttatatacatataaaatttactttatattttaaataatcattttaaattcaggtgcctaaaaatgaaaacaacaattataaaatggacaattccgtggtaaaactctcgccgaagttgaaggatgatacatgggacaaaaaggtaaaaaaattaaaatttttaattgaattcattaatttggatataattttaggaaaacaatggaatggtggtgcaacaacaaaaaataacgaaaaattttgctccaacaaccaaattaaatgatcaacaaaaagtgctaactcaaaaagatgatcagaggccgccgactttgtggacaatgtccagtttaaaacaaaaatttttaaaaataaaccgattattttaactgcatttcaacaacagcaaaaaagtgaacaaaatccgccagtcaatccaaattatattcaacaaaatcagtaccagtccactaaactgtttgatcaaaatcaatcccaaacaacttctccaacactgatccaaccaattcagtatcaaccggcggttcaaaaacagctccaactaactcagtaccgacctaattatccacatcaatttctgccaaatcagtatcagccggattcaatctctccaaatcaatttcatccaccagcagatttgcttcaacaaaaacaggatcagcagctggctacacataatcaataccaagcggacaagtctcagccggcggcgtcgccaaaccagtttcagcaagctcagtaccagtcgtctgtgccaagccaaattttcaaggagatgcgaacaaataccccaatctgcggatcaaagcaagaaaatcattccgcaatcggttggctctccagcaggcggaggaagaaacagcaaattcacgccatggaatgtgcacagctactactacacaagctatga

SEQ ID NO: 70535 - DNA, 388 bp, Heterodera glycines
  Genomic contig location: Contig_ID=SeqID_42709; Location=410..797; Strand=-
  SCN-specific regions: Sequence locations=1-20,42-275,297-388
atgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaacgtatggaaagaaaaaatagttatttctgggactttttcagaaatcagaattaattctccaatgtggcccaaattttaggcccccagccacagacccttgcttctcccagttttaagtcttggatttgtcaaataaa

SEQ ID NO: 70536 - DNA, 153 bp, Heterodera glycines
  Genomic contig location: Contig_ID=SeqID_42710; Location=1006..1158; Strand=+
  SCN-specific regions: Sequence locations=1-57,85-153
atgtacggtaatatgggtcccctgtcgcttcccatcacttttttatcgcttttgctgttggcggtattttgccattctgaggatcgtaccgttggtggtgaagagcctgaggaaaagctgccctacaaacagtatttcagtgaacaaaaatat

SEQ ID NO: 70537 - DNA, 294 bp, Heterodera glycines
  Genomic contig location: Contig_ID=SeqID_9188; Location=193..486; Strand=-
  SCN-specific regions: Sequence locations=1-294
atggaaaaggaaaaggcaaaagggacaaaaggaaaaagccaaaaggaaatgccaaaaaggacaaatgaaaaaggaaaagccaaaaggaaatgccaaaagggacaaatgaaaaaggaaaagccaaaaggaaatgccaaaaggaaatgccagaaggaaaagccaaaaggaaatgccaaaagggacaaaagtaaaaccggacaaatggaaaataaattaagcagacgaaaactagcctgttccgaccgtttgatcttctcgtacagtttggcgtggtgcaacgcgagaccacaataa

SEQ ID NO: 70538 - DNA, 696 bp, Heterodera glycines
  Genomic contig location: Contig_ID=SeqID_9188; Location=89..784; Strand=+
  SCN-specific regions: Sequence locations=1-228,424-424,446-696
  Gene Ontology: Mol. function=cyclic-nucleotide phosphodiesterase activity
atgtccgttcaattcagtgtgatcggagtcgtccaaatggtcaacaaacgcagcggagtggcattcactcaaatcgacgaagaagcctttgaaacattcgctatttattgtggtctcgcgttgcaccacgccaaactgtacgagaagatcaaacggtcggaacaggctagttttcgtctgcttaatttattttccatttgtccggttttacttttgtcccttttggcatttccttttggcttttccttctggcatttccttttggcatttccttttggcttttcctttttcatttgtcccttttggcatttccttttggcttttcctttttcatttgtcctttttggcatttccttttggctttttccttttgtcccttttgccttttccttttccattggtttcttttggcattttctttctgaattttcccatttgttttttcaattcagaaatatcgcgttgccctggaggtgttggcttaccacagcgtgtgtaaccgtgacgagttgaacaagctgaagaaggtgaagctgcgcgacaaaatccccgagttggacctgtaatgaatcaatgcccccccttcccaaatgcgtttggtttgttcagtttcgagttcaacggaaaccgtttgtccgagttggagaagccgttgtacgccgtttacatgttcagaactctgttcgacggagtgat

SEQ ID NO: 70539 - DNA, 517 bp, Heterodera glycines
  Genomic contig location: Contig_ID=SeqID_9189; Location=1..517; Strand=+
  SCN-specific regions: Sequence locations=1-413,435-460,486-517
  Gene Ontology: Mol. function=cyclic-nucleotide phosphodiesterase activity; Biological process=signal transduction
ttgaataaatcccaaattaataggaaattcatgcccatttccaaattaggacgggcacaacgttctaaaatcgctgagctcgtccgattacaaaagagctttgagcacaattcggcactgcattttggccaccgatttggcacttttcttcccgaacaaaggccaactcagtgccatcgtcaaagaaggcattttcagttgggaagacgacaaacacaggcaaaagagaaatgctttaaaggtgcagaagagtttgtttggttttcaggtgcctcgtccaggccattctgatgacggcttgcgatttgatagcaacagcaaagccatggcaagtgcaaacggagacggtcaaagtgatcttcgaagagttttacgagcaagtcggtgaagggagtcaaacacagccaaatgatggcaatttgttggaaagggcgacgccgagcgactgaacgggcgcgaacccatcccaatgatggaccggaacagggcacatgaactgccgcagatgcaggtgaaa

SEQ ID NO: 70540 - DNA, 1119 bp, Heterodera glycines
  Genomic contig location: Contig_ID=SeqID_9189; Location=1852..2970; Strand=+
  SCN-specific regions: Sequence locations=1-116,138-278,300-978,1001 -1119
  Gene Ontology: Mol. function=adhesive extracellular matrix constituent activity; Cellular component=collagen type XI; Biological process=cell-cell adhesion
atggccaaactgcaaatagaacaaaagcatcagcacaaattctatatggacatggtaaatcattcctaatgaaatggtgacaacgattaaagcaatatttttttaaagacagtgaaaatgtggcatgacattttgcagcaaaatgaggcgacacacgacaataccggcattttgatgagacaacgaaggcaatgttagtagcaatcattgctcaacattgctaataatgcataagctaaatgctttaagccaaaccgacaaattcgccgcaatgtgcgcaagggccaaagggaatgcccggaattccgggagagccaggtaattaacaaagtgaagaaaaacaccaaattacttctaaggccaagatggtcttcccggggttcaggggcagccgggaaatgcggcggttggcgggggatcgggcggagggtacggcgaaggagcgtcgccatcgcaatgtgtcccctggtgggggaggggggtggaggtgccttttcaaaggactttccaatttagcccgtcaggccctcccggaccgccggggtacaaaggcaaacgcggacagcgaggggaaaagggcggcaaaggtaaaggacaaaaaagtcattcgtaattgcatcatttgaaggaacccccggggcacccggaagagacggacaaattggtgagtgaaacaattagaaattgagttgaatgtttggcaaattgaaggtgatgaggggcccgagggggagatcggattgccaggggacattggccaaatggggccgaagggcgcgccgggtgaggacggcgtcggatacgcaaaaggagcccagggaccaaaaggcgaattaggcgccccgggagccgctggggaggagggaccgccgggggaaagaggcgaagacgcgtcgccaggtgagtacggacggagacttcagagagaataagcgcgatgcaattcaggcccgccaggagagttgggcccccagggacggcccggggaaaagggcaaaaacggagagacgggggcaacggggatcgccggaccaccaggcaagtggaagtgccgatgggacggatcaccaggagaccatttgaaggcaaagacgcggaatactgtccatatccggaacg

SEQ ID NO: 70541 - DNA, 1796 bp, Heterodera glycines
  Genomic contig location: Contig_ID=SeqID_9190; Location=329..2124; Strand=-
  SCN-specific regions: Sequence locations=1-868,890-1010,1033 -1248,1270-1350,1373-1796
  Gene Ontology: Mol. function=ATP binding; Cellular component=nucleus; Biological process=base-excision repair
cgataggaggggggtccccaaatgggcgccatggaacacaaacggaccaactcaaacaccgaaaacatacaataattttgaaatttgcttttcattccgattaatgagggattgaagccatgataatcccagcatttttagcttttggggcctacgcgttaaaaaacatgtttttcagccctatttgcttttttgggctgccccaggtttgtccggttgttggcgctagagctcctcgagagtcaaaattccgagactcgagaccgaggtttctagagcagccctaattggcggattggcggcaatctttttggggacggtccaattttaatggaatccaaaaagcccatggaaatatgtcaaggcaaaatcaccaaagagcagctccgttttgggtacgaagcattgggccgcattgagcgccacgtgcaaaaagggactttcggcagagactttgtggaggcaatgaatgagtgaggaaaagcaaagaaaatgggggggggaaaccccacgaaaatccaaaaaaaaaccaaaatgggcctaacagttgatcctccgccgttatgtttacccgggttatttagtgcccctctctttcagttattacacgcgcattccgcacagttttgggatgcgaacgccgccgccaattaaatcgccggaggaattgaagcgggaaaacgaactgttggaaatgctaacgggcgagtttttacaaaagatgtcattttcaggccaaacccgcttttaaggcatcgaaattaccgtttcaaacattggcgccgaccctttggaatgccattacgcgcgtttgcgatgggatttgattcccctggaaaaagatgatgcgaattacaaagtgaaatggaatttaacacaaaaactaaaagaattaacccccaaagattgtggaggagtatttgcaagggacgcacgggccaacgcacgacaaatatcggatgaaagtgcgaaatatttttgaattgagcgtcaaagggacggcggacgacggggaaaaaagaaagggtgccgaagaaaaacggaaaagcgcaaataatgacaaagggaaaggggaaacgcgaaagacgcaaaatgagcaaaagggcagaattggcaaccgaaagttgctttggcacggtactgaccaaagagggattgaaacgttttcgaaggcattgtccgccctttaagggtctcgcctcgccaattggtacagcattttggccaagggattgcgaatcgcaccccccgaggcgccgtcggtgagagagaggcgcaaattaccaattaatcatgcaaatctaattaagaccggctttatgttcggaaaggggctttactttgcaggtgctctttttgctttttcccttttcatcccattgaagacatttcgagtaaatcggccaattattctctctctgatccgaaaaagcccggctttcttttgctttccgccgtcgcccttggggaggcggtcgaactgaaagaggccgactcgaaaatgcatcaaaaattgccgaagggaaagaacagcgtgaggggagtcgggcattatgtgccgcatccaaacggaaggaaaacgatgtgagccaaagacgaacacaacaatcatttatggggaatcagaattggcatttaagtgacggagatgttgaagtgccctgtggaaaaccaattaaaaacaccgaagcggacgacgaaacttcgcttatttacaacgaattcgttgtgtatagcctcggtatttattattggtcggatcggtgctttctctgtttaattaaagccgtttaaga

SEQ ID NO: 70542 - DNA, 629 bp, Heterodera glycines
  Genomic contig location: Contig_ID=SeqID_9191; Location=230..858; Strand=-
  SCN-specific regions: Sequence locations=1-367,396-458,480-629
  Gene Ontology: Mol. function=ATP binding; Cellular component=nucleus; Biological process=base-excision repair
gaaatggagcagaaaacgacaaaaacaaaacggcgaaagaaagagaaagacacagaaaatggaggaacaaatcgggaaaagccaaaggacagtgaaaaggaaaatttggatggacgcatttcgaagagaaacaaaatgcaatcggaggaggcgacggtggacgccgaatgtgccgaattgcgggggaatgccaaagtgttcgtcgatgggaagggccgttgctacgacgtaatgctcagccaaacgaacattcagcagaacaacaacaaattctatctgatccaattgctgtgcaaccaaacggcggccaacaaattttgggtttggtttcggtggggccgcgtcggattcaaagtgatttttggaggaaataataaaggaaattcttttcattgtcagggacagacgaatttggtgccttttgggacggactttgacggagcgttggaattatttcacagaaaattcactgacaaagtaagcgaatccgtccttttgctcttttccttttacatgcaattaatttcagacgcaaaatgatttcctaacggacattaaaaagttcaaaaaagtcgccggcaaatacgacctaatcaaaattgaccactcgcgagaagtgacgacggaaa

SEQ ID NO: 70543 - DNA, 551 bp, Heterodera glycines
  Genomic contig location: Contig_ID=SeqID_42714; Location=399..949; Strand=-
  SCN-specific regions: Sequence locations=1-350,386-444,467-551
atggcgacgagtccccatcaacaatggcactatgatcgaggcgctttgctgtcatccacgatgccgggtacggcggaatgcggtcgccatgtgccgcaacagcagcgtgatgacaccacttactactggccccatccgcagggggagacggaccgtgaccgcttcggcgggcgcggcgccggtgccagcgacaatgccgccgcgtcagcggcactgcgacgccagcagagacagcagcaacgtcatcgcagtcgcctggcgcgtttcctgcacaccgacgcggcggaatgggaacgacatttgcgcgagcgacagttgcagcaggagttgaacatgcgcagaacggtggtacaacaacaaaaacagcagcaacagcaacaacaacggagtcgcatgcgaaacgacggcgacgcggggcccaacgaaatgtttcctcaacagtatcagcagcagccgcaacagcagcttcagcctgtggacggctccgctgggcatgaacagtttgcctacaatagtcaacaacagccatggccaacagcggcgccggcatg

SEQ ID NO: 70544 - DNA, 112 bp, Heterodera glycines
  Genomic contig location: Contig_ID=SeqID_42715; Location=23..134; Strand=-
  SCN-specific regions: Sequence locations=1-9,34-112
atggcaccgtcttcctcctctgccgccgccgccatgacaccactcggcgtcattttggtgtccaaggacgagtcggccgagcgcgtgctgttcatgtacccatttgagcgcc

SEQ ID NO: 70545 - DNA, 75 bp, Heterodera glycines
  Genomic contig location: Contig_ID=SeqID_42720; Location=134..208; Strand=-
  SCN-specific regions: Sequence locations=1-75
taaagaaaaaagataatgtttttctctggcactctctatttattggtacacatctcgttttttcggacggtgtgt

SEQ ID NO: 70546 - DNA, 418 bp, Heterodera glycines; identical to SEQ ID NO: 53014
  Genomic contig location: Contig_ID=SeqID_42721; Location=91..508; Strand=+
  SCN-specific regions: Sequence locations=1-2,30-32,155-206,236 -236,320-325,358-418

SEQ ID NO: 70547 - DNA, 81 bp, Heterodera glycines; identical to SEQ ID NO: 58971
  Genomic contig location: Contig_ID=SeqID_42721; Location=672..752; Strand=-
  SCN-specific regions: Sequence locations=1-13,47-81

SEQ ID NO: 70548 - DNA, 225 bp, Heterodera glycines
  Genomic contig location: Contig_ID=SeqID_1242; Location=1366..1590; Strand=+
  SCN-specific regions: Sequence locations=1-225
agtcggcctcggcaagaatccatccgcaccacattctgttcctttatgatgtaccgttgcggacgttttctgcttttctgaagatgttctgcgcgtccgatgtccagctgtttgtcgatgtcccttgtgaatgcagtaatgaagtcactcaatgatgggtgatggttgagctcacgctgaaataccaaaattaatgtttttctaaagtatatgttgtacagcgaa

SEQ ID NO: 70549 - DNA, 1442 bp, Heterodera glycines
  Genomic contig location: Contig_ID=SeqID_1243; Location=2982..4423; Strand=+
  SCN-specific regions: Sequence locations=1-852,887-1442
atgtttgtttttgaattccgttctctctgcccactcactgaaactctgattggtgatttcgtggtgccacaaattgatgcgcaaatcgtccgccgagatgaacgtctcctggtccgagttgatgcttatcgaattgatgtggtaagtgtgcgcgttggcgtacacgcggcggggcgacgcttcgacgattaattccatgggcaccaatttgggcagtttcaaaggcatggcacggttgaggaacctcaaaaggcaacataagcacttgaaaacagacagtttaatactgatctaactaatttctcccttcgattaaattttacctccgcgatccgtcgtcacaccgcaaattgtacccgccttccgtcatttttcgttcacgctcagaaatcttccacaattttaccgttttatctgcggaaaaagaaaataattttgaggtgaaaaaatgcgtgggatttgaaacatttgaaagggaaatatgtcaaaatattaaagggcattaaaaatgtctcagccgaataaaattcaaaattaaaaaaacaccattggttgagatgatgaaattggccgcgttctttttcttcatccatttgatttggttgattttctcctcgatttccagcgacttcaaataatcaaattcgggctcatgtgattggaaagttgagtacacattgtactcggaagtgcggacgccgttcagaaacactccctgaaaaggggacaaatcagaagcaaattgaaatggaattgacaaacgctttggtcccgttgaaagatcaccactcgtccgcctttgtcaccggtagcgagcagttcaccatctgtgcgagaaaaacgcaaaagtttttgtatttatttaaaacaaaacaaagaaaacgaaccgtgagaaaactcaacgcacgaaattatgtcagctgaaattaataatgcttttattaatctgttaaaacgtttaaaactaaaagacaattggggggataaagccaaagataaagcaaaaatagaaaaaagtaaacggaaatgaatgaaaagtgaaaagaaaagaaacacgaacagcatggatttacaacttttgttttggatttaccaatccaatcgtattgaaaagttaatttattcactaaaaattgtaaaaaaaaccgtcggttggcgcctcgcccgtctcaatgtttccctttatttgggagaagcgccagtggagttcgtcgccgccaccgctgctgacttcgaaggcggtgccgcaaaacggcggtggagttgccgaggaagaagctggcacatccattttcacaaaatgtagaaattccgcagaatttataacaagtggcgcgccttttttagttcaagccaaatttaggtgcactttttaaaaatttgcgaatagctgacaaaacaaatgaaattagaaaagaccgaaaatatgtaaatggaaatta

SEQ ID NO: 70550 - DNA, 108 bp, Heterodera glycines
  Genomic contig location: Contig_ID=SeqID_1244; Location=658..765; Strand=+
  SCN-specific regions: Sequence locations=1-108
tatggcacggaaagacttccgatttccgacatttttggggtcggaattccgacttccgaaatttttgatgaaaagtcggaaattttttgaatttaattgaaatttttt

SEQ ID NO: 70551 - DNA, 825 bp, Heterodera glycines
  Genomic contig location: Contig_ID=SeqID_9192; Location=303..1127; Strand=+
  SCN-specific regions: Sequence locations=1-126,160-166,208-596,618 -790,812-825
atggcaataaaattggaatttgccggagggcttgacgcaatttttaatgggaaacgcgagaccgaagctgaaaatgacaatatttcggtattattttttatctttgtgctttcataattctgcttcataattacataaattttaatttttaaaatttttctacgtgtgttaaataaaatttcaaattttattcattttgtcctttttcggactgttcgtcaattgttgcggtggctttcggacgggcccttgcggggcaatgatcggtcggaaatgctcatccaacgcgacaccgtcagaccgggcgttttggtgctgatcaacgacacggactgggaaattctgggcggagtatggcaaaaaataaaaacgaaagaaaattgtgcactcatttggtgtacatattttgtaaaaattcgggaatttagtttttttttttaaagtaatatttggccttattgcacagcgaaaatttgattttgttagggttcggacgaatgacgcgatttggcattcttttgactcaccattaaaaatggtcttttagtaaaaaaaaaaaattaagatggttaacccaattttcccaatattccttaccaaaaagggcaaaattttataaattttcatttgaatttaattgtttttgaaaatgcaatttttgccgtcttttttcagttggacgctcagctcaacggcggagacaaagtgacattcatttcgactttacacggcggataaaacagcaaaataattgaaaaataattcattcgttttttgtccatttttgcagaagcataaattataatttttaatcatttttcacta

SEQ ID NO: 70552 - DNA, 2561 bp, Heterodera glycines
  Genomic contig location: Contig_ID=SeqID_9192; Location=3860..6420; Strand=-
  SCN-specific regions: Sequence locations=1-79,113-1278,1313-1553,1588- 1769,1792-1818,1840-1895,1918-1964,1986-2190,2212-2326,2368-2398,2420- 2434,2456-2466,2488-2561
atggtagaactaagaagtgattttgtgttacaatttgcagattatcaacgaactgtcgcctcaagtggttcggtgtatcaaagatcagaatgggaatcatgttgtgcaaaaggtaaatggttctttcaaaatggagcagtcccccccccccccaaaaaaaggggaatgaactgctcccattttaaatgcattgtccacttttgtatgaaaaaataaatgccattttcagataatcgagcgtgttcagccgcaccagctgcagtttatcatcgacacgatggtcaacggttttacggactcggtgagtttgccgttggccagttttcttttgcaatctgttcgtttttcgtcaggtcacttccctctccgtccatccgtacggctgtcgtgtcatccaacgtgtgcttgaacactgcacggagggacaaaaacggcctgtgctggaacaactgcatgagaatgtgctcactttggtcaccgatcaggtgagaaaagcgtggagggactttaaatgatcaatccaaaaagacatttgatcaatcataatgaaaggggggaagttatcgaattggtaaaaaggttgcaatcgtcgcactttccccctttctcaagtacggcaattacgtgatccaacacgtgattgagcacggactgtttgacgatcgggagcgcattgtgcgcgctttgcatggagacatcctgaaatatgcacagcacaaattcgcctccaatgtcatcgaaaagtgtctcatttgcgggacgacagacccaaagaatgcgctgatcgacgaagtttgtgcggagtgagttttcctctctatttctcaattgtcatttgtctgttttgaatgcctaatttggcctttctccgtttcagcaacggttcttccaaccacccctcttggagatgatgaaggaccctttcgccaattacgtcgtgcaaaaaatgctggacgtcgcggactcgacccatcgcaagaagatgatgtttgccatcaaaggacacattccggcactgcgccgtttcaactacgggaagcacattatcagtacggtctttttatcttttttatgtccatttgtgcataataaagtgttcttatttcatacttttcagcgaagttggagaagtacttccaaaaggtgaccaccaactccagtccgatgaccacccaccagcagtccatgaacaatggcaacggcacttcgtccgttgcctccggcattgacgcatcgacgcccacgccgtcgcctgctgtgagtccgagtgggagcagcaacaacggcgccaaaaacaacggcagcagcagcaacgggtcctgcacgatgacgtcgagtgcgtcgcacaaccaccattggatgtcgttggcaccgcccaccgaaccgcccatttactgatgatcagtgagaaaggagcagggagggaaaaggggcgagagtgtgtgtgaaatggggagagcggagggacagagagagcggctatttggaaaagacaaaattgacagtctttgatatattgttacagtttgatatattattattacagtcgaatgtatattatattattatttttattatcattatttaccttttgatgggagcccaacgcccaattgttttttgtaatgtttcgttttgtgttgtcaaggaatggaaatgcccgaattttcttctccattgtttttgttgttgataaatcctctgaattttgcacttctctcgggcaaagtcattatcatttgtaccattataacaaacaaattgggcaaattcccaaaatttaaattttgtaagggttttccatgaaattgactgatttttctcatttgttttcttctacacatccaatattctcaaaagttgccaaaactcatccacgcaaaaaacactcaccacaaatgaaaatgcttttttgtggcttcatcactatcattatcaccatcgttgtatcctccaaatcccttccctccatccttacacatttccatcctccatcaactgccgttttgttaaaaacatataaaaaatttttgtctaccacctccgaaaacattgcacctctgatgagccttattttcgacacaatcatcaaaattctatagcttaattagaaagaggtgtacatactcatataaataccatatttaaatatttgttttatcaatcaaatgatttccctccccgacaaagacaagcatttaattaaaaaacggtaaaggaatggcatcacatttaattcaaacttgtttttttaaatacatcctcaaaaatggaactttttctctgtccgatgccattgcctttctgccgataattttttccaccttttttatgatgaaaatgacctcttccaatctccaacagatttagctccccaaaatacgcacagtaatgcttcaaatataccatataccatacagtatacaaccaacgtacgaccaataattaattatatcacattacccttaatttacccaatgtttatttcttattttcccataagaacatacataggtagtacaattttgttagaaaaacgatgaatttcgactaaaaataaa

SEQ ID NO: 70553 - DNA, 503 bp, Heterodera glycines
  Genomic contig location: Contig_ID=SeqID_42722; Location=183..685; Strand=-
  SCN-specific regions: Sequence locations=1-1,23-163,185-264,286 -396,418-503
caaaagttttttacaaccacttattgctaatctaatttcttgcagatttaaagccatccattgcctgccggttctcggcacagcaaagcactaatagggtgtttgactcacttcaaaaaataattccttacccaaaagttttttacaaccatttattgccaatctaatttcttgcagattgaaagccatccattgcctgccggttccggcacagcaaagtactaatagggtgtttgactcacttcaaaaaataattccttacacaaaagttttttacaaccacttattgccaatctaatttcttgcagatttaaagccatccattgcctgccggttctcggcacagcaaagcactaatagggtgtttgactcacttcaaaaaataattccatacccaaaagttttttacaacaatttattgcctatctaatttcttgcagattgaagccatccattgcctgccggttctcggcacagcaaagcactaatagggtgtttgactc

SEQ ID NO: 70554 - DNA, 86 bp, Heterodera glycines
  Genomic contig location: Contig_ID=SeqID_42727; Location=427..512; Strand=-
  SCN-specific regions: Sequence locations=1-60,82-86
aatcggaccaaaattgaggacgaagctcgagaccgaaccgaactgatcggagagctcggccttatgaaaaagaagggggaactgac

SEQ ID NO: 70555 - DNA, 456 bp, Heterodera glycines
  Genomic contig location: Contig_ID=SeqID_42729; Location=181..636; Strand=+
  SCN-specific regions: Sequence locations=1-45,68-222,246-456
gaaatgagtttttgaaagtggcatggggttgcattggttgcgccaccttcactgacatcaatgctcaaattggacaaaccgccaaagccactgtggactgtaaagcgatttttggcgaaaaggatctggatttttcgaatgaatatttcaattattcaatgttggcaatggccatggcaacaacgacgaagcagacaaagcgcaaaccgaaaaagcttatcacggagaagccgagcaccacggtggcaccaaaaaccaatggggcatggtcagcagaaatgacaatgaaggcccaggagacgacgattgaaggggaaccaatcactggagatcagggttaggcatactgtatttactgtgtgttcgttaaaaagccatttgtgcatgggtatataacagtcagtatattatggtaaaagttgttcctggaaaattggacaccgaaacaataagaaa

SEQ ID NO: 70556 - DNA, 1109 bp, Heterodera glycines
  Genomic contig location: Contig_ID=SeqID_9193; Location=117..1225; Strand=+
  SCN-specific regions: Sequence locations=1-146,170-411,449-624,646 -1078,1100-1109
gacattgctgccgcatgtgtttttctggcaggcaaaagtgaggagtgtccacggaaacttgagcacgttgtcgaagcatggttcaaacttaaaaatatgaaggcagaagtccaaccaccattcacagaaacagttaatggatgcgcaattaatttgttttcatttttaattgcttctcaggttcggagagacggcgcagaattaatcgtctttctcgaaagtgttctgcttcagacgataggttttgatctccaggttgagcttcctcatccacttgtccttcatcacatgaattgttacgcgggtggtaggtttttggatttcgtttttctgttttcactcgtcgccgagacactaattccatcgatatttccgttacataaaatattaccaccatttattgagtaaaacatattaatgtatatattttaatctttttgttcagataactcggcgatttcacgctgtgcctattggttcgcatcggagatgatccggttgaaaagcatccgcatttttgtttcaccacctccttcgtaggttaaccaccttcccggtgcggtacagcattcagactattgcttgcctctctatatttttggtctcgctctggtcagatttagaggttttcccattcccgttttctaaaaatgcgtggaaatgccttttttcagattcccgactctaatggtgttccgtggtttaaaagcattgaaccggaaatgacaatggatctgctgaacagttaatagcattcagattaaagcgataataacgggccgctctttgagcactcgccgatgagttcacgctgctttaccacgagtgtgggagcagcgaatgtcgcaaggcggtggatttgcttcagcggttaaaccaatcctccacagctacgtccagcacttctttcatggtccatcagcttcccccgccccctccgccgccaaatttgagtgccgtaaagacaaaccaagcgcaacaacagcagaaaacccctgacaaagtgattaacaacgatcaacaaaggcaacggaacaaaaggccggcacttgcgaggacggggcaaagcgaagagccatcgccagcgaagagaatcccaacagatgctg

SEQ ID NO: 70557 - DNA, 2076 bp, Heterodera glycines
  Genomic contig location: Contig_ID=SeqID_9194; Location=1859..3934; Strand=+
  SCN-specific regions: Sequence locations=1-171,194-387,410-546,568 -1227,1249-1636,1658-2076
  Gene Ontology: Mol. function=acetylcholine receptor activity; Cellular component=nicotinic acetylcholine-gated receptor-channel complex; Biological process=synaptic transmission
atggattcacttccgctggaacgattggaggatcggtcggtctttatcgttaataaccctccattttcgccacactctctccgtttagcgtgggacccgcggatgaacggagggatcgccaaaatgaaagtgcccgtcgaagttgtcatttctgttgtcgactgaattagcattctcctccattttcagatgatttggaagccggatatcattctgtacaacaacgccgcctcggaatatttgaacgaaatggtaattaattaattgatgggtgactcaccgatcacttaattaattggtcccgcaattctccccaattcagacgacggcgggtgtcacttacgacggaaacattgtaaagacaaaagaggcaaataaaatggtcaatttttaattttacagagtctttccatagccggcattttcaaaagcagttgcgaactcggtaaaaaggacaatctgttcaaaatttgtgcccaattcccacttcgttttgaagatgtccgtttttaccctttcgatttccaaaattgtctgatgaaattcgcttcatgggtaaatctgataattgttataacttttggcaattgtttttctttttttaagtcttatgatggcaccaaaattgacattttttctgagtccaccggtgacacttctaattatatggtctccacggaatggactctgcgcgaagtgcgggccacaaagaattcggtcatttattcgtgctgccctgaaccgtattatggcacctcttttttgtgccattctccgccattcccccaaaggtatccgttcatcgacgtttaccttctcctggaacggaaaccgttgttcttcgtcatcttctcctgccttccgtgtgtgctcatttccgtgttggtgctgctcggcttttatatgccatccgattcgggcgagaaagtcactctcggtgagttttgttggcgttgtgcccactgatcactttttggttgcagggatcacttcgcttctgtccacaaccgttttcctcatgttggtttctgagcatctgcccccaactgcggatgccctccctctaattggtattggtcactttttcgtcatttttcccttaaataataaatcgtttaaggcatttattacggtgtcactatttttatcgtatcccttcaaacggcatttaccgtctttacagtatgcccatttgagtgtcgttttgtctggtggcttttcctcagcttccccacccccctttcccatcagttgaatatccatcacattggcactaatgggccaccggtgccacgcattctgcaaaagcttttgttcggccgcgtctcgcggcttttattgctcaatttggagaagcaataccactcgataaatgaacacgtcaattacttcattggcaaacagaagaaagcggaacagagggagaagaaaggcgagaaaaacggagagaaatgggaaaatggagagggaaaaacaattttaaatggctcagagtttaaagttaataaaatatggacattctttagcttctccgtctccacgggtgagaagggcccattcggcaaattttttcgacgcaaatggcgcagacggcggcgtttttgtcgattccaatgtccattttccaaattcgatctaattttttcatttattattttcctttctaaggttcaatttgttgcggatggctccaactctttgctgaaagcgaaaaagaagcgcgtttccttcaccgatgacttcaacttttattgccaccagcagaagaacggtgcgttaccgtccgcctcggccactaccgtatcacttccgacccatcgctacggcagacgcattctgtcgctcatttcccccgttattccttcacataaacaccacccgaactgtgccaaaatgcgagtggccaccgtgtcgaacattggcaaaaaacgacatcggcataaggaccaaagcagtagcaacatgggaacaatgtctcctcattcatcggcccaccgaagtcggagtccctccgccctctcaacgacgggggaggaagacgtaaagcaaaagggagaagaaaacacggtattctaa

SEQ ID NO: 70558 - DNA, 150 bp, Heterodera glycines
  Genomic contig location: Contig_ID=SeqID_42733; Location=1..150; Strand=-
  SCN-specific regions: Sequence locations=1-64,94-150
atttgaaagagaatagaaagaaccaggttcgatgaagttttggtaagccaaaaaaaatccaaacatttaaaaatctataaaaaatttaaaaatgagaattcatgcgagattttctggaaataagcttaatagggcctagttaagctgtaa

SEQ ID NO: 70559 - DNA, 947 bp, Heterodera glycines
  Genomic contig location: Contig_ID=SeqID_42735; Location=29..975; Strand=+
  SCN-specific regions: Sequence locations=1-68,91-270,292-542,565 -580,603-640,664-711,733-756,778-947
  Gene Ontology: Mol. function=microtubule binding; Cellular component =spectrosome; Biological process=body morphogenesis (sensu Nematoda)
atgtctgttgatcagcataataatcatctgaatgacatgggtcctccgcctgatccggtgatggaagtgccgccgccaaaagagatcaaagtgttagagagcgcggtcgacattcagcaccggcgaacagaagcaagtggttcagaacagtacaaccattaatttgagtgctaattggccttaattaacgcacaatgcctggggatttaattcgggtttcaatggcttaaaattggaatggaatgtttgtgggcataattaaccccattcattctaaaattaataatttcaggtgcttgaccattactcacagttcaaagattttgcgaaaaccaaacgggaccggctggaggaggcccgtcaatttcagtacttcaaaagggacgcggatgagttggaaatttggattttggagaagctgcagacggcagcggttagttgaaaaaaacggaaacattttaacttaaacgagatcggaattttcaaacccgggaacgaggactgatgttggatagttgacaagaaacgccgttttattgtaccatggccgcgccggaaacggggattttcaggattcaataaaatggccatcataatgtaacaaaatcgacattccaaattattccgttttggaatccccttaattaatatatatatttattagttaaatcaaacctaaagcatcattttcgaattgcttacccctttctctctcccccaacggccgaacgtttttgaaacggggaataataaagggttttattggttttttgaaaattctattggattttcaaattatataaaagaaacatttttcaggaggagtcctttcgcgatccgaccaatttacaagcgaagatccagaagcatgatgcttttgttgcagaagttcaggtcggaaactggtgaagagaatttaattaattttggattgaattttcaagaaa

SEQ ID NO: 70560 - DNA, 65 bp, Heterodera glycines
  Genomic contig location: Contig_ID=SeqID_42739; Location=141..205; Strand=+
  SCN-specific regions: Sequence locations=1-65
atggctatctcttttttctcctggggatttgaccgcgaacttggtaccaacatttgccttctcta

SEQ ID NO: 70561 - DNA, 59 bp, Heterodera glycines; identical to SEQ ID NO: 68969
  Genomic contig location: Contig_ID=SeqID_42739; Location=319..377; Strand=+
  SCN-specific regions: Sequence locations=1-59

SEQ ID NO: 70562 - DNA, 59 bp, Heterodera glycines; identical to SEQ ID NO: 52421
  Genomic contig location: Contig_ID=SeqID_42739; Location=449..507; Strand=+
  SCN-specific regions: Sequence locations=1-59

SEQ ID NO: 70563 - DNA, 77 bp, Heterodera glycines
  Genomic contig location: Contig_ID=SeqID_42740; Location=1..77; Strand=-
  SCN-specific regions: Sequence locations=1-77
tcggagtaggaaaaaacgtcgtcagccgaaacgtcgtcgaacgaatttttcgaccataacttttttctttctcaatc

SEQ ID NO: 70564 - DNA, 882 bp, Heterodera glycines
  Genomic contig location: Contig_ID=SeqID_9197; Location=61..942; Strand=-
  SCN-specific regions: Sequence locations=1-403,425-480,502-882
atgcaaaatttttttctctatcgatatgcaaaatttggtggaaattacatggatagaaaaaaagttatatggagagaagtaaatgttgtttttcctaataataaaaatattagatagtacgccaaaaggagacaaaaaatcatagaaaaaaagataatgtttttctctggcactctctatttattggtacacatctcgttttttcggacagtgtgtttaagtattggtcatgggactgggaatccccacaggaaataatttccattccagttcggggccttgaagaaaatacggctagggtaagggttatgggcttgacatcaatacgggataaaaacccgtatcaaggaaaaatacggcccggcacgacgacacttcgccaactattctaaaattttggctatagaataataattcatgcaaatgtgcatctaagaaaaaccatggctcttaatgatttgtttgcttcgactaatttttaaaataatacagcaccacagagtacacatttgaattttctacccttaaccaatttaatcaaattaaaaaagtaaaaacaaatagtgggttttctttctcttcatcatcgaatattttgagcattagcaattgtttggcttagaggaaatggactaatctccggctggacaagttaaaagggaggacaatcataatggaaatatcttgttagactttcaatattgcacttaagaaatgtattcgtattcgtcgttttggtctgttcgttgtaggtagtatttgtcaatcagcgattcgatgttctttttgatgaactaaaccatttccgaatgcaatttttagggaaacaaatttcaagaacctgaacatcgggaacaaataacagctgcgactgctttatga

SEQ ID NO: 70565 - DNA, 357 bp, Heterodera glycines
  Genomic contig location: Contig_ID=SeqID_9197; Location=25..381; Strand=+
  SCN-specific regions: Sequence locations=1-357
ggaaagtgatgaaccttggtgcactcgtggaagaggtcataaagcagtcgcagctgttatttgttcccgatgttcaggttcttgaaatttgtttccctaaaaattgcattcggaaatggtttagttcatcaaaaagaacatcgaatcgctgattgacaaatactacctacaacgaacagaccaaaacgacgaatacgaatacatttcttaagtgcaatattgaaagtctaacaagatatttccattatgattgtcctcccttttaacttgtccagccggagattagtccatttcctctaagccaaacaattgctaatgctcaaaatattcgatgatgaagagaaagaaaacccacta

SEQ ID NO: 70566 - DNA, 1384 bp, Heterodera glycines
  Genomic contig location: Contig_ID=SeqID_9198; Location=537..1920; Strand=+
  SCN-specific regions: Sequence locations=1-20,44-68,90-330,352 -462,493-495,517-534,556-718,749-815,837-890,913-1206,1236-1384
atggaaaacaatcaaataataacgaaacgaaacaacaaaaaactcgaacatgaaggatgcctctatgtcttccatatgttcaatgctgaccgtgacgtaaaattttggcgctgtgaacatcagcgcgatgaattcaaatgccgaggacgaatccacacaacgctaaatgacgtcgtgctgaagaccgttggagaacacacgtgcaaccacagcgcggcaaatgtggtcacacaaaaaatcgtctctggcataaagcggcgtgccgttgagacgatggaaccaccagcggcaatcagggcgcacactcttcagcaaattgccacgccagtaatggcgaaaattccgacaaagaatgccacaaaaaaagtgaaaaatcgaatttttttttttttactttttcacatttttgtttttaagctggtgaagcgagacagcggtgtgttttaaggggagcttttcacatattttttaaatttaagaattctgatttttggccggctttctttcggaaattgggcttccgaaatgaagtacatttatttatttatttataaagaaaagaaaaagtccacaaaagggataaatccacttactttgtggacatatacatacattaatcgtccaaaagtatcggattatacaagcacaaataaaataaaatcgccaagaaaaatataaaatgaggtcaaagtcaaagagatcacaataaccaaatcacttataaaaaaaaattttttttttaaatattctgtagccattttttaagtttttccggtcttattgtcttaatgaacttttaagttttgttttaaattgatttaaagaatttgtttttattagttctttatctagttgattccacaattttgttaccctcccagcaaagggaatgaattttttgcccagtttgtattttgtgttaaatctataaaaggggatgttaaagcgtgctgatggattaaaaatagaaaatagtttcagatctgttcggccataaacaattttacgtcattttggcgcggtacttttttgccaattttgtttttcaatcgtttttctcctaatttcagtcgtggaaaatgggtgtttccggttcttcacaacgccctccgcgcaaaacatccacagagctcaatcaacttttgtctcttccacttggtgcgcaacatgaaatctcgcctaacagacgaacaaactcgcgtaagaaaaataaaaatttattgattttgaaatctcaaatttagcgtttcacaaccgacgctgcctttgcacaagctgtcaaaatgatcacttcgctggcgtttgtgctgcttgaggacattacaccggcgctggcagcgctcgaagatcatcttccggatgagcttgagggcgttctcgattg

SEQ ID NO: 70567 - DNA, 930 bp, Heterodera glycines
  Genomic contig location: Contig_ID=SeqID_42744; Location=1..930; Strand=-
  SCN-specific regions: Sequence locations=1-91,114-151,174-451,474 -541,564-751,774-881,903-930
accagcattccaatcactggggactcaacccaacagcatttttaaacactcgggactcaacccaccagcatttcaatcactgggactcaacccaccagcattccaatcactgggactcaacccaacagcatttcaatcactgggactcaacccaccagcattccaatcactgggactcaacccaccagcatttcaatcactgggactcaacccaacagcattccaatcactgggactcaaaccaccagcatttcaatcactgggactcaacccaccagcatttcaatcactgggactcaacccaccagcatttcaatcactgggactcaacccaacagcatttcaatcactgggactcaacccaccagcatttcaatcactgggactcaacccaccagcatttcaatcactgggactcaaaccaccagcatttcaatcactgggactcaacccaccagcattccaatcactgggactcaacccaccagcatttcaatcactgggactcaacccaacagcatttcaatcactgggactcaacccaccagcattccaatcactgggactcaacccaccagcatttcaatcactgggactcaacccaccagcatttcaatcactgggactcaacccaccagcatttcaatcactgggactcaacccaacagcatttcaatcactgggactcaacccaccagcatttcaatcactgggactcaacccaacagcatttcaatcactgggactcaacccaccagcattccaatcactgggactcaacccaacagcatttcaatcactgggactcaacccaccagcatttcaatcactgggactcaacccaacagcatttcaatcactgggactcaaccaccagcattccatcactgggactcacccaacagcatttcatcactgggactcaaccac

SEQ ID NO: 70568 - DNA, 645 bp, Heterodera glycines
  misc_feature (586)..(586): n is a, c, g, or t
  Genomic contig location: Contig_ID=SeqID_42745; Location=81..725; Strand=-
  SCN-specific regions: Sequence locations=1-374,397-645
atgcacgcgttttgcgctcgagctatttatcatcgggcttgtcaatccaaagcgaaacaacaaagatgctgttttgaacgaataaagggcataggttattttgaagaagtgtcaaagaacatgcagcaataagcctgcaaaatctaataagtggaaaatacatgagtatagaatttattttcagaaagtgtccacagacttttggaaatatatatttgcaatttatcaacaattttgataagtgagttagaaacttcacgattcaaaccaattttcgttgctctaattaaccgcgataaaaaattcgaatcaattaaatagcttctgagataataaggtttatcataaaatttcatttaaaaataaatcctcaattattggtatgaacgatactttccaaacatgcacgcgttttgcgctcgagctatttatcatcgggcttgtcaatccaaagcgaaataacaaagattgtgttttgaacgaataaagggcataggttattttgaagaagtgtcaaagaacatgcagcaataagcctgcaaaatctaataagtggaaaatacatgagtatagaatttattttcanaaagtgtcaacagacttttggaaaatatatttgcaatttatcaacattttgagaagtga

SEQ ID NO: 70569 - DNA, 327 bp, Heterodera glycines
  Genomic contig location: Contig_ID=SeqID_42746; Location=291..617; Strand=+
  SCN-specific regions: Sequence locations=1-153,177-327
atgagtcagttttctgatgattcccaaccccccgtgcttgatggtccttattcccctgttggtgatggtgggggcgaattgatggatgatgcacctccgctggaagacgttatgaaacgcctaccaatctccgttagtctttgcgaaaatgtcttaaaattttctattttaattttgcgaggtcttttcaggtcgagccatcggacaacaatgagcgcaaagtccaaaaggagccgtcgattacccatgaattggacgctgagttattcaacggcaacggatttgcatgtctctccgcagcacaggctgaagctggacggttcaaag

SEQ ID NO: 70570 - DNA, 84 bp, Heterodera glycines
  Genomic contig location: Contig_ID=SeqID_42747; Location=240..323; Strand=-
  SCN-specific regions: Sequence locations=1-84
gtgcgcccgtcaaattcatcactgtccgttccacggcatttgaggcggcgcccgcggacggaggcaacgcgacggttgaaaagg

SEQ ID NO: 70571 - DNA, 711 bp, Heterodera glycines; identical to SEQ ID NO: 42749
  Genomic contig location: Contig_ID=SeqID_42749; Location=1..711; Strand=+
  SCN-specific regions: Sequence locations=1-423,445-498,521-581,605 -659,681-711
  Gene Ontology: Mol. function=heat shock protein activity; Cellular component=cytoplasm; Biological process=SRP-dependent cotranslational membrane targeting, translocation

SEQ ID NO: 70572 - DNA, 1106 bp, Heterodera glycines
  Genomic contig location: Contig_ID=SeqID_9201; Location=888..1993; Strand=+
  SCN-specific regions: Sequence locations=1-172,214-386,412-870,893 -1106
atgaccgctgctttgggccatttgctggttgcttgcctggggcaacatggcaacgaattggtccaacgcgtcttggcccgcgtaagtgccagccgaccgggacaaagtggacagggaccaacccgtggagtccaaagagtggcgaactctgcaaaaatgagggaaacccgtaaattaattagaaaattaattaattaatttgattagtcaatttgcgttaatttagcacaacaccttttcagcatggccaacgtcgttttgacgggacgggcgagctgacggagttggttctgttggcgaacctctctcacgtccagagagatgcgtcccaacgactcgaccaattcgcccaatgcgaattcgacggtgtaactgaaaacgaatgccaaatggaaaaaaggggaaaagacccgaggagtgttttaaataatcaaattgaaatggaaaggagatgatggcccaagctgacacaatgtcgcgaatggcggccaaattgtgccggagaatgtgcgactgtcgccacccgccgtgtccgaggccggcggcaacgaattggctcattttcagtgcgtttgtgtccacgactttggcacaatcggtcagctgagagcagaagaagcgctttcgcagctgtgcctttttggaaaagcacaaattggctaatgaataagaagcaattttaagcgaatggccggtggaattatccaaatttttttttttttgaaattcacttccgcttcaacagcggcggtgttcgcccttttgtccgtattcgccatttcgtcgccatcttcgctgtccgccatacttcccccgccgtcgtccattgcttcgtcgctgtcgctgtaatcgggcggtggtctgaaaaacatttgaaaaacattcatgcactctcacaaatttaaatctgtggtgcatttcattggagctgttaaaattattgaagattagggtcgttgagggaaattgaaattttcggttaaaaagcggcggaatttcacagttaattttgttggatgtcctctcgcagggcacccgaatgcctaacggatgcactgatcagaaagtgctttttgctcgatcatttctttgatcgtgcacatcta

SEQ ID NO: 70573 - DNA, 2949 bp, Heterodera glycines
  Genomic contig location: Contig_ID=SeqID_9201; Location=497..3445; Strand=-
  SCN-specific regions: Sequence locations=1-40,62-1666,1689-2147,2173 -2345,2387-2573,2596-2949
atgccctcctgtgtccgtttccggcacagcagtggcagcgaagcggaggaggaaagtgaggcggtgaagatggcggaccatcgacgcgtctccgcgggggcgccaaagtcggttgctggaaaaggcagtcgtggagacaatcgcaacgcatcgccagccgtaaattcgcagtcgccgacggtcacttcgtcgctgcgactcacagaatttgtgccgtccaatggcggcgaacgcgcggaaaaacaatggaaagaagtgccgaagaaagtggaatatgaggtggatgccgtggaggaggcaatccgaagtttggagcagttcggtgggtattgtcttttcagcatgggcagtcgccccccccccctttttccaagggttttctgttgcatttttaattttctatatttaaaaaaacagtccattcaaaagcttcacgggtaacagcttataatgcttaataagccttagattttaataaaacaatgaaaaattaagttggcaaaaagaatcgtcaataaaaaaagaaagaaaaaaacgggggttaacgaattcatcggtcactgattttggcaagattaatttgaatatatttgcctcacaaatcgctcattttccatgcctatttaagcgatggcttctctcccctcctattcattctgtcattcatccaattaattaagacccgagtgaatttgtgtcgcaacaatacaaaacggaccaaacgacgaaattcaacgacggcacggcgaagcagcaacagcagcagaggaaccacaaaggcggctccccattcatcaggacccgagtgttcctggccagggctgagcctgtgcagctgcacccgactggctccgccaactcattgccatctccgctgcccgaagtaaaacggggaaaagccgaaagaaatggcgaggcattgtttcggggatggaaaggcaaggagagatacaaagaatctcgcagcactcgattcggggattgtttttgactctggcgaaacagtctcgacattttcctggcccggcatcgcattgtttctgcatccgattggcaaatggtcccttcccccccccactctcagcgtcggctgtcgcttcccttttcggctgatcatccgttcggcctctcttccgctgatcagcttctcttctcctcctgccatccgtcgcttcttccttccgccctctcttcttccggctccgctacgccaaccctcggctctctcacctcctcccagcaattgttaccttcgctggtcgagcccgcgttcagtcagtccatggattcgattaatcggaccccgcgggcgaacagtccgtcgtcctccgccttttccgcctcccagcagccgccgcaggcgcacaacggagtccgccgggcggtcactttcaacgacaacaccgtccaacacttttacacgccgtgtgacgggtttggccattgttttattagatgtgcacgatcaaagaaatgatcgagcaaaaagcactttctgatcagtgcatccgttaggcattcgggtgccctgcgagaggacatccaacaaaattaactgtgaaattccgccgctttttaaccgaaaatttcaatttccctcaacgaccctaatcttcaataattttaacagctccaatgaaatgcaccacagatttaaatttgtgagagtgcatgaatgtttttcaaatgtttttcagaccaccgcccgattacagcgacagcgacgaagcaatggacgacggcgggggaagtatggcggacagcgaagatggcgacgaaatggcgaatacggacaaaagggcgaacaccgccgctgttgaagcggaagtgaatttcaaaaaaaaaaaaatttggataattccaccggccattcgcttaaaattgcttcttattcattagccaatttgtgcttttccaaaaaggcacagctgcgaaagcgcttcttctgctctcagctgaccgattgtgccaaagtcgtggacacaaacgcactgaaaatgagccaattcgttgccgccggcctcggacacggcgggtggcgacagtcgcacattctccggcacaatttggccgccattcgcgacattgtgtcagcttgggccatcatctcctttccatttcaatttgattatttaaaacactcctcgggtcttttccccttttttccatttggcattcgttttcagttacaccgtcgaattcgcattgggcgaattggtcgagtcgttgggacgcatctctctggacgtgagagaggttcgccaacagaaccaactccgtcagctcgcccgtcccgtcaaaacgacgttggccatgctgaaaaggtgttgtgctaaattaacgcaaattgactaatcaaattaattaattaattttctaattaatttacgggtttccctcatttttgcagagttcgccactctttggactccacgggttggtccctgtccactttgtcccggtcggctggcacttacgcgggccaagacgcgttggaccaattcgttgccatgttgccccaggcaagcaaccagcaaatggcccaaagcagcggtcatggtcaatttatgcctttttcagctgcccaaagactgctacaagttggtccaatgggtgtattcgctgtccgtgtggcgtgacttgccccgcggcggtgccacttccgtgtttctgcccccgtcgtccggcaccgtccctttccatgccaaaatgcatcctccgccgccccctccggcgccgttcccccaacaacgaccctcctccccaagctcttctctgctcaactattattcatccgagtccatcgaagatgaacaaaataacaacaacgaagacagcttcagaaattgggcaactgtgccaatgaatggctcattgacggatcggcacggagggcaggcaaaggtggaagacagagtgatcagtgaaagccgaaatgatcaacgatga

SEQ ID NO: 70574 - DNA, 1079 bp, Heterodera glycines; identical to SEQ ID NO: 42752
  misc_feature (1023)..(1023): n is a, c, g, or t
  misc_feature (1026)..(1039): n is a, c, g, or t
  Genomic contig location: Contig_ID=SeqID_42752; Location=1..1079; Strand=+
  SCN-specific regions: Sequence locations=22-544,566-1079
  Gene Ontology: Mol. function=kinase activity; Cellular component =plasma membrane; Biological process=zygotic determination of dorsal/ventral axis

SEQ ID NO: 70575 - DNA, 193 bp, Heterodera glycines
  Genomic contig location: Contig_ID=SeqID_42753; Location=935..1127; Strand=+
  SCN-specific regions: Sequence locations=1-193
aatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcattgcttaacttgccagatcggacgggtgcgcatgactt

SEQ ID NO: 70576 - DNA, 561 bp, Heterodera glycines
  Genomic contig location: Contig_ID=SeqID_42755; Location=21..581; Strand=-
  SCN-specific regions: Sequence locations=1-459,481-561
atgccgttaaatgaaaccgaatcgccaaagataatgccgttaaatgcaaccgaatcgccacaaaaccagcaattaacttatattgaactgttccatcaaaaccaacacacattgaccatgtggctgattatgggtggaaagtgtgcactctcatcggttggcattctgttcaatgccattttggttgccactaccgtaaagtcgaagtaagcgagtacagtagtagaactggtagcgaaaaagccagcaggaatgacgcggaaatctgccattaatcgcttcaattgtattgaaaagataacattggcgagtaattgagcaatggcaaagttccgaagtttaaaaatactcaaaatgttggcaatggttagcccccgagagtcgagaccaagaccaaaaccctgataaatcctctaaacgagactacgagattttgagcatccctaaaatattctaatatatttcagaaagctttacaacacttgtaatgtgctgttcgccttggattccttgtttttggcactattccaactgaactctctgatcactttgctgatcgct

SEQ ID NO: 70577 - DNA, 714 bp, Heterodera glycines
  misc_feature (79)..(79): n is a, c, g, or t
  Genomic contig location: Contig_ID=SeqID_42761; Location=25..738; Strand=+
  SCN-specific regions: Sequence locations=1-714
atggcacagcatccaatttatttatgggccgatgacgtgccttctgaacaaggaaaaatcggtgagtaaatgacacttngataatatcgcaaaatcttctaataaactgttgtgtccccgggtttaaggctttcagccatttcaaattaccgttttaggagagaggaatttattataaggaaaagcattgacaattaattatgaattgaaaaccgggaatatgtttgggtcaacaacaacctcagagcattttgggtgggtcagtgcaattggttatttgggaaaggattgccaaaggcaagaaatggcacagactgactcaccgcagacatctcgcagcccccgagggggaaattgagtggacttatatactggcacaatgggtatggactttggataggatgaggggtatgacggcataaacacaggaataagagagaaagggatggcatatgcaacagaggtgaatgggatagaaacggcacgataaatgagagggacaggattggcttgagattggatgaacagacggacaagtttatgacgggattgggtcgaggaatagggcaatttacattatgcacaaaatatggaaatttgaatgctgcggatacagcataaatggggcaaaattcgccaatatcatttgttttttcagtttcgatcgattagctgtccatttcgattccattcaatgccagcggtgacatcaaa

SEQ ID NO: 70578 - DNA, 656 bp, Heterodera glycines
  Genomic contig location: Contig_ID=SeqID_9202; Location=249..904; Strand=-
  SCN-specific regions: Sequence locations=1-62,84-414,545-628,652-656
atgaaccatttaaacaaagtgagaaggaagaaaaacaagaagcaacaatcaaaattgaaacattttttaatgagcaaaaagagtagcaaattgacactaattggccaattagcaaggggaaaacggaggagcaaattgacactaattggccaattagcaaggggaaaacggaggagcaaattgacactaattggccaattagcaaggggaaaaaggcggcaaagtcggaaagcgattctgagaatgaggaaaacgaagtcaaattgatgattgtcaatcaatttatcaaaaagagagatgcattcaaaatggaaagtgattacaaaaaagaaaatcggaacaaaaaagaatgcgaaattgccaaggaattgggcacttaccgggcaaaaattttccaatggaatagggaatttgaagaaaaagggcagcagaaaaagaagaaaaaatacagtgaaaaagatgaggaaaaaatgaaaaaaataatcgaaaaatttgacgaaaaaagaaaaaaatacgaaaagaaaatgaaaagtgaaaaaataaattatcaaaaaattgatgacgaaattgcgaagggattgggagtaacgcgaggcaaaatttacaaatggaaaagcgaaattggcatcaaaaagcagaaaaacaaaccaaaataa

SEQ ID NO: 70579 - DNA, 802 bp, Heterodera glycines
  Genomic contig location: Contig_ID=SeqID_9202; Location=1855..2656; Strand=-
  SCN-specific regions: Sequence locations=1-414,443-691,714-802
atgcaacaaaattataaggcaataaggcaacttcaaacttttgttaggtaattttgatgttcatcaaaaattcaatcgcaccaaagtgatcagataactccttcaaggtgacctgaaaacctgaactgccgccctaaatgacttggaattgccaaattttcgtggcccatgagaagtatgaaaaaatgaaaaatattatgtttggattttcgccataaatatatctcgatcatttcttttttaaagatattttcacctatttttcttattatagatgcagattttttttcaatatcatttaatcgttcttctaaaaactttatttctgactaaaaaaacaaagattaaagcaatagtaatatgtaatacaaactatatgaacatagctaatagatccaaatttcatcattctgtgtttttagcccattttcagccattttttaggaattaaaaaaacgcgaaaattacacccaaaaatgaattgtttcgtaattttggtaattttaggtattttgttcgctttcgaaatgcccaaagcttcagaaatcgcaatcggcgttcatatcaaaaaaattagaaactcaatgaatgacattggcgcacagcttgcttttttaagtccatgtaattagtaacgctacatatttttattattcgtttgtgagatgttttgtctcgtctattaaatttgacgtaagaaaaatataagtaaatgtttttgagtggggtttttcttcagttgtaatgttggcataacattagaggcattgaccgataaatattggcacaaacaaaaaataaa

SEQ ID NO: 70580 - DNA, 1666 bp, Heterodera glycines
  Genomic contig location: Contig_ID=SeqID_9202; Location=3470..5135; Strand=+
  SCN-specific regions: Sequence locations=1-47,70-292,330-586,610 -652,678-789,811-812,836-1055,1077-1269,1294-1448,1470-1531,1554-1666
atggggaaaagctttataaaaagcgaacaaagcattggaaatgaaaaggaaatgaccaaattttcattggatgttcaaatcaaagaggagataaaaaatgaagtgaaactcgagagattagtgaaagaaatcaaaaacgaacaatcggaacaaatggacgaaattgggggaaaaaagcgcaaaaaagatgaagaagaaacggaaacggaacaggacagcagcagcagcagcaggtcaaaattatttaagtgaatagggacgaaatttatgtaaaaaaaactaaaattcgtggaataatataaataaatatatttattaaaaaaaataatgaatatgtacaataaaatggcagaaaataacttaaattatacaatgcttacaagggaacctcgtgaactgtaactcggaaaacgtaaataaatttggtaattgtgaatttttaattttacgggacaatagcaaaaaaaaaaagagttatggcgcctcaaaaatgggagttttagtgccaaagatctgtcccattcacagctttattcactttttttttattaattcccctaacatttacaactgagtgatttttgcttattgtcattaaagaaaaatcaacatacatattttttcataaaaaaaagttctaaatgtttagtccttttataaattaattaaaatttattcagttttatgttggatttgaacctggacctcctaaagtgcgaatttaaccattatttttgttgttaattttctcgttttaagggtttctttttttaaattctcactatttataaaaatcaaaaattttgaaaatgctttttccataattttattttaataattcggaatttttcatgaatataatacatatagtgatgaaacagcagaagcagacgaatttgataatgacgaacagaaacgcaaattgatgattttaaaagaatatgacatacggagaaaagaatggaaattgaaaaatggaatcaaaaaagaaaaccgttacaaaattgaagcggaaattgccaatggattgggcacaaatcgggacaaaatttaccaatggaaaagggaaaatgtgccaacctacaggaagagaagtgatgaagcgaaacggaaaacaattgaagaatttgaaaaaatgaaaatcgaatccaaaaacaaatgggaaaaagagaaggcaaaagttggagggcaaatcgccaaggaaatggaaagaaaaattcaaaaatggaaaagagaaatgcaaaacggagaaatgaaattggaaatggccaaggaatttggaaaaaggaaaagagcgcttgagcagaagaaatacaacgaatttgagcaagaaattgcaaagaaattgggcacgaatcggtgcagcatttaccaatggaagagggagcttaagcttggcaatgtgcttcaaatgagcagtgagtggggggacccaaaaggggggtcagtccaagggaaaggccaagggatgtgccgagggttgggccaagggtttagtgaagggaatggcaaagggatgaaccaagggaatggcaagggatgtgccgagggagtggacaagggcgtggccaaggggatggcccagggcgtggcaaagggatgtgccaatggtttagcgaacggaatggcaaagggagtggccaaggggcggctgagtaatgagtga

SEQ ID NO: 70581 - DNA, 143 bp, Heterodera glycines; identical to SEQ ID NO: 66029
  Genomic contig location: Contig_ID=SeqID_42764; Location=417..559; Strand=+
  SCN-specific regions: Sequence locations=1-143

SEQ ID NO: 70582 - DNA, 375 bp, Heterodera glycines
  Genomic contig location: Contig_ID=SeqID_42765; Location=673..1047; Strand=+
  SCN-specific regions: Sequence locations=1-248,270-375
atggtaaatatttcaataaatattggttctatttttttctttgcttttgccacaagcttatgtggaggcaagccaaatgatgacaaaaatgctgcctacagctcaagtgtgccaagcgaaacggaaaatcccaaaaacgaagagtcgaaaaagaatttggtgataattacggacatgggggcggatgatcaatttacactggagatgatcagcgcaaccgaattggccggtaaagtgttggcaattgggacgacggagaaaggaagaaaagcggcattgtcacaatcactgggatttgagaaagtgccagtgtatgtgagaagcagtggcgaggaattcgagaaaatgctttttatgaatcccaaagcagagtag

SEQ ID NO: 70583 - DNA, 532 bp, Heterodera glycines
  Genomic contig location: Contig_ID=SeqID_42768; Location=147..678; Strand=-
  SCN-specific regions: Sequence locations=1-85,108-239,277-305,329-532
atgaaaattattgttttattggtacttatgttgtttacagactgtcagattcgtgatcagcgaccccgaaaaccccctagaaatgtttaaatgtatgatttattaaaactatttttttatggtctgtaaacgacattagtaccgttttatttttggtgattttgcagcatcagcattaaattttccttttctcccattttgcggataaaatggtgcttctaaaatccctccttttcttcctcccattttatttgttttctttttccttggtttcttgccctcctccgccagctaaaagacagaagacggaatttcaacatgagaataaagcgaatgataacgaaaatcgggtggaagaagaagaaccggacaaagtaaccaatttatttgtatttgtttgatggattatgttaaattttagaatctatacgactttcactactcaaaatatttggaattggtcgtccaaatccttgaaagtcagccgaaatttcagcaacgtttgagggaaatgaatgaacacgacataaaa

SEQ ID NO: 70584 - DNA, 129 bp, Heterodera glycines
  Genomic contig location: Contig_ID=SeqID_42768; Location=1004..1132; Strand=+
  SCN-specific regions: Sequence locations=1-129
atggacatggacaaaatactcagtgatatgcgacagcacatatcgaatttgcaagacaaacttcacgtggcaaattctgccgttagcaaaggacaaattgtcaatgagaaaatcacactaatgaaggag

SEQ ID NO: 70585 - DNA, 857 bp, Heterodera glycines
  Genomic contig location: Contig_ID=SeqID_42770; Location=240..1096; Strand=+
  SCN-specific regions: Sequence locations=1-20,89-107,155-172,379 -420,455-489,512-512,564-665,703-793,822-857
agcaagaatattgctatcttgcctaggcgggattctgacttagaggcgttcagtcataatccctcagatggtagcttcgcaccattggtctatcgaccaagcacatgaaccaaatgtctgaacctgcggttcctctcgtactaagcaggattactatcatagcaacaggtctttagtagggtaaaactaacctgtctcacgacggtctaaacccagctcacgttccctattggtgggtgaacaatccaacgcttggcgaattctgcttcgcaatgataggaagagccgacatcgaaggatcaaaaagcgacgtcgctatggacgcttggccgccacaagccagttatccctgtggtaacttttctgacacctcttgctggaaactttacacattcaaaaggatcgataagccacgctttcgcggtccgtattcgtactgaaaatcaggatcaagtaagcatttgcctttttgctctacgagaggtttccgtcctctctgagctcgccttactgacacctgcgttacgctttgacagatgtaccgccccagtcaaactccccgcctgacactgtcatcggagcgtgtcgccgggccaccgcgtgtgccgacttatgacccaaatgggcaccctttcgggcgcactcccgttttaccgattaggtatagaatccatgaaagcacatgatatttcactggggccttgtcgttcccacttatgctacacctctcatgattcttcgcaaagtcggactatagccgagctcaataggttcttctttccccgctagatttgccaaggccgttcccttggctgaggtttactctagatagtatataggtgccgtggaaatctcga

SEQ ID NO: 70586 - DNA, 2075 bp, Heterodera glycines
  Genomic contig location: Contig_ID=SeqID_9203; Location=81..2155; Strand=-
  SCN-specific regions: Sequence locations=1-214,236-305,327-439,461 -1028,1050-1101,1131-1291,1329-1353,1375-1649,1687-1776,1798 -1803,1826-2020,2042-2075
atgctgattgagtttatgaaccaaaaacaattgaaacagcatgttaaagaaccgaccagagaaaatacgattttagacttagtaatgactagtgaatcagaattaattaatgaattaattgtattggaacatttttcaacttccgatcataaaatggccggatttaaaataaaagaaaaattccgtcgtaataatcccagtgtttatagaagagattttaaaaatattaatttttcgaaattaagtcaggcgatacttgaaaatcgaattgatttatcaataaactcagtgtacaccgctgatcaaaaatataaagaattcttaaataaagtactgaagttatatggtacttttataccaaatagacctctaaaatcgataataaaacaatcgtatcctcaaaaaataagagatttattttcagagaaattacggttacataagcttgtaagaaaatttcctgaaaaaagtgaaatcattttaaattacaaattatttctagggaaatgaaaacaattgcacaaattaagaaatgaacaagagtcaaaattatttcccaggggcaaaattcagttaacaaatttattagaaataaattatcaaaagttaatgaaattcctacgttaattgatagtgctggaaatatgttttccagtaatgagcaaaaattcgaaatattagcaaaaatatttcaaaaatcttttttagaaaattcagttgttaatggttcactgactcaatcagcacagaataagactaaactttcggatattgaattaaatgctggcataatttggaatatattaagaaagctccccaggcgaaattccacttcaccggataacattccttacattttattaaaaaattgtgctgagccaattacaaaaatattagctgacatatttcgacttgctttggattccggtcaaattccggaaatatggcgaacatcattagtggtaccaattttcaaaaaaggcgaaaaaactgatccattaaattacaggccggtgtcattaaccagcactgtctgtagagtttttgaacgaattttaagtagcaaaattttagaatttctgaacggtataagattttttgataaagaacaatttgggtttttaaaaaataggtcgactacaacccaaatattaaaaacaatggacgatatatataattctctacaaaaggatcaacaaattgacattatctatattgattttgtcaaggcgtttgattcagttccaattgatttattacttcaaaaaatcaaaaagattggaattgaaggaaaaatttataaatttttaactaactttttaaaaaatcggagttttaaggttaaaatcggcgaagtattgtcagaaagtttcagcatattttcgggagtgccccagggaagtgtcttagggccattactctttttaatttttataaatgatctgccgtcctttattgcaaatgaagcatcatcagttggcataaaaatgtatgccgatgatgttaaattatattatgcccatgaaaatgatgataaaacaaatcatttagataaagcaattgaagctttggaaaaatggtcaaaaataaatgggttagaaatttcaactgggaaatgttttgttctttatttagggaaaaataatatgaaaaaagattatttaattaactcaaaaaagatttcagaatcggataatgttcgtgacctaggcattataattgactcgaaactgcatttttcaggacatattaacaaaattgtacgaaacgcttatcttagagttttccagattttaagagtcttaaaaaccagggaaataaagactctaacaacagcttataaaacttttgtccgacctcaattagaatacgctaccgaagtgtggaacccaaatttaaaaaaagacattgacaaaattgaacgggttcaaaaatttttcacaagaaaagcatttagaaaatgtggttttttgtacaaaaaatataaggaaagactaaaaatcactgatttacacaaattagaagaaagaagaaaaatcaatgattgaggctttggaaaaaagatcaaaaataaa

SEQ ID NO: 70587 - DNA, 348 bp, Heterodera glycines
  Genomic contig location: Contig_ID=SeqID_42779; Location=1..348; Strand=-
  SCN-specific regions: Sequence locations=1-56,83-162,209-209,231-348
ggttcgatgaaactttttaaaatataagcctaaactttttggcctgtttaaaaaggaattaaaaatttttaaaaattttattcatctcccttttgatagaaaaagcttcagagagccttatttaacttttaattaacatttggtgcgtttcagagcacgttctaaaaaatatttatgaattaattttgcaaaataataaataattaatgaaaaagtcagaatttcgaaaattttaaaaacaacaagcgttggcattttttcaggttaagatagtcctttacaatggagaaggcctgcaaaattgtggagagattttatcgattttagtgcgctaggttcgatgaaact

SEQ ID NO: 70588 - DNA, 333 bp, Heterodera glycines
  Genomic contig location: Contig_ID=SeqID_42780; Location=646..978; Strand=-
  SCN-specific regions: Sequence locations=1-93,116-126,150-253,276-333
atgaaggaggaggaaaagggtattttatatgaaaatgattcatttttattcattcatttagtaagtgctcctgctgacaattcaaatttttcgtaaaatatttaaatttttatttcggtttttatgactttaaaaattttgggtttttcaattttcgtttcgccgcaattattctgctctttgtgtaatcatttggaaacggcaaattgtgctaatagccgtaaaaatgatccgacggtaaatttgaaatctcaaatttttaatatattaattttcccgaattttcagttggatttgtacggatatttggatggatattttgcccaattttga

SEQ ID NO: 70589 - DNA, 632 bp, Heterodera glycines
  Genomic contig location: Contig_ID=SeqID_42781; Location=34..665; Strand=-
  SCN-specific regions: Sequence locations=1-84,140-502,524-632
  Gene Ontology: Mol. function=MAP kinase kinase activity; Biological process=signal transduction
gcctaaactttatgaaggaaaagatgaacctcattcacagaggtgagcactcagacaatcaatcataatcagcctttgtccctttatatatatatatatatatatatatatatatatatatatatatatatatgtatattaatctcattgtcagacgtaaagccatcaaacattttgctgaaccgaaacggagaggtgaaaatatgtgacttcggaatttcgggccatttgaccaattccgtcgccaaaacaattaatgcgggatgcaagccgtacatgtgggtgacacttttgggggaatgggtattcgaagtgaagaaatatgaccatttttttttttgcaaaatatatagataggatgagttacgattaatttatatctttaaattaacagaattattttttaggccacccgaacgaattgagggcgagtcaaaagaagcttatggagtgcaagcggacgtgtggagtttaggcatcactttggtaatttgaattttgaaatttaattggattttttaattccataacaattttttcaggtggaaattgcgaacggacggcacccctacggcaaatggaagacgccgttcgaacagcttaagcaggtcatccaagagccggcgccgacg

SEQ ID NO: 70590 - DNA, 2550 bp, Heterodera glycines
  Genomic contig location: Contig_ID=SeqID_9205; Location=787..3336; Strand=+
  SCN-specific regions: Sequence locations=1-150,176-517,540-943,997 -1096,1119-1197,1262-1362,1384-1752,1795-1836,1859-2347,2372-2550
actttggcagcgaaacgcggtgtgccgtctgtggtgaggagaatgccaagatgcattatggcgtgttggcctgcctgggatgcaaagtttggtgattagtctaattaatggaattgtgccatttgcgttttcccaaagtttcgtgctggggatatatatattttttaacatttttcttgctactgactgaacatatacttttgatcagaataagtgatcagaaatacccaaattggttggatggatcgagatcattagccggttctgattgattatttccgtttcttttttgagaattgagagaccaccgattccaaatgttcgtggtactactgatcaatcacatctactgattagaatgaatgcataaaatcaccttaatttgatcaggatcattcacattgattattgccccaaccattttttgtagggctttttccgacgtgcgctgaaaaaggtgaacgaatatgaatgcttgcgggacaacaactgtgtcatcgataaacgcgcgtgattctatttattataaatgaatgaaaaatctttaaaaattcgttttggataattttgatcatgctgatcagtgccattttcagaggagcgcaattcatgccgtttctgtcgcttacagaaatgcctggaggtcggcatggacccggcgggtaaaaattcgggagtggcacacacatatgtatttgcacctctaacaatagttggagttggcattttgggcataggcatttaaattttcgagggtgagttcccccccccccgcgaaaaattgaaaatttcaaacaatttccaaaaaaatcttagaaaatttttttaaaaatttcaagaatttaaacttttgtaaaaatttcagctattttgtcggaaaatttttgaaaaaacagtaattcatcttaatgctttgaaaaaatcgttaaaaatttttcgaaacttttttttattgaaatttataaaaaatttctaagatatttttgaaaaaattttctaagttttggttttttaaatttttctgcggaaaacgatacggagatgcggcgggggaagaactcgtcctgttttcgaaatgccattgctgtccctgcgttatttcatttttacataattttagcggtacgcccggacagagacttttcgggccaacagcagctgttgacgcgtcgcctgtcactttcggcgggtggcggcacaacaacagcaataacaccaacgacaagcagtagcagcaacacaaccaacaataataacaacaccagaaatgccactggggccggcggcacaaatcgacgggaaaagcgccgggtgcggcaaacaacagcattgggcaacaatggtggtgccggcggtaacaaagcggcgccgggggaagatggccgaaatgggcaacgaatgcccgtcgaaatgcgcactatgctaatgacggtgggtggagagggccaatcaaatcccgctaatccagcgggatcccgaaaaaacccagggatttggacggaatcctgacatcgggatccgtccagagccgtttttcaaaaatcatcaggattggtcggggatttcttcgtgattccgagttgggatctctccgacccaattgtctgtctctacttcgtttgtgcgcaaaactgacaattcccgagactcgggatggccgaggagtttcgaccaccattaaatggggttggcattccgtcccaccccctgaagaaataaaaaactaaacatttttaaggaaaatgaatgcataaatttctttaaaatatgcataaaattttccccagtggcgcctctcggcagcgcctctgacgacaaaattgccttaaattcttcaaaatttgaccccaaaatgaatgaatgtgtgggcaatgtttccccccccccctaaatgccaataacatcttcctgaatttcagctccagaacattgaggcaaaggtaagcaagcggaagtgagtggttgccccgagggcgtccaatcggttttatgggtccaatcaatgggccgggccatcactcagtttcttaggccataacttttttcttacttgatcaatgcccacatttaccaagccaagaatctatgccttggctaaataagaaaaaaatgatggcctaagaaactgaggaaatgggccataaagtgcaatggagccaattttgatcactcttgagaggcacagcacattttgccaaatttaaatttccaaatttttcgggtggtccgtggtgacactgtaaaggatgcgtccgaaatttatccacttcacatcaacaccatccgtgaggtgatcaatgatccggcaaagttgcgcggactaagaacaacggtgggacgggcattcaaatttaaattttaaattaaaaaagtgatcagattcgctatgagccctatcggatggcacgcaacgaggagttgtgcgtgattgtctaccggcgtctaatcgccgccatcgattgggttgaactgttggccgaacgaatgggcggtctgagcactgaggatcgaatagcattggtcaatcaatcaattattgagtatttctga

SEQ ID NO: 70591 - DNA, 232 bp, Heterodera glycines
  Genomic contig location: Contig_ID=SeqID_42782; Location=1..232; Strand=+
  SCN-specific regions: Sequence locations=1-72,94-232
tttacccaaatccgtgcgggtgttttttcaccccgcgccgcgcagcgccgcgggaaggtcatcaatcatccacctgtcaccaaagtgacaggtgaaggaaattcaatttaacttttgcaaattttaatcttttgtttcaaaactttttagcgttttattttctcaatcctgaaaaaattttttatgatgatttttctgatcctgaaattaaaaattctttttgaaaattagc

SEQ ID NO: 70592 - DNA, 567 bp, Heterodera glycines
  Genomic contig location: Contig_ID=SeqID_42782; Location=427..993; Strand=-
  SCN-specific regions: Sequence locations=1-534,557-567
tttttggttgctatttatagaaggggtatattctaggagtgaaaggaccatttgattggtacattgtatcaaaatgcaaaaaccgataatcgtaaatataattgctctcgctaatctcggtaccggaattaaactaaactctctgacgatcactgaatgcgaatttaagtataaccctagaaaattcaatgccgcggttatcaaatgtataagccccatcaaagccacggcattattatgggaatccgggaaaatgatatgtctggggacgaaaagtctgatagactgtgaaaatgctataaaaaaatttatagaaataattaagggttcggggtgtccgggggcttcttacaccggacacacggttgaaaatattgtttcgacctataaattcgaacgtgaaactgaactgaacgagtttcgaaaaaatcgtcgtgcattttatgaaccggaaatattttgcggtttaaatttcaagcggggtaaaagcatgacagcgttaattttctggaccggtaaagtcgtaattacgggaactaaaaacaattctgaaatagaggaaatgta

SEQ ID NO: 70593 - DNA, 646 bp, Heterodera glycines
  Genomic contig location: Contig_ID=SeqID_42787; Location=455..1100; Strand=+
  SCN-specific regions: Sequence locations=1-98,132-263,285-327,349 -495,536-646
  Gene Ontology: Mol. function=protein binding
atgccatcgtcaatggatcggatgaaacatttgttgagcacgggtgagcattcggatgtgcactttttggtgggggacggagacgcaaaagaggcgagtttaattaaaaataaaaatttaattttatttttcaattgcaatttcattaattatccacgttttttaaaggttttgccagcacatcagcttattttgaagagcgcttccgatgtttttgaggcaatgttccgttttgacgccaaaaaagaaagaccggaaaatggtaaaaaaaataataattttaagggaaaataccaattatgctatttgttcttcattttgtctctgctaatttccctaattaatttttcaattagtttctggtaattgtcctgatgttgtggagatacccgacattgaagcagaagcgttcaaagtgatgttgagcttcatttacacggatgatttaagtgatttgaatggagacaatgcaatggcagtgctttacgccggtggatttatttttaaatttaatttattaattattttttaattagccaaaaagtacaatatccctgatttggtcgatcggtctttgcaaattcccatctccgaattgcgcaatgttttctttgcgtatgcccaagctctccttttcgacttggag

SEQ ID NO: 70594 - DNA, 676 bp, Heterodera glycines
  Genomic contig location: Contig_ID=SeqID_42788; Location=268..943; Strand=-
  SCN-specific regions: Sequence locations=1-276,314-676
ctattcgacacactgctttcgcttggacagagcggcgccccacccgagattcgaacatatttttttcatcctaattgccgcaaattccaaattaacattcagctggcccgtgccttccaaccacggcgtgtgctcggcgtggacatcgacagtcatttggtgggcgctgcgcgcaaaaacattcgccacttttgcgacaaggacacaaaggtcggaaaactgggcactttcagtactcacacccatttattgatagaaaaagtgataaaatttaggttttttttcaaaaaatgaaaaatttaaaaattttattgcaatcgatgtgccaatcaatctttctccctcctccgcagatgtctggcaaattccccgcttcatttggcgccaattttgggcccatttccgccccgtccacctctgacgggccccatttcccggacaatgttttgttcctttgtgaaaattacgtcctgccatccgacgcggcattggaaacggtttggcatggatctaaatttttttcgttttaatttcctcccaattttccaggtacacgaggagtttgacatcatttttgcgctggcctgctcaaaatgggtgcatttgaattggggcgacgcgggcataaagcggctttttctgcgcgcatttcgccaactacggacgggtaaaaaat

SEQ ID NO: 70595 - DNA, 900 bp, Heterodera glycines
  misc_feature (890)..(890): n is a, c, g, or t
  misc_feature (897)..(897): n is a, c, g, or t
  Genomic contig location: Contig_ID=SeqID_42789; Location=196..1095; Strand=+
  SCN-specific regions: Sequence locations=1-900
atggcacaggcgattccagaagagatacggtcggtgtcgagtccgccagaaatgcagccggagagggaaaagtcaaaattgtcagtgggagaaacgcagccgaagagggaaaagacaattctgaaagaaatacaactgaagaaggaaaagacaaaattggcactggaagaaatacaactgaagaaggaaaagacaaaattggcattgggaaaaacacagccgaactgggaaaagaccaaattggcaacggaagaaacacagccgaagaaggaaaaggcaattctggaagaaatacaaccgaagaaggaaaagacaaaattggcactgagaagaaatacaattgaagaagaaaaagacaaaattggcaccagaagaaatacagccgaagaaagaaaagaaaaaattgcaaccggaagaaacacattcggtgaagcaaaaggcaattctggaagaaatacagccgaagaaggaaaagacaaaattgtcagtggaagaaacacagccgaagaaggaaaagacaattctgaaaagaatacagccgtagaaggaaaagacaaaattggcactggaagaaatacaactgaagaaggaaaagacaaaattggcattgggaaaaacacaaccgaagaaggaaaaaacaattctggaagaaatacgatcggtgagaaatccggaataaattcaacaggcgattccggaagaaacacagccgaagaaggaaaagacaaaattggcaacggaagaaacacagccgaagaaggaaaaggcaattctggaaaaaatacgctcggtggcaaaaccggaagaaatacaatagaagatggcacaggcgaatccggaagaaatacggtcggtgtcgagtccgcaagaaatgcagccggagagggaanagacaanatt

SEQ ID NO: 70596 - DNA, 428 bp, Heterodera glycines
  Genomic contig location: Contig_ID=SeqID_9207; Location=196..623; Strand=-
  SCN-specific regions: Sequence locations=1-325,349-428
atgacttatcaaatgtaccgttccaccactttgggcaccgctttacaaagtgcgattttcagtgctttattaactttgccaaaaacatttgtcttccctttcaaaggttcgttggacgaactaattgcggatggaatgatttcgcagcaattggccggcacggtgatgaccaccttcgacaagtgcataaataaggcattgtccgagcgggtgaggaacaaaaccagcttcaaggtcggttttcctgatagaggagaatatggagggattttgttaatcggatgaaataattaatccatttgaggcggaaaaattgcgagcctatcgcttctgtgacaacgtgtggactttcatgatggaacacgtggaattcaaagacacgcaaaggcccatcgacggagtaatcgaccgggtgaaatttgtcgcat

SEQ ID NO: 70597 - DNA, 252 bp, Heterodera glycines
  Genomic contig location: Contig_ID=SeqID_9207; Location=1850..2101; Strand=-
  SCN-specific regions: Sequence locations=1-252
atttgcacaaaaggggcggggcgatgaagccacacaaccggcgtcactttcagtaagcccattcatcctttactattacaaatggcaaactttgacagatcgacgattgcttcgtcgaaccttcacggagagacgacgacaacggggaggacgaggaaggccaaggctctgaccctgagcaaattggctggctgttttggcactcgactgtcgagggcattctttttgcgggatgtaacgacggatcccttt

SEQ ID NO: 70598 - DNA, 883 bp, Heterodera glycines
  misc_feature (21)..(21): n is a, c, g, or t
  misc_feature (86)..(87): n is a, c, g, or t
  misc_feature (135)..(135): n is a, c, g, or t
  misc_feature (147)..(147): n is a, c, g, or t
  misc_feature (166)..(166): n is a, c, g, or t
  Genomic contig location: Contig_ID=SeqID_42794; Location=177..1059; Strand=-
  SCN-specific regions: Sequence locations=1-191,214-418,447-490,525 -756,778-883
aaatgagcaatgggaaattgncaagtgcttacagttcattcacaataccgtacactaccacgcaaaaatacggtaccacccattgnncacgcggggaacaaaacttttgcaaattgctcaattgcgacttaacgngtaaaattgaanttcaattctaaaatgatgnatttaggaaagtgtaaaattaaatgacaaaatgttaaaatttgatgattttacttaaattgtaatttttctacagagaatgcgtgccattatttgaaccacggcctcacaaaagtgccgtggactttgcgaacgaaaggatacggtaggacattttgaaatgggatttcagtttgtgattatggtaagcaattgcttagggtttccgctgaatcgtcacaccgatttgaggccgggtaaaaagcaaatgcagaaataattaattaaatttacattttaaagcttcgacaaatgggcaattcgttagcacaggtaaatgccggaattcgaaaaagcgaaatgatttaaaaataatttttgagtgctcggcccgggcgattttgccattttggagagtccgcgtttcaatctctctgatggcataaatgtgctgctgttccagtattttaggtctcaaaataaatcaaccaaaaacgaagtgtttcgcaaattcccaacttttaaggcccactcattcgtcgaccattcgcctttgcttgggcacgcgttacgcaaaacccctgaggcaatttgcaaactttgatttattgcattaattactcactaattacactcacagctttgttgtctctttgtttaggacagtgtccgcctttttgcaatgtccgcccatccttcggtcaatcacttcgaaacattccccggccaaatggaacag

SEQ ID NO: 70599 - DNA, 590 bp, Heterodera glycines
  Genomic contig location: Contig_ID=SeqID_42795; Location=563..1152; Strand=-
  SCN-specific regions: Sequence locations=1-57,80-351,420-527,550-590
gattcaactgttgccttgctggcccagtgttgaaagcgcacccggcgctttcacagggcccatcgggtcctggttgatgatataattgaaatattccctaataaaaagaccgtctttatttttggagagatttggaaagacaaataatgttgcgatttctacatctaaagccgtccgtgtgcggcctttgacagatttttacgtgttttttttacaaaacctataacccgaacaattcttgagccatttctcgttttttcatggtgacctgtctttttcttgatgcctgatttaatattttttacttcaccaattttacattgcccattctcagacactctagaatctctgttaaatttttaaatttaatttatgcaaacaaatttaaaaatatgcattatacattataaaatattttagccattattcacttggacctgaaatcggacaatatgctttttgtgaagaaaaaggaaggaggaggtattgaaatagaaatgttgaaagtgattgattttgggggtagtgaatttatcaaggaaaatatggagagtacactggatgaacgacaggtggccaatgtgtgcaag

SEQ ID NO: 70600 - DNA, 673 bp, Heterodera glycines
  misc_feature (49)..(49): n is a, c, g, or t
  misc_feature (67)..(67): n is a, c, g, or t
  misc_feature (70)..(71): n is a, c, g, or t
  Genomic contig location: Contig_ID=SeqID_42797; Location=842..1514; Strand=-
  SCN-specific regions: Sequence locations=1-85,107-107,197-202,264 -279,309-345,373-589,622-630
agtggtatttcattggcgccttgcggctcccacttctccactctgagtnatgattttttataaagtnagnntagagtaacctttaagggtcttctttccccgctaaatttgccaagcccgttcccttggctgtggtttcgctagatagtagatacggacagtgggaatctcgttgatccattcgtgcgcgtcggtagttagccgacgaggcatttggctaccttaagagagtcatagttactcccgccgtttacccgcgcttattcaagtttccttggcttaacattcagagcactgggcagaaatcagacacggtcaacgtccacaaggaccatccgtctcctctgttttaattagacagtcggattccccgagttcgttttttttctaaactggtcgttcagcgccaaccgaagtgcataccctgacgagcatacacgcagctgaagcgctccacaagcagctctcaccactagtccacgcaccatccccgaaggaacagcaagcagccacgggcaaaagccgcctgtttcacgcaacagcccggctgacccgacctttagagccaattcttttcccgaagttacgaatctaatttgccgacttcccttacctacattattctatcgactagaggctgttcaccttggagacctgctgcggatatcggtac

SEQ ID NO: 70601 - DNA, 46 bp, Heterodera glycines
  Genomic contig location: Contig_ID=SeqID_42801; Location=851..896; Strand=+
  SCN-specific regions: Sequence locations=1-46
atgcgttgtggcggaggcgatatttcacaagtgactaaatatatcg

SEQ ID NO: 70602 - DNA, 186 bp, Heterodera glycines
  Genomic contig location: Contig_ID=SeqID_42801; Location=973..1158; Strand=-
  SCN-specific regions: Sequence locations=1-186
ccaggaatatcccgctcgtttccaaccaaccgtcagtccgactactaccctactaccgctcacaacaaacactacgcctgggacgtgaaataactgcgtgtcgagcgaacagcgaacgacaagaaaaaaacatgcacatttattttatgttacgtttaggaatgacactgtaaaatgttctgccaa

SEQ ID NO: 70603 - DNA, 336 bp, Heterodera glycines
  Genomic contig location: Contig_ID=SeqID_9210; Location=1110..1445; Strand=+
  SCN-specific regions: Sequence locations=1-121,144-336
atgaattatttgagaataatggtttatttgaaaattcaaaccccagttggccgaggtccggcttttctggtctcggctgagaagccatatttgctttattttaatttacgtaagaaagttgaactgtttagtaattattcaatgattttttttgaacaatgttagtatttgtcttataaaatggtaacattaaattttgggcatctaatataattatcttattcatttgtagtaattacggtgctaggtcgatccacaaaaaaactcagtgtgggcgatccacaaaaaatctcagtgtgggcgatccacaaaaaactcagtgatcgataaaattaa

SEQ ID NO: 70604 - DNA, 2167 bp, Heterodera glycines
  Genomic contig location: Contig_ID=SeqID_9210; Location=2256..4422; Strand=+
  SCN-specific regions: Sequence locations=1-505,527-957,979-1138,1162 -1406,1428-1981,2003-2167
aaagagaatgaaggcacgccggcaaaagacaagaagcgcaacaggaacaacgactcagtgaaaaaactggaggctgtcgagtgtgcgcgaaagaactccatacgtgcagcagcaacgaagtcaaagtggacaggaaacagatcaatgactggatgacacatgaagacaaactgagaaaacagatgtacttaatattttaacatttttttgaccaaaatttagcatgacaccaaatggggggaagcgcatgagacttgagggagcgggtcgaccagttcaacatccggaaatcgacattgcattggctgaatagatcgccgagaaacgaaaaaataaacagcttgtgtcaaggaatatcattcgccgaagggcggcttcactgttcatagacattgacatcaaggtgagaaaactgctacctatactactagtcagaaaccgccgtccaactatgcagaagctgtggcaaaattcatcaattttgttgaacaaagacgaaaggcgaaaaacaattttcccggcggcatctttgcgatggacgagacggccgtttggttcgattgcccggacaaccgatgcatagacatgaaaggcgcaaaagatgtaataagtttttgaaaactatttagagctatttcctcaaattaggtgacagtggtggccaccggccatgaaaaaatgcgagtgacagtgtgcctaacagcccgcagcagacataagctcaagccctatgtgttggtaaacagaaagcgaccggtgccgcaaattatcaaccaatttgctggaaaattggtgatcaatttcgatggctctgtgtggatgaacgatgacacaacggaggactacctgcacaaataatcggggcaaagctgttcgttggcgaacgcctcttgatttgggatgcgtttggcagccacaagagcgagaaaacgacgaaggtggtgaaaggattgggagtggaaacggtttttgtccctggcggttgcatcaaattcatccaggtaccaaagcatccttctcaatgaaattcacttttcttccctaggctcccgatgtctttcacatggtacttgactggatccaccgatcgtggcaggaaatctccaaagaagtgatcatcaaatcatttgagggtcagttaaaaaatgaatacaggaaaaatgcttatatatttaagtctgtgggctgacaacgccattggacggaactgaagacgaaaaaattgcttgtttcaagccggaaggagcaattggaccaatagggatcaaatttttgcgcgagtttagaggaaatcaaacaatgagagatggaggaaatgttcaggaggaagccgcctatctgatgatgatgtagagctggatggagtgggagatgacgatgaattgctcatttgttagaatttttactagtgttttttgaaaataaatggtgttgataaaaattccatttatcccccgggggataaattgagcagggggattatttttcaaagccctcagaaaggggggggggataattggagccagcgggattaatggaaacggagggataaaaagagaaaacacggtaagtagttttttttctccgtactagtttcgatatattaagcataaataacacatttttcacttggtttgaggcttttattgggttgatgaaaaattgaccctttaagcacttcaacattaaacaatttttatttcacaaaaaacaaatgttcaatcaatgatgtactcaccattttgatcaatgatcctcccccatcgttcgggcaacatttcaatcccctttttataaaactgatcatttttcgatccaaaaaagtcatccaatgcattttcgacctcgttttgatcagcaaattctttccctctcaagaagtgctccatagatcgaaacagatagtagtcacacgggctgatgtctgggctgtatggtggatgaggaagaaccgcccatcgaagtttttcaattttttgttgcgttgagaacgcaacatgtgggcgtgcattgtcatgaaggagtacgccgccgcggaattttgcagaaaatggaggacgacgaatttggtcatgaacccgctgcagttgttgctggtagatgtcggcgttgatggtttgcccagccggaacaagttcatagcggaccaaccctgatgaacaccacc

SEQ ID NO: 70605 - DNA, 1022 bp, Heterodera glycines
  Genomic contig location: Contig_ID=SeqID_9210; Location=3977..4998; Strand=-
  SCN-specific regions: Sequence locations=1-741,763-1022
  Gene Ontology: Mol. function=transposase activity; Biological process= DNA transposition
caaaaaatggacaaaattcgcctaagacaactgttacttttcgaattccgaaaaaattctaccccaacccaagctcttcgaaatatttgtgaaagtgagggcaatgatgcactctctctttctacagttaagcgatggttcacaaaatttcgtgaaggcaatgagcagctcgaagatgaaccccgctccggacgaccacctgctctcgattcggacgacttggagcagcacgttcagcagcatccgtgttctagttcgcgccaacttgcagcagagttcggggtccatcagacaacagtgctcaattacctccatcagctcggcttcatcaacaaaaagggtgccgaagttccccatgcactgacccaacaacaaaagcatcagcgagtggtcacctgcactgaacttctcgcccgtttgagtgctggaatgcagctttcccagctgatcacgtgtgatgagaagtgggtttatctcaacaacaaaacggcataaaacaatggctgaagccaaacgaattgggcgagccgacccccaggcgtcttcaacatgcaccgaaggtattgctgtgcatctggtggtgttcatcagggttggtccgctatgaacttgttccggctgggcaaaccatcaacgccgacatctaccagcaacaactgcagcgggttcatgaccaaattcgtcgtcctccattttctgcaaaattccgcggcggcgtactccttcatgacaatgcacgcccacatgttgcgttctcaacgcaacaaaaaattgaaaaacttcgatgggcggttcttcctcatccaccatacagcccagacatcagcccgtgtgactactatctgtttcgatctatggagcacttcttgagagggaaagaatttgctgatcaaaacgaggtcgaaaatgcattggatgacttttttggatcgaaaaatgatcagttttataaaaaggggattgaaatgttgcccgaacgatgggggaggatcattgatcaaaatggtgagtacatcattgat

SEQ ID NO: 70606 - DNA, 329 bp, Heterodera glycines
  Genomic contig location: Contig_ID=SeqID_42802; Location=387..715; Strand=+
  SCN-specific regions: Sequence locations=1-124,161-241,264-329
atggtctcggatgacacgcaccggatgggcgacattccggccgcttggctgcccggcgtgtcggggtgagttgaacaacgaacggcgtgtctaactaatcatttttggcgtttcaattactttcatttaatttttttttaaattgcaaattaaaaaatttcatggatcgattttgaaaaaaattttcaaaaaaaaaattctaaaaaatcgctcgaaaatttttgaaaaattccctaatttgatttttattttatttttattttgaggggtaggggaaacatagaacccataaaaatgaatttcatattcattcgttcagaaaaacatga

SEQ ID NO: 70607 - DNA, 896 bp, Heterodera glycines
  Genomic contig location: Contig_ID=SeqID_42804; Location=586..1481; Strand=-
  SCN-specific regions: Sequence locations=1-100,123-135,229-283,306 -338,397-511,533-544,583-869,891-896
atggttgcattgtttttctgttgttgggcacccactgtgctgttcaattttcttcgggataaccagtggttgcccatttttgtgctcagccaagaatatttgtttggcatcatcactcactgcatatcgatgaggtaaaataaaatataatctttaaatatttaaaaaaataataataatcgtattttaaataaataatataaaattaatttgtgatttttttttattgaagttcaaccatatggaatccggtgctttatgcgctgttgaacgagcaggtttgttatatttaaattttaattattctattaacatgtttcaattccaaatatcccccctatataaatgaataattaaaacttgtaaaaaaaaagattttcaaaataatatttaattgatgattttgaaaatttgctgaagataacaatagcaggaatgaatctctttcttgatttaatttttcgtctgttttctgatttaacagaggaacaaaactaaaaaaaaagaagaagttttttgttattattattgaattaatatgctgaataaattcaaaatatatttttcaaattaaaaattttagggaattttattgtttcagtttcgtgcagccttttcggagcagttcaatcaacttcggcaccgtttctgttcaccatgcaacggtggcatgacaacggcacgaactcggctgccaacaattgattcatcggcacaacaacacagaaactcgatcagaaaggtggcattgccatcgccatcatttgtccaagcagtgccagcagttgcgcagcgatcaaaattacatgctgaaagatctgagtgatcagattttgatcaacggattaccgatcagttcaattaattcattttgtatttaaaattttcttaataaa

SEQ ID NO: 70608 - DNA, 304 bp, Heterodera glycines
  Genomic contig location: Contig_ID=SeqID_42805; Location=9..312; Strand=-
  SCN-specific regions: Sequence locations=1-56,78-304
atgaacgttccctttgctcgttatttggccacaaaaaatattgcaaagaaaaatacggtatcaaaatgccagtttttagaaggagcaactcgtgaaggaggcaaaagttcattactgggaattcaaccaatgtgtgtgttgtgataatattctattacactgggttccaattatcgttgcccatattaggattttgactttttccccatttcttccccgttccagggtaattaaaatctgccgatctttgcagaataagcatcgtttatatagacgcaatgttcgctgcttgcggagtgtttga

SEQ ID NO: 70609 - DNA, 571 bp, Heterodera glycines
  Genomic contig location: Contig_ID=SeqID_42806; Location=381..951; Strand=+
  SCN-specific regions: Sequence locations=1-571
atgcagtacaatgcttttaagccccgccgtgaggcgggacagttacaaaattttgtaccacattttactgtggaaagtccaagtaccttattggacaactacgtgtcaatgagcacagtcgcctttggccagttgtggaacggaaaaatgggaatatcagatggggtgcgctcttttctaaaaattcctcttttcgtctaaccatccctcccttttgtgcactatttcgtttcaaaattgaataattttttttggctttttgaaataaattgtgaaaaatatacgaaaattattttagcttttaattatgcagtacaatgcttttaagccccgccgtgaggcgggacagttccaaaattttgtaccacattttactgtggaaagtccaagtaccttattggacaactacgtgtcaatgagcacagtcgcctttggccagttgtggaacgaaaaaatgggaatatcagatggggtgcgctcttttctaaaaattcctcttttcgtctaaccatccctcccttttgtgcactatttcgtttcaaaattgaatcattttttttggctttttgaa

SEQ ID NO: 70610 - DNA, 391 bp, Heterodera glycines
  Genomic contig location: Contig_ID=SeqID_42806; Location=319..709; Strand=-
  SCN-specific regions: Sequence locations=1-391
gcttaaaagcattgtactgcataattaaaagctaaaataattttcgtatatttttcacaatttatttcaaaaagccaaaaaaaattattcaattttgaaacgaaatagtgcacaaaagggagggatggttagacgaaaagaggaatttttagaaaagagcgcaccccatctgatattcccatttttccgttccacaactggccaaaggcgactgtgctcattgacacgtagttgtccaataaggtacttggactttccacagtaaaatgtggtacaaaattttgtaactgtcccgcctcacggcggggcttaaaagcattgtactgcataattaaaagctaaaataattttcgtatatttttcacaatttatttcaaaaagccaaaaaaaa

SEQ ID NO: 70611 - DNA, 133 bp, Heterodera glycines
  Genomic contig location: Contig_ID=SeqID_42806; Location=884..1016; Strand=-
  SCN-specific regions: Sequence locations=1-133
gcttaaaagcattgtacagcataattaaaaccgaaaataattttcgtatatttttcacaatttatttcaaaaagccaaaaaaaatgattcaattttgaaacgaaatagtgcacaaaagggagggatggttaga

SEQ ID NO: 70612 - DNA, 541 bp, Heterodera glycines
  Genomic contig location: Contig_ID=SeqID_42808; Location=295..835; Strand=+
  SCN-specific regions: Sequence locations=1-179,201-267,289-541
atggatgttaatgaaattgtaccatttaaatccaaatatttaactcattatttagcatatcacccagtcattaaagaaacttcaaaaacgacactagacttagaagataaaaaaggaaaatttgaaaaattgtgtaaagaattaacagaaaatgcatatgtagacaactttgtaatgatatgtgaataaaatttaaacattcttggagtaaagaaattttcaaacttgcttcaatgaatttacgagaatttatttctaatcatgaaaattctaagaattaaattcagaaaattgagagctctgaaaatgccaaaaataagcaagattctttaataaaatggaacatagaaaatgatgatctaacaatatcaataaaaatcccaacgattaccaatggaacaattaaaagaaatgtaattcattttgcaaataattttatccaatgggatgggtttcacccgtaattttgccacataaaaatgctttcaaaacttatggaaatctaagaaagattgggatgaccaaacttagtaatgaagaa

SEQ ID NO: 70613 - DNA, 773 bp, Heterodera glycines
  Genomic contig location: Contig_ID=SeqID_42811; Location=32..804; Strand=-
  SCN-specific regions: Sequence locations=1-45,67-114,136-252,274 -332,354-401,423-470,492-539,562-608,630-677,699-746,769-773
gacaaagtggcgaaagtgatcattttgctgggaaggtacaattcaaaggacaaaataaaagaaaaccaggacaaagtgacgaaagtgatcattttgctgggaagatacaattcaaaggacaaaataaaagaaaaccaggacaaagtgacgaaagtgatcattttgctgggaagatacaattcaaaggacataataaaagaaaaccaggacaaagtgacgaaagtgatcattttgctgggaagatacaattcaaaggacaaaataaaagaaaaccaggacaaagtgacgaaagtgatcattttgctgggaagatacaatcaaaggacataataaaagaagaccaggacaaagtgacgaaagtgatcattttgctgggaagatacaattcaatggacataataaaagaagaccaggacaaagtgacgaaagtgatcattttgctgggaagatacaattcaaaggacataataaaagaagaccaggacaaagtgacgaaagtgatcattttgctgggaagatacaatttaaaggacataataaaagaaacccaggacaaagtgacgaaagtgatcattttgctgggaagatacaattcaatggacataataaaagaagaccaggacaaagtgacgaaagtgatcattttgctgggaagatacaattcaatggacataataaaagaagaccaggacaaagtgacgatagtgatcattttgctgtgaagatgcaatttaaaggacataataaaagaaacccaggacaaagtgacgaca

SEQ ID NO: 70614 - DNA, 843 bp, Heterodera glycines
  Genomic contig location: Contig_ID=SeqID_9211; Location=781..1623; Strand=+
  SCN-specific regions: Sequence locations=1-438,461-801,823-843
atgacaacggcacttttgtgggatttttacatggaaaagcgggaggccctcgccagcattcagcagtttgactacgacaccaacaaattgggcatacggctcggccttgtgtcgacgagcgatgtcgcaatggacgaagacagtgacggggacgatggccggccgacggagagggtaagggagacgaatggtgccattctatggcatcgtttcctcattgtcagaccccctcccccgcctactttcactaattaccaaagttttgagttttatatgaggagttgctacaatctgccgatgatactaataataattgttgcccaacccccattttacagaaaaaaacggaattttaaaagtcgagaaaatacgatcagttgttactaatggacaaaccccaaaatataaccatgtttaattattgtaattcatcttcatctaacaataagttattgtcagtgcgtcactaaacgggggtcaaaaggcgtcgtcccttccattgatttcccaatttgattttacattcatttattggctcccccttctgaagggtgccttcgctcggattcgcgcgacggcacagcgatggaagcgacgcatttgcacacgccggggccgcgagcagctgaaggcacagctcaaacggctgaaggacagacggcccaaagacaaaaggtgcgcgacgcgatgaattggcattacgaccgggaaataatgggacagtaattcgaaattttcttttggaattttaatttcaaatttcagggcaccctaacaacagaatatgcgaatatttatgggcatggaattcctttttccaacttttttcaggcctctgaataa

SEQ ID NO: 70615 - DNA, 237 bp, Heterodera glycines
  Genomic contig location: Contig_ID=SeqID_9211; Location=1773..2009; Strand=-
  SCN-specific regions: Sequence locations=1-85,121-237
atgagcaaaaagagaatcgaatggacaacgataccgacgtaagtgccggtgctgccaaaagagcaaaaaaatgaatttaaaagagaaatttaaaaaatttcaaatttttaataatttattgcgtattctctgaaaaaacatcaaaatttccgatttttcagtaaaaatcatttaccaaaactgaaaaatgcttacgatttggcaaagttgggatatttgagcgcaatgataaaatag

SEQ ID NO: 70616 - DNA, 354 bp, Heterodera glycines
  Genomic contig location: Contig_ID=SeqID_9211; Location=3000..3353; Strand=+
  SCN-specific regions: Sequence locations=1-33,56-354
atgttgcaattccattgcatatggccctccaaagtgaagggggcggtgaaggagggcgtcggttattttgtgaaaggcgccaaacaacgaatcaccgactacgcccgggagacgttcatgtacgacatgtgagttgttggcacggattggtcgattggttcggttcacctccaggacacctaaaaaattgtttcgattactttgcttcgtaatttcctattcatattctgaaattttcattcttttcttttcagtgactcaattatattttcaggtacaataaaacggtacgcgacagtaagcgatgttaatgtgacgagaaatgacagaatcatcggcgatattttaaaatga

SEQ ID NO: 70617 - DNA, 149 bp, Heterodera glycines
  Genomic contig location: Contig_ID=SeqID_9211; Location=5577..5725; Strand=+
  SCN-specific regions: Sequence locations=1-149
atggaacggatggtacgcgtcaagaagaaggacgaagacattggggagcaggagagacagatgattctgaaggggctggcggtgctctccgaggagaaattgcgctgtcaccgctgctcacgcgtcgatttgagtgttgcggaggcatc

SEQ ID NO: 70618 - DNA, 81 bp, Heterodera glycines
  Genomic contig location: Contig_ID=SeqID_42813; Location=964..1044; Strand=+
  SCN-specific regions: Sequence locations=1-1,24-81
aaaatctataaaaaatttaaaaatgagaattcatgcgagattttctggaaataagcttaattgggccttgttaagctgtaa

SEQ ID NO: 70619 - DNA, 70 bp, Heterodera glycines; identical to SEQ ID NO: 63777
  Genomic contig location: Contig_ID=SeqID_42814; Location=1..70; Strand=-
  SCN-specific regions: Sequence locations=1-70

SEQ ID NO: 70620 - DNA, 791 bp, Heterodera glycines
  Genomic contig location: Contig_ID=SeqID_42817; Location=162..952; Strand=+
  SCN-specific regions: Sequence locations=1-327,352-511,533-614,637 -759,782-791
atgtacatagggttgagcggtaccggtaccggtaccggtactggccggcaattaccggtttttttggtaccggtaccggcacagataccgcctatttcgacaatgaaattacggttagaggttagttattttccgatatcgttggaaaataattgaattgtgaattaaataattgtgtcccagattttagtatataacagtagaacaatgacactttaatacataaatttttaaataatgcttcgtttcaataatgatgaaatactcattttaattttaggataagattttcctttggatgtttcttgatcgatcagccgtcaacatttaccaaataaaatatgaaaattctaatgcaaaaccaccactacaatttagaagaaccgccaaaattggtatcgcttcactaagcaatggacagaggagaacaacatgtagataatatgaattgcacatcattggatttaagaccaacaaaatcaattgatcatatatatttgccccaataatattaattgttaattaccaaaaatggaaaaataggacataagaagtcacaagggagacgggctaatccacaggcaatcttcagaggaataggatttaatccgttcattaaatttaaaacattttcatcctaagacaattattatgagcatttattatttttaagaccacaagttttttcattttcttaaatgttcgcttaatatttcggattttttgcaacattttagtcaatgtttcagcattttttcgtaaatatttatttaaatattttgggattttta

SEQ ID NO: 70621 - DNA, 762 bp, Heterodera glycines
  Genomic contig location: Contig_ID=SeqID_42818; Location=255..1016; Strand=-
  SCN-specific regions: Sequence locations=1-324,346-382,404-426,448 -512,548-607,629-762
ctgtcttcctttaggctactctccggactctgttcaattccaacagcagctgaaaaacggcgttggcattacctccgcggcggcggctgcaacagtgccaatcaatgcggagaacaaaggcttcaagctgctcaagggcatgggctgggcggaaggccaagggctcggcaagcacagccagggcatccaagcaccggagggttgaaagttttttttcggtcaactaaaagtcgagaaatcttttgtttccaccagcgcttttctgggtctctgatcacgtttctgtcttttccggatcgctaatctaaattcgaacaaaaagccaaattaaaaaatttaattattcgcgttagggactcggagtttgtccaaatggatgtcagacttgtggtcagaagagagacctcgagaattcccgacaacttcttcatgactttttaaacagaaatttttttgtaaaccaaaagggtttacttatttttatgtttttaattatttttcgcgaaaaagtctaatatttttcattattttattagaatttttttttgcctgacagatcgccacacaattcaaaggggaccgtgtcgggcttggcacagtgtcatccacaacaacagcaactacaacaccattttcgacatcatcaaaaatcagcattaatctgcgcagcaaacagcaactcaatgcggaacaaatgcggaaacgcattgaacaagtctggccaaacagtttttcaaaaaaagaggaatttttcgcaataaa

SEQ ID NO: 70622 - DNA, 439 bp, Heterodera glycines
  Genomic contig location: Contig_ID=SeqID_42821; Location=379..817; Strand=+
  SCN-specific regions: Sequence locations=1-439
aaaatggtttaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgc

SEQ ID NO: 70623 - DNA, 661 bp, Heterodera glycines
  Genomic contig location: Contig_ID=SeqID_108; Location=1154..1814; Strand=+
  SCN-specific regions: Sequence locations=1-139,167-299,332-533,556 -619,641-661
atgacaaatttcgccattttggaatcacatttccaacaattaatggtccaatgggaattgcgatgcggttattaggcgccgcccggaattttttttcaaatcttaatcaactatgataagaaagccaatttttttttttaatttgcccaaaatttttttttcatttcggtaagcggggggggggggcgtccccaccctttgtctcctggccaggcctgatgcttgtgccagcatctaatgcgtaggctgccaccagggactgtcgaccgttttttcattccactgccacccgaaaacccaaagtggacctttatatttgagaattttctaatttttttcctgttatcacgctctgactttttaattttaacttatttcagcattaaattgtttatttccacagatgctgatcaccgtaaaagaggtgacgttggtgctgaagaagcgaatgcaacagaagacaccgccaagagaatggtatgaccaatgtgccgagttggaggacaaaatgatgggccaaattgaaaaaaaacgggagaagagagagaaagcgaagagttggaaactgcgcgaaatggacgacgaatgaatggatgaaatgattttttggattccatcttttttaatttacttttcaaattctacgcaattatcactgcaa

SEQ ID NO: 70624 - DNA, 1521 bp, Heterodera glycines
  Genomic contig location: Contig_ID=SeqID_108; Location=1795..3315; Strand=-
  SCN-specific regions: Sequence locations=1-102,124-195,218-423,445 -566,588-813,835-860,923-1295,1318-1345,1367-1521
atggcactcatccgcaccaccgcccgcgcgtggcattgcccgacgaaacgttcgaatggtttgcgctgtgttatttggtcgctgtcggcactttgttggcaccgactgcgctccattcctacgcaaattccgtggtgccgtacgacgcctcgtgggaatccattgactatgtaaaacaaagccaataatggcccaatcaaattgaaaagaatgttttcaaaaaaaattgccaaaagacaaacggatcattcccgacccactgattcttggccaaaaaccttggttgaagacattgatacacttatcaaccgatcggttagcaaatctctgactaaaaattaagtcgcttggcataaaatgtaaaccgagggagggaacgatctaaaaagttaaaagcgctattaataaaccatctctaaaattgatcattttcagctgttgatgggcatgtccgttgtgttcatgagcggcttcaagtactccgagctgtggctgatcagccgattggaggtgaggcaaaaagtatccattctttcaaagtgacagtacagcaaatcttttgcttgctcttgtataaaataaaccaaaagccaagaaactatccgaatttgatcacttttttgtattttatcttgaatcgtgctcattatctgacgaacgaatattttttgtaagcattttaaattcggatacaaaaattcatttggaaattcattggcttaacccatccaatcccaattttagccacatcaattttgtgcattggaacactccaaatacttcattgcctcaattgtatgttttttccattacttaaataatatttcaaaagcatatattaaaaaagggtttacttattgaaaattatgaaaatatttttgctaaatttttatatatttatttaaatatttttgaaaataatccgattgcaaaattttaatcctatacatctttttatcagttgttatgcattttattttttaatccaactttaaaacagggccaatggttcctccaaaacatggcacatgccacggtttttgccgcggtcggcaaggcgttgtttgtggtgtccgcgctgcgctattggctccgcgcggacgaaatggacgcggtcggcggcgcacgagccaaggaaaagtgtgggccaaagagcagttttgccggctgattgggacgaacggacggagggggggggggggggagtgatcggaaaagtgatcaatgatcagttatttagttgcgtatctacagtcatggtcatatgtttaacaacactcaaaattttctaccaaatttgatttaaattgattataaaatctcaatatgactatattgtgtatatatgttttatatttcttgtagcattttttgtgggctttataatgataccattcactatccctgtcaagatgttattattagttacaaaccattttaccaactgcactccctttttggggtggtcatatgtttaacaacactacccatatatttttatttgcagtgataattgcgtag

SEQ ID NO: 70625 - DNA, 1026 bp, Heterodera glycines
  Genomic contig location: Contig_ID=SeqID_108; Location=3798..4823; Strand=-
  SCN-specific regions: Sequence locations=1-276,298-309,332-424,493 -599,621-639,661-712,734-739,761-818,840-1026
atgaattctgctgaaggattcgtttcaaattctcgactattcgctgttgtggcgacccgtcgcggcacaactgttggtcagcgcgttgtccgcccgcgtgtacgtgcacaaccgggccgggcattgtacttgtgcaggtaatgatggcacggcattaaaaagcataattaatcggaacagagcaattctacattagctttttcgagattttttggtctcgagtcccgggattgaccgaaatgttaattgggatttatatgcctgatttttgaaatgtatatattttcaagaattttcgacttcctcggcacttttctgatcattcgctttggcgccaactttttgaacaacgcaaacattgcccggggcaacaaagaggagacgcagcgccggaggggccgcgcggccatttgggcccttttggtaaaaattattttcctataaatttttgtattttttatataaaataaaaaaatttttataataatttttcagtgcgcctccgaaaaaaccaattcatttcaatgctaatttttcatggtttttgttattttttctttcatttaattaataaatttgtaaattcaaattaatacataacaaaaagagaagaaaattagtttttttttatcgaatttcctttctcttaaatttaattttcacattatttcttcaaaaaaggtcgaaaaaacaaatccaaaacccgaaatatcaatttgagaaattgtttttctctttcaattctttttctttattaattatgcatttattcatttacaggggccacttgcgttctccgtgtcactttcatggtgttttttctttaaaatttttcaaaaaattcgatttcaaaggctcgaatttggcaacatcgagtgggacccgtgggctctgtttttggccccacttctcgcacttgtccaagctgttcacattctgttgctgaagcaggcgcagttggcatttttcgctgccctcggcatgcccaacggcaacaatgtgccaattctatgggccaataactaa

SEQ ID NO: 70626 - DNA, 3725 bp, Heterodera glycines
  Genomic contig location: Contig_ID=SeqID_108; Location=5652..9376; Strand=-
  SCN-specific regions: Sequence locations=1-152,175-290,312-822,866 -1219,1244-1359,1389-1423,1457-1496,1518-1690,1712-1786,1816 -2288,2310-2504,2526-2568,2591-3159,3181-3613,3636-3639,3662-3725
atgaatcctgtatttctcactgtccggcttacaaaagtgagtgggcggaggatcataaagcctaattagtaattacagaggggtctttttgctcatttttaaaacaaaatcaccaaaaaattttgtgaccacgaacggggattggtgtgactggaaagggaaactgtggcaaaaaattcgttttaccggtccaaaaatgtaagaagcgatcttttccgatttatgattattcggcagacaaaatcaggggaacacgttgacctggaatagtaaagtttgcctcccctccctaattttccgaaaaacccgaagattaccttttggtcttttgatctacccccccccctcccctttcggtggttttccgcgttgaaatttgacgaaaatttaaatcattcgtattccctttctcagaatgcgcaacagagcattgacgacttcaagactttttatgagcctcgccaaaacagctccggcgcgccaccacccgtggttagtttatcagcgcttagaaaaaaacacagtaatttccccccgttgttttagcctcgcgctgttcacgccaatgacgaattcacacaccacgagggaaccgtccacatcaatcttttcgtatttgatccaatcgcggaaggaacagaagcgaaggttgaggcccaaaaactgacgttgacggtggcacacgcatttggcacaaagaagacggagaaagaattcgatttgccagagaattttttgccgtaccaatatgaagtgagttctttttaaatcataaacaaaaatgggtggggaagcccaactcaaaaagaattttttttttttacaagacacgaagaaaggcgctccagcaatttttgaaaaaaaattttttttttcaagagtcgggaaaacatgtcccagcgattttcggggttgctgttcacgaatccggcatggcatcaatttctaacaattggaaccccggacccgaattcaaataagaagtttaaaaaaattttcgcatttcaaattttggttcaaatttgtacacggaacgaacttaaagtccattaatgcttcaattaaactatttttagactaaacatgaaaattgacaaatttgaatttcgacttttttttgttcgaattgacccggggtccggaattgatcgaatggatggatgccggattcacgatcagtgaccccgaaaacccttgaaatatgttttcatgactcttgaaaaaaaattttttttttttaaatgggagcggggggggggcaaagccacagtattaccgaagaatgaaacagcgacctcagagcggggggtggggggttagtggggtgcttttcacacttcattacctctgtcgtttcccccagaaaattttaaaacaaaaattaatttacaaattagagtgttatatataatgaaacttgaagaaaaaattaaaaaaaaaatttttttttttttttgacaaattcaagtttaaaacttttgagttttcgttttcggggggaatgaaatgccccggggtcatgaccaaccaccactgattcttaaaaaaaactcaattattttttcaaaaaaatcaaagtttttcacttataagattttatggtgaattactgttttctacaaaaattttcaaaaattcactgaaaaatttcgaaaatttctttgaacttttgttataaaagttttctaacaattatttacagtttaaattttattttcgggaacgatgaggggggatgacttgctccggggtcatgtccagaatttttttcaaaattttatggtggaaaattttttttgaaaaattttttttattcttttcggggtctgaggaacgacccgctccgaggtcagttgccgatgaccactggtcattggtcaccaatgcatcctatcgcttctcagttgtcaatatacgtatgacctttttacaggtattgcttcacgagcagagagtggaaataacagcgaaagtcgctgaccgtgtggacacgccgccaatcacggtcggttgttttacattaaaattgaataatttttggtcactatttttttgggccctcccgtcgcaaaagcaaaaaaaggtccttgaactcgaagttgagaccccatattaattgacctcccctgacatccattcgtaaatggtcagacatatcgcatgtgaatgcgtttatcgttcgttatgtgaaaaacaatttgtccccatttttggtctttccattggaattgatgaccactggtcattggtcaccaatgcatcctatggctgctcaattgtaaagtgtattactttttacagattgttgccaaagaagcggagcagaatgacgacgaccaaccttcgcccatcgcggtcggttgttctcattgaaattgggtaatccgtccgaccccatatgaatgcgttattaacaatcgtttatgagaaaaaaaattgtccacattttgctctccattggattgattttttccgttgttcgatttgccctcttccaacccgcggaaggggaggagagacccaccaattcaccatctctgctgctatagccaccatttacccaaaccaatattaaaattattcccattttcgtataattgttaccctgaagccatggactgtcccaaaaaagttaaacttccccctgaactcctttcggagttggccaattgccttcattacaattttcgctggtatggcatccgaatttctttgtcctttgaccattttctcgccaaaaatcaaaataaaattcgtcacaataaaattaaggtaatgagttggtcctctgcattaaataattggaaatgagaacaaggaaagcccattacagagctaattagacattgggtactattttttaacttaagcattttctcttgggtcctttttcaaatccgtttatgttttttccaatgcctttattaattaattacaattatactcccaattaattgctcttgcagaaagctgatgaagaaattcgagttcttgaaaaagttattgccgatgcgcaaaaagctattgccgatgcgcaaaaagttattgccgattcgcaaaaagctattgccgatgcgagtgctcgtatcgaatattggaaggagcaccgttctaccatggtctcctttttttacatttttcatttctatccaagtgactaatttattccaaacacagcatacgatgactatgccggtcttgccgcagcaaagcgaaagtacgagtcaacagcccgtcagttcggtactgtaacttcaaaaattgtaaaatttaatgttttttttttgaaaaattttcaaagttgcaaaaaattttttttttgcttggcggggaaaccatgcggggaactgagcccggggggggggaatagctgctcccgattttacattggcccttggtcagttcagagccgcctactttggctttcttttcttatttttttgtcaaaattttaggtaattttgtagtttgtcccccccccccccttttttgaaaatttttttttgccttaaaaacatgtttcatcaattaaattcatataacaaatttttatttagccgcccattgatcctccgattttggagaaagaagaaaacggaggggagccagccgcaaaaagaacgaaagcaaacgacgaatgaaggaacaaaagggaaagaaaagggcacggcaaaatttgacagaaaatccattgccataatgtttttttggattgtttaaataaa

SEQ ID NO: 70627 - DNA, 1396 bp, Heterodera glycines
  Genomic contig location: Contig_ID=SeqID_109; Location=1124..2519; Strand=+
  SCN-specific regions: Sequence locations=1-102,124-240,279-392,434 -502,524-987,1010-1338,1370-1396
atggagtgtcagaaattacgaattggtcgcagaaattgtgccgtcgcaaagcgtggttggttatgcctgtgccagctttatatcgtgtccaagcccgtccgtattcagaaaaaacaaattaaatagaaaattcgaagattttttgctctttacattaaaaaatttaaatttccaccatttgtggatcactcttcaaaaaattaatgctgcaaaatggcgtttcctttagtgccgttaggcgccccctaaaaaatttttggaaattttaaaaaatatgacaagaaaatatgccaaattttcaaaaaaaaattgcctattttccttaaaaaaattttttttttcgttgaagggtggaggttaccgcaaaacatcgccggccaaaacgtatcgccaaaatttttttaaaaatttaaagaaaattttgaaattttttcgttccccccccataccaaaattttaaaattttatgggtacatttttcattttacagacaattttttgtaacaaatagcactcaaattttcaaaaattttcccggcggcgcctattggcaccgccggacctccattttacatctgggactgtccctgggtcccacccgaaaaaccaaaggtgacttttgaattggagtcatttttcatgggatcaggcccgtatccagaaaaaatttcggggagggcacccgaagaatttttttttttgtttgttcctcttcgggtcaaaaaatttttcctccggtgtttaatttgttttctagttttttcctttttattcattccttagctttttttccagcatcaaattgtttattttacaatgcttttccacagatgctgatcaccgtagaaaaggtgacgttgatgttgaagaagcgagtgcaactgagttggaccgaatttgtgaagacaccgccaagagaagaattggcttggtatgaccaatgtgccgagttggaggacaaaatgatgggccaaattgagaaaaagcgggagaagagagagaaagcgaagagttggaaactgcgcgaaatggacgaccaatgaatggatgaaatgattttttggattccatcttttttttaatttcaaatttttacgcaattatcactgcaaatacctaaactgttttctcataaatacattaaaaagtcttacaacaaattaaatttttataagccttcatgaattttgaaaaatggtgggccgacggtgctataggcgccgcctgaaaaccttggaaattcgagtgcaatttgttaagaaaattgactataaaattcaaaaatctacccataaaattttgtaattttagtttgggggattaaaaaaactccattattagctgagaatttttaaaaaattttcatttcggtggggggagctagctagataggcaa

SEQ ID NO: 70628 - DNA, 983 bp, Heterodera glycines
  Genomic contig location: Contig_ID=SeqID_110; Location=379..1361; Strand=-
  SCN-specific regions: Sequence locations=1-125,147-585,607-639,670-983
atgggcatgtccgttgtgttcatgagcggcttcaagtactccgagctgtggctgatcagccgattggaggtgaggcaaaaagtatccattctttcaaagtgacagtacagcaaatcttttgcttgctcttgtataaaataaaccaaaatccaagaaactatccaaatttgatcacttttttgatattttatcttgaatcgtgctaattatctgacgaaccgaaaattttttttctaaaatcttaaattccgatacaaaaatcccttgtaatgtataataaaccatcactagggatgcaatttttaggcaaaagcctatttttttcctgagctccccatggcctgaaacgcacgaaaaacatgtttttttcgggtgttgttaagctacttttcgagttattagtgcctattttctaggcttttatttttagcgcctaaaaagcctaataaattttgaaagagcctatttttgcctattttggcgttttgcccaaaatttgttaacaaaaatgcaataaaaacgaaaaatacacccttaagaaacgacccaaacatttttcaaaaaaacacccctatgaatcgacccgaaattttcaaaaatatacccctaagaaatgaaaaacttttcaaaaattcatctccaaaatttatttatttattttcttgacaagaatttgtgctttaaaaattatttatctcaatactgatttggcctaatttttttcttttttgaatacattttgcacccctaaaaatggggttttttagtgcctattttccattttttagtgcctattttggggattttttagagcctaaagcctacctattttggcggtttttagtgcctataaattgcatccctaaccatcacattccaattttagccacatcaattttgtgcattggaacactccaaatacttcattgcctcaattgtatgtttttatatccatacataaaaaatatttcaaaaccaataaa

SEQ ID NO: 70629 - DNA, 671 bp, Heterodera glycines
  Genomic contig location: Contig_ID=SeqID_1247; Location=453..1123; Strand=-
  SCN-specific regions: Sequence locations=1-132,154-671
atgtcttctccaattgatgccattctcggacctaaggagaatgccgatcccgaagcgggagcaaaagcctcgaaaacgaagggctcgaataagcctaaagtctcaccggccaatatggccgagatccaaacggagctgggcaacgcaaaggaggaaatcctttccgccgtttcaaaatacattggcgaggctatgagtacggttaaccggggaatggaaggctttaccgcggccatcaaccaaatggctaatgctcttgatgcgagccgagcgcgggaagaaatggaacaaatgtcgctcgatgacccggagttggaagcggtgagcgttgaggccggagaaaccgggaaagaacccgagagcccgactgagggggagaatgagcagggagaaccccacccgggaccgaaaggcatctcattgccgcaggagcaatccgcccgtgagcgggggcgaggcaccggccatgggcgcgcattcatcagagggcgtgggggacatggccgtgggaccgctactggggcagccgcccatgcgcgccattatttcaacatgcgccagggacatcgagcgcaccaccagcaccacaaccaccgtcatcctgccccaggacattgccgatgccatgattgtcagccgccgaaccaccactttggacgccgcttccgtcc

SEQ ID NO: 70630 - DNA, 6666 bp, Heterodera glycines
  Genomic contig location: Contig_ID=SeqID_1247; Location=1306..7971; Strand=-
  SCN-specific regions: Sequence locations=1-169,192-223,245-728,751 -858,880-1240,1262-2313,2335-3390,3421-3588,3611-4205,4228-4540,4562 -4630,4652-4764,4786-5194,5216-5664,5692-6009,6031-6071,6093 -6170,6192-6539,6561-6635,6657-6666
atggacgatcacaaagggtccgactttaatcctaatcatttcactacgtcccaaaaccgaaattggtcccctttattggttcaactgcgcctatttgaagccaccgtttgcgaaacggtgagaaaattaatcgagaaagttgaagacatagagaaaggaaatggcaaggtcggtaattgtattgtcctcgaaggaaaactggaactttttggcgaaatgatgagacaaatggataaaggaataggtgaacaactagtgggaatcgaaaccgacttaaatttggctcaatcgaaattgaccgacctggagttgacagtcgatcagatttcccgaagattggacaaaggggatgagtctcagacggaaatgggacgaccaaatgtgaccgaaattaaggtcgcggcaatgagaagcaaagttgtggagatagacggaattgtaaaagaaaatcgtgaacggattacattcctagaacaaaaagttttggatgaaaacgaagaatatttttggaatggtcatgacaatgtggatggggagaataattttagcataaaccaaaatgttgaggacgagcaaaatcaggggctaacgggagaatgtgaagtaatgataagtgacccatttctgctctccggcagtcatttgtcccagtatgatggcaatccaagcatttccttttctcgttgggcacagaaatttaaagacttattatcgctttatacggctcagctcacagaggaacagaaaataagtcgtttgcgcttttgtctatcagggccagcccgtgccgaattagactcaatggatttaccccctgtcactttggatgctgctctagggcatttacagagcagattcgaaaatgagaacacaaagagtatagcgagacaaaacctcgcgatctgcagacaatacccgggagaaaaagtttttgattttgccactcgtttaagtgaggcagttaggactgctttggcaggggaaacggagggaaacattaggaaaagactgttggaagaatttttggatcggttaattcccgagctacaatacgaagtgaaatcggagaggccaacggactatagcagggcttacgaattagctcaacattatgagcttctccaggcgtcgcgcaagtcgacttcaaatgtggccatgaatgaacttattgaaaaagtcgaggcgttggccatgcaaaatgtgagacatgccccaaatttttctgatcagcgcgatcaccgggtttgtttttattgtaaaaaagcggggcatgtgataagagattgtgcggcgagaagaagggaagcaaacaatgggccaaattggcgaagagatgaaaacagccgtagaacggaacgcaatgggaattattctcggccattcggacagggatatgaaaggaaccgagagacgtggagaagcggaaatagccaacaaaatagtcggtcaaatcagaactatcggcgatacagagaccaaagtggtactagacgggaatgcgatcaagaaaatcgtttcccaagaacacccacaccaagagtaaaccctaggggaggcagaatagcaggtgcccgagtggcgagcccctactttttggcaataatcgctattttggcattgttctctccaacctcaatccttgcaaatgttccaaaacggcagccgatgatctgtttaccggacgctccgtcgagtttatggaaattgccagaggagccaatctgccccacgtggcaaccgactgaaagtccgatcccgatggaattaacgatttaccggccaaatacactccaatataaaacaccggctactgcatgtaaatgtgttaaatccaaaattcaccgcagagtcggagtttttggagccccattagaggaggtggaaactgagaatttggatatccctacctcaacttgccacagaatgagggatttagaccattccccagcgggagagctcagtaaaaatggaaccctccggtccactaatcactcattggaagtcggatggcgagtatggcccgtaggaatgttttggcatatgacggaagtcttaaattgttatacctatgatacggttgttttcaccaggtacggagttgaaggagtcagtactcccttaaataattgcccagggtgtcagtacaaatccggtgcatgtcgttgccagcaaaatagtatgatttggagtccggacccaacacaacaatgtccttttgtgtgggtagctaaatgggcaggtgaatacgcaacaaaggtgtggatttcgggctcaaatgattttgctctaacatttgaaaacataactgttcggcaaaactgcaaaaataaagaatttgcaatctcggaccaaggattttctgttcccttagaagagtatcaagaattggtaaggagaagggatttggctagccgagaaacagtgagattgagaagacaattagatgaaataacgcaggaagcgactcaagcgagggacaaaagtcccgttggactcatatactcttctcaattatcggctcaattaactgccttaagcgcccgattaacccataccactcaacggcttttttcagaggcaattagacaaatttgcacaagtttgcaatcaatcgcggatcaaacggctacgttagccatcgcaaatccaaccctattagccagatttttcttgagtaatcaactaataactgcgcgattagttacagagaaatccttggaaattcgcccatgttttggagtgaatgtgaatgagatgcattacaattggaaatcggggttttgtttcaatcgattaccagtgacatttatgatatacggggcacaacggcatgggtttttggatacggtaacccttatcatataccctgaggcaagggaaattgattgccagtcaggaagatggttgtacattcagggagagaaaaaattaacacaatatgaccaagtgaacggagatatcaaggaagtgccatgggaaacaattcataaaattgcccgttatggaaacattgatttgccagaaatagggtttactgtgttcaaaaataaggtgatggcaaatttgagtgagctttattcgccggaacatttcaccgagacactggaggccgcagagattcatcatgaaattgtcagattgacaaagccaagtggcgcttggagcgagaattcagcgaagcccgaatttttggccggaaatatagtgtcaaatgggcttttctcctttctgaaaggtggaattttttcagcaaaccaaatttgggttttttgtgtttgctgctatgttacaattggagcggtgatgcgtttcctattacccccattcttggctgaattggcaaaccaattaaatgttggggagtccctagttcgagttacacggacacttcagacaacaaaaagaagaaaaagggaattaaaacgtgtagcaaaggaaaatgaccagttacaattggcccggcaaagtgccattcctttaacccaaaggtggacaaattgtaatggggcattcacaaacggggagacccaaatcgctgaagttgcggtaattgaactcggaagatgtgatgaagactcccgaataggaggaataataaacgggaaaaaagttatatttttgcttgattcgggtgcgcatgttacactaattggtctggaaagtgccaaaaggttaggcataacaaaattttacccgccggaagttgcgggagtcacgggaattgggccgggagtcattccggcacttggccaggcagtcgtaactttatgtatagccgggtgtcagttcgaaaccacggcgattataatcccaaatgaagtaagcaaaagagggctttatcaagtgattttgggaagaaaaacgatgcgacaattacccctcctcttggacttagaaacgggccaattaataaaaaaagacaaaattacgagggaatgttttatttccgaaaaagtggaagaacctcgaaagtcaaatctgatgagccggcacaaaactgatttgcaaaccaaagctgagttaagcaaattttttggacttctgcaacgaaatgaagatattttctcgaaacatgattacgatttgggtgaatgcactatttcagctccacctattttaactacaacggagacgccagtctacagtcggccataccgagtgcccgaaaaataccaaacagaattggatgcccatttagagaaaatgttgaaaactggagttttggcagaatcaaacactccatgggtttctcccgtggtaatagtgcagaaatcagatggtaatttaagaccgtgtgttgactttcgagcgctgaacagagttactgtaaccgacccctacccaatcccaaaaatggagacagttttgcataaagtagcgggaaaagcattttatagtacgttggatttggcggccggattttggcaaataccccttgacaaacatacagcacataaatgtggaataataacagaaaagggagtctacacaatgagaaagctaccatttgggcttaaaaacagccccgccatttttcagcgaattatgaatgaagttttgtcggacattggacatacatgtgcctatatagacgatatcattgtgtatacggacacatttgaagagcacatgtttattttggagaaaatttttgaccgaatacgtaactttaaattgaaattgaagcctcaaaaatgtgaattttgtaagagcgaaattgtttatttggggcataaactaaactgtaaggggtacgagccgtccatcagcaacaaagaagtcatacagcatttcccagaaccaggaaatgttaaggaaataaaaagatttcttggactggttggattttttagaaaattcataccaaattacgctgcaaaagctgccccattgacattattgttaagaggaaaggaaaacgatgcgaattttaagtgggagacagaacaacaaaaagcatttttggctctaaaaactgagctgacaaagtccccaagcttacgacccccaaattataaaaaagagtttcatttatttactgacgcttcacaaatcgcttggggaggggctttgatgcaaaaagataacgaagggacactgtacgcagttgcatattgcagcaaaatattaagccaaactgaggcacgttacccaccaacccatggggagctggcggcaattgttcacgcgattggtgttttccatccaattttttacggatgtgacattaccatttataccgatcacaaacctttgactttcctgttatccaaaggaaagaccaatcccaaattgaacagatggcttctaattttccaggatatcaacccaaaaattaattatgtggaagggaagaataatgtggtggctgatgctttgtcgagagttgtgagcaccgagggaataaaatgggacctggttatggaaaagcatttccgggaggaaatcccttacattttgacaaccgaaccttttgtaattgataaaaacataattgagaatgaaacagttcgagacgagaatcttgctaaagtgatcagagagataaaggatagttggcaatcaacaacaaaagaaattgagccatatcacaaaatccggagcgagctatacttagagggaaatataattcggaaaaccccaacacagatcgtagtccccggaaatctaaaaattcccattttaaagggcttacacaccgcccattttgggatggtgaaaacaaaaagcaaagcccgaaaattgttttggtggcctggaatgagtaaggatatcgaggaatttatcaatgggtgtgagatttgtcaacgaaatgccgatttgccaccgatcactgataaaggaagaaaatggcccgaagcaaaattatgtatggaaagaatacatgctgacttagcagggcccatatggaatacgaattttttaattgtggtggattctttttcgaaatatccatgggtgtaccaaatgaattcaacgaattcccatgcaattataatggcattaggtaacattttttcagaatttggagctccgatcacttttgtaagtgacaatgggccacagtttgtgtcggaagaaattgagaaatttttatgggagaacggaactaagcatctgaaaagccctccgtataccccgtcctcaaacggagaagcggaaaaatttgtccaaacatttaaaaaaggagttaaaaaaatattagccgaaagaggggagggaaggattaaagaagccttgcaaatatttttgagagaataccgatcatatccgtgtatttcgaccatggagtcgcccgcccagcgtatgttcaaaagggaaatacgcaccccgttggaccgaatttgggtcagaacggaggaaaaacgtaaacaaatggctcaaaaagaagtgccgaaaatcagagataagcaattcgaattgggagactatgtttgggcaaacattaataaaacttggaggccaggaatggtggtggggaaaaagggtgatgttatctatgtggttagcgtcgaaggggacgaatcacccgatcggccggtccatctccactatttaaagccgcggagaccggcactcgccagagggcagcaaggcattactctgaaccaaccccccgaggatgttgtgtccacccctcccgaggaagaggagggaatacagtaa

SEQ ID NO: 70631 - DNA, 3429 bp, Heterodera glycines
  Genomic contig location: Contig_ID=SeqID_9212; Location=11..3439; Strand=+
  SCN-specific regions: Sequence locations=1-495,517-1281,1303 -1835,1857-1914,1936-2102,2125-2256,2280-2767,2789-2826,2848 -3248,3270-3429
  Gene Ontology: Mol. function=transferase activity, transferring hexosyl groups; Cellular component=endoplasmic reticulum; Biological process=dolichol-linked oligosaccharide biosynthesis
ggactaaaaaagcccgaaatatggactaaaaaggccaaaaatggccaaatatggaccaaaatatggataaaaaatgccaaaatatatgttgtaaaccccccaaaaaaggtgtgcatatttaatatttgcttaaataaacctaaaaagtacaataaacaaccaaaaaatggggtttaaaacttaaaaatgcatattttttattgttgttcgttgtatcaaaaacacctccaagtttgccaaatttcgaaaaaattctcattaaaaaaaagaaatgttcgcaaaaaaatgacgaaaatatttattgaaaatgccaaaatgacgacgaaaactcaaatttttcgtgttttgtggggtgtaatttttaaaaatttccaaaaagttgatctttaggggtgtatttttcgttttttttcatttttcttgtgaaaatttccaaaaaatggccaaaatatggactaaaaacccaaaaatggcgaaatatggatttattcccgaaaacccccaaaatatggatttatatggactaaaaaccttcaccaaatcaaaaaattttaatgcagaaatgctatttttaagcccctttcttcatagcatatgcgcagaaaaaatatgttaatccatataatttacaaccctacaaatgaggcttttttgcttgccgaatgaggcttttgaaaattttcatctgcgagccctggtttattcctatttaaatttattttcagcaatttacttcgtctgtcatgaacaaagtcagctttaaattcaccccttctcaggtttgttcttctcttaatccattcatttcggctctattgcagttttacacgaccagaaaaaaaggttgaaaaaattcacaaaagtttcaaaaattaagataaacaaaaagtgcaaaaacgaattttctatttgtttataatttttctgaaaccaaatgaatcttaaaattttttaaactgcaatagatctttcatttcttggtcgtaattcatcttcattatttttttaaattcattattctcttttataatgttttgatttgtaaaagtttaggtcaaaccttccgaccgatttggcagcaaaccgtcgaaagatcagctgaatgaatgtacacgaattgcggaagaaaataaccaatttttggatgatagggccgcgcttgtctttctcctggccttgtttattctccttcagatttgcttttctgtcgccaattattcgggtcttttcttgcttacttcatagcttttgcggagaaatccaataattatttatcgtatctttaatctttgataccaattgccgttttgagtgcgtccctttaactttggtcgttttaggccaccaaagtccgccaatgttcggtgattttgaagcacagcgacattggatggaagttactgtaaatttgtctccctccgaatggttttccatctttcattggtctgattttctaacatttcttaatttaggtatgtcaattcgactacaaatgatttaaattattgggggcttgactgtaagtgcaaaacacacattaaattgctaattttctttaaagaccctccgttgaccgcttaccattcttggctgcttggacaaatgtgaatttattttggtttgactcccaccgtctatcatttcatcattatatccaattgctttttgaagtgctctttttgtcgacccaaattgggtccgtcttggccattcgcgcggtttggaagagccccgtctcaaattgttcatgcgcctttccgtcatccttacaatggtcgctttgtttgcgcctgcgcttatacatttggtattgggtcaacaacgaacggaggaagccaaagggaacaaaaaaggcattgtcatggccaacccgacaaaggttgggtcggatttactaaaaaattaccgaatcggatggcctttgtttttgaaggtcctccgtttggtcggtgctcctctgctgttccccggccttttgttcgtggactgtgcccactttcagtacaatcactgctccctcggcctctttctgtgggcgctctcttttctcgagaagggccgtctccgcaccggtgcttttttctttgtgttggcccttaaccacaagcaaatggaactttaccacgctttgcccattgccgtttttctgttcgcccgttcattcgttcacacaaatcgaattcgttcattgttttcggcaattggacaaaggcaggacattcgatgaaattccctcattttctattcatatttgacttttttcagtgtctttaatttgtttcaattggctctggcggtgctgctcacttttctcattctttggtctccattcctttggcctgagccttcattggccctccaattgcttcgacggattttccctttccatcgtggccttttcgaggttttaattgtcttagtttctaataattattaaattgtccaaggataaggtggccaatttctggtgttgtgcttctgtgctggtcaaattcaaacaaatgttctccataaatgtcctcgtcaaggccaggcaaaatgctcatttctttttctttgcaattttcttgtgattttacctttttccgttcttttcagtgcctttttggtgtttttcgcttgcgttccttcgcttttttgccttttttatcggccaaactcttccaatttgcgcgtcgcattaactgtcaacgcattggccttttttctgttctccttccaagtgcacgagaagtccgtccttttggcggccatgtgagtgattcaaaaaatgagcaaaaggcaaaatgtatgcgatttgtctgtaatatttttcttcgcatgggcaaaagggttttactcttcttcatggaagtgggatttttgatgattggtgcccctggaaataaactgccaattaaaactcattctccaatagacctgcgcttcttttactgaacgacgaatcattgcaaaggccgacttctctctttttggtcgcctctttgttcaggtgattaactgcggacaaatctctcttggaaacatcaaatcccccgcctcccatccgtttccctttttcatttcattttccttttcagtcttttcccattgtgtctaaaggacggtgttgccgaggttcttccgctgtttttggcctactcttttctcctttggctccaattcttccgtttttccaatggccgacctttcccttcggtttgtccctcctttttttgtttccttattttcccatttaagctttacaactttctgttttgctttgttttggggccatccttcgcaatttgtgtctttcaacttttgctctctccgcccgtccgttttccccatttgttcccattgcttaacgcactgttcaactttggcatatttacagtcttttggctacatttaaattttgtgatagttcgccaaaatttggccgtg

SEQ ID NO: 70632 - DNA, 423 bp, Heterodera glycines
  Genomic contig location: Contig_ID=SeqID_9212; Location=3935..4357; Strand=-
  SCN-specific regions: Sequence locations=1-301,325-423
gacatgcaccatcaggagctgcagttgaaggccatgctcgagcagttgcgcatcaaagccaagtcggtgatggtcccgtgggatcacgtggttcaacacctcgacaaaccaacgaaatcctctgggggaagcagcgcagcgtaagtcgccgcctcttggcttttccataatttgctctattctgtgtcctctcatttaagggacatcaccgattactccgaaaagtttgtcagggcggtcaacgaaaccattcagcgcaatagtagcagcgcagccatgtgcttcctgaacttgccacttccacctccgacaaacagcaacaagtcggagcagtacttgtccaaactgcgactgctgactgatgctttacccccgactttgctcgtccacggcctcgcttcggtcatttccacagcgttatga

SEQ ID NO: 70633 - DNA, 1997 bp, Heterodera glycines
  Genomic contig location: Contig_ID=SeqID_9213; Location=1..1997; Strand=-
  SCN-specific regions: Sequence locations=1-280,309-776,798-894,926 -1663,1686-1781,1803-1877,1900-1997
  Gene Ontology: Mol. function=sodium:chloride/potassium:chloride symporter activity; Cellular component=integral to plasma membrane; Biological process=transport
aaaaaacttttcttttgaggattaaattgaaagttaaaaagcaaatgccacaaaattcctctcatttttaggccatggtcgatatcagcagtgtgccctccttgataatgctcggcattttcgttgccactttcttttcatcgatgagcaatttaatcggcgcctcgcgcgtactcactcgatttgcacaggtaatttttgttttgtaatttcaaaaattaatttgaattaataaagcattgtttttttcaaagttggacaaatggagggatgaagtcaaaaatacttttattttccaattaggacaaacttttcggcgctttgctcagaccggcgaccatcgaagtgggctccaaacggaatcccatcatttccgtcattatctcgtggatttgtgtcgtggtaagcttttttgtttgtttgtttttgcatttgttgtcaattttcttttcagatggttttgatgatcggagcgatgaatcgaatcgcaaaaatcacttccatcctctttctgctctcttacatgggcgtcaacattgccacagtaactttttctcagcaaattttcccgcatttctccattttcattgtacgccttttccgtctctcaatattcgttaccatatttttacagtttccttccccatttcttgcacaaatgttgacattgtttagctcgcgcttgaactgacttcggcaccgaatttccgcccaaatttcaaatatttttcttggcacagctgtgcgttgggtgccatttcgactgttcgtttctcccctttttctcattagtattttgtgttaaggtcgtaatgatgttgatcattgatgcgtcaatgtctgctgttgcggtggtcattctgatgttgctgattatgatccttcattatcaggcaaaatcaaacttttattttttattataattcgctcaattttcaaggctccgattggctcttggggctccatttcgcaggcactcatttatcaccaagtgcgcaagtatttgctgctgttggatgtgcgcaaggagcacgtcaagtgaacaccaatttaataatacaccaaaaaatgatgggaaaataagaaattaaataaataaaatgcaataatgttttaatttttcagattttggcgtccccaagttcttctgctggtcaatcggccggccacttgctgttcattgatggacttcgtcaacgacttgaagaagagtggactttatgtggtcggacacgtccaaaaagggcaaatggacgctgaagggacaacgatggaccctctgcaacaagtgggaaacaaataaatttaaacgattttaaaaacaattaaaacccaaaggtttacccctattggctttctctgatggactatctcaaactgaaggcgttcgttgagctgactttggcagaaaatgtgcgcaatggcattcagcaggtgcctttctcgttgcttgatgtcttcttttcaaaaaatccctccgtttttcagttgatccgtctcagtgggctgggcgcgatgaagccgaatacggtggtgttggcttttcacgaattggactcatcggaaacggcactgaccgaagcgcatctgttgaaggacctcaaattctcgaagattggtcgtgcggaagtggtggaatattttaacacgaacgatgtaaagaaaaaatccatttttaaagtgttgtaattcactcagaatggaatttcgtacactgaaaacgcactgaaggcgaaacagcgattggatggtgtggaatacgtgcaaatactgaacgatgttgttaatctaaataaaaatttgtgtgtggcccgtcactttgggccttttgagcgtgaatttgtactaaggtaaccttttgtaccaccgtaagcaatttcttcatttccatttcagacagtctgagcgtcgtttcatcgatgtttggccctcgcatttgttcaaacagagcgatgatggcaaaacgaatgaagacggaatgccaacggcgccgggga

SEQ ID NO: 70634 - DNA, 1323 bp, Heterodera glycines
  Genomic contig location: Contig_ID=SeqID_42822; Location=188..1510; Strand=-
  SCN-specific regions: Sequence locations=1-990,1012-1165,1187-1323
  Gene Ontology: Mol. function=endoribonuclease activity; Biological process=protein amino acid phosphorylation
atgggtgagaaatgtgtttttcggaccgattgtgctgttggctaattcaccttttgccccattttcagccgttacgtccctgtggattgctgtcaatatgctgcagttggagatgtgccgtgtgttgatcgctcatggtgccaacgtggacttgggaagtgacgcctccttgacgcttctgctcgcttgtgacaaaggcagcacagaaatcggtgaagcaattgtccggactaatttctcatcaaaattttttgccatttcagtcacccttctcgtggagaatggcgtcaacgttaatctcggggacagcgaaggagcaacgccgacaatgaacacttctcgttccggaaacgtgagaaaggcagcaaaatttgaaaacattttcatttctttagacagaaattttgcgcttcttactttctcacggtgcaaacattgaccagatggataacagcggtgggtttttgcccgtttctcaataattattgccctaattaatgtgtctttttcaatttcagggacccgatttgctcttttgaacgccgccgctaatggtcatttggaggtgtgccgtttactggtggacgagtgggcagctgacgtcaatcagcaagcgatcgacggcatcactgctttgataggcgcatgcatccgcggacgcttggacattagtaagagcaattggtacaaaagccgactcaatttttccccaatttcagccgtttttctcatcgaacacggcgccggcattgaccacgctgacatggacggatacaatgcccttatgtgggctgcgaaagaaaagaacattgaaattactcgtcatttgctggcaatcggcgcgaacgcagaccatatgggaattgacggtgggtaaaccgcaaaggcgttaattgtgatgcttcaactaacttatctccccccccccccatttaaggcaaaagcgctgtcgacattgccgttgagggcggacgcgccgacattctcgccttatttggcctttgaaagcgttcgctgtgttcagatgaaatgtgacctttcgataacctctgtttatcatgtgattgctgtcttattattcccactatttcggtccctttaattatgttcctgtcattgttatgtgatcgtatgtattatttacatgaaatgtcgttgcgtaaaaatatatatgtacagctgataaaatgctctttaaaattttgaaagtctgaatgaaaaatagtgaaagaaattgggggctaaatttaagggaccagcaggtcgttttggcgccagcccgagttttgattatagctttttttttgtgtgggccaaattaaa

SEQ ID NO: 70635 - DNA, 57 bp, Heterodera glycines
  Genomic contig location: Contig_ID=SeqID_42823; Location=103..159; Strand=+
  SCN-specific regions: Sequence locations=1-57
gctatagggaagatactcccgaaggattcggtctcccccataaatctgggcgcatcg

SEQ ID NO: 70636 - DNA, 1171 bp, Heterodera glycines
  misc_feature (43)..(43): n is a, c, g, or t
  misc_feature (62)..(62): n is a, c, g, or t
  Genomic contig location: Contig_ID=SeqID_42826; Location=327..1497; Strand=-
  SCN-specific regions: Sequence locations=1-1093,1117-1171
atgcctcccggggaattggtcgcattggagaatataaatttgnagatacttgtcagggattntcttggagaagatgggccagccggtatgcacatattaagtattatgtatttgattttttgaggatacgagcaaaccatcaaatggcttgctcgttatggacttattgctaatgcgttaacttgtccagaatgtcagcagcacgttgcttcacttgtaaaatatgcacaaagccctgaaggctttatagtgaaaaaaatgtaaaatattcttataacattgattttaagtggcgatgcagtcattgtcgaaaagcaattcctggcagcgaaagctcaagtcgattttccatcagaattggttcatttttcagccaggtgcatctgtctctacaccaagtcatgaaactttgctactactggtctgttcatccaacaagcactatggatgcagtaatgagagaaaccggagtaactcgcaaagacacgatcgttgatttttataacttttttagagatttatgccaggactgggcaattaggaaacaagaggaagggaagctaggagggatgggcaccgttatagaaatagatgagaccaaaatgtatagggccaaatacaatcgagggaggatgttaaatcgcccttatgagtgggtatttggaatgattgaacgtggaaccaatcgtgtaaggttttttcctgtcgctgaccggactgcagcaacgcttcttccgattattgctgataatattgaggctggcagtacgatagtttcggacggttgggcagcttacggtggaataaataacatgcagcaacagtataaccatcaatgggtaaaccaccaaatgtattttgtggacccaaacaaccctcaaatacacacccagggaattgaagcgacttggagggctttaaaacaaagcctaaaacatttgcatgggactacgcctgacttattgccaacatatttgtatcagtacgcatttcgtcgttatcattcaaacatcaaaatattccaaaacattttggaggaaatgcgtagagaatacccagtttaatgctcttatttgttagccgtttgcttctctttttagtgtttttaaatgtcttccttctcagcattttctgtgtacttttctttattatcattttcttatttaataaa

SEQ ID NO: 70637 - DNA, 75 bp, Heterodera glycines
  Genomic contig location: Contig_ID=SeqID_42830; Location=494..568; Strand=+
  SCN-specific regions: Sequence locations=1-75
atgctggcaatttgtccactttcgcttctcctttttctgctactgatcttccgctgtttccatgcatttctatgg

SEQ ID NO: 70638 - DNA, 52 bp, Heterodera glycines; identical to SEQ ID NO: 52019
  Genomic contig location: Contig_ID=SeqID_42831; Location=585..636; Strand=+
  SCN-specific regions: Sequence locations=1-52

SEQ ID NO: 70639 - DNA, 909 bp, Heterodera glycines
  Genomic contig location: Contig_ID=SeqID_9215; Location=1720..2628; Strand=+
  SCN-specific regions: Sequence locations=233-272,321-334,512-516,580 -584,666-668,713-791,821-828,858-878,904-909
atgtcattcgacacggaccaaaaattgccggttaaatcgccggccgaccagcgccgcgaggcaaatgccattcgcacattggcattcgtcggcgtttgtctgtccaccgtgtccacaatgatttgtgtggtgtccgttccgttggcttaccagcatttccagcagatgggcaccaacatgttgagcgaaattgacttctgcaagtcacgctcgggcaacatttggaacgaggcaattaaaagcgaaaattaaattggaggagaaaaaaacgctaaaattaaatatttgtttataataattaaagaaaattttcaaaaattgcttttattggcttaggttactcgtacccaagttctgtcgcaagtgtacggcaaaggcggcgcttttcgcgcagttcgccaagccgatggttacggtggcggaggaggaggtgccagcggcggaggagctgcctcttcacaacctcctgcagctggaggttacggcgcgggaggaggagctgcaggaggtgctgcgccacagggaggagctgcaggaggtactgcgccacagggagaagctgcaggaggtgctgcaccacatggaggagctgcagaaggcgctgcaccacagggaggagctgcaggaggcgctgcaccacagggaggagctgcaggaggcgctgccccccaaggaggtgctgctggaggtgctgcaccacagggaggagctggaggaagtgctgcgcctcagggtgcagctgcaggaggtactgcaccacagggaggagttgcaggaggcgcagcgcctcagggaggagctgcagggggagctgcaggaggcgctgccccacagggaggagctgcaggaggcgctgccccccaaggaggtgaagaggaggtgctgcaccacagggaggagctggaggaa

SEQ ID NO: 70640 - DNA, 521 bp, Heterodera glycines
  Genomic contig location: Contig_ID=SeqID_9215; Location=2111..2631; Strand=-
  SCN-specific regions: Sequence locations=1-9,35-55,85-92,122-200,245 -247,329-333,397-401
  Gene Ontology: Mol. function=pre-mRNA splicing factor activity; Cellular component=nucleus; Biological process=signal transduction
cacttcctccagctcctccctgtggtgcagcacctcctcttcacctccttggggggcagcgcctcctgcagctcctccctgtggggcagcgcctcctgcagctccccctgcagctcctccctgaggcgctgcgcctcctgcaactcctccctgtggtgcagtacctcctgcagctgcaccctgaggcgcagcacttcctccagctcctccctgtggtgcagcacctccagcagcacctccttggggggcagcgcctcctgcagctcctccctgtggtgcagcgcctcctgcagctcctccctgtggtgcagcgccttctgcagctcctccatgtggtgcagcacctcctgcagcttctccctgtggcgcagtacctcctgcagctcctccctgtggcgcagcacctcctgcagctcctcctcccgcgccgtaacctccagctgcaggaggttgtgaagaggcagctcctccgccgctggcacctcctcctccgccaccgtaaccatcggcttggcgaactg

SEQ ID NO: 70641 - DNA, 1322 bp, Heterodera glycines
  Genomic contig location: Contig_ID=SeqID_9216; Location=438..1759; Strand=+
  SCN-specific regions: Sequence locations=1-376,398-599,645-707,729 -831,853-857,879-1240,1271-1274,1297-1322
  Gene Ontology: Mol. function=structural constituent of cuticle; Cellular component=extracellular; Biological process=cuticle biosynthesis (sensu Nematoda)
atggtcttcccggcccccctggtctgcctggtccccccggaaatgccggtgggcccgggcagccagcgcaagggggtggtgccggcgcaccgggaccgatcgggccgccaggacccgagggtcagcccggagcacccggaaacccgggagagcaagggcagcctggcaagctcgaagaatcgggtgggtttttcgagccaattaatgcgatttgtttttttatttaaggtcaaacgcagggtccgccggtcagttttcagggcatattgttaatctgtgggtattttggtcattcattcccgtgctggtcgtttcctaaaaatcgcaaagaagtgggaaaacaaaaaatgtcaacatatagattcataacttggttcaatttcaaccaaattaataatatttcatcgtatccaaggtgttctctacaagaaaattaatttagaattttttttttacaaaattgtaaaaaagttatggtcataatttttgagtcaaaattattttaccagaacttttttaaaactgatgaaattttttgaaattttaaacataaatagagaattcttttgaattatcgaatacatagaattcattttgacttaatttttaatgactttaaattttaaatgtttataattatatttgcataaccatgccaaaaaaacatagctgttcaatgctatataactttttttcaaaagcaattagattaaattttctttttagaatttcaaatactctatttaatctcttttctttaaaatttcaaaaaatttcattgagttttaaaaaagttcttgacaaaaatttccgacttaagattttattatatgttaaaaaattttgaaaattaacattctcatataaaacaactagagctattgaaagataccatgaatattaattttgttgaaattaaaccaagttatgaatttatatgttatacattttttgtttttctaccctttggcagtttttaggaaaaacctatcaacattcattcccattttaattgcttagggtccgtccggccctcctggccaacccggcggcaatggcaatcccggcccacccggccccaacggcgagcccgggccccaaggccccccgggcgacgaaggacccgcgggaacgccgggacagcccggaaacgcgggagagcaaggaaaattgggcgagggaggaaagtcgggggtgtgcgatcactgctcaacgccgaggacggcgccgggctattagagggaggaggaaaaggaaaaggcgaaggaaatgccaaaaaatgcaaattgtatttttaagattatttgaagaatttattatta

SEQ ID NO: 70642 - DNA, 573 bp, Heterodera glycines
  Genomic contig location: Contig_ID=SeqID_42832; Location=207..779; Strand=-
  SCN-specific regions: Sequence locations=1-260,282-413,440-522,565-573
caggctatagggaagctattcccgaaggattcggtctcgccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagact

SEQ ID NO: 70643 - DNA, 255 bp, Heterodera glycines
  Genomic contig location: Contig_ID=SeqID_42833; Location=102..356; Strand=-
  SCN-specific regions: Sequence locations=1-60,84-255
atgccatttccatttgacggtggtagaagcacaaccgccgaacgtcgcgccattcgaattggttataaatcccgtgccaaacgagtcgacggattttgtgcggacacttcggctcgcattggtttgaatccgctgatcatcaaacggcgatttgagtgcgcgtcgggcgagtgccaatgtcaacatccaccaccgaagggaagtggtgatatgcgcgtccgcgttcaatcggagcgggtgtgcccgacactttag

SEQ ID NO: 70644 - DNA, 60 bp, Heterodera glycines
  Genomic contig location: Contig_ID=SeqID_42834; Location=926..985; Strand=+
  SCN-specific regions: Sequence locations=1-60
atgagaaaaagagatagctattttttggtcagaaatttttttgtttgcgtttcaaatatc

SEQ ID NO: 70645 - DNA, 694 bp, Heterodera glycines
  Genomic contig location: Contig_ID=SeqID_42836; Location=136..829; Strand=-
  SCN-specific regions: Sequence locations=1-41,63-174,196-694
atgccaaaggaattggacgaggaccaaatcgaacccatcgatgggcagagaaaggaaatggcggcaaacggaaaggcgccgcgggcgattgaatttgacagagcgaagggattggataaggaagagcaaagtgaggaaaggaaatggcagaaggaaaacggcgaaagtcacgccatatttttgaaaatgtttttgaattttcgaaaattctttcggcggcagagcctatcgatgcaaaacaaattgttcaaaatgaaaacgatcataaaaataaaatgaaattgcattgtacacaattttaatgcaaaaactgatgagtcagccgcccgttcagagaagcacagccgtcgccccctcgacgcagtggtcgcgcggatgcccctccgctcgcgtcttctctacttaattatgccctcgggcgagtcttttcctttcctctcagcaactaaacttttttaattcagaaaggcgaaaacagctgaacaagtaaaattggaaaatgttcaaagcgaatgccaaattttaaggcacatgcagcggcgacagcgcgtgggcaccaaatgggtacagacggaccaatggttgttggacacggcggaaccgatgcatcagaacgccaatttttaaacggaacgaaggatgggttgcgaagatgcatagacaatttagaaagaaaattgtgtcgccgaataaa

SEQ ID NO: 70646 - DNA, 341 bp, Heterodera glycines
  Genomic contig location: Contig_ID=SeqID_42837; Location=110..450; Strand=-
  SCN-specific regions: Sequence locations=1-341
atggctctgaaacgcatcaaattttatcgtacaagttaaataaggctctctcgatggctttttactaatcaagctctagctcttttcatttttaaacgttaggatttttttttcggttaccaaaacttcatcgaacctggctcttttctattctcattcaaatcgccccaaattttttttaacaggttaactaaggccctaattaagcttattttccagaaaaatcttcgcatggaatttctcattttttaaagtttggagtaccccaaacggacacttggaaaaatcgattttttttggtttttcggggcagtccccccgaaccgatgggcccagattaa

SEQ ID NO: 70647 - DNA, 194 bp, Heterodera glycines
  misc_feature (31)..(31): n is a, c, g, or t
  misc_feature (37)..(37): n is a, c, g, or t
  Genomic contig location: Contig_ID=SeqID_42837; Location=1..194; Strand=+
  SCN-specific regions: Sequence locations=1-194
tcaagtgtccgtttggggtactcaaacaaantatggngagcaaaaatccaaccgccagaattaagtacaggctatagggaagctattcccgaaggattcggtctccccattaatctgggcccatcggttcggggggactgccccgaaaaaccaaaaaaaatcgatttttccaagtgtccgtttggggtactcca

SEQ ID NO: 70648 - DNA, 98 bp, Heterodera glycines; identical to SEQ ID NO: 59716
  Genomic contig location: Contig_ID=SeqID_42837; Location=927..1024; Strand=+
  SCN-specific regions: Sequence locations=1-33,60-98

SEQ ID NO: 70649 - DNA, 362 bp, Heterodera glycines
  Genomic contig location: Contig_ID=SeqID_42838; Location=300..661; Strand=+
  SCN-specific regions: Sequence locations=1-362
atgcacgcgttttgcgctcgagctatttatcatcgggcttgtcaatccaaagcgaaacaacaaagatgctgttttgaacgaataaagggcataggttattttgaagaagtgtcaaagaacatgcagcaataagcctgcaaaatctaataagtggaaaatacatgagtatagaatttattttcagaaagtgtcaacagacttttggaatatatatttgcaatttatcaacaattttgagaagtgagttagaaacttcacgattcaaaccaattttcgttgctctaattaaccgcgataaaaacattcgaatcaattaaataacttctgagataataaggtttatcataaaatttcatttaaaa

SEQ ID NO: 70650 - DNA, 456 bp, Heterodera glycines
  Genomic contig location: Contig_ID=SeqID_9217; Location=3239..3694; Strand=+
  SCN-specific regions: Sequence locations=1-413,453-456
atgggcattggcctggcaatggccaagccctcatgtgcaatcgctaattgcgatcgccatgccccctgccagcggttgtattcggttggagtcggcttgagcgctaatcgccaatttttttttcaattcgtttcgttgttttaaaataaattagcagggctcgaattttctacctttttaggccagttttaaaagactatttttttgttcattttgcttttctatatgaatttttcgtgagtttttcaggtcacggggagctcaggaaaaaataggcttttgcctaaaaatgtgagccctactcattattatttgttccttattctcttacttatgctcattgttttactttatgaatattggttacttttctgtgctcatgaaaagcgactctttttgatctttggcgtttcttttaattttaattaattctttttttattttaattaaatggca

SEQ ID NO: 70651 - DNA, 1045 bp, Heterodera glycines
  Genomic contig location: Contig_ID=SeqID_42842; Location=1..1045; Strand=+
  SCN-specific regions: Sequence locations=1-1,501-513,695-909,960 -986,1043-1045
  Gene Ontology: Biological process=N-linked glycosylation
aaagaaaagaaagaggaacaaaggaatgatgagagtaaaaaagaaaaaggagagaatgaagagaggaagagcaaagaagaggagaagaaagagagaaagagcaatcaagaagagaaaaaagagagtgatgaagaaaaagaggaagaggttaatgaagaaaagaaggatgagagtaaaaaagaaaatgaaggagtgaatgacgagaggaagcgcaatgctgacgagaagaaagaaaatagggaagaaaaacaggaagaaaaggaggagaaaagggccaaggaagaagaaaacaaggaagagagtaaggaagaaaaaatgggagagaggaaggaagatgaaaagaagaatgagagtaaaaaagaaaaggaaggagagaatgaagagatgaagagtaaggaagaagagaagaaggagagtaaggaagaaaaaaaggaagagaataataaaaaagaaaaggaaggagagaacgaagagaggaagaagagtaaagaaaaagaggataatgaaactagggaagaaaaactggaagaaaaggaggagagaagggccgaggaagaagaaaagaagaaagaaaaaaacgacgaaaaagtggaagagaaaaataataatgacagcgaggagcaaaaagtcaaagataaaagaaaggacaaagaggaagaaaagaagaaagagaaaggcggaagagaaaagaaaactgaaaatggggcagaggaggaggtcagttttcaaaaacaaacaaaaaaacaaaaaaatttaccaattcagtcccgccgtaaggaaatgggcacgaacgcgggttatttgtcggcgaacgatgaatgggactgagatggacaagggatcagcggaggagagagagcgaagcgattggaggagagggagacgagagagacgaaatgatcggcgcaggagagagatgagagagagagagagagaagagagagaaagagagagagagacaaagtgattggaggaaaagagagacggaaatgaatgtttaatttttgttattttaaatgttttgattgaagatttgatttttaaa

SEQ ID NO: 70652 - DNA, 293 bp, Heterodera glycines
  Genomic contig location: Contig_ID=SeqID_42845; Location=61..353; Strand=-
  SCN-specific regions: Sequence locations=1-248,270-293
atgtgttttaaatttttgactcggaatcgagttgttcagcggcgttgtttcgagcggttgcatgtctttcccgatttggaggttcccgattctgtacgcgagaatatcaacaatcgaggtgggtttttttgtttttttgctatgcaaatagttcaattgttcgggttttagcttcgccaagtccgggaagtgccgaagaaatcaacggagtacggtgccgaagaacgcgccgcctttcctctgcttttccgcccgggagaagactttctcaaaaattgggaagagcctattga

SEQ ID NO: 70653 - DNA, 921 bp, Heterodera glycines
  Genomic contig location: Contig_ID=SeqID_42845; Location=419..1339; Strand=-
  SCN-specific regions: Sequence locations=1-84,114-502,534-671,725-921
atgtccacaaattgtgatgaattgggcggtcaattgccaatgccaacaaataatggacaaagttgtgataatttttcaaaagcaattgataaaaagaaaagagaaactgtggaaaaatttcataaaattaaggagaaagttaagcaaatgggaaagaaacattcaacaaaagaatggaataaaattgaaagaaaaattgcacaaaaattaggtgcaaataaaatgaaaatttacaaatggaagagcgaacttggaatgatgacgaacaaaaattattcagttgaagaaaaaagaataatgttaaagcaatttgatcaaatatatgcaaaattaaaaatgaaattaaatggaaaattggaaggaaaaaagaaaaaatgccaaaaaataatagcaaaacatttgggcacaaatatcagcagtatttatacatggaagaaagaaataaaagatggaaaaatggtgaaaaatcaaaaaactgatgatgaaaaaagagaaattgttgaaaaatatttaaaagtaaaaattaaatttatgcaaaatggaaaacattcgcagaaggaatggaaggcatttaatgcaaaaattaaacaaatgtttggtgtgagttattggacgattgaaaaatggccaagaaattaggaattaaacaaactaatttaaaaggtaaattcaattaaacttttatttttaaatttaaaataaatttttcaatttaaatatattacagagcgaaaaaggttcacaattgtcgaaaaaatggaaataatgaagcaatattatcttatgaaaaaggaaactccaaaattttccgatgtgaaaatcgccgaattgttgaacattgagctaatgtccttaataaaatacaaatccgaatttaaggaaaaagtggaaatgttttaaatacgacagaaggccaataaa

SEQ ID NO: 70654 - DNA, 529 bp, Heterodera glycines
  misc_feature (30)..(30): n is a, c, g, or t
  misc_feature (78)..(78): n is a, c, g, or t
  Genomic contig location: Contig_ID=SeqID_42846; Location=342..870; Strand=-
  SCN-specific regions: Sequence locations=25-142,222-253,280-529
atggtgatgataatgatggtggtgtgattnggcatgatgaataaaaacattggacttattagaaatgagaaagacatnttctaatgtgaaacttccgcagaaatattaattgctaattaattaaagggtgcgcaaaatcttcaataattaattatcttatattttcaatgattttactttttcttttttcttaagaaatgaaatttttataaaattattttctattaaccatagtcattggtttcgttttttgaaataataattattattttaatttttgttagaatgggattggaaaaactatgcccaatgagaaacaattggcatccgtatttgctctaattatcccccatgggggattatttttcaaccacctcgtagactggtggataattggagattggaggattaatggagattgggggataattagagcaaatacggtactatagctgaagaggcaaagcggagattcttggctatgatgactttcataattcattttcaatattatttttttgccaataaa

SEQ ID NO: 70655 - DNA, 128 bp, Heterodera glycines
  Genomic contig location: Contig_ID=SeqID_42846; Location=369..496; Strand=+
  SCN-specific regions: Sequence locations=1-128
atgaattatgaaagtcatcatagccaagaatctccgctttgcctcttcagctatagtaccgtatttgctctaattatcccccaatctccattaatcctccaatctccaattatccaccagtctacgag

SEQ ID NO: 70656 - DNA, 729 bp, Heterodera glycines
  misc_feature (37)..(37): n is a, c, g, or t
  misc_feature (68)..(68): n is a, c, g, or t
  Genomic contig location: Contig_ID=SeqID_42847; Location=988..1716; Strand=-
  SCN-specific regions: Sequence locations=1-199,234-276,337-470,492 -548,570-729
atgtggccaaaagcgcgtcatcgcccaccaccactanctggtaaagtgggtgggtttcccaaggaccncatcgattggatacctgtcggggattggtatctgatttctaaatccttttcttcatcccccaccccccattcagaactgtgaagaggccataaatgattattggcagcgatatcgagaaggcaaagagtacagagagcggaagaaagaggaaaagatgaaaaagacgggacagcggaagagaaaagtctcgggaatggctacggccgcgggagaaaaggagcaaaaggaggaaaagaaagaggacgaaaagaagggagcggaggaagaattgcagcaacagctcccgataaatgccgggactgagggcacgaatgaaggaaaagcagaggtcggggaagaaactgatggggcggaaacaacagaggaagcgaaaaaagagatgggctctgccccgggggagatggtggaggacgggactgaaggtcgggaggatgtgtgcaaaaaagggaatttggaatcggcagatgtgggactggaggttgaaaagttgaagaaaatgttacgcgacagtggccaaatggcgacggacaatgccccacttcccctacctcgatgggtgaagggttgtggggcattcaaaaggaaatataagaaaatttatgataacatgattaaaataaacaattcgtgagctgtattgtattattgttgcgtaataaa

SEQ ID NO: 70657 - DNA, 967 bp, Heterodera glycines
  Genomic contig location: Contig_ID=SeqID_42849; Location=225..1191; Strand=+
  SCN-specific regions: Sequence locations=1-300,326-491,545-627,653 -841,884-967
atggtgtaagtaaaaatcgtaattacgctaaaaaagcttctcaaacaattttagcgcttccaattccttctacaattgcctttatacatcccattatgagcgctaaaattatcagagtgccgaaaatcgcatgtgatctaagcctagaaaaaatggtctaagtaaaaatcgtaattacgctaaaaaagcttctcaaacaattttagcattattttttcagaaagtgctctgaaacgcaccaaattttatttacaagctattttaggcactctgatgctttttctatcaaaaagggagatgaataaatttttaaaaatttttaattcctttttaaacaggccaaaaagtttaggcttaactttttttttcagaaactgatcagaagcgcaccaaactttgcagggaaactccccggtaaaggactaacttacactgaaatgagcgccgagctagctgggtttaaaaattttttcgaaaatcagagtctttcgtttttatttaattatttattattttttgcaaaattaattcataattattttttcagaaagtgctctgaaacgcaccaaattttatttacaagctattttaggcactctgatgctttttctatcaaaaagggagatgaataaattttaaaaaatttttaattcctctttaaacaggccaaaaagtttaggcttaactttttagtgaaaattaatttactcatttttcgagtagtgctcagaagcgcaccaggttttgcaggagcctaaaaaggtcaaggaaaggcgtctctgcgttgatttagcagtagtacctatgaatttaaatttcctatgaatttttaaaggttcacaatttatttattttttgcaaaattaattcataattattttttcagaaagtgctcttaaacgcaccaaattctatttacatgttaaataaggctctctgatgctttttctatcaaaaaggaagatga

SEQ ID NO: 70658 - DNA, 286 bp, Heterodera glycines
  Genomic contig location: Contig_ID=SeqID_42850; Location=1..286; Strand=+
  SCN-specific regions: Sequence locations=1-286
attgcgcaccgccctctctatcatgctctagagcatttgtatgtgtgtaaaatttatcaaaaaaaaagatagccattttctgggataacctctaaatataaaaatcctatgtgagaattaaatcggcgattgtagcacacgtcctcctgtctcatactgcaagatgcttttgtgaggtataaaatttctcaaataaaagacatagacatttttctgggatagagatataaagttaaaaattccctcaaaaataaaaggtctattgcgcaccgccctccctatcatg

SEQ ID NO: 70659 - DNA, 81 bp, Heterodera glycines
  Genomic contig location: Contig_ID=SeqID_9219; Location=183..263; Strand=-
  SCN-specific regions: Sequence locations=1-81
atggtgatggacgaccagcagcaacaacagcccaagcagatggtgccgacgcctccaccacagcaaaacagcggtcaaacg

SEQ ID NO: 70660 - DNA, 2201 bp, Heterodera glycines
  misc_feature (520)..(520): n is a, c, g, or t
  misc_feature (522)..(522): n is a, c, g, or t
  Genomic contig location: Contig_ID=SeqID_9220; Location=46..2246; Strand=+
  SCN-specific regions: Sequence locations=22-634,659-1184,1207 -1320,1343-1363,1385-1411,1439-1758,1780-1985,2105-2201
atgattccaaccacaattctccatcgatttaacacgctgttgttgaacagaagcaccaccaagccgtacaaggacacttttgtgctgtggacaatcgctctgctgatttgggacattgaagagcagaaaatgctggccttactccaattgaacagcgtagccaaagtgcatggacttaacagcttttgggatcaaataaaatcgctgatcagcgaaaccctccgaaacccaaaatcggagcaaaatgcatgtgtactgatcaagctgagcgaactttttcttattccaaaaaaagcattgccaaatattgcgagaatggcgtctaaatggcgcaaagagtgcgaagagaaaactgagcgcgagactgcgctgcggcgctttgttggcagcgcaaacggcgtactgtacaagaattgggtgagtatcgtattccaagtgtgcgaaaagacgaaagttggcgcgaccgtggcacttatgcaaaagcctggggccaaaacgcgcctcaaaaaagtgatgggcnancgaacaccggcggaagaactcttgacggaaaacaatttggcacacatttacgaaaatgacggtaagtcatccgttaatttgagaattgttttcaattggcattagtcttccctattttaaaattaaaaaataaaatgttcattttttggttctctgaatgccttccgatagattccttgggatatggcacaaatattcaaaaaaattttagtgttttttgacaatgaccgccttttggagcactacacttttggcatggaaaaagacgttcctctgatcgaacgcaaaagtcacaaattgggcgccgatgtcgtcgtttttatgcgatggtttgaacgtaaaagcgaacgccacattggcacggaaaagctccaactgatcataaaatatatggacaatcaaatttatgatccgatttttgatcaggacgaacaacagttggacaaattgggaacattcctcaaaacattatttatcgacgcgaaaacatttgcggaaaaaattgagggcaaaaacagtggagaagagaaacaaaaagtgcagaaaaacattttcaaaaaatggaaattaatggtggaaaatgccgataaaaatgagcaaggaaatggtgacgataaaaacggagaaatgaaagaatggatttgtgaattgcacgccaatgaatttttaaatttgatggaaaatgaggaaaagcaccgaagcttaaaaaacagtaattgaatttaattttttttttaatgttcaaatttgcaatgcgacaaaatcataatgtaaaaaaaactcagtaatgctaagtgaatttataaatgaataaattaaacattttacttattagcggtagaaaaactaaaaagttttgacatttctcagaaaatacagtaattcacagaatttgcaattttgaaattttttaaataaatatgattttgatatgcaacagggctggccgtgatcatggatcacgggaatcacgggggttttggggtgcagtgatcacggatcacggatcacgtgaatcacggcgtttttggggtgccgtgatcacggttcacggatttttttggaagccccgtgatcacggctcacggatttccgtgattggaaattcaatcatggccagccctgatatgcaacaacgtctcctgcaaaatcctgcgcggaacttttcctgtccggcctcttaacaatccgaatttttcgaaattttccaaaaaaaaagacaaaagcgcttaaattttccattttcaagctctcaacttacccaatcctggtcttgcatccgtggaataaaaatgaatatttttctattttcagttctaattcggcatggacctaaaaaggttcgcgaaaatttgctcgattttgttaatgaaaatgttgcaacgaatattttaaacaaattgaacacttttgaaatggtaaaaggaaataaaccgaaattaattttaaaattgcgccaaaatggaggagaattgaacaagcaaaaggaagaaaaggaaaaagaggaaacagagaatgatcaaaaaaaggaagaacaggaaaaagtagcggatgatgagcaaagggagggaaaaagggaggaaaattgggaaaatgcgaataaattccattggagaataattggagatgaggatgatgaatttacactggaaaaggaaggcattgagcaaaagcaaaaa

SEQ ID NO: 70661 - DNA, 702 bp, Heterodera glycines
  Genomic contig location: Contig_ID=SeqID_42854; Location=75..776; Strand=-
  SCN-specific regions: Sequence locations=1-15,39-104,156-198,235 -309,338-341,364-702
atggtaaaacaattctttttattaaatttctatgaaaaaacaaattctaaaggaacgagccccgcccattcgagtttctttctaccattactggtctgggtaagttaatttattttatctaaattttttatttaattttaaattatttcatattaggcaagctaccttttgccaatatttgcgtgggtaaaaatgttgataattaatgataatgttttatttatttttttaattcagagacctgatcagtaatattcctgatcgcaatttcgccaattcgtaagtcagtgggttacggaaaatgtagtgtataaattttgaaattttatttttatatgggctttataattatttatttcccccaaattaattttgttcagagcaacgtttgtcttaatgtatctacctcatttttatgttctcaattatattaaaatttatccaattacaattaatttaaaatcagctaatctaaaataattcttgttaaaattactttgatgcagacgaacaaagtttcgcaaatagaaatgctttcataaagagacagataaatgctcttctaaattataactagggataagattttaaggttctaaaaactgcaaaaataggtaggcgctaggctctaaaaaaatagaaaataggcattaaaacctcatttttaggagtgtaaaatgacaaaacattcaaaaaaataaa

SEQ ID NO: 70662 - DNA, 59 bp, Heterodera glycines; identical to SEQ ID NO: 52422
  Genomic contig location: Contig_ID=SeqID_42855; Location=115..173; Strand=-
  SCN-specific regions: Sequence locations=1-59

SEQ ID NO: 70663 - DNA, 59 bp, Heterodera glycines; identical to SEQ ID NO: 52421
  Genomic contig location: Contig_ID=SeqID_42855; Location=245..303; Strand=-
  SCN-specific regions: Sequence locations=1-59

SEQ ID NO: 70664 - DNA, 59 bp, Heterodera glycines; identical to SEQ ID NO: 52422
  Genomic contig location: Contig_ID=SeqID_42855; Location=375..433; Strand=-
  SCN-specific regions: Sequence locations=1-59

SEQ ID NO: 70665 - DNA, 59 bp, Heterodera glycines; identical to SEQ ID NO: 52421
  Genomic contig location: Contig_ID=SeqID_42855; Location=505..563; Strand=-
  SCN-specific regions: Sequence locations=1-59

SEQ ID NO: 70666 - DNA, 59 bp, Heterodera glycines; identical to SEQ ID NO: 52421
  Genomic contig location: Contig_ID=SeqID_42855; Location=635..693; Strand=-
  SCN-specific regions: Sequence locations=1-59

SEQ ID NO: 70667 - DNA, 59 bp, Heterodera glycines; identical to SEQ ID NO: 52421
  Genomic contig location: Contig_ID=SeqID_42855; Location=765..823; Strand=-
  SCN-specific regions: Sequence locations=1-59

SEQ ID NO: 70668 - DNA, 80 bp, Heterodera glycines
  Genomic contig location: Contig_ID=SeqID_42858; Location=264..343; Strand=+
  SCN-specific regions: Sequence locations=1-8,60-80
gtcctgcacataatatctgtggcatggaataaattttggaactgcgctgcctaacggcgttgcttaaagtgcgctaaaaa

SEQ ID NO: 70669 - DNA, 1000 bp, Heterodera glycines
  Genomic contig location: Contig_ID=SeqID_42859; Location=5..1004; Strand=+
  SCN-specific regions: Sequence locations=1-862,892-1000
atggatctgacacttgaacaagaccgcgagtggtatatctcattcattcgtgacaatgtaccggagcacctcaccgaagcagatctgtcgcatgaagttcatttgggggcgtttaatctagcgatgcaaatgtgtcatgcattgtctacaacagatttgaatcccgctccaaaggacatcagctttactagaccattcacaccggcaagtactcagagataaacgcctctatcggattcggtctgaggattttttaagcattttcagccataattgccattttgtaccgtttaattgggtacttatacacctacgccacattaattctgatagttatgtcgttttctggggtattggggtggccgatcaagactatgacagtgaggttcatctatttagaaccacggatccgatttcgaacagaagttgaaaattacttattcacatgtatagttcataacagattcaagtgcactcaatgcccgtgagtctctattcacagctaaacgcctgattgggtgaatcggtcatgtccaaaaattgtgcttaggtcgaaaagttgatttaccccctctcatgttcgatttcgggattcggaaagtttaaaattggcagctgttgggggtgagttatattacaatgtgagagtttttgtatacggttcatttccatactaaaaacttggcccgctgcctgcagccgatgcgcgtacacccctgggtgaattctgtcgggaacgttcgttggatgtaagattgaattatgtttccaatttcggttttattttatatccgggaaaattttttgtaatttcgttctgatttgttaacagattttcaccaaaaaattaccaaattttgccataaattttatatttttttttgtaaaatagtgacattaggccataaatgggaaaaagccattaatttttgtttgaaaattgttgtgctttttgtattcaaaagattttttgactgataaaacatgggaaaatcatata

SEQ ID NO: 70670 - DNA, 375 bp, Heterodera glycines
  Genomic contig location: Contig_ID=SeqID_9222; Location=1284..1658; Strand=-
  SCN-specific regions: Sequence locations=1-375
tacggtaggggtcaactccgtctggccaactccgtctcagcaatgttcaaaaagctataacttttttctttggtggccaaacttcacaatcatggtatcattcgaaagccctagatgtttagaagatatttataagctatttctcagtgattagtcagctctcaaaaaagttgtcagttgaaaaccgcaaaaaaggcagaattttcaaagttttttatttctatctttttttatagttcgaaattttctgtaatttttagtaggctaatagagcctgtgaagagctttcgaatgatatcaagattgtttgattcggtcaataacttcaagagttatattgactcaaagttggctcagacggagttggcccgttcc

SEQ ID NO: 70671 - DNA, 211 bp, Heterodera glycines
  Genomic contig location: Contig_ID=SeqID_42863; Location=395..605; Strand=-
  SCN-specific regions: Sequence locations=1-211
ctgttcatgctcgtcagtccatcttccgctcgctgtgtatcattctttgcctgcaattttgcggttggacatttggccaactgacctacgcatttgtgtacatgaatgcgccgttgatgcacccgttgacccggtggcaaatcaacagcatgttactagtgtttttaagcttaactgcagcactggatgtgccagtgttgtacatcaacag

SEQ ID NO: 70672 - DNA, 559 bp, Heterodera glycines
  Genomic contig location: Contig_ID=SeqID_42864; Location=335..893; Strand=-
  SCN-specific regions: Sequence locations=1-175,209-243,265-322,398-559
atgaagaaaatcacttttttgaactcacttattctattggactgttcgagagtttcgagaactcaatttgtgctctcggtttgtcattaacgggaatttcgtcccactaatttcaaattaaatccaccacaacaaagtcaattgctgctctctctctctctcttttatcttttccgcctttcccctctttgtttttcaaactataattaatcactcactaattgtatttggtgctgctgtagtttgaaattccaatttaaaaatatgaaactattttgactgttgtaaaatagtaaaattggaaatatttctcatcttttcttcatttttcagatgatatttatttatttgattaaagaaaattaattttcaaatcatttgttttatttgatttattctgctgttgttctactgtttttctgtgttatcttatcaacatgaagaaaatcacttttttgaactcacttattctattggactgttcgagagtttcgagaattcaatttgtgctctcggtttgtcattaacgggaatttcgtcccactaatttcaaattaaa

SEQ ID NO: 70673 - DNA, 633 bp, Heterodera glycines
  Genomic contig location: Contig_ID=SeqID_42865; Location=37..669; Strand=-
  SCN-specific regions: Sequence locations=1-500,522-633
attgatgacaaggcattcctcgcatttgttaagggacaatccaattttgagcatttttgcatacaggaaaaggacaactatttgtttgacaagggattgccaaaaagtgtcacttttgatcagagaaaggagcatttggcacaaagatacggagcccatcttggcacagttcagttgatgagagagcattggcactgtgccaaattgggaaagcatttggaaagcatacgcagacggaatgccaaaaataccgaaaatatttggacattttgtacggctatttattctgtgtgtacactgaaggttgtgcttttcttagggaagggccgagaaattttgctttttttcagatgacgaacaaccacagggattaatgccgctgcttatccgaaatattgaaaatttcgggacactaattgatttcgtcaaacagctaaaccgaatagccaaattctattttgatgccaaattcagcaggtacaatcagtacaaaatagaaaatgccttcaaattcaaaaattcggtcatttctatgcaaaattttgaacaaatatttaaagcagcaaattatgggggaggaaacgcgaaaaatgatggggaaagccaactgatcaaagcacaattgaccaaaag

SEQ ID NO: 70674 - DNA, 821 bp, Heterodera glycines
  misc_feature (782)..(782): n is a, c, g, or t
  Genomic contig location: Contig_ID=SeqID_42866; Location=87..907; Strand=+
  SCN-specific regions: Sequence locations=1-786,809-821
  Gene Ontology: Mol. function=electron transporter activity; Cellular component=mitochondrion; Biological process=glycine catabolism
gtgttcaatgacttggaaaaatggctgtgcgagttgactggctacgacgccttctcacttcagccgaataggcaaaaaataaaagcaaagaattgaaatggcaaaactgtttaattcagtggggccaacggcgaatacgccggacttttggccattcgtaaatatttcgaagcgaaaggggaaacgcagcgaaaagtgagtagggaaacaactcactcacttggagatttggcctcattagagaggaaatttacgattaaatactcactaatctgtgcattgattccccccccccccccgaaagatttgtttgattcccatctccgcccatggcacaaatcccgccactgcgcacatgtccaatttccgagtggtcccagtggagtcggacaaacacgggaacatcaattacaaggacctctcagcaaaggcacgtgggagaagggcagtggggggaaaggcattgaagcatttcagtgtgaaaagcacggggcggagttggcatgtgcgatgatcacttatccggtaggattttagttggccattgccaaattggcctccatttctagtcaactcatggagtgttcgagtccaacattttggatgtgtgccacaaagtgcatgagtttggtaatggcgctctgtttgcccattcaatattatttagcgttattttcccaggaggtcaaatttacttggacggtgccaatttcaatgcccaagtcggcctttgtcggcctggcgattacggaagcgatgtgtcgcacttcaacctccacaangtgacagaaaagtcatcaaagcataaactttaccctaac

SEQ ID NO: 70675 - DNA, 279 bp, Heterodera glycines; identical to SEQ ID NO: 58736
  Genomic contig location: Contig_ID=SeqID_42867; Location=313..591; Strand=+
  SCN-specific regions: Sequence locations=1-153,196-279

SEQ ID NO: 70676 - DNA, 121 bp, Heterodera glycines
  Genomic contig location: Contig_ID=SeqID_42867; Location=280..400; Strand=-
  SCN-specific regions: Sequence locations=1-86,120-121
gctgtaaaaaaaatttggggcgatttgaaagagaatagaaagaaccaggttcgatgaagttttggtaagccaaaaaaaatgcaaacatttaaaaatctataaaaaatttaaaaaaatttga

SEQ ID NO: 70677 - DNA, 123 bp, Heterodera glycines
  Genomic contig location: Contig_ID=SeqID_42870; Location=243..365; Strand=+
  SCN-specific regions: Sequence locations=1-123
atgcagctcgtctgtgtgttaaagaaatttggcgagttaattgacttgtgtaaatgttgcctaaggcacaaatgctgtggggaactcatcactggggatgctgaacctaaagctggtggtgaa

SEQ ID NO: 70678 - DNA, 66 bp, Heterodera glycines
  Genomic contig location: Contig_ID=SeqID_9224; Location=469..534; Strand=-
  SCN-specific regions: Sequence locations=1-66
atgttggcacaattgagaggaaaaggcatcgccgaggggcacgagaccagctcagataccattctg

SEQ ID NO: 70679 - DNA, 1091 bp, Heterodera glycines
  Genomic contig location: Contig_ID=SeqID_42874; Location=194..1284; Strand=-
  SCN-specific regions: Sequence locations=1-474,501-819,841-1091
tttagcgcgtctcattttcctcattatataattcattcgttgtttgctcatccctccgtcgaccgctgaccaaacgaatttgatcgaatagcataacggaaatgaactacgacagcgctttcaatgggaccaacggaggtgcggttgaggaccgagtccgaccggcttcccatgccgggtcgtggtacgaccgacgcatcagaatgatcaatttccctctctctatgttaaggtattccgaaaacgctaaagggttggaccgtcagctgacgaattggctcaacgcggccggtccgaccgttggggcagcgcgtgcgataatatcaccgtcagtttcgcataatcagcacgttaattgccctgcattaagaactcatttgaaaacggatggttaaccctcaccaactaagaaatttacttggaaatggttttgatttgaatgcactttagtcgcatcatttgcaatatgtcataatttagcatttattttattaccaaatttccacttttgtgggggggggagtaaatttaggcgttgtgttcgcttccgtatgttttggcattgacttattcatttgctgtttcagtcatgccgggtacacttattgcggtgaaactgcaggtgcctttctctttctctccatttacttttttctccaatttgccattttcccttttagcatttgccttcaaacaaattgtgccggacaaaatgttgtgccttttttttaactcctccgcccttttcaatgcgttcgttccctctcagaaagcgcattttcgtgctcggcccttcccacgtcgtttatttgtccggctgcgctttgaccacttgcagcaaatacgccactcctttgggcgaccttttcgtggacaccgcaggttttaagagggaaattatcataaaaaggggtcggatgggctgaatttctgcattttaattgctcatcgcatttttgttcattgtcagtgaatgagcagctgaggtcggccaatggtgccgactccttcgaatggatgtccgtgcggaatgaggaggccgaacacagtttggagatgcaaatgccattcattgccaaggtgatggagag

SEQ ID NO: 70680 - DNA, 731 bp, Heterodera glycines
  misc_feature (31)..(31): n is a, c, g, or t
  Genomic contig location: Contig_ID=SeqID_42875; Location=339..1069; Strand=-
  SCN-specific regions: Sequence locations=1-90,112-731
cagaaactgatcagaagcgcaccaaacttgncagggatactgaaaggaagagaaataacctattttaaatattatctagtcagttcatttaaataatttttatccaaaaaatttttttttgggtttcggggcagtccccctgaaccgatgcgcccagatttataaggagaccgaatccttccggaatagcttcgatatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagtctgtactttaattctgcgttggatttttgctccccataattgtttgagtaccccaaacggacacttgaaaaaatcgatttttttatttcataaatattttttcagaaattgctctgaaacgcaccaaattttatttacatgttagtttaggcactctgatgctttttctatcgaaaagggagatgaataaaattttta

SEQ ID NO: 70681 - DNA, 974 bp, Heterodera glycines
  misc_feature (13)..(13): n is a, c, g, or t
  misc_feature (52)..(52): n is a, c, g, or t
  misc_feature (59)..(59): n is a, c, g, or t
  Genomic contig location: Contig_ID=SeqID_42876; Location=155..1128; Strand=-
  SCN-specific regions: Sequence locations=1-158,180-857,879-974
atggaactaatgnaaattgtggatgacgaatacaaggaacgatggcttgganaattgtntacggaaattgaggacgactcaattcatgtcaaacgatttggcagaattgacgaggacgaagaaattgacgacaacaatgatggtcgagatgaatgcagtcagtcagcatacatttattggtaaacacatgtatgttaccttaataatgcacttttctacctaaaaacgacaatttcgtttttaagtttatacaaattgcaacttccgctccttaattatttacaaattgtaacttctttctcttaattctgcatttttctacctaaaaatgacgttcccaaatgcttaataattttcaaattttatcttccgttgcttaattctgcatgcatgttaatgtccttaattatgcacttttctacctaaaaatgacaagttcgtgcacataataaaaattgtatcttccactccttaataatttacaaattgtaacttctttctcttaattctgcatttttctacctaaaaatgacgttcccaaatgcttaataatttacaaattgtgtcttccgttgcttaattctgcatgcatgttaatgtccttaattatgcacttttctacctaaaaatgacaagttcgtgcacataataaaaattgtatcttccactccttaataatttacaaattgtaacttctttctcttaattctgcatttttctacctaaaaatgacgttcccaaatgcttaataatttacaaattgtgtcttccattgcttaattatgcatgaatttttattaaaaacgcaaataaaatgacaaaattacacaacagaactgttaccaatggtgacccaaattaaaaacatcttatttattcccgactatccctttgatctactgaccggacgacagccttcgacgggcaaaaggccctgcgaggcgatttccttgctcaacggaacgatttgttga

SEQ ID NO: 70682 - DNA, 225 bp, Heterodera glycines
  Genomic contig location: Contig_ID=SeqID_42877; Location=563..787; Strand=+
  SCN-specific regions: Sequence locations=1-225
ttttaaaatttcgaaaattttcaaaatttttcgagttaggcctaaaaaacggttttcgggtttttgaattttaggattttttaacgatttttcccagagaaacggagaccacttccaaaacatagtttttcgagctctatcgactggtatttttttcggaaaaatttcgattttttcccggaaatagaaaaaatttttggcctgagcgggacgtttgagtcccgg

SEQ ID NO: 70683 - DNA, 180 bp, Heterodera glycines
  Genomic contig location: Contig_ID=SeqID_42878; Location=331..510; Strand=+
  SCN-specific regions: Sequence locations=1-180
atgcttgcaccaattccaataattgagccggcaactgtcactgttccgcccaatgaagacgttgtgggctcagatgatgagaatcagcaaagagaagaggaactcctggtcaatcaatttgtcatcaattcggaagcgatcaagcgcatattggacgacccgcgctacgctgacaaaaag

SEQ ID NO: 70684 - DNA, 904 bp, Heterodera glycines
  Genomic contig location: Contig_ID=SeqID_42879; Location=242..1145; Strand=+
  SCN-specific regions: Sequence locations=1-163,185-238,261-643,665 -685,707-752,774-904
atggtacgtatttcacgctatttattaattgattatgacaatctgcaggttcggccagcttctttggacgaaatcaatttacgttggatttacaagcagaattcagaggaaatactacaatttctggcttatcatggacttatcaaaaaccaaatggagtgcaagaagtgttttaacaaaatgtcattgacaaagaaaaagcaaaaaatggatagtttttggtaagcacaagttttagattttttaaatttatttttttagtggaaaggacttcagaaacaaaaacgccatcaaagaactgggaatcgcaaaatcaacttgcgtcaattggttcaatttttgtcgcacccaatgtgttcaacaacaaaaaattggtggcgttaacgtcgtggtggagctggatgagacctgttgggtgaagcaaaaacacaaaaagcctaaaaaaggctgcagcaagtggttttttggggccataaaagaaaacgttgtacaaattgataaagaaatggattcgtccaggctcagtgatcatcagcgacgaattggtcggcatacccgaaagtgggctcttcactttccacagtccgaccacatgctcttcagacaccaaaaatcgaccggtggtggcttgtcgaaacttgtcatgctcccggacggcaccgaattcaacgtcaatactaataaatgtgaaggactctgggctcaattgaagcaaaagacgaaaagaatttatggaaccagtacaaatttaacaaattccaaatgtttgaacaaatttttcgacttaatgctagggctaaaggaaaaactattattaatgctttctgtgatcttattcgtcataattataattttattcgccataatcatgctgctaatgcttaatatttatcattacgtataa

SEQ ID NO: 70685 - DNA, 218 bp, Heterodera glycines
  Genomic contig location: Contig_ID=SeqID_42881; Location=161..378; Strand=-
  SCN-specific regions: Sequence locations=1-218
atcgttttccaaattgatgatcccaccgcccattaccacgtgccaatcactttgagtaactttggctattccacgtacaaaggccaataatagcgatggaattacgacgcaattgcacttttttggtcatcgataaatgttttgagcatttcccgctgatttgttcatgtaaatccatcttttttttttgtccgatcgccaaaagtccgttgaataaa

SEQ ID NO: 70686 - DNA, 756 bp, Heterodera glycines
  Genomic contig location: Contig_ID=SeqID_9227; Location=404..1159; Strand=-
  SCN-specific regions: Sequence locations=1-120,175-190,212-314,336 -434,503-756
atgtatttatctttaaaagattggtgttccgtctttgctaaacatccgatttttctgaacaataattcgttcgacattttttactacgaaatttcaattggaaataagagatggtaagagaattatttattatttgaatattagatttattataaatattaaaattcaattattgttaattgttattcctttattttaatttcagttatttgatcttcggattcgctgttaaacagcagaacaaattcgatggaacaattcttagccacaagggcacttatgcatattataatggtggcgatatatgcattaacggagaaggaaagggaagaaatggcaaatattcctacggtgttggcgataccgtaggaattggtgttaattcggccactcgacagatctttttcactaaaaatggacttcgtttgggttggtaaataaataattaatttaagaatcttaaatataatttttatttaattaatttttgtatttaaattatcgaaatcccataactttttcacagattcctctgaatttttcgttgctcaatcttttgctgatgattcttttcatccattcgttactttattcaattctgatgaccaaattgaggcgaattttgggcccaatttcaaattcgatttgaaaagtctctgaggaagaaatacactaaagttgatcaatttgtttcttcttaatactttttatgcttttcttcttcaatgttttggttttttgaattttttaaataaa

SEQ ID NO: 70687 - DNA, 1502 bp, Heterodera glycines
  Genomic contig location: Contig_ID=SeqID_9228; Location=1149..2650; Strand=-
  SCN-specific regions: Sequence locations=1-20,42-44,67-111,142 -1417,1443-1502
atgcaaaatgatcagaagattcttttggagaaaatcagtgaattggagaaagaacagaagcagagaaaggtgaattaatttgtaaggggtaaaacaaagcatatgttttagtattttttatttattttatattaattatttgctgtatccgcagcatttaaaatttcatattttgtgcataatgtacattgccctactttctcccgacccaatcccgtcgtaaacttatccatctgttcatcccatcccaagccaatcctatccctctcatttccaatgttatcgtgccatttcttcctattcacctctgttgcatatgccatccatttctcttattcccttttgtgtttttccgtcattacccctcatcctatccaaagtccatccccattgtgccagtatataagtccatccaatttccccctcggggggctgcgagatgtctgcggtgggtcagtctgtgccatttcttgcctttggcaatcctttcccaaataaccaattgcactgacccacccaaaatgctctgaggttgttgttgagccaaacatattcccggttttcaattcataattatttgtcaatgcttttccttataataaattcctctctcctaaaagtggtaatttgaaatggcttgaagccttaaacccggggacacaacacctttttggtgccacgacccggtgtgtaaaatttttttgttaaacagagagagagagaattaaaattccagagcattccagacaaaaagtgtctgaggccattaaaggctaatttgaacaatgcagacttaaaaagggacgcagacccaaaagcagttttaatctggttaaattttaattccttgttggagataggaagagtaaattaaagtacgttttggcaacaaaaaaaaaaggactaaagcaatgggaaattgctatttttcagtaaaacgtaaatgaaccaacaaaaatgcattgtcttgcgaaagaaatttggcaaattttctgtggctaatatggctgagtacggtaatacaaaaaccttatggcatattttgtgatcattgattgatcaatgcgctgtgttttaatgtgataatatgttaatttttgtgattttggctgttttcgaaaggataagtgcaaaggttttgagcatgaaaagataaaagctagtcgcagctgtgtgctcctagctgggctgagtgccgttgtggctgtgtgccacgagactggtcgaagctgtgtgctcccagaaaagagaccaattaatgggtgaaatgagcgtaagccatggactagtcgaagctgtgtgctcctagtgtcaagcgaaaatggcaggtaacgctgtgtgcttaaaatgactatgtgccaagggcttagtgccaaaaatgaattgtgaatttgaaggcataaagccattgtgtgattttttgttattgtttgtattatgtgatgcctaactggttaaatgttgaaccgtttttaatgccaaaattggttttactgaataaa

SEQ ID NO: 70688 - DNA, 530 bp, Heterodera glycines
  Genomic contig location: Contig_ID=SeqID_9229; Location=341..870; Strand=+
  SCN-specific regions: Sequence locations=1-24,46-222,244-258,281 -282,340-487,525-530
atgttatgttttgtttttcattgtatcttattgtaagttttattttgcaaggaaaaattgcattaattttgacccgggctaatgacttcactatttccaccattatttttggtcatgttatttcaaaacaaatttctcaaggatagatagggccggtggtcatttagacgccgccggggaaactttttcaaattaaggtgaattttgcaacagattttgaccataaatgacctttttaagtgttttctccaaaaaaaacatcacaaaagcctcatttttacgaattaataaaaaaattaatatttaatatttgtttttctaaaatttatacaaattattctagttttacgaaaatgattatttttcattgtttaaaaaccagggtcgaaaaatcaaaatataattcgtgtgaaccgaagcgaaaaaagtatgagtgcgggtgatcggaaggggcgggtcatttcagtacggaagagttattcgaatgattaattaattatttaaatttataattgaatattaatctaata

SEQ ID NO: 70689 - DNA, 107 bp, Heterodera glycines
  Genomic contig location: Contig_ID=SeqID_42882; Location=1..107; Strand=-
  SCN-specific regions: Sequence locations=1-107
cttatttgcttttatttcggtttatttctgccgtttatcgctcacactaaaagtgtcctaaatgggagaatgttcctccaacaatgacgtgccaaacgcatcaaaga

SEQ ID NO: 70690 - DNA, 225 bp, Heterodera glycines
  Genomic contig location: Contig_ID=SeqID_42882; Location=558..782; Strand=-
  SCN-specific regions: Sequence locations=1-225
attccggaaggattcggtctccccataaatctgggcgcatcggttcggggggactaccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccc

SEQ ID NO: 70691 - DNA, 892 bp, Heterodera glycines
  Genomic contig location: Contig_ID=SeqID_42883; Location=277..1168; Strand=+
  SCN-specific regions: Sequence locations=1-168,193-194,219-277,309 -381,404-892
atgtgtttttattcggaatcaattatcacaaaaacacatttccggttatatttatcatgaaaaatactcattttaagaatgtgtttttatttggaataaattatcacaaaaatacatttccggttatatttatcatgaataatacctaatatcaaaagagatattagtcattaaattttatgaattaattggtctttttaaacttcatttcatttttgtattgccataaaaatatgacacatttaattccttaatttaaagattctttattattcagttaaattttaaaaattttaagtttaaaaaaagtttgggacaaaaatattgagtctcgaatttcgaactttttagttatattttttgcaaatttttgttagaatcaattaaaaacatttcatatttttcaatatgtcctgatttttcacgtttttttcctgtgtatgaattctatatgcattttttgttgtaaattaatgtaaaatgattctcttttggatgaaaatcattgataattgtactgatttttttcatttgtacttttataatcaatccaaacaaataaattctcattttcttcatttattaaaaaatagcaaaaaatttcataatttccgttatcaaattgtaataataaacaaaaatttattgccaatcgcaaatgaattcagatatttcagtagtattaatgttttttttaagcgttatacctggtaaagctgaatcagtgaagaaacaattgcaagaaaagttttgtgaagatatttttggagaaaaatggcaatataaagaagatcaacttcgcaatgatgagatgatcagtgaaatgatccgaaacttctataatttaaacgctaatattaaccaaacaggaagaggatattattcagtgtga

SEQ ID NO: 70692 - DNA, 49 bp, Heterodera glycines
  misc_feature (23)..(24): n is a, c, g, or t
  Genomic contig location: Contig_ID=SeqID_42888; Location=41..89; Strand=+
  SCN-specific regions: Sequence locations=1-49
atttaaagctatccatgctgccnnggttctcggcacagcaaagcactaa

SEQ ID NO: 70693 - DNA, 432 bp, Heterodera glycines
  misc_feature (372)..(372): n is a, c, g, or t
  misc_feature (396)..(396): n is a, c, g, or t
  misc_feature (421)..(421): n is a, c, g, or t
  Genomic contig location: Contig_ID=SeqID_9230; Location=29..460; Strand=-
  SCN-specific regions: Sequence locations=1-148,197-432
atggtgaaaataaaaatttttctttcattttccattttggtgaaaatttttcccattgcctttggccatgagaattgtgagaatgcaccgaacaaaacattgaaaaagatttgtgaacagctgtatcgatatgacaaaaaagcgagggtaattaatttatttatttatttattacccaaatattattaattattaacaccccaaaattcgacaaattatttaattagaaaaaaaacatatttcgtttaataactcattaaggaagtcatacttgacgaagaagagactattattctaccaccagcaatacctgggcttgaaagtaattaaaataattggaaatttttttcattttaattgctaaacaattanatatttctcataaaatttttttanaaaatggaaaaatttagcgccaatnttcgccgctga

SEQ ID NO: 70694 - DNA, 483 bp, Heterodera glycines
  Genomic contig location: Contig_ID=SeqID_9231; Location=1103..1585; Strand=+
  SCN-specific regions: Sequence locations=1-145,214-230,262-343,365-441
atgccggtgccaatgcgatcagtgaaatggccaattcacttgggcatccgattgcgatgccaaagtttgcgtgatgctccgtgtgtccctcatgctgttgtgcggcggaggccttttatgtggcatagtttttgcaaaatgtttctaataaatgaaatttaaataaaaaactttgagttttttaaaactaaaattgtataattttatataaaagtcatttataagtgcactaaattcaatttatttatttattttttgattagcaaaggtagagctgtatgagggtttcggatgacggtattatggcaatattaagaaaagttactgcgtattgtgaaagatgatggctatttggggagctaagcttacgatttattaaaaagcctcataaaaagcaaatcatttattccatttcagtacaaagcttcttaaaaagaaaggtataataaagaatattaattgaaattttttttatttttataa

SEQ ID NO: 70695 - DNA, 223 bp, Heterodera glycines
  Genomic contig location: Contig_ID=SeqID_9231; Location=1640..1862; Strand=-
  SCN-specific regions: Sequence locations=1-97,143-192
atggttcacaaattctttttgctcgtcatattggcaattttgatcattggcacaattgctgaggacgacgaatgtgccgatgctccatcgcctacggtaaaataagaataaattcaaataaatttatttttaaatttttttaggcccgtaaatattgtgaacagctgcagagaaaagccaaactgcaaagagtaataataatttctttttaaatattaataaa

SEQ ID NO: 70696 - DNA, 637 bp, Heterodera glycines
  misc_feature (15)..(15): n is a, c, g, or t
  misc_feature (45)..(45): n is a, c, g, or t
  Genomic contig location: Contig_ID=SeqID_42895; Location=78..714; Strand=-
  SCN-specific regions: Sequence locations=1-637
atgggcaccggcttnttgtacgactatccaccgattgtctacacncaatatccgtggatcaacgacttgtgcactttggtgttgtccagttggatgttgttgttcaccagcagcattttccgccaccaatttgtcaaggacttttgtccaaaatgcatttggccaatgccaacaaacaaattgagtgaaaaattttccaaaacgaggacaaactttgggaagcagttcagcaaattcggaattataaaacgaatgatggaataaattgtcgtgtgaacttttgtattttttttttaaaattctattacaaatttactggatttttttgaaaattctttaacaatttagtttattgcagattccttccggtattgttggaggtcctaattcccgatcctggcttttagtaacaaagaatttctgaatttacatgaaaaatccgaaaaatgccaaaatgttaacaaaacattgacaaaagcccaaaattattgaaatataaaattcaaaaatttacatgtcttcaaagttttgaccttataattttcaaataatgaatggtttgccaaacagaagttataataacattcgatcccccctttttctctcgccgaaggttggagaccaaccctaaaataaa

SEQ ID NO: 70697 - DNA, 80 bp, Heterodera glycines
  Genomic contig location: Contig_ID=SeqID_42900; Location=1215..1294; Strand=+
  SCN-specific regions: Sequence locations=1-41,68-80
atgactagaaggtgtttatttgaactgaaatggattggtggaatattaataaattatgatttgattcttacacagattaa

SEQ ID NO: 70698 - DNA, 829 bp, Heterodera glycines; identical to SEQ ID NO: 42901
  misc_feature (25)..(25): n is a, c, g, or t
  misc_feature (744)..(744): n is a, c, g, or t
  misc_feature (797)..(797): n is a, c, g, or t
  Genomic contig location: Contig_ID=SeqID_42901; Location=1..829; Strand=+
  SCN-specific regions: Sequence locations=1-266,289-690,712-829

SEQ ID NO: 70699 - DNA, 817 bp, Heterodera glycines
  Genomic contig location: Contig_ID=SeqID_9233; Location=943..1759; Strand=+
  SCN-specific regions: Sequence locations=1-155,178-274,296-432,456 -667,689-817
atggaggttgacgtgtcttcttcatctgactcggccacaaatgttttgttcagtttacgtgccgatcggagtctgttggacccgacttttgaccggtacattttgcgtacagaaaaactggcaatgttcaagcggagaatggacgacaaaagtacgacattaatttaaatttaatttgaaactcaaatttggcaatcttaggcagttttattgaaaatatccagaaatactcattttgaaattctctttttcggtttaacaattataaatttgtttataaatatcaaaatgttcattttcagttcgtttcaaattgccctccgacagccaatggggctaccaacaaattcgggcccacactttggcctcccatcttttcttcgaccatttcgcttcctccgttgaccagcaattatttttcgcatttctcgacgatctccgtctgatttcttttacatttgatcgaacagttcgttgttttgttttcccattttaattggtgcgtttgactcactttcgctctttcagtccaaccgttggtccgtccccgtccaagtcgcggacattggcacttcctccgtggcattgtccccctcatttgtctttgtgtccgaggacgacgcttcttcccagtcgttccccgagagtttacactttgtcgactcgcgcacggcgatcactgcgcgcggactgaacactttcagtgtgtgggatacgggcgagcgacgcccgaccgatgggacgacacaaaaatggagggtcagtgaatgtgtaaagaaatgctgcggtgaaatgtttgcagggacattttgaaaaa

SEQ ID NO: 70700 - DNA, 229 bp, Heterodera glycines
  Genomic contig location: Contig_ID=SeqID_9234; Location=534..762; Strand=+
  SCN-specific regions: Sequence locations=1-58,81-229
ccattggcggtgctgaggaaattgcggtgaacgatgtttgtttgttggccctttggcgttgtgttattcattgtcctccactccttcttaggttcagccctccgctgccggggacgcgcagcagcagttcaattccgagcagttggaggagtgcgatcggccgcccgacgctgaggacgacgtcagcgccttttgggtggacggcgactcgcacgaattggtcgcgatg

SEQ ID NO: 70701 - DNA, 197 bp, Heterodera glycines
  Genomic contig location: Contig_ID=SeqID_9235; Location=270..466; Strand=+
  SCN-specific regions: Sequence locations=1-197
agcacgaactgaagaatcgtcggacgggcaaacgagcggaacacatcgccaaacaattggtgctttcgatgtccgacttggacaaggagttcgacccgaacgattcgtccaacgaattcatcgcatttcatgcgacggcggaaaccctctttctgcttactcgctgcgcaatttatgccgtggaaatgccaaaatga

SEQ ID NO: 70702 - DNA, 352 bp, Heterodera glycines
  Genomic contig location: Contig_ID=SeqID_42904; Location=442..793; Strand=-
  SCN-specific regions: Sequence locations=1-119,141-352
atgcttaatttgactcattttcgccttgtccacattttgctcagttgtgctaccatttttctgatcattttattccattttttgctgtccaaaaatatcctcacgattgatcaccgattatcagcaaaacaaacgaccgtatcagacggagtcctacttttaagttggatgtatacgatactgaagaatggcgtacggtcgttaaaagcgttggctgtgacctcagtcaatttacgaatgttcggcatgaaaaattggcacaattttacggccaaaatggcttatacacattaagcaaaagcaaaatgttttttgatgaaaaaggcatgaaaatttaaaaaagggtaataaa

SEQ ID NO: 70703 - DNA, 1062 bp, Heterodera glycines
  Genomic contig location: Contig_ID=SeqID_42905; Location=78..1139; Strand=+
  SCN-specific regions: Sequence locations=1-830,853-963,985-1062
atgcaggctggtacaactcagattcctggctttggccagttgtacattctggacccagtcgaggctatggaacagcgtcgaaacaaccccaggtttactggggagaaaatcacaaacgaagatgagtttgtgcagggtcaccagctaaatgagcagactcttgagatcttagaacaaatgatccaagtgtatcatcctgctgcgcaggcatataagcaggcgcgtgagcagctcactgagcttctccaacaacaaactccggaagagcttcgcttctttcgcatgactttgttgaatgagcgcagggctccagctggtctgaaagacccaaaattgcacccacaccaaataatcaccccttctacgggtgaagggatgttcgctattcatgcggaccccactggtgctcctccgcccaaaggaatttgggtagagaacaaacaagggcaattaaatgaaattgctcctttcagtccgtggactgatagtcttacgtatccattaatcaagccaatgggcgatgatggatacacaactggcattaaatatgctaagccaccatcgcgtaagcgaaaaggtgctcagaatgcatctggcctatttgacccggaagccgagtcagataatgagtcgtgcgagactcagtcaattgcatcatctgatgctgggtcagtcgcaaattcagatgctgaatctgtagcatctgtttcatcgcagcaccggcggattgacaaatccaaacaatttatctccctgcgagattattgcaagtattatctcgcaataagggatgaaaatttggagttgcaataccaccacatcctttcatgtggtggaggacttggtcagcgctggatccttgaccaggctgcaaaaattgattggcaaattgcaacatttttgcgtagacctgacatggacctgcggatcagcactccaaaaaatctgctgcagtatttggtcaaccagtacaacaggcagcaggcacggcaaaaccccaatgcccaacagaaaactgttgatgacattggcagtgttgttcggctttccgaaaacacgtaa

SEQ ID NO: 70704 - DNA, 67 bp, Heterodera glycines
  Genomic contig location: Contig_ID=SeqID_42909; Location=25..91; Strand=+
  SCN-specific regions: Sequence locations=1-67
tgtccgttggggtactcaaccatttatgggagcaaaatccaacgcagaattaaagtacaggctatag

SEQ ID NO: 70705 - DNA, 1574 bp, Heterodera glycines
  Genomic contig location: Contig_ID=SeqID_9236; Location=363..1936; Strand=-
  SCN-specific regions: Sequence locations=1-200,384-981,1004-1059,1081- 1407,1429-1574
gaacattttggcgactgcggcactgaaacgattggactttcaaacggcggaacacgcatttgtgaagttggaagactacgggggcattcagttcctgaagagactgcagaacattcattcggacgggttgaaaaaggcggaagtgtgcgcatttttgggcgatttggaaacggcggagaaaatttattttgaaaatgatcggaggtgaagggacggcacgggaaaaggaatggcataggaagggacggcacgggaaaaggaatggcataggaagggacggcacgggaaaaggaatggcataggaagggacggcacgggaaaaggaatggcataggaagggacggcacgggaaaaggaatggcataggaagggacggcacggaaaaaggaatgatttcagggacttggccattgacatgctgaagaagatgaatgattggtgtcgcattacgcagctcatccaaacttcgagtggacctggcgacgacattttggcacaacaaacatggcaccatgtgggcgacttttatgccgaaagacaaaaatggtggaaaattggggggggggggaattattggaacaataaacgaataaaattgagaaaattaattcgttaattacttaataatgtaatgctaaatgactccaaaggcaaaacgcggcccattattatgaaatgtcgaaaagttatgctcagttggcgaagtgttatttgatgttggatgacttttgtcgcatggaaatactaagcagagaattgcctgaaggacatgaagttcttttggttagtcagggaaaagcgacaattaaaggactaattagtgagggattaaacagctaattaagaggcattagttcgcactttattatgaaattccatagctttaaaacaaatccattgttgataattgataatattttttgaatttaagcaattggcggaaacattttcgaattacggcctttgtgaacaatcggtgaattgttttttgaaggtgaaaaaatcaaagaaaaagcaaagcacagaaattcaattaatcagtgcgacagaatcagtgaagcatttgaaatgtgcataaaactgaacaaatgggacaaagcgacggaattatcggacaaatttcacttggcaaatgttgagcaattgctgagccaatacgccttccaaatggtgggcaacaaaaccaaaaacttggccatggcacaactctaccgaaaggccgccaaatttattcaagcggcaaaaattgtctacgaggtgaaaagtgatcagtcaatgggaaaggggagtgatcaggggaaacagagtgatcaaagaatgtgttaagactgatcgaatggttataaacgatcagataacccaaatcggaataacgaattaatccaaattgatcagaatctgcttgaaaagaagcaaagaaattgctaattcaggtggccaaggcggagcacgagaagcaggtgccacctcaaaggctgaagaagctttatgtgatgggggcattgttagtggaggaataccacgagcaaaatcgggagaaattggccaaacggagagaggagggggcaagcgat

SEQ ID NO: 70706 - DNA, 1055 bp, Heterodera glycines
  Genomic contig location: Contig_ID=SeqID_9238; Location=163..1217; Strand=-
  SCN-specific regions: Sequence locations=1-200,222-223,267-340,363 -449,559-919,941-995,1017-1055
  Gene Ontology: Cellular component=cytoplasm
tttcccccgcccatttcagtttcaaatccaaacccccggctccgccaccttcacaaccatcgcgtggatgctcaaccggggttatgtggcggtgggcggcagtgacggggccctgagagtgatgctgctgaatttggaccagggcaaactttgggggggggggggtcaaatgcaattcttgaggtcccattttaacggcatttcccttccagacaaaagtgccggcccttcctccgcctccctcagtccctggctgtcctcccaacaactcgaaggccattccgccagtggtcattgtctttttttaaatttatccatctccctaattggtttcagttcgccttttgtgttggaatgaaattcaccaaaaattggcgtcaagcgacgatgccggactgatcatcgtttggatgagccacgggcaagtgaaagggcggaaaagcaatgtccaatcggtccgctaaccgacaaatcaatcaaagattagtcgaccaatcgaccaaagggttgatcaagcaatcgatttatcggccaatcgaccttgcgaattgatcaatctttgtcagtcccttcggctactgatgttttcgtgtttagtgcggatgagtcgtggttcgaggagatgatcaacaaccgtcaaaggtccaccgttgcctcgttgaaatggtccaacgacgggtcgcgcattgcaatcgcttacgaagatggtaatcagaggaatgaactcattttcatctcttccgattaaggacaaattattttgggctcggtggacgggaacagactttggaataaggacatcggagcgtcgctggtcaaattggcggtagggctgaaacggcggttgggctaatttctgctctcatttggcagtggaattccgacgacactttacttctgatcggtaaattggcactgggaaaatgccaaaccaacagatcagttcatgaaagggttcaccgacggagaagtgcacgcgtacgatcagaacggcaatttttgcatgaaaatacaaatgctttgtgtggaaaatgtcgaaatggaaacggcactga

SEQ ID NO: 70707 - DNA, 816 bp, Heterodera glycines
  Genomic contig location: Contig_ID=SeqID_42912; Location=139..954; Strand=-
  SCN-specific regions: Sequence locations=1-35,57-142,179-210,233 -267,289-531,553-816
atgaataatatttatctttttaaatgcatttccgttggacagatcctcattgccaacctcgttttcctctattttttgactgcaattttttatggggtgtccattgtccgatatcaagttggtacaacactttgttacctaatatgttaagttggcaattaattaattaattaaccaatgttgcttcattccccttttcccagatgctcttccattcttcgttctctcctccaaactgtgtgcttttgctgacccctgtttggctcgccttccttttggctgctcccccttatttgtatttggtggccaatccgtttttccactttttcattatggccgaaaggtgccgagccactttttttgcgcggcactatgaaaatgtcggctttcgctttggatggatttgtgccgtaatttcggtgaatattttttaattttcgtattatctctcttttaattgcttttttgcctttttcagtggattgtcgcccttttgaccgtttttggcattgttttgagtgatttgtctgaccccattttctcccaacctttggccattgtctcattgacttcccaaaacaatgcgatggccatcatttttttacattgtgccgtccttttccttctgattgtcacttcaattggcgattattgggttcaaaaaaagaacataaaactgattagtcggtacactttgaagtcagtttactttattggaatttgaatttgcaattccatcgcttttggcattcttttttaattatgatgttttttgataaaaaaaatcaaattaatgaatcactgtatttaaataaa

SEQ ID NO: 70708 - DNA, 352 bp, Heterodera glycines
  Genomic contig location: Contig_ID=SeqID_42915; Location=302..653; Strand=-
  SCN-specific regions: Sequence locations=1-37,70-121,209-215,238 -242,273-352
ggaatcaaaggtgttgtaagcttttttcctttttcacttttaaatttatttaaattttcaatttttttagcttttttcgaaatattttttgtcttttttttcggcaggcactgcctctgacaatattttttatttatttagaaaaataaatgttttttttctttttgatttattttaattatatttcattcttaaattttttaataaacattttcaaactttcaccttattaatttaaggcgaattttgccttttttaataaattctcttgtgaaaaggcaaaaaaataggctcttttaaatatgcctatttaaattactttcattgctttcctttgcttacgaccatacca

SEQ ID NO: 70709 - DNA, 328 bp, Heterodera glycines
  Genomic contig location: Contig_ID=SeqID_42915; Location=735..1062; Strand=-
  SCN-specific regions: Sequence locations=1-17,46-99,162-328
tttttcttttttcactgtaaaatttattaaattttcaattttttagcttttttcgaaaaattttttgttttttttcgccaggcactgcctctgacaatgttttttattattagaaaaaataaattgattttttttctttttgatttattttaattatatttcatcctcaaattttttaataaacattttcaaactttcaccttattaatttaaggcgaattttgccttttttaataaattctcttgtgaaaaggcaaaaaaataggctcttttaaatatgcctatttaaattactttcattgctttcctttcgcttacgaccatacca

SEQ ID NO: 70710 - DNA, 677 bp, Heterodera glycines
  Genomic contig location: Contig_ID=SeqID_42916; Location=271..947; Strand=+
  SCN-specific regions: Sequence locations=1-6,44-167,298-344,388 -431,459-471,506-522,630-630,662-677
gatctcacttgaatatttgctactaccaccaagatctgcactggtggaagctccggccgggcccacgcccaaagccttcaacgcaaccaccacgaccctcctacacgtcatggccagactacgcgacaagcacgtgtacaagccaatgacggtggagtataggtggcccgctccagcgccatccattttcagggctagttgattcggcaggtgagttgttacacactccttagcggattccgacttccatggccaccgtcctgctgtctatatcaaccaacaccttttatggggtctaatgagcgggcactttggcaccttaactccacgtttggttcatcccacatcgccagttctgcttaccaaaaatggcccacttggagctctaaacattcaacgcctgggttcagagtcaagcaaccctggcttcatacccatttagagtttgagaataggttaaggacatttcgtccccaagtcctctaatcattcgctttaccgagtataactgcttaacgagctccagctatcctgggggaaacttcggagggaaccagctactagatggttcgattagtctttcgcccctatacccaagtcagacgatcgatttgcacgtcagaatcgcttcggacttccaccagagtttcctctggcttcatcctgctcaggaatag

SEQ ID NO: 70711 - DNA, 86 bp, Heterodera glycines; identical to SEQ ID NO: 67418
  Genomic contig location: Contig_ID=SeqID_42919; Location=540..625; Strand=-
  SCN-specific regions: Sequence locations=1-86

SEQ ID NO: 70712 - DNA, 564 bp, Heterodera glycines
  Genomic contig location: Contig_ID=SeqID_42920; Location=22..585; Strand=-
  SCN-specific regions: Sequence locations=1-564
atgcgcggatttggccaatttgctcaatgcgttggaacagaggctgagagccgtcgaagaactgacggagggggtaattattatacaaaattgccaatttgtaattgtaatgcccacgattttcagattgccaaaaagatcggctacagcagctgatgagtgtttgagtgagcggagtttatcggggcaatccccagaagatgatttcgatgatgatccagtgcagcaccaccaatctgatctttttgctagtgtaacatttgatttttgatcagatccaaaaacgggaaacgtttactgttttgttagaatattgttgcttttagtaattgttgcatgcgaaaaacatttatttcctccattcattgaaaaagcgtaaattgaaaagtgcttttctattttgattttttatgtcctctgacaatgagcattattatcctacaaattgtctgtcatttttgctaaatctgtgctgattctcagagttctcttttcgatgacttcgtggcgattgtgtttaggaaagatcagacgaaaagagatggtcagattgtacaaagtgaa

SEQ ID NO: 70713 - DNA, 674 bp, Heterodera glycines
  Genomic contig location: Contig_ID=SeqID_1248; Location=342..1015; Strand=+
  SCN-specific regions: Sequence locations=1-237,259-674
atgcaagaaaataactcatcatccgacgaagagggtcaattgctttcatcttcatctgggaatgaagaagcggctaaccaagaattaattcaattcatcgaatttaagtcaaagcgtggtgcctcacttcttgcacgtaatgggtttgagtaccaatttgaacgcaattcggccttagttgataatgttgaatattggaagtgtgttaaagtgagtaacaaaataaaatcgaatggatttttctttggtcagaggccaccctactgcgcgggtcgcatacatgtccatgctccttggcaagagcaaaatggcattcggtttaaatttggactgctaaaaaatgatcaacactctcacattgccgaacccgacaaagaatatgtcaaatagttgccaatttctttttgaatttcttaatctcagattcgttccgccatcgaacagttgaaacaatctgcaagagccaataacccaatacagacaagagacgcggttgatgctgcgagggctgcattgagtgaagaagttcgagttaatgctccttctggcagtgccatggccaaagtctttcgttccgcaaggcgcagcgcccaagaacaacacggagacagaggaaaggattagtggggttcatttaggcgctcgcgtttgtacgctggggtcgtatgggcaca

SEQ ID NO: 70714 - DNA, 1301 bp, Heterodera glycines
  Genomic contig location: Contig_ID=SeqID_1248; Location=1203..2503; Strand=+
  SCN-specific regions: Sequence locations=1-1129,1164-1301
atggtcattcctcaacatttggaggcaaatgtgataacaaatgaaaatgtcaacattggtggccaaatgcgtaaaatcatagttttttcaacacaaagtgcaattgaaatgcttgatcgttaccgtaacgagatagcaattgatgggacttttaaggttaaaaggatcaaatgaattaaaattaaagcttaattggttatttcagaatgcaccgaggggttttgggcagctttttaccattcatgtcgtggttgatgcatgcgctgttccatgtgtgtttgcttgtttacctaccaaacatatgcaggggtatattcgtgtgttcgagtcgattcgcaacagaattcaaaattggtctccgggaagagtaatgtgtgattttgaagcctccgaactctctgctatccggcaaatatttccccaggcaataattacaggttccggtaataaaaaatcatttaatagaccaattttacaagggtgctcctttcacctcggaaatgcaattcataaacacatccaaactctccctgggttgtacaaccgttacagaaataacagggatgaccgacatttatttcgatcacttcaatcgctggcttttgtaccaatcaatgaagtgtacacctttttgtgcattttgatggacaatttgattggccctcccgaaattgaaattttgggtatgaaagggtttttattatttttttttcacctgattttagaattacttaaatattttgtgttaacctacattggtccttcctatgttgttgctcatccccaaataattgctggtgaacaggaagcgaattatggacagggatgtgatggatggttgcgtgcctggatagctcatgagaatttggcacatcgaaatgccttgtttccaatagcggtaaaaaattcttgactatctacttttacatatttctgtaatttagctatggaatctgactcatcgcctcgaaattggtctttcaagaagcaacaattcgttagaagcgtggcataacatttggggggcccttcttgaaccaaacccactgttcagcaaatttgttaagcgaatgcttaaagaatttgaacgttggcagcacattgttgccgattttcacaatgcaccggcaaatgggataaggggaaagggccttaagagaaagtccatttatctacaacaagacaacaatttgcggcaactcttcgctgaattccaacaacgagcgggtcaagacccattgcaatatttaagagcgatttcatatcacttggctcaaatttaatgcttttttattcaaaaa

SEQ ID NO: 70715 - DNA, 330 bp, Heterodera glycines
  Genomic contig location: Contig_ID=SeqID_1248; Location=4628..4957; Strand=+
  SCN-specific regions: Sequence locations=1-216,246-330
atgaatttaattccaaacttaatgttagtgaatttagatttaaattaattactttttaagagtccaaagagatccaaactttttcaatgttaaaacactgcttcaatttttagctttttagattgtagcacattttcaatattttattgctacactatttaacattaatgatgaactactattaattttttattgtaatcattagcattatacatgtaattaataatatttataatttttatattccagtttgaggaaatttaatcgttgtgaaatatgaaaacataataagtttcacattttaaatcgcagtaaaatatgaaaaacata

SEQ ID NO: 70716 - DNA, 324 bp, Heterodera glycines
  Genomic contig location: Contig_ID=SeqID_1248; Location=6708..7031; Strand=-
  SCN-specific regions: Sequence locations=1-107,129-324
atgctcattgatcagattgtttataatagggttcagccccaagctttcggggagcaaaatgtcggggaacggggagtaaattccccgaaataatttgtcggagatggctgtagaaatttaaaaaatgtcggggagcaacaccttcgtcggggaggaaattttcataaaaagtctaaaaaaacaaaaataaaaaatccagaacaaaaaagtcttaaaaactcatttaaagatacttccatcttatttcaagtgcaatttacgactttcgtaatttcatttcccgaaacatgtcggggctgaacctagtttataatatcaaataaa

SEQ ID NO: 70717 - DNA, 685 bp, Heterodera glycines
  Genomic contig location: Contig_ID=SeqID_9239; Location=864..1548; Strand=-
  SCN-specific regions: Sequence locations=1-130,155-659,681-685
atgactgccgaagtggcggagaaatggcgccaaagttaccgacattacagacagcgcaaacacttcgagaaaagtgggtggactctcgttcaagtccgattgtgtggtcggatggtctttcgactccctatttctctctcccctgtccctccctttaatcactttcatttcttcagaattgcgcaattcgatagccgctgccgttgagtatggcacgactaccacaaccactagtgctgctcacactgtgcccgcgtttatcggcagttctgcccattattccaattcaccaacttcggaggacaatggcactgtcggcgtcggtttgcccccgcggcgttgcaaaagcgttacaatcattgaaactccgtcccatttatcgccgagtgaacgtcgtgcacgtcggcattttcgagtgcttttgcgacccgtttcattggactgcccggcggaagagaatggaggaggcgaaaaagggcatcagcaaccaaaaccggtgggtcgtatgagtgggtcactttaaagcccaacattttttgattattcttacactaacattatcttaaagggatatcaccgtcgtcatcattatcaaaaacgcagaccaaagagtgaagaacggcaggaaaaccgagaagaaaagattgacgaggacggcattcaaatgggaaaaattggggagtga

SEQ ID NO: 70718 - DNA, 585 bp, Heterodera glycines
  Genomic contig location: Contig_ID=SeqID_9239; Location=1675..2259; Strand=+
  SCN-specific regions: Sequence locations=1-498,520-585
atgaatgccaataagctcaatgcctcgcagccaaagtgcgcggcctcggctcatcgattgggaggcaaacggcccactgacggaggcaacattttcgggcggttggcgacggtggagatgcaattttaaagcttctaaacatgtaattcgaatgataccaacagtgtttgatttggttgacaaagaaaaaaagttatagtccaaaaactgggctggcgccgaaacgaccgacgccgaaacggcctagtccctcccattttcattgtccattttatgtcagcgtgcgctatttctagtataaaaagacggggtttttcttcatgaaaacattttgtctaatttcaaatttttttttttttgtcatatatctgaaaataataaatttctttacagatgatttacattattccgtgcatcgctcttttggctgcatttattctcattgcccaatgctgcggttgcggcagtgagggagcaacggaaaaggatgaccagcaggctgcaccttctggaaatgctcgacttcaacgagcgaaggacatgatgctgctaccgcaactgaggattcggcgtggacgaatattg

SEQ ID NO: 70719 - DNA, 1523 bp, Heterodera glycines
  Genomic contig location: Contig_ID=SeqID_9240; Location=1..1523; Strand=-
  SCN-specific regions: Sequence locations=1-76,98-196,218-465,487 -1305,1327-1523
  Gene Ontology: Mol. function=calcium-transporting ATPase activity; Cellular component=integral to plasma membrane; Biological process =transport
acattgacaacgaatcggatgaccgtaaggaaaatgggatccaaagaccaatttgttcggattttaatctaattagaatatattcaatctacaggttgtccagtcctttttgtgcgagcgatattttggagaggagaaaagtcagccaaaaccgggagaatttcgcaaaggcaaacggagtgatcgtcaacaatttaatgcagaatgcttttgtcttttagaattggtcactttgctaagtgaggcaatcaccgttaattgtgcgtacaattcgatgattgttgcgacgaaaaaggcgggcgaacggattcaacaattgggcaacaaaacggaatgtgcacttttgggctgggtcaggcaaatcggaggagattatgagaaaattcggagagagtacacggaggaagacaattacagagtcagtcgggaacggacgatgtcccgttttacagtattcgcttgctgaaggtgtacaccttcaactcctctcgcaaaatgatgatgaccgttgtcgagttgaaaaatggggctggtcgccgtgttgggttccgtgtttttgtgaagggtgcctcggaaattctgctgaacaaatgcgctttttttctcgacgccaacggatcaccgactgaattcacggagcatcgaaggaaacgaataattgacgaagtgatccaacggatggcggaggacggactgcgcacgttaaccatcgcgtacaaagactacgttttggctggggaacgaactgttggcccaacggaggttcgggaatcgccggtctcatttcttgttgcctattttttcaggtaccactcgattcagaagcagcagtcaattgggacgatgaacagagtatttcggatggcgtcgttgggttggccatttgtggcatccaagacccggtcaggtgagtactttttgcgcttttttgttcgggtttcatttttattgatttcttttcctttcttattgtaagagacgaagtgccagacgcaattgaaaagtgtcgccgtgccggcatcaccgtccgaatggtttgtgtcttttgcgattgctttcattcatatgcccgcccgtctccctgtaggtcactggtgacaatgtaaacactgcacgcgccatcgccattcggtgtggcattcttcgaccggacgaggactttttggtgttggaggggaaggagtttaacgaccgaattcgggacggacgtggcaaaattgatcaaaggaagctggacatggtcaaaatgggtgtggacaagtaacgaacattttgacaattatttcacagatttggccacgtttgcgcgtgttggccagggcccaaccggcggacaaatatactttggtcaaggggatcattgacagcaaattgaacacacaacggttggtaaaatgtgtttgagaatgcgtttcgcattttaatatcactttaactgcttctttcttaatacgattaatttatccatttccccagtgaattgtcgctgtcaccggcgatggcacaaacgacggacccgcgtt

SEQ ID NO: 70720 - DNA, 926 bp, Heterodera glycines
  misc_feature (842)..(842): n is a, c, g, or t
  misc_feature (861)..(861): n is a, c, g, or t
  misc_feature (911)..(911): n is a, c, g, or t
  Genomic contig location: Contig_ID=SeqID_42922; Location=31..956; Strand=-
  SCN-specific regions: Sequence locations=1-581,604-608,631-926
aaagtgtccacagacttttggaaaaatatatttgcaatttatcaacaattttgagaagtgagttagaaatgataaacttcacgattcaaaccaattttcgttgctctaattaaccgcgataaaaacattcgaatcaattaaatagcttctgagataataaggtttatcataaaatgtcatttaaaaataaaccctcaattattggtgtgaacgatactttccaaacatgcacgcgttttgcgctcgagctatttatcattgggcttgttaatccaaagcgaaacaacaaagatggtgttttgaacgaataaagggcttaggttattttgaagaagtgtcaaataacatgcagcaataagcctgcaaaatctaataagtggaaaatacatgagtatagaatttattttcagaaagtgtcaacagacttttggaaaaatatatttgcaatttatcaacaattttgagaagtgagttagaaatgataaacttcacgattcaaaccaattttcgttgctctaattaaccgcgataaaaacattcgaatcaattaaatagcttctgagataataaggtttatcataaaatttcatttaaaaataaaccctcaattattggtatgaacgatactttccaaacatgcacgcgttttgcgctcgagctatttatcatcgggcttgttaatcaaagcgaaacaacaaagatgctgttttgaacgaataaagggcttaggttattttgaagaagtgtcaaataacatgcagcaataagcctgcaaaatctaataagtggaaaatacatgagtatagaatttattttcagaaagtgtcaacagacttttgganaatatatttgcaatttatncacaatttgagaaagtgagtagaaatgataaacttcacgattcaaccaanttttcgttgctctaa

SEQ ID NO: 70721 - DNA, 205 bp, Heterodera glycines; identical to SEQ ID NO: 42923
  Genomic contig location: Contig_ID=SeqID_42923; Location=1..205; Strand=+
  SCN-specific regions: Sequence locations=1-131,153-205

SEQ ID NO: 70722 - DNA, 305 bp, Heterodera glycines
  Genomic contig location: Contig_ID=SeqID_42924; Location=56..360; Strand=-
  SCN-specific regions: Sequence locations=1-305
aaaattccctcaaaaataaaaggtctattgtgcaccgccctccctatcatgctcgagagcttttgtatgtgtataaaatttatcaaaaaaagagatagccatttttctgggataacctctaaatataaaaatcctctgtgaaataaaatggcgattgtgcaccgccctccgtctcatacgcgagcgcttttgtgaggtataaaatttctcaaaaaaagagatagacatttttctgggatagagtataaatttaaaaattccctcaaaaaataaaaggtctattgcgcaccgccctccctatcatg

SEQ ID NO: 70723 - DNA, 304 bp, Heterodera glycines; identical to SEQ ID NO: 51570
  Genomic contig location: Contig_ID=SeqID_42924; Location=690..993; Strand=-
  SCN-specific regions: Sequence locations=1-304

SEQ ID NO: 70724 - DNA, 703 bp, Heterodera glycines
  Genomic contig location: Contig_ID=SeqID_42925; Location=397..1099; Strand=-
  SCN-specific regions: Sequence locations=1-78,108-178,201-338,362 -456,478-480,535-579,612-703
atgaacaaatgcgcctcacagcgcgacttcaaccagtccacctggaagaaagttggcaaaactgagcagcgtgagcacttttttttactaaattttataaatttaatgattagagcgctgcaaatttggatataaatcacgaaatatgtgccataaaatagggccaaaaatcatgcaataaataataaaatggcaattcaatttgaatgtataatttctcaaattttcttcaaacttgtcataacggctttatcagagttggcaaattgattgccaaaattggcatcatattcttaaacagagatgaagcatttgcttggccaattttaggagggcatttctttttaaatttttgcataatcgctttatcagagttggcaaattgattgccaaaaattgggatcatatgcttaaattataaaaaaaatacaactttatacatgaataagctgcatattgctttattgctctttcttttccaaaaaatcttttttcattaaaaaataatgtaaaattttttattttcattattttcaataccaaagtattttacggtgaagcacaaataatcagcttgcgaaatttatgaattaaaaaataaaataaattttcagatgaatgcgagtatttttctgctgttcgcagtttgctgttcttttctggcccattattcccaaggaatgttttctgggctcagaaataa

SEQ ID NO: 70725 - DNA, 523 bp, Heterodera glycines
  Genomic contig location: Contig_ID=SeqID_42928; Location=58..580; Strand=-
  SCN-specific regions: Sequence locations=1-67,89-257,298-523
atgtttttcactgggcttgaccgactcatttgtgttcttttcccggaaaagtaaggcataaaaaaacatcccaaattaattgacttaattatccaattaaaaaaggcactccaaaattaatttgcgcttttatttgggcgcgattacttttgtctgttctctgttctccgctgcgttactttgcacactctttttgactgctaaacagctcaaaggactgatgatcagcggatgtatcgtcgacattgtccaagtccaaaaaaataaaaattatttatttaaattgaattttaaaatggaattcattaaattttagggtccatccgttgcatttttcgctctttccaatttgctcacaaatctcgtgaccactgccatttatttggccatcggaatcaccgtcaaagccaaaactggtaattatatttaataaaaacgctttttcatcccaattaaccttcattttttctttattttcagcttctttcgccgcccaagcgaatctttccgccgcggcgaataa

SEQ ID NO: 70726 - DNA, 339 bp, Heterodera glycines
  Genomic contig location: Contig_ID=SeqID_9242; Location=486..824; Strand=+
  SCN-specific regions: Sequence locations=1-266,288-339
atgcctggatcgagccatgacaagcctggattttttgggattcgttatttgatcccttcccaaattcgctgcccttttcagttggccgttgtcgctgtgatgagtgctttcccgttcatgcatccgcccatgattgcatttgtgcggcacaatgtcggactttatttgttgggatagtgagttttggcactcaattaattgcccaattaattaattggctgaaatgtccaatttgttgctctgttcagcatcactttcttcgtcgtttacattgcattgatctgttgcgagggcgtccgtcgatcattcccggccaatatcattttgcttggcattttg

SEQ ID NO: 70727 - DNA, 709 bp, Heterodera glycines
  Genomic contig location: Contig_ID=SeqID_9243; Location=281..989; Strand=+
  SCN-specific regions: Sequence locations=1-239,261-309,331-353,377 -649,689-709
atggcctacagtatgcttggcattgtgttcatcgccacaatgtgtttggcgttgttcggcttggttgtgatcattgtcggaatgttcaccaatgtgcgcattcttttcgttgtttacgccgcgattggggcatttctgttcatgatttggttggccattgacattcaggcaagcaaaatggggcagcagccgaaatttacgaacggagtgacaaaagcgaagccattcgttgaacgtcacaaaaattggcaattttaaattgcaaaaattttttgtcaaactgctcaaaattcgatagccctgcatttaaaaaattaaatttcaaaaagtgtccatgatttgtcttgttaaaatttaatgaatttttaggattttttctttctgtcgaaacgtccgcttggcggatttacaaaaagtatcaaattctctaacaatgttcttatcaaaatcgaggggatagccatgaaaattgtttattttataattttaagaaacaaaatattcaaaatcaatcatcctcctccccccatttgctttttcagatggttatgggcggtcgtacctacgaaatttccccggaagagcacatcttcgcgtcgattactttgtttcttgacatcattcaggtggctttctcatttaatccaaaatataatgtataaatgttttttcagattttctggtttcttcttgcaatttttggagatcg

SEQ ID NO: 70728 - DNA, 537 bp, Heterodera glycines
  misc_feature (475)..(475): n is a, c, g, or t
  Genomic contig location: Contig_ID=SeqID_42936; Location=246..782; Strand=-
  SCN-specific regions: Sequence locations=1-14,36-134,213-280,322 -342,396-444,466-537
atgttagcttttactaaaaactttaacattttagtaagtaatatcatttttgtttatatccttcaaaaaaattttaaaggatgtttttcaaatttgcataaaatatgatttaaaaattacctcaaaaataacagtttttaattctttaaattgtttataaacaaagaatataatgtataaaatgattacaataaatatatctaaaaattaaagtaaatggtataagtgaaaaaaattaaaagcttatctcaacaaattcaacaaataagcacttgatttcttttaattaattatttattacaaaaataaattatttttattcttagtcaatttcacctatgctaaattaatttaatcttttaagtcatttattatttattatatattttttatttcagaaaacgagatcagatttagtcgatcattgagtaatgttcccaaagcttatttattgctttgaattttgatttcttanataacaataataatagaatatgcatcttaaaactgatttgtagtaaacaattttttaataaa

SEQ ID NO: 70729 - DNA, 207 bp, Heterodera glycines
  Genomic contig location: Contig_ID=SeqID_42938; Location=197..403; Strand=+
  SCN-specific regions: Sequence locations=1-173,196-207
atggacacgagcagccaagagctgaacgcgtgtgccgagtgcggcttcaccacccgggactgggcactgttcacgcgtcatgtggaacggcacgaaagcgccgatggcatcattaacagttggaaaagttcaaagactgtgccgacaacgcccgaggcgatggacgaaagcgtagaagcggaagatggtggtggcacagattttcag

SEQ ID NO: 70730 - DNA, 367 bp, Heterodera glycines
  Genomic contig location: Contig_ID=SeqID_42940; Location=601..967; Strand=-
  SCN-specific regions: Sequence locations=1-367
cattatgatgcgctaaaattatcagagtgccgaaaatcgcatgtgatctaagcctagcaaaaaatggtgtaagtaaaaatcgtaattacgctcaaaaagctcctcaaacaattttagcgcttccaattccttctacaatcgcctttatacatcccattatgagcgctaaaattatcagagtgccgaaaatcgcatgtgatttaagcctagcaaaaaatggtgtaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagcaaa

SEQ ID NO: 70731 - DNA, 715 bp, Heterodera glycines
  Genomic contig location: Contig_ID=SeqID_42941; Location=14..728; Strand=-
  SCN-specific regions: Sequence locations=1-715
atgacggtcggaggtggcaccgatcaggagaaggagacgaagttggcggccggaagtggcattgacccggagaaggcgaagaagatgacggtcggaggtggcaccgatcaggagaaggagaagaagttggcggccggaggtggcattgacccggaggagacgaagttggcggccggaagtggcattgacccggagaaggcgaagaagatgacggtcggaggtggcattgacccggagaaggcgaagaagatgacggtcggaggaggcacagatgctgggaaaggggagatgacggtcggaggtggcactgatcaggagaaggagacgaagttggcggccggaagtggcattgacccggagaaggcgaagaagatgacggccggaggtggcaccgatcaggagaaggagacgaagttggcggccggaagtggcattgacccggagaaggcgaagaagatgacggtcggaggtggcaccgatcaggagaaggagacgaagttggcggccggaggtggcattgacccggaggagacgaagttggcggccggaagtggcattgacccggagaaggcgaagaagatgacggtcggaggtggcattgacccggagaaggcgaagaagatgacggccggaggaggcacagaggctgggaaaggggagatgacggtcggaggtggcactgatcaggagaaggagacgaagttggcggccggag

SEQ ID NO: 70732 - DNA, 815 bp, Heterodera glycines; identical to SEQ ID NO: 42941
  Genomic contig location: Contig_ID=SeqID_42941; Location=1..815; Strand=+
  SCN-specific regions: Sequence locations=1-723,745-815
  Gene Ontology: Mol. function=pre-mRNA splicing factor activity; Cellular component=actin filament; Biological process=signal transduction

SEQ ID NO: 70733 - DNA, 647 bp, Heterodera glycines
  Genomic contig location: Contig_ID=SeqID_9246; Location=458..1104; Strand=-
  SCN-specific regions: Sequence locations=1-48,73-151,174-178,212 -390,477-647
atgcgaaaaaatattccgacggaattactttttgaaattatcggtgcaattccattcgacagaaaatgggctcaaatccatgtgtcccaagtgtttaaccattttctgttcaatcgtatgggctcgtggcttagtcaaatcaaaaatttggtgagtttttaaagggtaatttttcacgaatttttaaaaaattctttaaatattttaaattccattggccgattattttttgatttttttttgtcaaatcattaaatttttggcagattgccaaatgtacgtttctcgtgcgaagcatagtgaaaatgatcagaacaattcctgataatttgctgcttagcaacgtaattccaattaaacaatttgaagcacagattttctataagggttttaatttgaaataaaaattaattaattttcaaataaaatttaattaattataaataaatttaattaattaaaaaaattccaaattacccctcataaaagaccttctttacttcattggacgttggaccaattgttctcgcatttttcctgaactcattggcttgccgcttaactcagacgaccctaattacgtaattaaagcgctcgaaaatattttaggtgttcgtatcattacgtagttgtttttatttaataaa

SEQ ID NO: 70734 - DNA, 68 bp, Heterodera glycines
  Genomic contig location: Contig_ID=SeqID_42942; Location=1116..1183; Strand=-
  SCN-specific regions: Sequence locations=1-68
gacataaacatttatttgatttattttaccatattcacaatttgatcaaaatatagggggtcaaaagt

SEQ ID NO: 70735 - DNA, 654 bp, Heterodera glycines
  Genomic contig location: Contig_ID=SeqID_42942; Location=506..1159; Strand=+
  SCN-specific regions: Sequence locations=1-256,278-654
atgacggtcggaggtggcactgatcaggagaaggagacgaagttggcggccggaggtggcattgacccggaggagacgaagttggcggccggaagtggcaccgatcaggagaaggcgaagaagatgacggtcggaggaggcacagaggctgggaaaggggagatgacggtcggaggtggcactgatcaggagaaggagacgaagttggcggccggaagtggcattgacccggatagtgtaaaatgcactattttcttaagaaatacagtactttttataggcaccgaaataaaagtcgacgtatgtcagcgggcctaaatcgtagacccactattccaaaggcaatacggtagcaaattttgtgctctataaaatgggcctactcaaaatttccagaaaaattttcccaaccccctagaaattttttttgaaatttacccctcgttcccagccaaaatgggctgatcagatcaccatgaaggagtgatctgatcaacttggtgttgctaccttttttgatcagcatccaaagttatgcttacctgaatttttttagatttttttaatgctgatccagagaagcaatattttaaaaatgaaatgggacaacacttttgaccccctatattttgatcaaattgtgaatatggtaaa

SEQ ID NO: 70736 - DNA, 355 bp, Heterodera glycines
  Genomic contig location: Contig_ID=SeqID_42945; Location=354..708; Strand=-
  SCN-specific regions: Sequence locations=1-355
atgcgtaattcatttgactcatcaaatgcgattggactcataaagtgcaataaaaccctcgaaacaccgaagaaaaaagacattttcctaaactttggtaaaatgtgagtgttttttttgtaattttgtgcattttcgtcaaattttccctatttgtccccccccccctcccaatttcagccggtttggcggagaatgtgcttcatttgttggacgccaagtcgttgtgcgcctcggagtttgtcagccgccggtggagtcgtgtcattgtcaacggattgctgtggcgcaagcacatcgagcgccaagtgcgcaacgacgcgctgtgggccggcctcgccatccgacggggatg

SEQ ID NO: 70737 - DNA, 527 bp, Heterodera glycines
  Genomic contig location: Contig_ID=SeqID_42946; Location=146..672; Strand=-
  SCN-specific regions: Sequence locations=1-16,39-247,269-377,414-527
atggagcccggtgcgaagaagcgcagaaaaaggaagaatgccgaaaacaccgacggcgagtctatggaatgcgaagaagaagaggatgccgtagatgaggacgccgagaacaactggatgctggggtacgaagaagccggggagaagccggagtcggtgacaacatacgcgtacgcccacgccggtaattttggaattatttaaaaaaaaacttggaagaaataaaatttaaaggttcccgctacgatcatgtgctgatttatggtgaaatgctgcgcatgggtgtcagccctgaactcatccaccaggggaaccatctcctggaaatgaaggcccgcaaaacaggagtctacacaaccaccgttttccgggacaggtaaatattttgaatattaaatatttttaaaatttttgatcattttagttacaagttgatcccaataaaacttgccaattttgtcaatacgtttggcctagaaattgagggcgtggaaaacaagaaatattttccacacaaattcaataag

SEQ ID NO: 70738 - DNA, 469 bp, Heterodera glycines
  Genomic contig location: Contig_ID=SeqID_42949; Location=318..786; Strand=-
  SCN-specific regions: Sequence locations=1-469
gtttcaaatatcgtaagattgtttgatagggccagacaagagaaggcaactgttggtaccaattttgcggtaaaaaaatgagaaaaaagagatagacattttttggtcaagaattttttttgtttgcgtttcaaatatcgtaagattgtttgatagggccagacaagagaaggcaactgttggtaccaagtttgcggtaaaaaaatgagaaaaaagagatagccattttttggtcaagaatttttttttgtttgcgtttcaaatatcgtaagattgtttgatagggccagacaagagaaggcaactgttggtaccaattttgcggtaaaaaaatgagaaaaaagagataaccatttttggtcaagaattttttttgtttgcgtttcaaatatcgtaagattgtttgatagggccagacaagagaaggcaactgttggtaccaattttgcggtaaaaaaatgagaaaaaa

SEQ ID NO: 70739 - DNA, 314 bp, Heterodera glycines
  Genomic contig location: Contig_ID=SeqID_42951; Location=773..1086; Strand=+
  SCN-specific regions: Sequence locations=1-260,282-314
atggccaaaaatgaaattttagcgcagaaaaatgttgaaaaagaatggaaacaaaattatgtagaaatttgtaagaaaattggagtcatccgagacataattaacaaatggaagaaacaatttggaattcgctgtaaaagaataacggaggaacaaaaaatagaaaaaatgaaaatttattggcaaataaaaagtgaaaatccaaaaatgagtgataataaaattgcaaaaatattgaaaattcatctaaagagcattttcaattggaagaaacaatttggagaacaaataaacgaggaatgaaaaagggataa

SEQ ID NO: 70740 - DNA, 557 bp, Heterodera glycines
  Genomic contig location: Contig_ID=SeqID_9247; Location=1047..1603; Strand=+
  SCN-specific regions: Sequence locations=1-529,551-557
atgggttcaagcagttctagcaatgcgggctcgttctcatcagcatttgcgagtagttctggaagtgcgcgctcatcaagtcagggctcttcaaaactgttctgcagtgaagctttctgtgcctgtccccgttctcaccttcgtgccatcgaattcaagaaggtcgccgttgccgttgattcgggtaagagagtataagttttgtaatacaacaagtaactgtagaaatatacgaaaattaatggaatttcatgttgaatggtaaaattccttttctttctacagtaataactttattttggtccatatttggccatttttgagctttttagtccatatttcgggcttttttagtccatattttatgtccatatttgggatttttcagtccatatacttattgtataaccctagtaatgacttatccccacgcggctgttgaagtgctctacatatgcaatgactgtgaccatgaactgcgtgtcacgtacgatcttgtgttcaatttgcaccttctaaggggtcagtcaattaaaggaagagttgaagtcatttaa

SEQ ID NO: 70741 - DNA, 274 bp, Heterodera glycines
  Genomic contig location: Contig_ID=SeqID_9247; Location=430..703; Strand=+
  SCN-specific regions: Sequence locations=1-44,66-274
ttttttaggtcgattcttaggggtgtattttttgttcttattgcatttttgttaaggaattttccaaaaaatgtcgaatagtgaaaaaatagtgacaaaaccccaaaatagtgatttttaactattttagtgacgaagtcgccaaaatagtgatttttaactattttagtgacgaagtcgccaaaatagtgatttcagtgaccgataatgacatcagaatcgaaaatttttaatgcagaaatgcgttttttgagctcctttcttcaaaacaatt

SEQ ID NO: 70742 - DNA, 2695 bp, Heterodera glycines
  Genomic contig location: Contig_ID=SeqID_9247; Location=3321..6015; Strand=-
  SCN-specific regions: Sequence locations=1-22,44-254,321-469,491 -776,798-815,838-956,980-1206,1254-1371,1393-1514,1553-1599,1651 -1743,1766-2104,2126-2249,2271-2332,2354-2465,2487-2538,2566-2695
  Gene Ontology: Mol. function=neuropeptide receptor activity; Cellular component=integral to plasma membrane; Biological process=G-protein coupled receptor protein signaling pathway
gccaagagctgcaactgttatttgtttcatttattttaggccagttttcccgagttggtcgacctgttgcccattcaattgtccttctccgccctgtactttctcatttggttggccgcaattttgggcaatgcttccgtcctttatgtggttagcttaaaacaggcgagttttattatgcataatttggggattcgagaataaatgcatatttcgcattttttaagaatattttttatgccgacttttttaccaaaaaaaaagttaaaaaaaattatttagcaattgttttgatattttatcatttttatatttttaaacaagttttacattttttggcttaaatcatttttggcagtttttagtgcatatttgggccttttcatatttctagggcatatattattaatttttcgtgcatattttatgcaaattggcatttttgtacataaaacgaacacccttataattagagttttgggttgttagtaatattttaggccttaaaatttcaattggttctttgcccaatttttacaattcaataaaagggaaatattcgaattcgagttcgatatttaaaaaaagcctgggtaaaacggaaaatagactctctaaatccaaatataattataaatatgtctttttcattttcggtccaattgtcatcggtgcgttcggtgttcatctgcagtttggccgcatccgacattctcatgtcgttcacttcattgccgatcaccgccatttcaatctttacacgtgattgggttttcccttctccattttgcaaattgatgggcattttccaagtcattaatatttaatttttttaatgaattttctttcaccaaattagcagttccgcgaaaattattcaaaaagacagaaatatgataatttaaagtttgctttaatcatctccgtcctcctccattaatgagctgctaattcggcataattaaaacattttttcatggatttaaaaaatttgtatttttcattcgataagaccggatcgataggacatcgataggtgccgcagtgaaaattaatcaaaaaaaaattattggcaatcataatttacacatttgtattctcaatgttttcaaaaagtcagggcggcacagtttttgtgtccagcttcacactgaccgcaattgctgttgaccgttacattctcatcaaacacccgacaaaacaggcaatataatttataaatatttttttattaataatcataatttaaaattgcagaaaattgaatttcgcaccgcaatttgcattgttattggcgtttggacattgggttacgcttgtgccttgccggttggtcttttctcatcaacgcaagaatatccaccattttgcggcacattttgtgaagaaaattggtaaaaaaaaaagttaaggggaaaaattgccaaaattaattaagttaaattgttattaaatttaacggaatttaaaattaaataggccagacacggaagaacaaacggggagaagtcggattcgtaagctgtacggtttgcttgtgctgattgttcagttcggtttgcccactgtaatctcttcgctgtgctattggaacatcggtttttaaatatttaaatgatttatttgttaatttattttttattttttaaaggtcgactgattcggcgccaaattcaaaagagaaaggaacggcaacttgtgctgctgcaggaaagcaaagacagaatgaaaagtcagaagaacaggacaaatcggatgatggtcactatggtaaaatactgtaaaaaaatatgatcaaacttttgaaaaaatttcaaaagtccattaaatattcactatttaaatcacacgaatgctttgcttatctttcccgattaatcccggcccaacagggaccggaataaaacggataaagattctaaaagatttgagaagtgaaaacataattttttcaccaaaaattcctttttttccttctgatcaaggttgctggcttggtgttggcctggttgccaatgaatttgatcaacctttggcgggattttaacagcgaaaacagtgccaactccgatgatgccaaatctgttcgatcaaaacccttccctttttattataattttttattgaaaaagaatttagaacgaatggtattctctgatttttgctgcatgtcattccgttgcgatgacatcaggtaaaaatgataattcaaattgaaaataataatataatctgaaaccagcggtatggaacccattgatctacagctttttcaacccacaattcaaagagacaattcgcgcgtctttggagcggcgcagaaaatcccaggtcattaaaatttggtttatttgcaacttttcaaaatgatactttgatcatctgggagttttttggcttgtcactttattttttcgtctcctttattcattttttatggaaaatttgctgataaatgagaaatggatgactgtgaaatgagaataataaaaatggaattaagcattaattcatataagaggacatttgtgtccatagaatatttaaaaaatttaaaaaaaattaggcagtcacggcacttctgatgactcagcaacaaaccaacgccaataccagcgagtcccggagaacatcatgccgaagtttaaatgtgcttatcacaaacaacgcgccatctgctggcaacagacaaagc

SEQ ID NO: 70743 - DNA, 795 bp, Heterodera glycines
  Genomic contig location: Contig_ID=SeqID_42952; Location=138..932; Strand=-
  SCN-specific regions: Sequence locations=1-352,376-795
atggtgaatggtgaagaaaccatcattcaatcggttggtgcttctgttggtttctcagaccatgctgattgcttcggcacgaatgaaccgtctcgactggccgaagaggattcaccgcgaggagagatcatgaaagcactccttgccaggcctggaagaagtggactgaaagtgaccactcaaaaactgattgattatggtcttggccaaaagacggcaatgccatcagtagcgagactcaacgaggaacaacagcaaactttggcactcattgcatgtgaccttcctttggttgtgttgcagcaagccccgcctggcacaggtaagacactaacattggctacggccatcgaccttcttttgtcggagaaaaatgaggaaacggtcattgtggcgacagctacgtctaaccttcctgtcaccaaaatggtggaagaaactcgggcagttggagtttcggaggaacacttggcactcttcagtggaacggccagagtgcgctacggcgagcaaattcaaccgttggaaagaagtctgctacggccaagactcacgcagacattcttgaaaaaagtcaaagacaagaaggtaaagcaatttgaggactacaaaaagcacgtgtttaacacacctctgcgggtccgagaagcaaaagtggctgaaagttatctgaaatacgacaaaaggaaagttattttcctcacgactcacatggctggtcgcatcaaaggaacgataagtcgagcaacccatcttcttttggacgaagcaacgcaggcaagtttcaccaccgta

SEQ ID NO: 70744 - DNA, 283 bp, Heterodera glycines
  Genomic contig location: Contig_ID=SeqID_42954; Location=438..720; Strand=+
  SCN-specific regions: Sequence locations=1-283
atgcttttgtgggagaacggacccgaggacacttccttttaccacgcgctcagaatttgctccgaagaagcgatggaacagaacaaaaaagcgccggaacaaaagaaagtgaaagacgcggaggatttaaacatggaaatattcgccaaaatgatcatttgcatgggcaaaaggctgaaaatgccacgccgaagggacgcaattttgaacggaatgcattttgacaaattggcaaaattggtggacgaatgggaccaattcggcaaaatattggggcaaaaaa

SEQ ID NO: 70745 - DNA, 1104 bp, Heterodera glycines
  Genomic contig location: Contig_ID=SeqID_42955; Location=428..1531; Strand=+
  SCN-specific regions: Sequence locations=1-27,50-232,263-350,373 -568,592-1104
atgaccaactggcacaagaagggacggatggacggaggggaaaagggggaaattgaaggagaggcattaggagaggcggaagcgaccgcggcggatgaccatcaccatcaatcccaattcgaggaaggacggaggaaggggacagatggaagacggaggaaccgacggcggggtaaaagcggtggccaaagaaagggtcaaattaatggccaaaagaggggcgtagacataaaatataaagacagacagacagacaaagtgatggatggccaggccaaactgtggtctgtcggaataaaagtaaaagtgtaaagtgaaaagcactgaccgctacggcgcgcctaaaatgagaagagagagaaaaaagggataggcggagatttatactttatatacaaagaaaattgaagatcagtgcgtactttgagctctcagactttcgtctcccccggcacattttgccgtctttcccccccccccttttccgctctcttccgccgattgctctttggccggcattgccattccagcggcgaaatatggaagcgtaagaagccactgataaaaaatgcacaattttctgcataagcaagcgatgaatccgccgtccgtcgggacacaacggcaaaaatgccattggtaagcggtgccaacccaacctttaccctgccccgtcctccgcattttgccattctctttttgcctgctataattcaatcataaatttgcatacgccgcgagggaatccgtccaatcagtgggacaaatcaccaaacaagctgatcggagatacttgtgaaagtaagactgatctttgagcaaagtttgagtgatcagaacaatcggtgcttactcaaaaatcatcaaatggaaaatattaactttgttcaagagtttttcgcgcatttttggtcataacttttttgaaactaacaataagcgaaattttgcaattttatagagaatagaaaaggctacccgacttttggggatttgcaacttggggacccgacatttggggacccgacatttgggggaccgaacgaacatttgagcaaaagacacttaagaaaaccacggacatttggtaacccgacattttag

SEQ ID NO: 70746 - DNA, 56 bp, Heterodera glycines; identical to SEQ ID NO: 57643
  Genomic contig location: Contig_ID=SeqID_42961; Location=131..186; Strand=+
  SCN-specific regions: Sequence locations=1-56

SEQ ID NO: 70747 - DNA, 936 bp, Heterodera glycines
  Genomic contig location: Contig_ID=SeqID_9249; Location=1512..2447; Strand=-
  SCN-specific regions: Sequence locations=1-24,51-150,172-444,466 -857,880-913
atgcgattcttggagcaatcagacttagcacggggtgtgctgcgcctggcacaatttgccacgcgccaaacgctggcggcgctttccggcaacaattttgaggctgaaaaattattggagtttaacatattgtgcccaatcataattagcgcgcaacagcaacagcagaaggtcgattttgacaagatggtcgagaaatgcatctattcaccagaaaagtgagaatttaaaacaaacaattagtgtggttaattagggagtgaacaatgcattaatgaaaatttaatttgtcaaatttttgatttaatatttatttggattgttataattaattagaaataaaggaattaaatccttaatacaaaacaaattttgcttaattgcatttttgtagttatggcgtcgcttctgtttttgctgagttattgcgcaaagctattgtcaaaaatgacaacaaaaatgacacaatttttcaaagtgcaaaaatttattcggaactttacacggcgattttaaaaatgcaaaaagaggtcaatttggaagaatggcgaaaagtgccaatgccatttgctatggaatggaataaaatgaacaaattcctaagcgaaagtgtcgaagaaattgacacatttgttaagcgatgggaggaaatgggaaaaaatgaaaaagaaaccaaaattggcgaaaatgtgaaaaaggagggctttttcagtgacaatttgttggaaaaatgcattccgttcattgtggagagcagcaaaaagggaaacagaacaaacaattgaggaaaaagagaacgaagaacaaaataatttagattttattaaaaagagaaatgaaattaattatttcagtgtcaaatttcatttcttttgtattgttaaaaattggaaaaaaagaaatcattttttcattaaaatattttgaaaaaataaa

SEQ ID NO: 70748 - DNA, 2884 bp, Heterodera glycines
  Genomic contig location: Contig_ID=SeqID_9249; Location=1105..3988; Strand=+
  SCN-specific regions: Sequence locations=1-15,37-65,92-110,132 -341,367-402,440-464,487-878,900-1172,1194-1293,1320-1358,1409 -1672,1696-2475,2500-2680,2707-2884
atgaaagaatcaatgaatgattggatgattattattcaccacaaaccaaaagagcaacagaagcaaaaggtaattaattaattaattggaagaaatttgaggatttcgagttgaaagtaaataagtaaattggaaatgcaaacaaaagcataataataatttaaattaaggggtgcaaaaatggccataaaatatagaaaagaaattcccgaaaatgaaaataaaattgaaaagacaaggacaacatatgttttcagattgtaaaattactcaaattcttattaaaagctaaaccaagttcaaaccttatttttcacaaaaaaaaatttggacttgagatgttttaatgaattgcatttcttttatgtatttatagaaaattcaattttcccttctattcgcttatttttattttttcaaaatattttaatgaaaaaatgatttctttttttccaatttttaacaatacaaaagaaatgaaatttgacactgaaataattaatttcatttctctttttaataaaatctaaattattttgttcttcgttctctttttcctcaattgtttgttctgtttccctttttgctgctctccacaatgaacggaatgcatttttccaacaaattgtcactgaaaaagccctcctttttcacattttcgccaattttggtttctttttcattttttcccatttcctcccatcgcttaacaaatgtgtcaatttcttcgacactttcgcttaggaatttgttcattttattccattccatagcaaatggcattggcacttttcgccattcttccaaattgacctctttttgcatttttaaaatcgccgtgtaaagttccgaataaatttttgcactttgaaaaattgtgtcatttttgttgtcatttttgacaatagctttgcgcaataactcagcaaaaacagaagcgacgccataactacaaaaatgcaattaagcaaaatttgttttgtattaaggatttaattcctttatttctaattaattataacaatccaaataaatattaaatcaaaaatttgacaaattaaattttcattaatgcattgttcactccctaattaaccacactaattgtttgttttaaattctcacttttctggtgaatagatgcatttctcgaccatcttgtcaaaatcgaccttctgctgttgctgttgcgcgctaattatgattgggcacaatatgttaaactccaataatttttcagcctcaaaattgttgccggaaagcgccgccagcgtttggcgcgtggcaaattgtgccaggcgcagcacaccccgtgctaagtctgattgctccaagaatcgcattcgcttttcctgatgtaaaataaaatgaatttttattttgcaatgattaaataatttttatttttctggtcactgttatacagtatacgtattttaccatctcttcttgatcaattcttgacgctccaacgatcgcataaaattcttgcgacatttgagccaacactgtgctaaaccaactgagcatccattttctcgttgaagctatgtcgatgaccttaattaaatgacaattaatattcaaaattcactaaattgtgtgtcatttaccagaatgccatcggaggtccaagaaaaaaaggacaaaaatggcaatatttaaaaccaaaacttttggattttggaaaaggggtgttcgaacagagaccgcgagtgtttttttattttaaaaacctgacctgaatatatctttttttttgcacgtttaatgaaaaaacattcccaaactaataaaaggactaaaatgttaatgctgcttctctttaatcatctgcacagatacactactgtatactgtggatgttcttactgtatctttttgactgtaactttggtatggagtctctaattctacgattaattttgtgatgagtcgcgcacaaaaatagagcattaattgttctttgtgttcgtttgtctgctcttcctacaatagcgggagcagggagttgtactcccgtaaaatcccacggtagtcctgatcccgccgcactctattgttaagctattaattcaacttttcgcccacaatagctgatctcttttccaatcacacggtgcgctgggaattgtttcaagaaatgtcctccgaagaaaatgtgataatttttggcattgaaacgtaaaatccccaggtaatctaaaggtaattgtttacatttttgccgcatatactgcaatacgatggatcgtctttggggcggacattcaaacggattcaagaaatgtggacagtacttgaaaagtacttcagatcactgagagaccgtgattgtcccaaatttttgcgtcaaatttttgatgatgaattgacgccaaggtcagaggaatggaaagttgttgtgtgctttatgtgttttgcattcgatcagtttaaccaattgaatgttattagccaggtagtacttagaaaattactagattaattttaaaaaattcagaaaccgacacttccgttttccattttggccaaacaaattaaatcattaaaggtgaagctgtaactttcattgaacgaggagttttatggggaagcgaccagtgaactcttgaaacaacttgaaaatgatggcgctatttatcaaaaaaacaaattaaaggcctgtttctttaataaaatattggttttagttttgttttttcagcaattttacgcggacgcacatgaatatttgggcaattggtcacagcaattctctgagacggatgaaattattggagattgggtcattttcgagtcagagccaactagtgaaaaagttcgaagggcgtataggcatatttctgtggggcatcaactgacgaaatggatgctttgtttg

SEQ ID NO: 70749 - DNA, 500 bp, Heterodera glycines
  Genomic contig location: Contig_ID=SeqID_42965; Location=205..704; Strand=+
  SCN-specific regions: Sequence locations=1-152,176-254,278-462,485-500
atgaaccagggcagcaacaacaacaatggcggtggtgctactgcaatgcctatgccaccaaatggtagcggtgcgtttgccatgtccccctccacgtttgtgccgtcgcatccgtctcccctcgccacttcgtcgtctcctccgcccgaatacgcgccgccgcctccgctgccggcccatggcgctggtgcttaccgacagcaaacgacgggcggagtgcgtttttggattgcataaatttttcgaaatccgaattttttaaataaaaaattcggggaaagacgggcaatctcaaaatttttattggataatttaatacaaacagcaaatggatgacaaaagttgcgttatttcagcacagtttccctaccggcgacctcgccaacaaaagtggggtcggcgccgtttatccatcggcgcatccgccgcccgcgggcactccgacgcagcccttcccaaacgcaacaccaccaccacaacaacactaccaacagcatttg

SEQ ID NO: 70750 - DNA, 484 bp, Heterodera glycines
  Genomic contig location: Contig_ID=SeqID_42967; Location=187..670; Strand=+
  SCN-specific regions: Sequence locations=1-217,239-275,380-484
atgaaaattctcattttgtgccctcctcaaaggtgcgaatgggctacttttttttcgcactgcgacggatggtggcaataattgtgcggcacataggtgccgtgccgaaacagtcgtttgcgatcagtccaatcgtatgggccgtgccgatttttcacttaaaacaatcatttttaaaacaaaggctttcatatattcatattagctaataaataatacaaacattttatttgtaaaatattaccaagccaaaagtgatcctcaattgtctcctgaattaaaatttttttttattgttgaattaattaaattttaatatttcattttttcctaaaattaatttagttgatttaattatatttaaatatttttatttatacatttgcagcaattgtctgctcaaaatacagatgtgtgctgttgaaaatgtgcattcgactgaagccataattgcttgaacgaaatgcgctcctaaacaattaaa

SEQ ID NO: 70751 - DNA, 944 bp, Heterodera glycines
  Genomic contig location: Contig_ID=SeqID_42967; Location=199..1142; Strand=-
  SCN-specific regions: Sequence locations=1-116,142-392,480-577,682 -718,740-944
ttacgtggccccaccggctcctgttcatattatcagcggttctgcgggatgccaagaaaatacggacacatttgttgctcatcctggaccatggtaacgagtaaattatgtgccggaaattttttttatttttattaaattgccaaatgggcgggcattttttcaaccaaaatttcttataattttgctcaaaaccaagctaaatttaatattttgctaatgttctctctatttatattcattattttccaattttggtaaattcaaaattttttgaactttgttcaccatagtttgtgtaaaatctggtaaacaaggatgataaggatactgttgtcttctatgctaactacagtagttcgaaaaaaatcgcagtgattttacaattgaagtaatttaaattaaaatagtttattgaaattttctatcttaattataaaataataatttaataaacatttaaatattttattttaattgtttaggagcgcatttcgttcaagcaattatggcttcagtcgaatgcacattttcaacagcacacatctgtattttgagcagacaattgctgcaaatgtataaataaaaatatttaaatataattaaatcaactaaattaattttaggaaaaaatgaaatattaaaatttaattaattcaacaataaaaaaaaattttaattcaggagacaattgaggatcacttttggcttggtaatattttacaaataaaatgtttgtattatttattagctaatatgaatatatgaaagcctttgttttaaaaatgattgttttaagtgaaaaatcggcacggcccatacgattggactgatcgcaaacgactgtttcggcacggcacctatgtgccgcacaattattgccaccatccgtcgcagtgcgaaaaaaaagtagcccattcgcacctttgaggagggcacaaaat

SEQ ID NO: 70752 - DNA, 65 bp, Heterodera glycines; identical to SEQ ID NO: 56492
  Genomic contig location: Contig_ID=SeqID_42970; Location=731..795; Strand=+
  SCN-specific regions: Sequence locations=1-65

SEQ ID NO: 70753 - DNA, 59 bp, Heterodera glycines; identical to SEQ ID NO: 52421
  Genomic contig location: Contig_ID=SeqID_42970; Location=131..189; Strand=+
  SCN-specific regions: Sequence locations=1-59

SEQ ID NO: 70754 - DNA, 59 bp, Heterodera glycines; identical to SEQ ID NO: 68969
  Genomic contig location: Contig_ID=SeqID_42970; Location=261..319; Strand=+
  SCN-specific regions: Sequence locations=1-59

SEQ ID NO: 70755 - DNA, 59 bp, Heterodera glycines; identical to SEQ ID NO: 52421
  Genomic contig location: Contig_ID=SeqID_42970; Location=391..449; Strand=+
  SCN-specific regions: Sequence locations=1-59

SEQ ID NO: 70756 - DNA, 59 bp, Heterodera glycines; identical to SEQ ID NO: 52422
  Genomic contig location: Contig_ID=SeqID_42970; Location=519..577; Strand=+
  SCN-specific regions: Sequence locations=1-59

SEQ ID NO: 70757 - DNA, 518 bp, Heterodera glycines
  Genomic contig location: Contig_ID=SeqID_42971; Location=386..903; Strand=+
  SCN-specific regions: Sequence locations=1-518
atgtcggcgaaagttaaaacggaggcgtcgtcgccaaaacaaatgaacgaaaaggcggaagagaatgaattgacagagcgtttggagttagactttgtcgaagtgcgccttttttctcgatagtatttggcaccataaatccaaattgatggctaaaacttggcgaaaatggctaaatttcctgggttttcccaccgtgtagaaaaatttaagggaagttacatttgtcaaaaacttgggccagaagagtaaaaacttgtagagcctcttccgaaattttctttcttctatacgcacctgtttagaatgtccagtttcacccatctttatgaactgtttaggagtcagtcggcgacgattggtacggaaatgccatcatggaatgcgacgacactttagccaccgcagatgaagcggaggaggagggccactcaaaacgtcgcccgactcgccacgttcgttgtctgccccgcgttcccccgaagacgaagtggagacaattggtgccaaggaattaa

SEQ ID NO: 70758 - DNA, 987 bp, Heterodera glycines
  Genomic contig location: Contig_ID=SeqID_9250; Location=67..1053; Strand=-
  SCN-specific regions: Sequence locations=1-80,102-284,306-439,475 -550,577-672,695-873,895-987
atgacaattcttgaaaatagaaaaatgatgaacgattcactaggaaatgttcggtaaatgccgttaaaaaaaggacattaattatttcttgggcttttggatggactcaaggcatattttaggaatttaacagtccaatgtgtcaaggttgctttaaaaatcgtgaattttatttcatattttttattactttttgactttaatttccaaaaatatgtttttatggtgactaatatttaataaaatagaattcgatggattattaatgcatttttctctgagggttaacagaaaattggataaaataattcgttgaattttatttaattttgactgttaacttctaaaatatgctcaaaaagaggacaaaatcatggacaataatcttctattactttccatttagacctttaccggaaatcccccaaaaattcatctttttagattttggatattttttgagattaaatttcgaaaatattactttactaataatgaatatgacgtctaataatttctccacattattaatccgttttttcgctgattcttaacagaatatttgtccaaataattagccaaattgccattagctggactgtagagttcttgttaggacggggcattgctgaagctaaatgcatcgagcagcagccagccccgccaaagcagattttggctgtaaagcaaaattgtgcagtgagaaccaaaggctttgaagcacgtggtcaagtgcaacagcagctgaatgtgtgctggcgctgtgggcgaagctcacattttccaagtgtatgtccgcacattaaagttgcgtgccggaagtgcagcaaagtgggacatttggaagcgcagtgcaaccaacaccaatcgtggataataaggcaagggaaaatgcaaagtcgtaagcaaggcaacctcaagcttggaggtgtgctgatcaattcggtgaaccaaccgaaacggctgattgaatgccctataaaatga

SEQ ID NO: 70759 - DNA, 647 bp, Heterodera glycines
  Genomic contig location: Contig_ID=SeqID_9250; Location=1136..1782; Strand=-
  SCN-specific regions: Sequence locations=1-80,102-284,306-439,475 -550,577-647
atgacaattcttgaaaatagaaaaatgatgaacgattcactaggaaatgttcggtaaatgccgttaaaaaaaggacattaattatttcttgggcttttggatggactcaaggcatattttaggaatttaacagtccaatgtgtcaaggttgctttaaaaatcgtgaattttatttcatattttttattactttttgactttaatttccaaaaatatgtttttatggtgactaatatttaataaaatagaattcgatggattattaatgcatttttctctgagggttaacagaaaattggataaaataattcgttgaattttatttaattttgactgttaacttctaaaatatgctcaaaaagaggacaaaatcatggacaataatcttctattactttccatttagacctttaccggaaatcccccaaaaattcatctttttagattttggatattttttgagattaaatttcgaaaatattactttactaataatgaatatgacgtctaataatttctccacattattaatccgttttttcgctgattcttaacagaatatttgtccaaataattagccaaattgccattagctggactgtagagttctaaaataggctttaaaaggggccttatttctgaataaa

SEQ ID NO: 70760 - DNA, 300 bp, Heterodera glycines
  Genomic contig location: Contig_ID=SeqID_42974; Location=210..509; Strand=-
  SCN-specific regions: Sequence locations=1-300
atgacattctatgcttctcttgttggatacacgggaagaaataatagttagtccttttgttgaatttttagaaattctatccgtccaatcggcttttggaattttaatgagtaaatcaggaaccgtaaatgaaattctatgcttctcttgttggatacacgggaagaaataattgttagtccttttgttgaatttttagaaattctatccgtcatatcggcttttggaattttaatgagtaaatcagtaaccgtaaatgaaattctctgcttctcttgttggatacacgggaagaaataa

SEQ ID NO: 70761 - DNA, 300 bp, Heterodera glycines
  Genomic contig location: Contig_ID=SeqID_42974; Location=594..893; Strand=-
  SCN-specific regions: Sequence locations=1-185,207-300
atgacattctctgcttctcttgttggatacacgggaagaaataatagttagtccttttgttgaatttttagaaattctatccgtccaatcggcttttggaattttaatgagtaaatcagtaaccgtaaatgaaattctctgcttctcttgttggatacacgggaagaaataatagttagtccttttgttgaatttttagaaattttatccgtcaaatcggcttttggaattttaatgagtaaatcagtaaccgtaaatgacattctatgcttctcttgttggatacacgggaagaaataa

SEQ ID NO: 70762 - DNA, 356 bp, Heterodera glycines
  Genomic contig location: Contig_ID=SeqID_42976; Location=688..1043; Strand=+
  SCN-specific regions: Sequence locations=1-356
atgggtccggtgaagcatttgatggaagctgagcagaaaatgtgccgaattcgcaaccacggactccgatcactgaatcattttacgaccaatgcaattcgttcgaatcaatttttgcacgtaaattcaatttggttgactgttcctacaaagattcggtcagcgaattcacaaaaaaaaaaaaaatttgaatttaagaccgatccgccaaatgctcctcgggcagcgaattttgaaataaatcacttgggacccctcattagcaagtcaccaccatacgtcgccatggatttgatatttgttttcgaaattgtcaaacctttccatccttcgaacagctcatcatcaatgataag

SEQ ID NO: 70763 - DNA, 656 bp, Heterodera glycines
  Genomic contig location: Contig_ID=SeqID_42977; Location=418..1073; Strand=+
  SCN-specific regions: Sequence locations=1-372,394-557,642-656
  Gene Ontology: Mol. function=zinc ion binding; Cellular component =nucleus; Biological process=regulation of transcription, DNA -dependent
atgccagaatttaatccaatgactccaggaatgccaccgatgatgcctggttttaatccgatggtgccagggtttaatccaatgatgccgggttttaacccgatgatgtcagggtttaatcctatgacgccaggaatgccatcgatggtgccgggttttaatccgatgatgccagggtttaatccgatgatgccgggtaggaggaattgccgaaacttcaatataatttattgatgaatttcaacattctaatggccaaccctatttgatgaaacaaattttgagaagaaatttagttcttttaactgcttaaaatggattacaataaaaagcattagtttttttaaatttacgaataaatacttaatgcccattaataattattgtacaattagtaacgcagtttatgatttatcgctcttacagcaataacaattaggttaaataacttcgaaaattgtataaatttgagttgaaagtcattttttcaatttcacatcaactttatcttcaaaaatgccaagatgttcttgagctgtgcgagtcttctcatgctctaaaaataaatgttaatcaaaataaatttttttgtttcagtttttatttaaaatcttttttttaatttttaaatatttaataatgtaaggctaaccaaa

SEQ ID NO: 70764 - DNA, 49 bp, Heterodera glycines; identical to SEQ ID NO: 60106
  Genomic contig location: Contig_ID=SeqID_42979; Location=192..240; Strand=+
  SCN-specific regions: Sequence locations=1-49

SEQ ID NO: 70765 - DNA, 397 bp, Heterodera glycines
  misc_feature (248)..(248): n is a, c, g, or t
  misc_feature (292)..(292): n is a, c, g, or t
  misc_feature (319)..(319): n is a, c, g, or t
  misc_feature (324)..(324): n is a, c, g, or t
  misc_feature (353)..(353): n is a, c, g, or t
  Genomic contig location: Contig_ID=SeqID_42980; Location=1..397; Strand=-
  SCN-specific regions: Sequence locations=1-397
agttcatattattgtatggttggtcgtgttcagcattcaacagcatttaaagttcgaaagtggttcagcgtcttcgtttggcccgtttttgttatcagttatatccttggcgacaaataccaatattggcaattgaaaaccgggagacgaaagaacctttttgacgaattcgcatttcttcaggttaatgcggtcagcattttgttgcctaataattttccatttttaggaggcacaaattcgagagncaaaggcactttataacagtccgtacgggccgagagcctgagcnaatacaccgttttttggattatctgtncatgngcaccttcacccttaaatatttcttcaanaaggccgttcttgagcgcccgtggtactttttccccgcctttat

SEQ ID NO: 70766 - DNA, 1009 bp, Heterodera glycines
  Genomic contig location: Contig_ID=SeqID_9253; Location=211..1219; Strand=-
  SCN-specific regions: Sequence locations=1-517,539-612,636-979
atgggcgagaaacgaccaaaaaagttgggtgtatttgtcgactgtatggaaatgacttatgaagacgccatgcgattttatgcgaagtatgtcatttatcgtcgggaaagtgccaacattttgggctggaataatcgctttttctcagatgggcgagcggactcgaagaattgtcggcagattgtgttcagcaacggctgagcattttccttggccgcggcgttcgggcgggtgcccaaatgcgaagtgttgtgatgcgatgtccggagatacttttcatgggggttcctcagcaaatggacatgttttgggagaatattttggatttcttcacgttaaacgacttaaagaaactgatggtcaacagtcctcaaatctgtttgatgagttttgaagaaattgaggaaatttatgaggtgagcgaattatttctattcttcgcgacaaaatttcctttcaaatcaatttccattttttgcagtacatttattttcacatgggaattgagccgggcgaattggcagaaagcaaatattggcatactcttgagttggaccaagtcatgtctcgccatgaatttctactcaagacgggcaaatacacttaccccgacccaaaaaagcctcaattgaaaaaggtactctggatattggaaatgttttagcatttaaatttgcatttcatggcttcattaactgtttctccgttaggaaaatccagcggctcgtcggatctttgacgttgacgaattggaatttgcaactaaggtcggctgtgtttcacatgaagaatgggtaattttccaagacatgagaaaacaggaagagattttgagcgaaaaggagcgaccatatgaaaggtgaatttaccgtagctaatatagatgatacggtcccattgagaagctcaaactcatattcctttaaacaacttcaaattatcataatggactaaaatttaaaaatttaccatttttgcctattttattttaattttaaattataataaa

SEQ ID NO: 70767 - DNA, 172 bp, Heterodera glycines
  Genomic contig location: Contig_ID=SeqID_9255; Location=930..1101; Strand=+
  SCN-specific regions: Sequence locations=1-172
atgtccccacaaacaatttatgcaatgggagaaaacccatcagatacagtaagacgacgttgttttgatgtacggcaaaaccaaaacaatgtgtactccgacttttgacaaaaacaagcaacgaaaaacaaccaaatatccagcaatggtagttttgtggtttcttcgaaaa

SEQ ID NO: 70768 - DNA, 77 bp, Heterodera glycines
  Genomic contig location: Contig_ID=SeqID_42985; Location=80..156; Strand=-
  SCN-specific regions: Sequence locations=1-6,35-77
atggcaaagcgatgccgccgccgctgccacctgctgctgatgaagtggccgatgaggaggacacattgttgacctaa

SEQ ID NO: 70769 - DNA, 143 bp, Heterodera glycines
  Genomic contig location: Contig_ID=SeqID_42985; Location=82..224; Strand=+
  SCN-specific regions: Sequence locations=1-41,70-143
aggtcaacaatgtgtcctcctcatcggccacttcatcagcagcaggtggcagcggcggcggcatcgctttgccatctgctaatcacccatttgtttcaccaacctcattagtgccacaactggaggcagcaaactcattttgg

SEQ ID NO: 70770 - DNA, 529 bp, Heterodera glycines
  Genomic contig location: Contig_ID=SeqID_9256; Location=44..572; Strand=-
  SCN-specific regions: Sequence locations=1-187,218-529
atgggacctggatcccgcaggattttctgggcccatatcccggcttttaaaaacggctcaggaccgggaccccagcaaaagcaggatttgaataccggactcagggtactcaaattccggaaaaatgaactttccatcccggtattcttatctcggcctgatgtcaatgccaaattccgacttttacattatttaaaatttaattttcaaaattaatccatccgtttttctgcagttgtttttttttgcaatatgaatacgcttgctaatcgctgctctttttctaaattgtcgtccttttctcgttcgtttcactttttggcgaccggaaaagatttgcaaaaggttttattataatgaggagaaactgtgttggcactgttctgaaaatgccaatttttagttcaatccgatgaaaatgccatccgactttaaaagtgccgttggacgtcgtcagctgtcagtccaaagcaattccatttcacgagaggcatcaaatttgaaatcgtttgacgaaatttgtgctgag

SEQ ID NO: 70771 - DNA, 777 bp, Heterodera glycines
  Genomic contig location: Contig_ID=SeqID_9257; Location=1..777; Strand=+
  SCN-specific regions: Sequence locations=1-14,36-777
  Gene Ontology: Mol. function=gamma-glutamyl transferase activity; Cellular component=integral to plasma membrane; Biological process =spermatogenesis
tcaaaaaatggcaattttaaattgtgaaatgccaatgccaaaaagaaataatttaaacggcgccgaaaaatgcctttccctcagggcggaaatgcggtggacgcggcggtggccacaacattttgcatcggtgtgatggacacgcaaagttccgggcttggcggcggccatttcatgaccattttcaacgcgtaaaattctcctccagggggatggggtagaaaatttttgaaaatttctaaaaaaaatttgacagtaccacccgaaaatgccacgtggtcgacgcgcgtgaggtggcaccggctgccgcaacggaaaacatgtacaaggaccggtggaacaagtcaaaatttggtacggtttgtcactgtgtgtgtgtgtgtctttttgtgtattgtaatttggctagcaaatttgttaggtgtacggtatcttatcaatcaatttttatgtactgtatatttgattctacatgatttggcttaattatcttttataaattgtgtatttggctaataagcatcaatcataatgggtgtatggtaactgcagtttttgtatatacggtatttggcacaacaaatactgtatttggttaattaatattttaatatacggtaattttgtaattaaagcacatcgtttctttaaattaggttgggaagctgttgccgtgcccggcgagctgcacggcctttggacagagtacacacattttgggggccaagtcagctgggaatcgattgtccggccgacaattcgactaatggaggaggg

SEQ ID NO: 70772 - DNA, 1870 bp, Heterodera glycines
  misc_feature (1829)..(1829): n is a, c, g, or t
  Genomic contig location: Contig_ID=SeqID_9258; Location=192..2061; Strand=+
  SCN-specific regions: Sequence locations=1-48,71-290,314-621,643 -709,732-929,952-1870
  Gene Ontology: Mol. function=gamma-glutamyl transferase activity; Cellular component=integral to plasma membrane; Biological process =spermatogenesis
attttctttggctaggctatccgacatcgcacgcgctggcacatgcgttggagcagtacaaagcacaggtgctcaacgagccgaccatgcgccggcactttgtcaacccggcaacgggcgtggtgtacaagctgggcgagcagatcaaaacgcggacaaatttcatcaacacactgcgcgggttggccaccgcggcggaccccgtggcatttttctaccgcagcaatttgacgcagcaaatggtggacgagttcaagcggaacggtgcgggcgggcggcattttaatttagtgggggcgggggagggcggtggacgattgctgatcaagcactgacacactgatctgaaaattctgcaattaacaaatttggaggggtggggaattgattgggactgcccaaatgcgaaagtcggcattttgccgcgcgagccaagtgccgaaaacagggaaacgatctcgagactgaattgatgccgagcatttaaccccgagaattgagttcatggaacgaattttaaataccgggggatgattcgaacggctcccgttaattgacccgtgagtcaagatcgagagttttctccgagtattgagacagagaaaatcgactccgagactccaaaaaccagcaaaatttctcgactcagtaacctagattctcgtatattgtcaatcaattcaagaaaaaggctccaagattactttaaacatttatttatcgatttttcgatcattttcccatttttgttaggtggcattttgacgatggacgactttgccaattatcgtgccattgtccgtgccgatgccgacatcatttacactcaattagaggacggtcgcactgtttgcgggcctccgcccccatctggtgccgcggtgacacaagcaattctgtccattttggacccgtcagtgatttgacgcatatttatctatatataattttcgaattgtttggcgcgagggtaattaaccaactaattaccccactaattgtatttgaaaataaacgaaaccagaattgtaatgtaaaaaatccgggaattcctaacttctccctcttaccgtataactctcaaccacaccgggccaaatacggtacatacaagcattctctgattactgtcatggtatcgttcaatccaaaaaatcattgtttcaaaatactttaatttgtaataccgtattaccgtaccaccataaatttccactccgttactgtaccaagtattttcagtatcgtgttcaacaccagcaccatttctggcaacgtgggcttcctccaccgcttcatcgaggcatccaaatttgcgtatgcggcacggagttcaatgggcgacatggcatttgtgaagaacgcgacggagttggcacggaacatcaccagcaagtggtgggcccagttggccaggtgcgttttgtggggctgcactttttaaaaaatatttcagcgattttttgaaaattttttgaaaagtttcgaagtgaaatttaaaaaaaaattttcgggatggggggggcgaaaaagccgctcctgttttgtggcaccgatcggagtcatcccctgctgatcaggtagggacaacgttgagaattccatgatcatgggatgatttcaaaatggcattaatatcattcattattcattcttcaaggtccaagatcagctggggcacacatccggacgactattacggtggcggttaccaagcgctgcccaacgaccacggcaccacgcacatcagcgtggtggacaagcatggcaacgcggtgtccatcacatcgaccatcaatttaatgtgtgtgtttgtgtgtttggccaanatttaatccaatgatccaagttgggatgctaattgatcatt

SEQ ID NO: 70773 - DNA, 466 bp, Heterodera glycines
  Genomic contig location: Contig_ID=SeqID_42993; Location=211..676; Strand=+
  SCN-specific regions: Sequence locations=1-60,100-192,219-466
atgaaccaaattgtaattaattaataaagcaattattaaattcacgcaaaacaattacagtaaatttaacttttagaaaaataattttttaaaatttttctgtacagaaatggagggcgtcgttagcagccgaagctgtgaaagtgttgggaacaagtcaaaacaaagcagtcaatgttttggatttggaggtttcactttaaaattgaatattttttggcacaatgccaacaaaaattgattaattaatcgcaacgaattgcattttcaaggcgattcatctgatcgccggtggatatagtcagcagcagggcgaaaacggcacgggttacggtatgaacaacagcgaattgggcggcgcaggatacggtaacgagcgggactacggtagacaattctccaaattttccatttgaaaacattaaaattgcaaactttcaagatttaggattcttctcgggactga

SEQ ID NO: 70774 - DNA, 640 bp, Heterodera glycines
  misc_feature (635)..(635): n is a, c, g, or t
  Genomic contig location: Contig_ID=SeqID_42995; Location=549..1188; Strand=+
  SCN-specific regions: Sequence locations=1-456,480-640
atggaattcactgacttttcagaaattgccttccgtcacgaattgctggacgaattggccaaggagcgctatgatgccgccatttatgaactgttcgatctgtgcggtgctgccattttcgagcgcatcggtgtgcgcaccaaattggcaacacttaccgtgccaatgtatcaaacgactgccgcccattttggcattccaacatttgccagttttgtcccaagtaaaaaacgaaattaatcattatgaggagaatcacaatttcctgttcaaataaatttgccttaatccgctattcacagattgggctcatccgccgctcaatgcgccggcgatggacttttgggagcgtctgatcaatttcctcaacactttttacgattggtacaaattgaatgatcgcgtcaccgatttgcaggtgcgttcggtgcatttgttgtccattgtatttttagcatttatttttatttttattatttcagatttttttccatattttacattcatatttcggtactttcacaaaaataaaaaccgaaaaatacacctctaaacatggaaaattttttggaaattttgtaaattgcaaaatttactaatttttgctttttttctaggttcaatatttttcaganaaata

SEQ ID NO: 70775 - DNA, 469 bp, Heterodera glycines
  Genomic contig location: Contig_ID=SeqID_42996; Location=431..899; Strand=-
  SCN-specific regions: Sequence locations=1-469
gtttcaaatatcgtaagattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaagagaaggcaactgttggtaccaagtttgcggtaaaaaaatgagaaaaaa

SEQ ID NO: 70776 - DNA, 929 bp, Heterodera glycines
  Genomic contig location: Contig_ID=SeqID_42998; Location=74..1002; Strand=+
  SCN-specific regions: Sequence locations=1-165,299-299,425-702,725 -758,780-904,926-929
atggtgattagaagaagtacaaaagcgattagaaaaggtacaacagtgattaaaagagtgattagaagaggttcaacagtgattagaaaaggtacaacagcgattagaagaggtacaaaagtgattagaagaggtacaaaagtgattagaagaggtacaacatggtttaaaattaaataaataatgaaaagtttttataaaaatcgaatgcattttaatttaaaattttttttataataaaatactctttttattcattaaatataattttgaaaattaataattgaatatttattttgaaatgaaattcatttttataaattcaaaaaataaataatgaaattaaataaattcaaacaaaaaattaattttaaaaaatttttcacaaaaaaataatttaatttaaattaaaaaattaattaaaaaaaacaaacactcttttaaatgaattaaaaacattaaaaataaccaaaaatgcatagcaaaaagaatgtacaccgtccggatccgaacctgccccccccccctcaaaatgatgcctcagaatccccaatcacacagggattctgaggtcttaacgatgtctaaactaaaatctgatcacgtattcgtgatcagcggcccaaataacccctaaagacatatttttggaagaattttgtgaaaaaaaaattttccattcaaaaatcatgtgcacccccctttggtcccgaatcccaaaatcacttttatttttgtaacatctctcaaaaaagtgataaaaatgccaaataaaatttatataatagagcataaaattgcggatttttgtagtattttacttttacagaatgacttttcagaagcgagttctgaatttttttctgaaaaatctaaaatttccagaatttctggaataacttttttcatattgatgttagaaaacccaa

SEQ ID NO: 70777 - DNA, 668 bp, Heterodera glycines
  Genomic contig location: Contig_ID=SeqID_43000; Location=349..1016; Strand=-
  SCN-specific regions: Sequence locations=1-238,260-668
atgcaggctggtacaactcagattcctggctttggccagttgtacattctggacccagtcgaggctatggaacagcgtcgaaacaaccccaggtttactggggagaaaatcacaaacgaagatgagtttgtgcagggtcaccagctaaatgagcagactcttgagatcttagaacaaatgatccaagtgcatcatcctgctgcgcaggcatataagcaggcgcgtgagcagctcactgagcttctccaacaacaatctccggaagagcttcgtttcttccgcatgactttgttggatagccgcagggctccagctggtcttaaagacccaaaattgcacgcacaccaaataatcaccccttctacgggtgaagggatgttctctattcatgcggaccccactggtgctcctccgcccaaaggaatttgggtagagaacaaacaagggcaattaaatgaaattgctcctttcagtccgtggactgatagtcttacgtatccattaatcaagccaatgggcgatgatggatacacaactggcattaaatatgctaaaccaccatcgcgtaagcgaaaaggtgctcagaatgcatctggcctatttgactcggaagccgagtcagataatgagtcgtgcgagactcagtcaattgcatcatttgatgcggg

SEQ ID NO: 70778 - DNA, 906 bp, Heterodera glycines
  Genomic contig location: Contig_ID=SeqID_43001; Location=37..942; Strand=-
  SCN-specific regions: Sequence locations=1-314,336-906
atgtacgatttgcgcccggacaggcccgcaatgtatttccgtccttcaccaactgatggtggtgcccaattagaggtaaacggcctgatatacgacaactcacatgtcgtgccgtataatccttatattctgctgcgttaccgagtacaccataatgtactgtttgcatatggtaacaaagcaaatattaaatacgcactcaagtacccttttaaagggccaggacattgttatgtcgagtgcaaacaagagtccggcaataaaatcggaattgatgagccggctcaatatgccaagatgaacttccgtggtgcaacggaagcatatgccattgttcattcactgccatttgccaaactttcacatcaggttgtcaaacttagcatccatatgcctaatcaacaaccgattgtgtacagggcttttcagctggtgagcaaagctcaacaaatccagcaaggcgaactgccagagacgcaatgttctgcctattggaaacaatggcaaaatgaatggaagcatgatccgaagctcaaggacatgctttttgaaaaagtccctgagcattttatatgggcaaaggacaaatggaacaaaaggaaatataacctaacaaagagaccaccaatcggtcgaattgttcctgtacccccatcggacccggaaaggttcgcgctctattcacttatgcgtcactttcctggagacccagaccatcttaagatggttaatgggttgctttgtacctcattcactgaggctgcaataatgcatggtcttcttgaagacgacaaaatttgggacaaaactctggcggaggcagctctgtcgcgctggccagatcagatgagatggctctttgtgagcatcctggtctatggccagccgagtaatgccatagaatag

SEQ ID NO: 70779 - DNA, 287 bp, Heterodera glycines
  Genomic contig location: Contig_ID=SeqID_43001; Location=1256..1542; Strand=+
  SCN-specific regions: Sequence locations=1-245,269-287
aatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccattcttcgacctgca

SEQ ID NO: 70780 - DNA, 1642 bp, Heterodera glycines
  Genomic contig location: Contig_ID=SeqID_9259; Location=5..1646; Strand=+
  SCN-specific regions: Sequence locations=1-266,288-738,762-1215,1239 -1642
  Gene Ontology: Mol. function=inositol-145-triphosphate receptor activity; Cellular component=plasma membrane; Biological process =vesicle-mediated transport
tacaaaggaaaagcccgagaattggccaagaagaagtttaatgagaaccaacggcagggattgagggacttggtcaaagctgggctggtcaacggttcagctgaagacattgcaaatttctttctgacctgtgatggaatcaaaaaagtaaatatattgaatgtctgatttttagcccaatatcttttataaattttcctttttcagtccgcaattggcgatttccttggcgagaaggacgatttcaatttggaagtcctacaacattttgtgcatctccaaccacttcggtcgctgccattggtgcaggcaatgcgtgggtttttgtcgcgtttccgcttgccaggcgaatcacagcaaattgaacgcatcatggagtatttttcggggcattaccatgtccaaaacccgggcatatttgagcatcaaggttggtaaaaaatgtttcaaaattgataaattgcaattaacttctattttaatgcaatgttagcataaaaccctatttttgaagattggcatcatactacgagcagaatataattttttgctttttcttcagacaattgctacaccctttgctacgccataataatgctaaacacttcgctgcacaatccgagcgtaaaggagcgcatgagtttggacaactttctaaacattaccaattcattgaatcttccgccggcactggttacggttggcaatattttttgttgctgggcatttaatatgaacaaataaaaatttaaaaaataaatggttaattctataaaaattatcgcaaatttgtttaaaaaaccgaattaatgctccttttctgtatgttttaattctaaaatttaaggacatttataattccattcgctccgaagccttcaaatttccggacgacaatttgcaagagcatttctctgccgctttgtttcaacagtcggagaagcagggctggcttgagaaacaaggtggcacaaagccaaaatatgcaattgtaacaacgaacatttgtttatttcttttcaggcagtcgttacaaaacgtggaaccgtcgttggtttttacttgccaatcgttgcctttactattttgaatcgcccagtgtaaaaattttgtaaatatttgggttcaatatgaaatatttcagagtcgagaacccaaaggcataattccattggagaacattagggttcgggttggtttatctaaaatgatacattttttatttctgtttttatttcataggtacttgaccaagaaatcgacacgattcggcgagcgcatgtgtttgaactttactcaccgaacacggaggtgatcaaagcgtgcaaacagagcggagagggacggcttttggagggacagcacagcacttaccgagtaaaagcgggggaatgacaaaggcacggacggcgaaacagggcactgacaatgccatgtttttaatttgcaaatacctaatagggaataaaattactaacaataaataataaattattagcattcggcgttttcttttagtccaattgccctttaattaaaaaaatattctttctttttgcagatttctgctccaaacagagaagaaatgcattcgtgggttagcgccatccaacgcagcattaacaaagaccaacacattgaa

SEQ ID NO: 70781 - DNA, 427 bp, Heterodera glycines
  Genomic contig location: Contig_ID=SeqID_9259; Location=1013..1439; Strand=-
  SCN-specific regions: Sequence locations=1-197,221-427
atggcattgtcagtgccctgtttcgccgtccgtgcctttgtcattcccccgcttttactcggtaagtgctgtgctgtccctccaaaagccgtccctctccgctctgtttgcacgctttgatcacctccgtgttcggtgagtaaagttcaaacacatgcgctcgccgaatcgtgtcgatttcttggtcaagtacctatgaaataaaaacagaaataaaaaatgtatcattttagataaaccaacccgaaccctaatgttctccaatggaattatgcctttgggttctcgactctgaaatatttcatattgaacccaaatatttacaaaatttttacactgggcgattcaaaatagtaaaggcaacgattggcaagtaaaaaccaacgacggttccacgttttgtaacgactgcctgaaaagaaataaa

SEQ ID NO: 70782 - DNA, 545 bp, Heterodera glycines
  Genomic contig location: Contig_ID=SeqID_9259; Location=1534..2078; Strand=-
  SCN-specific regions: Sequence locations=1-545
atgacagtgaatcgtaaacaaactcaaaggcaaaggtaagtgacagcaattaattcaattcaacgcttttgtgtacaattccataaatcatatttcatcaatcactgccaccatgaaggggaattagcagagaacctttaaaaaattgttgattggacgtgctttattatcagttaatgatacagtatattcattcactgaccactgacgtcgactgggttttgctgctgccccgccgatgattttcccaccaatgagccaccgcttgcgattcgccttcgtcgctgttcaagcacatcctattgatttgaaaaagatttactattattagtttttttaaatgtgttttttcagagagactcaattaaaaatccatccatgggattttgggtaattcataaaaggctttgccgatgattaatcgtttcttacttcaatgtgttggtctttgttaatgctgcgttggatggcgctaacccacgaatgcatttcttctctgtttggagcagaaatctgcaaaaagaaagaatatttttttaattaaa

SEQ ID NO: 70783 - DNA, 990 bp, Heterodera glycines
  Genomic contig location: Contig_ID=SeqID_9260; Location=109..1098; Strand=+
  SCN-specific regions: Sequence locations=1-280,304-313,337-990
  Gene Ontology: Mol. function=iron ion binding; Cellular component =mitochondrion; Biological process=TCA intermediate metabolism
atgagtcgttatgagccgaacagtcgccttccttatgaaaagctcgatgctaatttggcaatcattcgaaaaaggttttttttttttactttcggatcacaaattcctgtgaaaagcacatatacttcgaaaacccatttttaaatctccaatttctgcattattgaaattcttcaggttgaaccgtcctcttactttggctgagaaaatcatttactctcatttggatgacccgcaaaaccaaaaattggaacgcggtgtgtcatatctgaacttgcgccctgaccgtgtggccatgcaggacgccactgctcaaatggccatgcttcagttcatatcgtccggaattccggcggttcaggttcgcacactcacaatcagagactgacacgaaaggctttctatgttcatttttcaggtccccaccacaattcattgtgaccatttgatccaagcgcaagtcggaagtgagaaggacctttaccgagcaaaggttggccaatttgatggatcaaacattactattattcatttaaattccgaaaggagtttattattagatagttattctaatgcgataagagcaactattgtattgctaaactgctttttaggagatcaataaggaagtgtacaactttctcagctcctcttccaacaaatacggcgttggcttttggcaccccggcgccggcattatccaccaagttatcctggaacactacgcttttcccggtctgttgctaattggcacggactcgcacacgccaaacggaggttcgtgacttaaaaaaaatacctttcaaatatgacaaacattttttaggaggattgggcggaatttgcattggtgtcggtggtgccgatgcggttgatgtgatggctggttttccttgggaattaaaatgcccaaatgtcatcggagtcaaactgaccggccgtctttccggatggacagcaagcaaggacatcattctcaaagtgggatga

SEQ ID NO: 70784 - DNA, 1505 bp, Heterodera glycines
  Genomic contig location: Contig_ID=SeqID_43002; Location=98..1602; Strand=+
  SCN-specific regions: Sequence locations=1-1505
accaagcaaaacatcccccagacaaaagccgggaaaagcacgggcggttgcgagttcgcccacgcggacgccatcgaagatttatgcggtgctgctttggtgggcaacgcggcgcagtcgcgcagcagcacagccgagggcgatgtgcgcgagctgtacgaattgggacgacgccgtcgcgcctgtccgtactttgccagccgcgcggcgcttggcctttgccaattggtgttggtcccgtacaacattttgctgcacaaatcgacgcgagacgcgtggcggtaaggaaaaagcgcatctggcgaaaaaatcaattctctcgaatttaatccctttttgggatattgtttttgaaattttaaaagcatcgctaattatggcacttcgtaaaggcataaattttcgaatcaggctgaatttgcgcgacaatgtgctgatcgttgacgaggcgcacaatctgttgcagacattggcctccatccacgctgtaattttcatttggcaaagtgatcggcggaattggaatgaatttactttgtagataccgaccaatgccgggattagggggtcgagatcaatttgatagcactttgggcaaagtgaacggaattggaatggattttactggagagatttcggcagtgccgggattaggggtcgggatcaattttaaagcattcagattcgttggtctttcttgatcagcagttttactgttgactctttctttgcctttgtgtcaaccaatgattctcccaccgatccaaggtggagctgagcacgggccaactcagtctctgctccgcgcttatcacgactatttggagcgcttccgaaagcgggctttcaccgcgaaaccttcgccacattcgccaattgcattcgcttacggtcgctgtgtacaatttggccacttcgacggcaaaggaggaggacggcggtgccgaggagagagtgctcactctgacccaatttatggccaaagtgcgctagggggagggccaaattggggggggggggtcgatcaccgatacttaaatccgaattggattgattcccttttgaatagccttccatcgctcccattaggtccattccttcccccattagtcgcgtaattatcgacgattgtcccaaattcgcctttctttgtttaagtctccgctgtttcagttgggctccgcctcggacattgacctgttccgtctgctcgactacctggatcagtcgaaactttgcagaaagttgcgcgactttcgtcttcggcactccgcccgagggcattcccagccgaccgtcgcttcttccgagcaaagaaatggtgccgtgggactcaaatctcacaggggccgaagtgggcaaaagctaaagcagcgccaaacagcgaaaaaggaaatgccgaggggaaattctgcctcggaaaacattccgccatctgcgaatgagcacggtgaagctgcgacgccggcggacaccaattcaacaccgctttaccaattgcggga

SEQ ID NO: 70785 - DNA, 819 bp, Heterodera glycines; identical to SEQ ID NO: 43004
  Genomic contig location: Contig_ID=SeqID_43004; Location=1..819; Strand=+
  SCN-specific regions: Sequence locations=1-125,147-404,427-495,518 -680,702-742,766-819
  Gene Ontology: Mol. function=hydrogen:sugar symporter-transporter activity; Cellular component=integral to plasma membrane; Biological process=anion transport

SEQ ID NO: 70786 - DNA, 108 bp, Heterodera glycines
  Genomic contig location: Contig_ID=SeqID_43005; Location=1..108; Strand=+
  SCN-specific regions: Sequence locations=1-108
ttggcattttcatcatctcttcttgtttattggcattttttatggcacaacatttcttatcttttcctcgtcttttcgtttcttgtggcatttccctatggcacaaca

SEQ ID NO: 70787 - DNA, 1799 bp, Heterodera glycines
  misc_feature (733)..(733): n is a, c, g, or t
  Genomic contig location: Contig_ID=SeqID_9262; Location=407..2205; Strand=-
  SCN-specific regions: Sequence locations=1-58,80-169,192-242,274 -413,449-509,531-692,715-1023,1086-1148,1182-1219,1245-1375,1473 -1519,1544-1799
atgacttcattgcctggagagactgctgatcaactatttgattggatttgttcgtccatggaaaaacatcagctggactttaagaatttgatcagtttttgtgctgacaatgcgccgacaaattttggtgtgccacaacaattacaggagggtaggacggggaacaatgtttttgcaaaactcaaaacaaagaggcaaaatatcattccgattggctgttccggttacttttaaattgtttgttcttcttatttaaaaatttcagcccatattttgcataatgcagcaaaaaagggtgccgaacaattgcaatttgacattgagtccgtcgtttacaaattaacttcatatttcaaaggatcaacgcaaagacacaccgaatttcatgaaatttgtgaccaatatgaggtgctcaattttcaaattttaaaattaattttgttttaaagattccgacatccaacgcattcgtggaacgagttttttcactggcaagcagtcaatggaccaaagaaagaaatctattggaagttgaatcagtcaaagcgttgctactggtgcaggtgaactttgatctcacgtgcgcggaaatgaggaaaatgataaatgaaaacaaaaaaatattggaaaaaatccattccggtgaaaaatacaagccatttgaataaatattaaccattttcattgcatataataaaaattttaaatgtccttgaatttcatgaattttccncactatgtccttgaaaatcggcatacccgtccttggaaacggaggatggacgatgggagccctgtaataataagtgcaaattaaaatggccaattagagtgatcagaaataataataaaatgatcaatcaatgatcagatgtggcagacacgaggaacagctgatcaaatggcacagtgagcagagtcatcagatggaaaaggaggtggccaaagtccgattttggcataaatttcttttcttggctaaacatgtccaagcagaagggatcagacccaaggatggaagagaaatttatattcatttttatcaaaataaacaaaaataattttaaaaaatttaatcaataaatcaatcaaaagtatacaattttttgtaaattctatcaaacaaatattttattatccatagatggaaataaaaataaaaaaagttttttttaataaatgaaattacagacctcgccctgcttggacatgtgtatacaaaaaattatttttatttttttttacaaaatctctctgatcactactgatcggccagcctcagcactttttgccaattgccattcgctttcactctgccgctaatgtttttggtgtttttcgatctttttttcactattttttgttgtaaaaatcattccatttttgttttaatgattattattatttttatttcatgagacgttgccatttttgttttttgtttatgtattattattgtattgatttatattgaacaaataaaaattgataaaaaaattatcaggaaaatgtcggactcaaaaataatatgtgataattagggctttaattttaggcaaatgcctaaaattcctgcacacttgctacgcacagaattccgtttaaattaaatataaccaaaattaagtttggtcctattccagtttaacgcgtccaatcagtgaccattctcatttttttaggtcatacaacttttttattactacttagtcaatccaaacattgctggtttcaatcgaaagcttagagaattaagaccaagaagaaggtaattttgaacagtccaaatccaaaataaa

SEQ ID NO: 70788 - DNA, 951 bp, Heterodera glycines
  misc_feature (633)..(633): n is a, c, g, or t
  Genomic contig location: Contig_ID=SeqID_43012; Location=220..1170; Strand=-
  SCN-specific regions: Sequence locations=1-565,589-951
atgaaatctctcctaaagattatattccgccagaggtgagatggagtaccaaacttcctactctcccaaaaccgggattgaatcgccctccgtctaaaagaatatgtcttgaggggacgaaactgagtaattcgggacaaatttcgctaaaaaatatcgttgataaatattctgaggcattcgtcggtgatgacggtaaaattggactttacaacggccctattgttcaccgaattgaccttgtaccagggtccctaccatttcacttcagaccttatcgttacccacctgaaacacaaaaagaaattgagagacaaatcaaaatgatgttggaccaaaacatcataagggaatctgaatcagagtattcatctccgatagtcatggtcccaaaagctgataagaaatcgtggagatttgcagttgactatcgggcacttaataaaatgacaaaaaaacgtgttttccatctgccaaacattcaagaattactagacctaatgggagccaaaaagttttatacatgcatggatatgcaacagggctttatgcagattccaatggcaaaggaagatatgagaaaacagcgttcatttcacatttgggaatatacgaatttataaccatgccatntggattaacagcagcacctgacacttttcaacgagtaatgaattcattacgtaggagattgaccgctgccatgctaatatatttggatgatattataattgggagcgaaactgaagaaatgcacttggtcgatatcgaaaattttctgaaacttctgagagatgtcggactaaaacttaaaatcgagaaatgtttttggggaatggcagaaatcaaatatcttgggttcctattaagcgaaaaaggagttcgaatggacccaaaacaagtaaaagcagtgcagaattttaggccaccgaaaacgctaacggaattaaa

SEQ ID NO: 70789 - DNA, 199 bp, Heterodera glycines
  Genomic contig location: Contig_ID=SeqID_43014; Location=166..364; Strand=-
  SCN-specific regions: Sequence locations=1-13,35-102,137-166,188-199
atggccattctactgaagtgtgtgctgctcctctcaatcatggagattttctgcgactgtatgaacgaccccggcaaaaaaggaaagagcaaaggtaaacccaaaaataaaaataatttttataattttattttaagccattcgaaaaaaggctgagcccgatgactattttaaaatgataaattttaatgcaaactaa

SEQ ID NO: 70790 - DNA, 505 bp, Heterodera glycines
  Genomic contig location: Contig_ID=SeqID_43018; Location=1248..1752; Strand=-
  SCN-specific regions: Sequence locations=1-126,155-295,317-427,449-505
caaaagttttttacaaccacatattgccaatctaatttcttgcagattgagagccatccattgcataccggttctcggcacagcaaagcaccaatagggtgtttgactcacttcaaaaaataattcattacccaaaagttttttacaaccacttattgccaatctaatttcttgcagatttaaagctatccattgcctgccggttctcggcacagcaaagcactaatagggtgtttgactcacttcaaaaaataattccatacccaaaagttttttacaaccacatattgccaatctaatttcttgcagattgaaagccatccattgcctgccggttctcggcacagcaaagcactaatagggtgtttgactcacttcaaaaaataattccatacccaaaagttgtttacaaccacatattgccaatctaatttcttgcagattgaaagccatccattgcctgccggttctcggcacagcaaagcactaatagggtgtttgattc

SEQ ID NO: 70791 - DNA, 1014 bp, Heterodera glycines
  misc_feature (187)..(187): n is a, c, g, or t
  Genomic contig location: Contig_ID=SeqID_43019; Location=500..1513; Strand=-
  SCN-specific regions: Sequence locations=1-503,525-849,871-946,968 -1014
  Gene Ontology: Biological process=glutamate metabolism
caacacgcggatcaccgatgtggaagtctgggaacgccgttacccggtcattgtgcgccgattaccccttcgtgccgggtcgggcggcgacggacgattccgtggcggcgatggcatttcgcgacacctccaattccgtagagtcctccatctgtcgctgctcactgaaagacgcgtcttccccccnctatggactgaatgggggagaagcggcgaagcggggaaagaacacactttgccggaaggacgggacgcgggtgaatttgggagccaaaaacagcgccgaaagtggaagccggggcaagcgaattaggggtggaatatccactgatcgaattgaatatttaggatattttggaattggaaacgcctgggggcggtggatgggggcaaaacggacaaaaatgcacgcaacaaaagccaaatgattttgtgatttagatttgataaaattctattttcaaccgcatttttgctttgaatcaccaataggatatttccgttcaaaatgaatggttaattcattagtcaatctctgctggaccattttagttaacttgaccaaaaaacaaaccgattttaaaaatacaccatattttttgttatctcaattttctaaatttttttgtacaacttttttatattgtctgtcattggttctctaaaactttggcgttcgttttgctgtgagaaagtaattctttatcgcaaaataacaacaaaaagtgtctcttcttttttttctcttttcgctctctaatagtcttcgatgtcttccccctcctccgactcgtcaaagtcttccacgaactgtcgctgcttctcccgcgttgtctccgtctcatattccacttcttcctcctcactttgctccgactcgtccaccctttccatcgctttgtcaattgtcttgtcactgaatttgtacatgctcccgtaggtgcccttcttcagcctctgcagcagttccctttcgatggcattgtccaattttgccgcggccaatgctttttc

SEQ ID NO: 70792 - DNA, 651 bp, Heterodera glycines
  Genomic contig location: Contig_ID=SeqID_43020; Location=1..651; Strand=-
  SCN-specific regions: Sequence locations=1-311,334-523,561-651
atgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggagggggggggcgaaggcccaccacgaggccgcgaagaggccgagtgagtaccttcggtgcaggaaaattattaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaatttttcgaaaatctgagtctttcgtttttatttatttgcaaaattaattcataaatattttttcagaaagggttctgaaacgcaccaaattttatttacatgttagtttaggcactctgatgctttttctatcaataatggaggtgaataaa

SEQ ID NO: 70793 - DNA, 1268 bp, Heterodera glycines
  Genomic contig location: Contig_ID=SeqID_1249; Location=2685..3952; Strand=-
  SCN-specific regions: Sequence locations=1-203,225-397,419-1110,1133 -1268
catttcaatcactgggactcaattctcttgcattccaatcactgggacctaacctcacctggtccttcggcattccaatcactgggactcaattctcctgcatttcaatcactgggactcaaccctccagcatttcaatcactgggactcaattctcttgcatttcaatcactgggactcaacacaccagcatttcaatcaccgggacttaattctccaggacttcaatcactgggactcagtttttatgcatttcaatcacagggactcaagacaccagcatttcaatcaccgggactcaattctccaggacttcaatcactgggactctattctcctgcgtttcaatcacccggactcagtttttatgcattccaatcaccgggactcattctcctgcatttcaatcactggtcaattctcttgcattccaatcactgggacctaacctcacctggtccttcggcatcgcaatcatcgagactcaattctgcgaaattccaatcaccggaactcaattctgcgacattccaatcactgggactcaattctccatcattccaattcccgggactcaatcccaccagcattccagtcactgggactctgttctcctgcattccaatcaccgggactcagctctccaacattccagtcactgggactcaattctccagcattccaatcaccgggactcaactcaccatcattccaatcgctgggaccgaacctcacctgattcttcggtatcgcaaccaccgagactcaattcccctgcattccaatcactgggactcaattctcttgcatttcaatcacagggactcaaatctccaggacttcaatcactgggactctattctcctgcgtttcaatcacccggactcagtttttatgcattccaatcaccgtgactcattctcctgcatttcaatcactgggactcaaccctccagcatttcaatcactgggactcaattctcttgcattccaatcactgggacctaacctcacctggtccttcggcatcgcaatcatcgagactcaattctgcgatattccaatcaccgggactcaattctccatcattcctattcccgggactcaatcccaccagcattccaatcactgggactcaatccttcacttttcacggattcttcggcatcgtaataaccgaggactcagttctccgccattccaatcaccgaggactcaatccttcactattccaaacaatgaactcaattttacggattcatcggcat

SEQ ID NO: 70794 - DNA, 1415 bp, Heterodera glycines
  Genomic contig location: Contig_ID=SeqID_1250; Location=2602..4016; Strand=+
  SCN-specific regions: Sequence locations=1-220,246-570,592-594,616 -989,1018-1360,1382-1415
atgagggcgatgaagaattatgtgaggaaaagtgaggaaatgtcgcccttttatacaactttttttcccttaatttcgaaatttttttgcttgtctatataaagggagggattgcaaaatttgctttcattcattgcgcccgtcaaattttaattcttctattatgcgaaagatcgtctacttcaaactgttgcaaattgtgctcagtttggccttcatgtggcaacttctttcccttcaccaattctgcggcacttttgtctctccaaaggtgttgcttttgctttgacaattcatttgaatttaatttattgttccatgcttttcaggccttcctccatgacatctcaggtggccattgcaaacgcttcacgttcatcggaaaggactcaaagacgggcgaattcggcgcagtgttcgacgagcgcaagtggcacaaccaactgttcatgatcagcaccaatggccaaccaatcgaggaacagcaacagaaattcatggacgaattggccgagaaattgccccccgctggacgccactgtattccgataaccgtaagcaaaagctaatcacaacaaatacatgcaaaaataatcccattttgttctttcagctctcgccttttttctggactgagaaagacagaaatgtgctcgactacgttatggaccttttttccggccaactgctcatcgcaatgtgctcgctgctcactcttggcgtcggcttcatccgagtgttacgctctgcggcagaatatgaagtgagttcgatgcgtgaacacagacagcacatcagcccgacaaaaacgtgaccaaattgcttttcagtcgaaatccgagcaattttttgatcaaactgtgatcagtttttcttttgcgtgaccaaattgcttttcagctgaaatccgagcgattttttgatcaaactgtgatcagtttttgtcgtgttgcatgttgtcaaaattgctttgtttgccattgtgtctgtttctaatttgtttttcatttttaagttctacgactgttgcactgccttctattccgtcttctgctggagtgcctctgcttggttctcgtcgtgtttgctgctctattggacgccttcttggtcttgcatcaacttccgtgcggatgacacaaatgtgccgttggtcactttggtgagttttgccgtgcttttcccatttgattctacgtttttcaattgctgtctttcaggtgttcagcatcgtcatggtgtgtacgttcgtcttcgagattttcttcaacaattcgttgctgaaaaaccggcccgtgaatgcttcagtcgccgcagccgatcagaaattgcgcaatgatgtcgccaaggaatgtgccaatgtcgtcattcatcgacagcagcagaagaacggaagtgccatcatgcagacttaa

SEQ ID NO: 70795 - DNA, 497 bp, Heterodera glycines
  Genomic contig location: Contig_ID=SeqID_1250; Location=4536..5032; Strand=-
  SCN-specific regions: Sequence locations=1-166,188-244,266-348,370 -464,486-497
atggctattgagcacagcacatgggtgggtcggttgatctacgacactcactctgatcagagggtcgtcactcactccgatttcaccagtctgtcaaccatgtgcagaattttgtggacccaataaccggtgcacatacaaaccacgtggaaaatttttggaagaacttgaaaatgaagaacaaagccatgtcaggcacgcagcgcaatttactgcctggatatgttgacgaatatatgtggcgccagttttatggcaaaaagacactttcggcatatgaaaagacaatcgatccattttgataaatttcagacagttgaagacgcacaagcagccgaaagggaagcgatggaattcattagaaaatatgagcagcaaaacggcggaggaggagagggacaacaacaatcaacaatgtccgaccaaagggggatgaccgccggtcactctccgatcggcgatgatcactgatcagagaggctctagaaccaaataaa

SEQ ID NO: 70796 - DNA, 569 bp, Heterodera glycines
  Genomic contig location: Contig_ID=SeqID_9263; Location=1154..1722; Strand=+
  SCN-specific regions: Sequence locations=1-379,414-569
atgggtgtttgatgtgtgccgaaatgtcagagtgatcattagcctcttcttcttgctgctcctgcttaacttgacgaggcagaatgccggcagcgacgagcatttcatagtcgggctggttgaggtcggccaaattcattgcagccatttggcctgatttttgtgggaattttttaattttttattctcctcagataaaagtttgtgtaaaattatgtggcaaatttttcaggaattataagggttgtcagatgtaaattcaaaaagaaaaatcagttggcatgccaaaagcttcatttcttctcacaaagctttttgaagaaaaaaacggtgttgagaagtgcctccggggaaaaacttgaaatttttgtctaatttgttttttagaaatttatttaaatattttaaaaaatcccttcgtctagtgaaatggatatggacggttggcacatttagggccgtccattgacgccgaaaaatgttgaattggtgcccttttagtcgggagcaaaaaccaatgttcactttggtttacattagaaaaatgttatgaaaattatatttgtcaa

SEQ ID NO: 70797 - DNA, 720 bp, Heterodera glycines
  Genomic contig location: Contig_ID=SeqID_43025; Location=682..1401; Strand=-
  SCN-specific regions: Sequence locations=1-102,124-131,153-720
gctcattaccagtgatggacttccactatattctttttatgaatataaaagtggaattactggaaaaccacaatcgtgtggagtggcgagtgagaaggcactcactcaaacaaagaaaaatgggcttttgtacaaggcgtcagagcatgggaccctgcaagggtacaaagctgccatggatttcttgacagcaaaaaggttgccactcgtaacacgtatgtcgaaatataatattgtaaacaaattttttttctaattacctatgttttaggaatttttgctccgcccagctttcacgagtacaatggtacttttgtttacatcccaagcatcaaggaatgcgaagaggcggaaaaaaacaagacaaaacaatgcacacattaactatcttggggtttggcacagaaggggacaaagatttttggcttatccaaaacagccacggagcaagttggggaatagatggggttggcaaatttatcagggctctaaataggtgtgggatagaggagtttacctattacataaaaaatgtcgtgcatattaagcaataatgcgttattgctttttatgtgcacgacggtttttatgcaatagggaaacttatatatcccacaactattttgaccttgatcggggcggcgggctgaggggctaaaggctctccccaaaacccaaaaagtaaaaattttagaaaaagacaaattttttgaaaataaa

SEQ ID NO: 70798 - DNA, 539 bp, Heterodera glycines
  Genomic contig location: Contig_ID=SeqID_43026; Location=122..660; Strand=-
  SCN-specific regions: Sequence locations=1-539
atgactggtaaaatcgactggctccagcacttcactgcctggcatcaatttttttgctttttccaatcagtcggactcaactcaccagcatttcaatcaccgggactcaattctccaggagttcaatcactgggactttattctcctgcgtttcaatcactgggactcaaccctccagcatttcaatcactgggactcaaccctccagcatttcaatcactgggactcaactctccagcattccagtcactgggactcaacacaccagcatttcaatcaccgggactcaattctccaggacttcaatcactgggactctattctcctgcgtttcaatcacccggactcagtttttatgcattccaatcaccgggactcattctcctgcatttcaatcactgggactcaaccctccagcatttcaatcactgggactcaattctcttgcatttcaatcactgggactcaaccctccagcatttcaatcactgggacttaatctctcttgcattccaatcactgggacctaacatcacctg

SEQ ID NO: 70799 - DNA, 804 bp, Heterodera glycines
  Genomic contig location: Contig_ID=SeqID_43030; Location=1..804; Strand=-
  SCN-specific regions: Sequence locations=1-192,215-804
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaatttttaaaaaaatttttctccatctccctttttgatagaaaaagcatcagagtgcctaaactaacatgtaaataaaatttggtgcactttagagcactttctgaaaaaatatttatgaaataaaaaaatcgatttattcaagtgtccgtttggggtactcaaacaagtatggggagcaaaaatccaacgcagaattaaagtacagactatagggaagctaatcccgaaggattcggtctccccataaatctgggcgcatcggttcggggggactgccccgaaaacaaaaaaatcgattttttcaagtgtccgtttggggtactcaaacaattatggggagcaaaaatccaaggtaaaaataaagtagaggtatatcgaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattacagtacaggctttagggaagctattcccgaaggattcggtctccccataaatctgggcgcatgggaggaaggggactgccccg

SEQ ID NO: 70800 - DNA, 677 bp, Heterodera glycines
  Genomic contig location: Contig_ID=SeqID_43031; Location=123..799; Strand=-
  SCN-specific regions: Sequence locations=1-9,52-134,161-292,314-677
agtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttcgggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatctttcgggaatagcttccctatagcctgtactttaattctgcgttggatttttgctccccataattgtttgagtaccccaaacggacacttgaaaaaatcgatttttttgttttcggggcagtccccccgaa

SEQ ID NO: 70801 - DNA, 1401 bp, Heterodera glycines
  Genomic contig location: Contig_ID=SeqID_9265; Location=271..1671; Strand=-
  SCN-specific regions: Sequence locations=1-105,128-152,174-324,351 -472,494-636,658-667,690-818,842-989,1011-1210,1232-1401
atggcattgttcggatttgggctcggaattctttctgcaatttccagctatgttggctttcacaacatctatgccggaatggtaaattaattaattgattgaggaataaaaattcaaaaaattttttgaaatttgtccacaggtgtacctggcttcgtctcttttctatctgtcggttattattgccatgaaaaagaaggagccgtcactgttcctgccttatctgattttcgaggtgatttatataaaaacacacatttcgaaaaaaattttgaaacgcactaaatttcgatttacataaaacaatctttagacaaatgaaagtttatttttaaataaattttaaaaatggggatcaccataaatcagctcttaattggataccgaacgggctcgggcgcccgataggcatttaccggtcaacctgagcccgggccggtaatttttcaaaaaaatacctggggcccggaccgccatgttaaatggcttttttccgggctgccttggcccgatcagttgtctaagtaagcccggccaaaaaatccggattctagcaatcataatatgccgccaagttcaatcgatttgttttttaagggcatcggcttgttatgcgcagcggtgatctcattgactatgtttatctttggaatttggtctccacagcaagccttctctactaaggaacagggtgaatagagtttacttatgaaaaaaagaataattaattttattggtatgctgcagaaagtgtttttttttaaattttgattttgaaaaattgttcctgaccagattaaagaagcatgaaaatcaggattttttaatattttttattttagtgtattttgggcgcattttaaagatttctagtggtaaaaacagttctcggagagtttttgggatagctagctgatcacaaatcagacatccccatggctttcaaaattaattacattttaatttgtcgcgctgctaattgtacactaattatttcagaaatgaattttcgttccctcatgcttttctttgccgccaccgtgggcattgacgtcgctttgaacgcctggttctactccatcatttaccgcacctacaatttgctcaaaaagacaacaaagttggtggcatcggcttccgccgtcgcttcggcacgcgtgccgccgcccgtgtgatttatggcgagagattgatttgatgagtaataacaatggatggatgtgatcgaagaaagaaacaatatttttggcaaaagttcaaagttcaatgcatatttttgatttttaaaaatttattcattttttgtgccaacccaatattatggtagtcaaattatttatttttggaacaataatcctgctttttgttatgtgatatgaatctgagtattttgcgaataaa

SEQ ID NO: 70802 - DNA, 237 bp, Heterodera glycines
  Genomic contig location: Contig_ID=SeqID_9266; Location=85..321; Strand=+
  SCN-specific regions: Sequence locations=1-16,65-237
atggggggaattgaggtgatgatgatgatgatgaggaaggatgatgatgattatgaggaagatgggcaaaatggaaacgaaaacggatggatgactcatcaaaatgaggaattggacaaaattgcaatttctacatgggcttttgaggcagaaacaaagtaccgtcttttgatgaggaggcaggcgcctctgttttgccttgcccttgttttcgtggaaaagaaaagagatggatga

SEQ ID NO: 70803 - DNA, 2675 bp, Heterodera glycines
  Genomic contig location: Contig_ID=SeqID_9266; Location=478..3152; Strand=+
  SCN-specific regions: Sequence locations=1-328,353-743,795-951,1024 -1072,1119-1275,1299-1339,1361-1395,1449-1485,1525-1933,2092 -2171,2214-2675
atgggcttttacataaacttagaagtatcgacttttgatggggcctcccttttgccacccacccttggtcttcggccgaaggcatttgtagtattgaaaaggatatggaattgtaatgataatgatgtgatgaaatgatatcgaaaaaacatggattactcaaaataattgatgttcggcttccgatagggcctgtttgctagccttgttttttcgtggtaacaaaaacggaacgaatttggataatattggaatttctacatagactttttacacctaggggtatcggcttttgagaaaaatgatgaatttggaagatatgtattacgaatttttaaataaagatttgtttatttgttatcgttgttgaaaggagttttgaaacgagggagagatcccggctttcgtgtgtatgtcttgttttactagctaaaagatatttattttttttatttcatccaattcattcatgcaaaagtgccatcagttgaagtataaaaggaccttgttgtttttaaaatattaaagtgaaattgtaaaaattgcgcaatgaaaaaccgatgatgaaagaaaatttctaagtgaaaaaattttagtgctttcttacagataaattaatgcttcccgattattaatagcttttaaacttaatgatttagccaattacattttctttcatttttcagccatttttactttttaattgcctttttttgatattatacgtcacttaataaacaaactttttttttataagtaaaaattgttatttaaaaaaaattaattaaatatttctctcctccactcatatgtaaattagaatttcacgctccgattgtcttttaatcaacatttgtttaacattgccaactgtgcttcctaaatatgtaatttttatccattcattcagaaaactcattagcaccattttggtttagctttaaagctctgaaaattattattttttcaatttcataattttattcacaattatttaatttaacttgttttaatattaattaagaatggagggcaaaaaaagttatggaggcgtaaatggagcatttatggcaataaaaatacattttattttaaaattacaaattttgaaatttttaggctctgcgaaaaagaattccaacttttccatttgaaaagcgtctctccaaaattgacacattgaatttggcggtaatttttaaggcattgggataatcggcaaaaattaattaggacaataattatttttcgtgaattaattataagtatatttggaacattttaattttttgttccattaaagtttcttgttgttcattgaattatcaaaaaagcgtggaaaatataattttttaacaatcctttgcaaatatttttcatttggagaggaaacccaaaaattaaaaataattaatatatattttttattaaacaaataaaataaaattggcccactaaaattgccgattttccaacgccaatttctaaatattatattaatatatttttaaatattcaatttaagtgtgcttacatcaatcttctcgatgtttgtaatgcttgtaaactattaaatttttctcaaatttttatgtcattaaggaaattttggccactgaagagcatccagctgtttttctggaatactcaattagtttggcaaaatatggcgggaactcagcacaaactatttggggcacaagcggtaattattatgaaaaaattgaataaaaaactcattagtgggtgaagcgttaatttaataattaccagtgattagcgggtgaagcgctaattaataaacaatctttgtttgctcattaatctccttcctcttattgctctgtttctctcccatcctcccactttctatattttttcatgctctatctctccttctatatagctctttaatgctctctccacttttgtttctctctcccatgtttctctctcccatgtctctctctcccactctctctctctctctctttgtttctcactcactcactcactcactcactcactcacgcactctctcgccctcgttctctctctctctctctataatattctctctcctctctctctgtataataatgtgttgcaaattgttttaaccccattctgctgctctctcaaattttcttacccagccttagcgctaatgttattttttaattcatgaattcaaataattaaataaaaaacaattaacaaacaatactccagatctgctttctcgattggactggatcaattggaaaggaatgggaatggacccgcccagaacatcatctcaattttaaatttggcttcataattttgattattcataatattgaaaacaaataacaaatttaacatttcatccttttttatcaagcattcattggctatatgtagtataatttgccaaataattcatagacaaatcccgaatcactttttttcgatgatcaatcggtcacctcaaaattggtgtctctacttctcatagcagtaatgtttgggcagcagtgtgaacgtgcagaaggggtttcgtcggaaaatttttgtcggatttccatttctcagatagtaatgaaacatgaaatccggctgtttctttagtgcctgaaaattaaaaaaaaattcatttattgccgagaaaacaactggcattctataaaaaa

SEQ ID NO: 70804 - DNA, 1185 bp, Heterodera glycines
  Genomic contig location: Contig_ID=SeqID_9267; Location=71..1255; Strand=-
  SCN-specific regions: Sequence locations=1-174,206-254,308-313,335 -448,477-584,606-688,711-743,765-801,824-890,912-1056,1078-1185
atggtctttagtggtgtgtttgttttttttgaacagaaaaaacaaaactggtcaaaagcatcaaattgtgagccaaattttatgcatcacatcgtttaaaatgacacaaacggaatatcagacccaatttaagaattccagatttccttcaaatgatccgtatttaacattttcaataatataatttttaattaaatttttttttgatatacttcatatttttcatttttgccaagttaaatttagttttattcgtcaacatttttaaatattttcaattttaatgacataaaaaattcacttaattgtgcttttttgagaaaaatgatgttatcctcttatccattttggtcatatgcaaaagttttgcctctagtgaaaatttattcggattctaatttatgttttggcatggattatcttattttttgagtatggcacaacatattaaatatttttgtggggatttattttttcaagggcttcggcaaatgcagattaagctcagctttaaagtcgataacattttaaggaacttttatttattctcacatcattcgtacatttttacatttaactgaaatataaaaattttcaattcaactcaattttacattcttatttaaatttaactgagaaataaataatttagtattagggttaaacaaatcttcataaaatgttaatcttatttattttcattaaattaattaagaaatacagtaaccataatttcataccgaaaatatacaaaaataaatttttcataagaagataaatttttgtcatccagataattttaacaattttgtacataaattttacggaacaaattttgtaattttttgcacatggtttaatgcatttttttccagggttttgtcccctactaattaattaattatttttatcaaatgcatactccaattttacaaattgcattttgttttctgctgagctttctgcaaaattctgatagcaaaataagcttaggagctgtcgtgtcaacactgaatgcaaaacaacgaaatcaggcaaaaaaaaatggaaaatttaattttcaaattttattttgcagattttgaaggagcaaattcactggcaccatatgagcaagcagcaaaccgtgaaggtatacaattttctgcaatgaaaaatgccgtaattcaaaatttttgccattaa

SEQ ID NO: 70805 - DNA, 563 bp, Heterodera glycines
  misc_feature (61)..(61): n is a, c, g, or t
  Genomic contig location: Contig_ID=SeqID_43038; Location=6..568; Strand=+
  SCN-specific regions: Sequence locations=1-91,145-154,176-214,243 -247,277-285,308-320,344-511
atgcacagggaaaaaatgctaaaatgccacgaaaaaaagtaattaattaaaatatttcttnttacttaaaatccccatatgaatctcttggttaaatttttttaatattttcttaattttaaaatatttatatatttatttaaaggcaaagttgaaaaatttaaattttttatttggtaaattgaattctttttaaaaaaattgttggcttttcaaaataatgatttatttttttatttaaagacaacattgaaaaattaaaattttttgctaaaattatgcgttattcaaatgagtttatttaaatatggtttcttttcaaattttatttatttgttacagtgttatcaatgccaatgtcgcaaccactcaaactattcagctgaaattcagcggtgccaaagacccgattgccacgttcagtggagtcgataacagcgacccgcaaaattaccatatgatcatcaaaacgtgtgttttgaagggcaatgtgtgccagaaagggtcagagaattaattacattaaataatttatttatttttaacacatttatttattatta

SEQ ID NO: 70806 - DNA, 203 bp, Heterodera glycines
  Genomic contig location: Contig_ID=SeqID_43038; Location=1081..1283; Strand=+
  SCN-specific regions: Sequence locations=1-203
atggacccaagcgtggcgacaaagggtggccgtttcagtcttgaaaattacaagcaaaacaattcaattgcgacgagttgtgagcaacagctgcaacaatcgggtggaagcgaaacattggccatagggaaggtgctgcacggcttcaacatcgcatttgctgaggacaagctgttgttgacgtcatcgaccagccagaaaag

SEQ ID NO: 70807 - DNA, 728 bp, Heterodera glycines
  Genomic contig location: Contig_ID=SeqID_43041; Location=158..885; Strand=+
  SCN-specific regions: Sequence locations=1-345,368-381,403-599,634-728
atgttggaagaagcgaagacaatggtcgaccaactcgtcgaagtcggctcggtccacgccgcttactacggatgttcggcggagtaccaattccaaatgggcgaccacgaccgttactatgaagaggttggagttttgttcatttttaattgaaaatgcttcaaaaacccattaggcccttcattatctcggctgtgaagacattaacgtgaaattgagcgcggaacagaagcgacaacaagccgagaaaataagcatttcggcactccttggcgaaaacgtgtacaactttggcgagctggtcagttgttcataaactaattcgttttgccattccctctgcttcacttataaaattcgggtaaaaccgaatttttcgattgaaataatttttaatggacgaaaaagatttaaaaccggaggagtagcaaaattatgcaaattaattacaattttatgctagctaattcctcagtgatttttcttttttgagttggcccatccaattttgaacgatttgtccgacacgccaaacgcatggcttaacgaacttttgcacgcggtgaacgccggcgattgggacggctttttgaaggtttgtcactgaaatagcaaaaacccggccgttttcttttaagcacgaagagaaattggtcgccgcttattcggaggcggggcgaaaaattgaggcgttggaacggaaattgcgcctccaatgtttgatcgag

SEQ ID NO: 70808 - DNA, 213 bp, Heterodera glycines
  Genomic contig location: Contig_ID=SeqID_9268; Location=175..387; Strand=-
  SCN-specific regions: Sequence locations=1-213
atggcattgctttccgaccgtttcgacattttagtggacaaacattttgatggaaagggcgaattggcaatttggagaattatcagaattgacaaggacgaaggaccaaagccgaaattatctgtgcggatcgacggcacttttgtggaatttccgttccccgaccaaccactgcccaacaaaatccgtttttgtttccttcagattcagtaa

SEQ ID NO: 70809 - DNA, 983 bp, Heterodera glycines
  Genomic contig location: Contig_ID=SeqID_9268; Location=425..1407; Strand=+
  SCN-specific regions: Sequence locations=1-322,345-544,566-983
atgtccatcacacgtcgcgcactttttgcgacaagcattcgccatttgagctttcacgatggcgatgctttggacaacttgcgcagtcgcacttcgccgacaattctcactgatcttgatcaattgaattcaatcgattctggacttctattacccgatggaattgctgacgatgggccaaatgcaactgctggccaagctttgaccaaatggttacacactccgagcaaaaatgggcaaccgaagcaattacgtttccgtgcttatgtgagtccaccaaatttcgaatgcgtcaacaacttcaaagaggtgtcctgccatattttcgtcaatttgtttttattttaccaattttctttagacattcgccgtgccaccacttctgtcagttaccatattcaattttatttttgggtggacacaatgccaactgagccatttgaattggtgaacaaagtgacgaaagaaaagctgacactgaaacagaatatcgatgaattcgacttaaatgtgtgtaattggttgttgcaacggtgcccaattggggagacggcgacggcgccagttaagtgggaaaaccgcgaaaattcgggtgccaattttaactatatcagatttgagctgtggtatgacaataattcggatgccaatttgaacaaaatcatatttgatttgtggggtgaaaatgatggcaatcattaagaattggtgtcccgacgaaaaaaaatgttaaaaatttgtcgggtattttttctaggcttaaaaaatgcgctgatcacgaatctgagctcagattttgaaaatcattgatttttatctaagattttttgtcaactacttgattttttcgatttttaaagttattttttaaaaaaagtttagcaatgaatttgggttaaaaaaatactctgatcacgaatctaagctctgactatgcatgaaccttcattttgtctgattttcatcaagtgtcataaaaaaaa

SEQ ID NO: 70810 - DNA, 73 bp, Heterodera glycines
  Genomic contig location: Contig_ID=SeqID_9269; Location=845..917; Strand=+
  SCN-specific regions: Sequence locations=1-73
gccattgtcgccaccagcggaagaagaaaacgtagaagaagaagcggatcaaagcaacggaaatgtcgtctga

SEQ ID NO: 70811 - DNA, 723 bp, Heterodera glycines
  Genomic contig location: Contig_ID=SeqID_43042; Location=263..985; Strand=+
  SCN-specific regions: Sequence locations=1-206,228-427,449-467,489 -579,601-723
  Gene Ontology: Mol. function=protein binding; Cellular component =nuclear body; Biological process=segment specification
gtaatttttttgtttatacttttttcgaaaatcgttaattattaatttggattttaagaacgtgccctctgtgcaacggttatttggtcgaagcgaccacagttatcgactgcttgcatactttttgcaaatcctgtctgctcaaatattttgaaggtgggcagcatccaattaaaaactaattttcatcgttattgaagattttttgcctttcagataacaatgattgtccaaagtgccataaccaaatccaccagtcccatccgtctcattatgtggcatttgatcggacaatgcaggacattgtgtacaaattggtgccgggcatgcaggcggaggagcagcgacggagggaacaggtccacccgcacggatttttgttttaattagagtgatttgggttacaattttcctggtttatcatggtcctcctttttaaaaatgtctatccttattttttgcccaaataaatcttcaaattccatttgccgttttgcagtttaaaaagcgccaccaacaaatgaaggaggcgcgcgaaatgaatggccgagcagcggaaaaacataatcatcagaacatttcctcctcctcttcagccaccgccgtcgtaccgccgccaaatacaaacgatgaaaattcagcggagggcgctgaacagcgaaagaacgtaatttggcaaccgcggctcttaaaactgagaaaatggacgaaaacggcgacacc

SEQ ID NO: 70812 - DNA, 733 bp, Heterodera glycines
  Genomic contig location: Contig_ID=SeqID_43047; Location=174..906; Strand=+
  SCN-specific regions: Sequence locations=1-20,89-107,155-172,379 -420,455-489,563-677,701-733
agcaagaatattgctatcttgcctaggcgggattctgacttagaggcgttcagtcataatccctcagatggtagcttcgcaccattggtctatcgaccaagcacatgaaccaaatgtctgaacctgcggttcctctcgtactaagcaggattactatcatagcaacaggtctttagtagggtaaaactaacctgtctcacgacggtctaaacccagctcacgttccctattggtgggtgaacaatccaacgcttggcgaattctgcttcgcaatgataggaagagccgacatcgaaggatcaaaaagcgacgtcgctatggacgcttggccgccacaagccagttatccctgtggtaacttttctgacacctcttgctggaaactttacacattcaaaaggatcgataagccacgctttcgcggtccgtattcgtactgaaaatcaggatcaagtaagcatttgcctttttgctctacgagaggtttccgtcctctctgagctcgccttaggacacctgcgttacgctttgacagatgtaccgccccagtcaaactccccgcctgacactgtcatcgtcggggggtcgccgggccaccgggtggcccgacttaacaccaaaatggacaccccttgcgggcgcactcccgttttaccgattaagttaggatcgatgaaagtagtggtatttcactggcgccttgcggctcccacttatgctacacctctcatga

SEQ ID NO: 70813 - DNA, 388 bp, Heterodera glycines; identical to SEQ ID NO: 59796
  Genomic contig location: Contig_ID=SeqID_43048; Location=240..627; Strand=-
  SCN-specific regions: Sequence locations=1-20,42-275,297-388

SEQ ID NO: 70814 - DNA, 551 bp, Heterodera glycines
  Genomic contig location: Contig_ID=SeqID_43049; Location=1..551; Strand=-
  SCN-specific regions: Sequence locations=1-192,216-358,380-551
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtatggggtactcaaacaattatggggagcaaaaatccaacg

SEQ ID NO: 70815 - DNA, 182 bp, Heterodera glycines
  Genomic contig location: Contig_ID=SeqID_43050; Location=1..182; Strand=-
  SCN-specific regions: Sequence locations=1-182
taattaaatccattccttcgggggaccgtgacgggtgccgcggtgtaagcagagtaggttcgtttcatcacggacaccgaaccttttggctagtcagtaatcgtggcttaacttgccagatcggacgggtgcgcatgatgccactgttgcaagcaccccaccaaaagcaaaacgatataacc

SEQ ID NO: 70816 - DNA, 697 bp, Heterodera glycines
  Genomic contig location: Contig_ID=SeqID_43050; Location=578..1274; Strand=-
  SCN-specific regions: Sequence locations=1-384,406-537,564-646,689-697
cataaatctgggcgcatcggttcggggggactgccccgttaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagact

SEQ ID NO: 70817 - DNA, 66 bp, Heterodera glycines
  Genomic contig location: Contig_ID=SeqID_43051; Location=119..184; Strand=-
  SCN-specific regions: Sequence locations=1-66
cttttgaccacctatattttgatcaaattgtgaatatggtaaaataaatcaaataaatgtttatgt

SEQ ID NO: 70818 - DNA, 482 bp, Heterodera glycines
  Genomic contig location: Contig_ID=SeqID_9270; Location=298..779; Strand=-
  SCN-specific regions: Sequence locations=1-118,172-482
aaaatggacgtcgctttttgaatgataaattccgtttgtcgccaaaagcgttggtggaacgcccgtcggacggtgatttgttggccaattctgttaaggatgtgatggaggtgggttcattaattaaaaattagtaaataattgttttaattaattaatttaattattaatcactgatcattgctccgatcagactccgaatgctgaagagatcaactggattttcgtgatcaatttcccaaaaacgttctataaaataattgggcctagaatctattttcaatattaaatctttgtctctcactttctgatcagtccccaaaagttcatgaaaatgtgatcgatggtcagtgatctcggagcgaatcactttcaaaactctcgtccttaaactgatcaatcgccactttcagacattggccatggtcgactacccgtacccggccaccttcttagcaccgttaccaggatggccagttaag

SEQ ID NO: 70819 - DNA, 2790 bp, Heterodera glycines
  Genomic contig location: Contig_ID=SeqID_9271; Location=1..2790; Strand=-
  SCN-specific regions: Sequence locations=1-671,695-859,881-1197,1220 -1496,1519-1602,1625-1859,1882-2053,2093-2250,2274-2631,2655 -2749,2771-2790
  Gene Ontology: Mol. function=serine-type peptidase activity; Cellular component=lysosome; Biological process=protein catabolism
attgaaaaaaattatgtatttctcggatcataagatgactttaatattttaaatattcatttttagatatcttttgaacacggacagttttcgtgataaaaatgcgcccattttcttttacaccggcaacgaaggcagcattgagggctttgccgagaatacggtaagaattattggcgaggatacggtattgtttggccaaaaacaattatcctgctctgatctgtagtgatctattgtaataatgaagtctctccttgatttggagattttattattttggctttaatttttggcatttttgaggggttttttgccgaaaaatgttgtcttgattgaacaatctgatcagtgatcacattcattaagggcttcatgtgggacattgcgccagagtttggcgccgccattgtttttgcggagcatcgcttttacggcaaaacgcaaccgttcggcaatgagagctacacaaaattggaaaatttgggctacctgagctctgaacaagcattggccgactttgctcaactgatcgactacttgaaaaatgaggtgggcgacaatcctttgggactttgatcactgcgattgatcagctcccgttggattttggatccgggatcactgcgctttgatcagttccctttgggtttttgagttagggccttgaccattgcacttgatctgcttggcatttgaatgtctgactctgatcaccccgcttgatcagcccgctgtgcagctgggattataattaatgcgcttgatcggcttccgtttagttttcgatttgtatccgatcacaaaaagtaatattggaatataagggcgggaaaatagaagaatgatctcataattggactgtttccctgattcttcaatcaaacaaatcaaatcatttgcattttgaccattatcctgtctataaatattgcagaaattaccgaatgccaaacattcgccggtcattggatttggcgggtcttacggtggaatgttgacggcatggatgcgcatcaaatacccgcacctcatggacgggtatgattttttgaattcaagaaataaaaaaaatgccaaactttaagaccgtcagtagtagttatggtaccggtccataactactgttagttgagcccaaggtttttgtcctagactttttgaaaaaaaaattttgtttcagttaataactggtgcaaaaattattttaatattaaaagcttttcaattgttgagtcgagagtctataaaatatcactcaattaattgccttttgggatcgggatttggtcgtgattcctactcattgatctcttatcatatctctctaattataattcttctaatgataccaattttttttttcaaattttgatcattttcagtggcattgcggccagcgcgccggtgttttggttcctcaatgtgccaactccgccggaggatgcgtatgacaaaattgtgacccgaacatttgtgaacagcgggtgcaatgtggagagcatcaaacagagcatggacgcgatccgagaccttgccaagacaggtgggcacattattgtaataaacattgtagtaaaggtgctgctaggtagagaatggcaaatcattttttaaaatttatatgagcggtttataattttagtgcgagagataacgcaaaaatgagagagtgctggatctcagtcccagtcatacaaaacatttttgatgaaggaggtagagaaaacaatttcaatagagagcgcaatgggaagggagttcatgtctcttcttcgctgattcttttggtaagagacgcagattcctcgctatgttctctattctctctctgtcttaaatctcttcccataacactctctttttaattaatttttctttattcttctttaccaaaaatgcttttgtatgactggggctgaatataacaccctctcacttttgcgttatctctctccccatcttattttccgccaaaagtcatttttgaaaaattgctttaaattttaaaaaattatcccaattttaaaaatagcgttgatattacgttgatggcataatgttatgttgatattaaataaatatcaacgtcaatgttgatatttattaaaacaattttcgctaagagaaaaatgttgatttgcctttatctactcctccaccaccttcttcactcaaatttctcaaaaattttttttgcaaatttccataaaagtgccaattttttggtaccaaacagacttaccctccgccacctcagcttcctcctccacgccgccgttcgcgagggcgacagagccacgccggtgtagctggtgctgtcgttgttgtcgccggcggcgctgctctcgttccagccacacgctgtgctgcagcacaaccgcacggcgtacacagtgcgcaatggttttgcccaaccggcggctgcccgtctccaccgccaacagtcgttgctcatgttgttgctggttggtgccggcaacggtggccaattggttgggcgaacagcggaatttcatgcgccgcttggagtggaaacagagcacctgggcgtcaacgccaaccgtcaaatggtccaggtcgcacaacggcagcacatgctgaaacagagaatgagttgatggaaatttgaaattaaaaaaaaaaatttaaaagaaaactccgtttttttgtttttttgggcgcgtcggcagcgccatgaattttttttggaatttttatgaatcatagtacttatacagtttacagggtactttttacatacattttcagatgcctataaatgtgttt

SEQ ID NO: 70820 - DNA, 476 bp, Heterodera glycines
  Genomic contig location: Contig_ID=SeqID_9272; Location=29..504; Strand=-
  SCN-specific regions: Sequence locations=1-226,248-476
atgctaaatttattgctgtttttgctgattgtgtccccaattttggcgatcgaaaagccatggattcgccgtgatccgatcactttgactaaattttcgcgccattttgcgctgaaagaagcgcccagatacaaatggcaagagctgtggtacgacaacatgcccatcgatcacttttcgttcagcgacccgcgcagctttcggctgaggttcgaaaaacctgcaaaaacctaaatttattgggttagggggttgaaaaaaacgaaaatttggcaatgaggccttgacgggctcaaaataatggaaacccccaaaaattataccttaatctatgaaaaatatgtaaagcggtcaggcctctgaatacaaaaaatttttaaaaaattcgtagcgtaatacgcagaaaatctcgaggcctaattagttttaaattgaaataattgaaaaaaattatgtatttcaggatcataagatga

SEQ ID NO: 70821 - DNA, 76 bp, Heterodera glycines
  Genomic contig location: Contig_ID=SeqID_43055; Location=657..732; Strand=+
  SCN-specific regions: Sequence locations=1-76
aattactggagtaagcatcatagcagtgcttttccttgtctttttgatgccctcgcaaaatctggttcgcttctga

SEQ ID NO: 70822 - DNA, 484 bp, Heterodera glycines
  Genomic contig location: Contig_ID=SeqID_43055; Location=1..484; Strand=+
  SCN-specific regions: Sequence locations=1-157,184-310,339-455,482-484
tttaaaacaacaagcgttggcattttttcaggttaagtttgtcctttacaatggagaaggcctgcaaaatttggagagattatatcgattttagtgcgctaggttcgatgaaactttttaaaatataagcctaaactttttggcctgtttaaaaaggaattaaaaatttttaaaaattttattcatccttttgatagaaaaagcatcagagagccttatttaacttttaattaacatttggtgcgtttcagagcagtttctgaaaaaatatttatgaattgattttgctaaaaaaataaaatagtgaagctttaaaaattaataaaaaattttaaattcagaattactggagtaagcatcatagcagtgcttttccttgtctttttgatgctctcgcaaaatctggttcgcttctgaccagtttataaaaaaaaagttaagcctaaaatttttcgcatatttaaaaagcaattaaaaattttta

SEQ ID NO: 70823 - DNA, 59 bp, Heterodera glycines
  misc_feature (59)..(59): n is a, c, g, or t
  Genomic contig location: Contig_ID=SeqID_43056; Location=18..76; Strand=-
  SCN-specific regions: Sequence locations=1-59
atgcccacctactatgactatcatagcaagcgattgaagaccgctcatggaacacaaan

SEQ ID NO: 70824 - DNA, 327 bp, Heterodera glycines
  Genomic contig location: Contig_ID=SeqID_43056; Location=293..619; Strand=+
  SCN-specific regions: Sequence locations=1-153,177-327
atgagtcagttttctgatgattcccaaccccccgtgcttgatggtccttattcccctgttggtgatggtggggccgaattgatggatgatgcgcctccgctggaagacgtcatgaaacgcctaccaatctccgttagtctttgcgaaaatgtcttaaaattttctattttaattttgcgaggtcttttcaggtcgagccatcggacaacaatgagcgcaaagtccaaaaggagccgtcgattacccatgaattggacgctgagttattcaacggcaacggatttgcatgtctctccgcagcacaggctgaagctggacggttcaaag

SEQ ID NO: 70825 - DNA, 1529 bp, Heterodera glycines
  misc_feature (109)..(109): n is a, c, g, or t
  misc_feature (979)..(979): n is a, c, g, or t
  Genomic contig location: Contig_ID=SeqID_43057; Location=1..1529; Strand=-
  SCN-specific regions: Sequence locations=1-73,181-398,420-432,455 -460,493-753,808-969,1089-1135,1157-1186,1303-1428,1450-1455,1477-1529
gatagcaaattgccagaattacggctaattgacggtcccacccgtcaggccaagccgtctgcaggcaaatttctttaatattttttttcaaaaaataatttacgaaatntaataaaagttcgttttcaattaaaaatgttttttttataaaaaaaacatttgaattaaaaataaaaaatacgaggtttacattttaaagccatttaaaataattgtctaattgagctgaaattttacaaaaaaaaaagaagattttgctcaaaaataaaaaaagcgtatttttcagaattattttcattgtcatcaagatttgatcaattttggaatttttcgaaattaactatgaatgttacagtctaaaaaaaactaataaaaatttttttcgtttaccactaaaatgattcttaaatgattttttcatctttttgttccaaaaaattagaaattgtaattaagtaacaaaaaaaaaaaaaaaaattaaatttttaatttcgtaacgcctttttatcatttaaaattaatttgaaaaatgcataatacattttttgaaattttttttttgattagattcgctttcgggaccgttggcgttccgtctgtacccaaatgacaaattggaccagcattgacacgggcaccgcgtgccgtaccatgggctatgatgacggcgcattttggcgcttttttcggcgcaacaacgacacttacccatttgtaatgccggcgcccaaatgtacacaaggccaaagtgggaaaattaaaaaattttaatgccaaatttaattttatttattttttgaaatttaagactctctgtggaactgtccaggctttgaggacaaagaacagattccgttgtccgaaaatttgtgccaaggtgaggacgacattggcatttattgttggggaaggccaactttcattggatgggctcgccatgggaaaggtaaaatagaaaaaatgggttagaatttaattntaattaaattcaattagtttatattattggattgtgcatattaaatttaaaaaattagattttattaaaaccaattaatttaaattaaaatgcattaaaaattaaattattaggtcgatgcatcaattaaaaaattaaccaattactgaaatttattgacactcacagaacaaaatgctaattctatgcaccacccaaataacattgaataatatttatttttaaaaattcatcaatgattttaatgtttaaatttaaactttttttatataaattaaaatattgaaaaaaaaacaaattctcaaaaaaaaatttgaaattttcgcattttttttcttttttaattgtgatttttccactaaataatcttgtcataatatcgtttatcctaattatagcaatttttctttaggttgaatgccaaattttgcttttgtatttgcgtaatgagttttttggaatgtttaaaatttcggcaattttgtattctttgattttgttctttgagttgataatattgtttaatatgttccattttttcacccaattg

SEQ ID NO: 70826 - DNA, 621 bp, Heterodera glycines
  Genomic contig location: Contig_ID=SeqID_43058; Location=454..1074; Strand=+
  SCN-specific regions: Sequence locations=1-215,237-316,341-621
atggcagggcgaaagggtccaagagttggtccaaaaagatggctttttttcgactgaaaaaccaatgtatcgcattttggaccattttttgtctgccggattgttcaaatcaattcctggaatggcatcattatgtccagatgataaggtttattattaataaacggcacaaacgaaccgagaacataaaaaactaccaaagcactaaaaaatccaaaataaattattttaaatttgcaaagcctagattttcttcctaattagagcttcattaaagattgatttacgcctaattgccaccactcattcaataatgataaattaattattattattttttgcccaaatttaaagtttaggcaactttatttcgcgcacttgccataccgttgtgcggcttcatatccgcctacttttcaattcagcaacagtcggacacggtgatccggccaaacgggctgatgccgttttggtatatgaatgtgccgcgctacacatttgatcagaatgtgaaaatgttcatcacaaatatgtactgcaatgcattgaagccgttcaagcaattgcagatgaaccgtgaggagtttgtgctgttgttggccatcctgatcacacaaactt

SEQ ID NO: 70827 - DNA, 1041 bp, Heterodera glycines
  Genomic contig location: Contig_ID=SeqID_43059; Location=5..1045; Strand=+
  SCN-specific regions: Sequence locations=1-536,558-679,714-1041
atgatgcggcgtgagaagaaaaagttgctgggaacgtcgacgtgcaggacccactggcctttgtcattccagcaacgttacgcgaaaaacgtggcgaagacatcgtcttgtatgacagtcgcaatgtcaggcaaggcgaaaaggacgttgtccttattttcggcagtgttaaggtacattttttggctataaaattctgtttgttattggcattcctttagactctgaacattttgcgccaatgtggcacgtggcacctcgatggaactttcaaatgtgctccagcgatgtgggagcagtgcttcgtcattggtgcttcagtgcatcagaggatgtgcatcagcatgtggtgtctcctgcctggaaaacagcgacgctactacgaagaagcactgaattcggcatcggctcaccggcaccatcaactcttacgtggccaaccactgtgagtccacgggagcagcttgttcaatattcgttgagcccgctaccgactttgacagctccttcaggcagaatctttaatcaatcatccgtttaaatttaataaaaaaattcagttccagcgtgggaggacgaaatcgttcgtgcgccacattttccaattccgctttggaacatgcactcacaggcaacatctgccctcgctcgtacaaacaacggactggaggcaactcatcttcattttatggtctttaatttattaaaaacaaattgaaaagaaacatttagaaaggcctctgtcaccaccccgccctctcggacttcatttgtggggttaatgaaagcatcgacagacaggtggacgctgcccgatctgctcgccatttcattcacaagcgacacaaacgatacatcctccaggatgctgtcattatgcgaattttggcggaggcgtcgtacaacagcaatggtgaaattagtgatcttatgacggcgctcggtctccaaaattgaaggatatgcgggaaaattgaaggatttcgagaattttgatgattcaattgtccacgttccgtaaagaattttattgaatgttta

SEQ ID NO: 70828 - DNA, 80 bp, Heterodera glycines; identical to SEQ ID NO: 51817
  Genomic contig location: Contig_ID=SeqID_43060; Location=19..98; Strand=+
  SCN-specific regions: Sequence locations=69-80

SEQ ID NO: 70829 - DNA, 80 bp, Heterodera glycines; identical to SEQ ID NO: 51817
  Genomic contig location: Contig_ID=SeqID_43060; Location=635..714; Strand=+
  SCN-specific regions: Sequence locations=69-80

SEQ ID NO: 70830 - DNA, 460 bp, Heterodera glycines
  Genomic contig location: Contig_ID=SeqID_9273; Location=39..498; Strand=-
  SCN-specific regions: Sequence locations=1-102,127-231,263-356,378 -404,427-460
atgtcaatgaaacaacacataacgtcattggagcgtaaatatgccgaaaaaaagcccaaattgaaggcacgattaagaaaaagtatgaagaaatcgtgacaaataatttgtttaatgttttcaaaataatatttttcccaacaagttcgcgaagaaattacatattcattatgcaatccaatatcagttaattgcaccatatacgtcaattctttttgtccattgaatttcaaaataaataaataaatataagaaattttttgcattttattttcatattgagtcgtttcgtaaaactgtcaattgaaaaggcatctttattttgaaaaatctattgctttatctgaactttcaattattttgatttgtattttttgataataataatgattagaagaatgaaatattttttagttttatttaatgacttctgagaagaattcttttaaacctaaataaa

SEQ ID NO: 70831 - DNA, 979 bp, Heterodera glycines
  Genomic contig location: Contig_ID=SeqID_9273; Location=553..1531; Strand=-
  SCN-specific regions: Sequence locations=1-37,59-221,266-424,455 -643,667-731,776-979
atggtgttgagaagaggtaaatttaaaaaaaagtgaaaatttgcatattttaaaaattttcgctttaagccacccaaatgcatcaacgacatgagcgaaaattgtccaaaatctcagcggaaagtatgggtaatttttatattagcagttaagtgctaacggtgtgatgtgaccgcggtcagcgatttgcgcgcttttttggctattttcattattgatccttataaaacttatttaaatgaatattatttaattcttaaaataagaaagaaaagtaaatttgcatgttcataggagctgaaattttccattttattagtgtttttctgcgatttttgagtttttttttaccgttactattgactctctattttgctctttaactccgcaccgaaaaaaattctatttttcgattctaaaaaggattaatataataattattttaatattttttgtttctatagcatttttgcgtcgccgcaactccgagtgtttgtcgccgttccgtgaggcggaggacagtgaccaagcggcgacaagcatggaggaaaaggtggaggaaatgcgccgtgccatttggacaatctgtgccgacgtggagagaatggagtcaaattttgtggtgggcatgccacacataaaagtccaagtttcccagtctctgatcaccggtcttattgcttttggtttaattaattccgcgtcccagaccccaatcaaatcataatttctatattttaattgtttgatttgtaaaccaaaaatgaaaattttcgttttaagttaaagggctcaaaatcgcatttttacgataacattttttgttttatgaaggtaaatttattgaatatttggcatttttcgggttttgagcatatttgagggatttttaatgcatattttatgcgcatttttagtgcatatgatttatagcccatgtgacaaagagagatttttgtatgggctgccgtaaaataaa

SEQ ID NO: 70832 - DNA, 1064 bp, Heterodera glycines
  Genomic contig location: Contig_ID=SeqID_9274; Location=1644..2707; Strand=-
  SCN-specific regions: Sequence locations=1-100,137-225,281-301,335 -587,731-866,888-932,954-978,1001-1031,1053-1064
  Gene Ontology: Mol. function=ligand-gated ion channel activity; Cellular component=intracellular cyclic nucleotide activated cation channel complex; Biological process=transport
ctccggtcccacggcattcggaaatttgaccaaaaaatatgcaatgagcttttattggtccgccttaacattggttacactgggtgaacaggtgacagaattttaaactgtaaatgaaaatataataaaatcattaaagaaattaagtgttattggcttaatctaccagactatggaagcatattttaatgctaaaaataaaaaatctgttttaataaaagctccattttttaaatacatataaatttgataattttagaaaaataaataaaaattaattgacaaaaagatcaacgaagactttattataaaaaatatttatttttataattttgctttttaagccttggcccgaaaattccgtccaatcgatgttcgaaattgtggacactttgatcggactgctggtatttgctgcgattatcggcgatgttggcattatggtttgatttttttgttttggcgccatttattttttcaaattcttcaggttagtcgtgcccattctgccaaagcgcgttttcaagaatacattgatggctgcaaactttacatgcacattcggtaagcatttttacattttgacgaatatttataaatatttaattaaatgataaatttacatttctattttaaatgaggaattaattaataaattttcaattaaattgtattttctcctcttatattttcattttttatgaatttttaaaattaaaatactttttttccatttttcttttgaataactcagccatgtcaaccatcaaatgcacgacagagtgatcaaatgggtggaataccaatggatgagcaacgatcggggccaaacagtggacgaaaatgtggcaaaaataaaaaccaataatttcaaatattttaaattttaggaattgctaaattcgttgccgccgcggttggcacgcgaattggcagccgaattccatctgaacgcactcagccgatcaccagtgcgccaaaatataattttaaaaatattctcataagaaatgccatttgcaaagaaaatgatttatatttttatttaaatacgaccaaataaa

SEQ ID NO: 70833 - DNA, 138 bp, Heterodera glycines; identical to SEQ ID NO: 50950
  Genomic contig location: Contig_ID=SeqID_43062; Location=268..405; Strand=-
  SCN-specific regions: Sequence locations=1-138

SEQ ID NO: 70834 - DNA, 710 bp, Heterodera glycines
  Genomic contig location: Contig_ID=SeqID_43066; Location=418..1127; Strand=+
  SCN-specific regions: Sequence locations=1-61,83-164,190-439,461 -542,568-710
gctgcatcggatgcaagtgccgccgttgctgtacgcctaacagttggtgagcaatgacggaaaattgcttaaaaaagaaaccaaacaaactcatcaattgttagctcccgttggcaaaccgaagggtacattggggcaatggatgttgggctaccgtatcagttattaaaatttttgtttttcaaaaaggatactaaaactgggataaccccattcagagactagtcaaaaaaaataataataggcttggactactatactaattagaaattttagaatgtgtctgttaaatgcaaaactgttgtgaaaaattgttataactcctttcagagaagagatagaaaaaaaataaaaatagggttagagagcccgtgaacagctgcatcggatgcaagtgccgccgttgctgtacgcctaacagttggtgagcaatgacggaaaattgcttaaaaaagaaaccaaacaaactcatcaattgttagctcccgttgacaaaccgaagggtacattggggcaatggatgttgggctaccgtatcagttattaaaatttttgtttttcaaaaaggatactaaaactgggataaccccattcagagacaagtcaaaaaaaataataataggcttggactactatactaattagaaattttagaatgtgtctgttaaatgcaaaactgttgtgaaaaattgttataactcctttcagag

SEQ ID NO: 70835 - DNA, 498 bp, Heterodera glycines
  Genomic contig location: Contig_ID=SeqID_43067; Location=151..648; Strand=+
  SCN-specific regions: Sequence locations=1-107,134-217,239-263,292 -408,446-498
atggagaaggcctgcaaaatttggagagattatatcgattttagtgcgctaggttcgatgaaactttttaaaatataagcctaaactttttggcctgtttaaaaaggaattaaaaatttttaaaaattttattcatctcccttttgatagaaaaagcatcagagagccttatttaactttaaattaacatttggtgcgtttcagagcagtttctgaaaaaatatttatgaattaattttgctaaaaaaataaaatagtgaagctttaaaaattaataaaaaattttaaattcagaattactggagttagcatcatagcagtgcttttccttgtctttttgatgctctcgcaaaatctggttcgcttctgatcagtttataaaaaaaaagttaagcctaaagtttttcgcatatttaaaaagcaattaaaaatttttagatttttattcatctccctttttgatagtgaaagcatctgagtgcctaaaataacttgtaa

SEQ ID NO: 70836 - DNA, 1387 bp, Heterodera glycines
  Genomic contig location: Contig_ID=SeqID_9275; Location=1732..3118; Strand=+
  SCN-specific regions: Sequence locations=1-39,96-423,446-787,827 -966,988-1105,1127-1239,1284-1387
atgggcggtgaaattcggcaacggttcacttcctcccgccagcagcagcagcagcaagaacagcagcagagaaggcaacagccgcagcaacagcaaagtgccggaaaaggcagcagtctgacggttgtggtcggcggagagtcgcaacaacagcagagacaacaggtggggagtttattttaaaaattttacaaactcacaaattttcaagtttttttaataagagaatttcaagaaaaattaggaaaaatttttcagcgattttttggaaaatttttgaaaaaacaaattgattcatcttaaaatttgaaaaaagcgcttcaaggtcactcgcagtattgttctcttttgacagtcattgagcattatcttttcttcccgaccaaaattacgaaaaacaaattcatttttttcaaaaagaaaattagctataatttaaaaaatcaattaattaatgatagccaatgcgttaaattttagtgttttcctttagccgtcctcccttctcaattcgtcttctccattccttttgccacgggtaaattcatcggacgccaacaaaaattgcctaattgtggaccttgacgagacacttgtgcattcctcgttcaaagtgagcactaatgaattgtatttaaaaacaacgaatttcccttttagccggtcaaaaatgcggatttcatcatcccggttgaggtgagacattttccatcattttatttattcatttatttgtcctttttcaatttcagattgacaatgtcgtccatcaggtggggaaatttcataaacatgatttaatcaacataattatttaagttaattagattcaaactgacaaagaattagacttggccgggttcaaacccaggccttttttgtcaacctgggttttcctcctaaattttaaaaacataaaactcgataattttgaaaaaaagcctggatcaccctagacttggattccatgtttgacctctggacctggatttctagacaaaagcccaggccgaggaaaacccagggctgaatccgtgtccagatcgaactctaatattattattgtcaaaagttcaggaattttccaaaataccgggctctacaaaaaacattcattttcaaattcgcatttccttttttgaaggtttacgtgctgaagaggccccacaccgaccactttttggaacgaattggcgcactgttcgagtgcgttctgttcaccgccagtttggccaaggcaattaaaaacaaataaaattaaaagtttttcacttttgtattattacagtatgccgacccggttgtcgaccttttggacaaaagacgcattttccgctcgcgactgttccgcgagtcgtgcgtcttctacgagggcaactacgtcaag

SEQ ID NO: 70837 - DNA, 499 bp, Heterodera glycines; identical to SEQ ID NO: 60789
  Genomic contig location: Contig_ID=SeqID_43072; Location=141..639; Strand=+
  SCN-specific regions: Sequence locations=1-107,134-263,292-499

SEQ ID NO: 70838 - DNA, 269 bp, Heterodera glycines
  Genomic contig location: Contig_ID=SeqID_43074; Location=88..356; Strand=-
  SCN-specific regions: Sequence locations=1-269
atgtcgcctctccgttttatcattgcctttcttttggtcgttttgtgcgctttttccccactgataaccgcgcaagaagagagagttgacaatgaacctgctgctctgcgcgccagacgtgagtttttattaagcaattattaattaattacatgccaaatttaaatggacaaacattttaatttaaatcattcgaaaaaaggctttttgaaaattgaaatgaaattcaatttaaaagtgccaacatttcagaatatttatgtaaataa

SEQ ID NO: 70839 - DNA, 308 bp, Heterodera glycines
  Genomic contig location: Contig_ID=SeqID_43074; Location=612..919; Strand=-
  SCN-specific regions: Sequence locations=1-47,69-161,183-198,220-308
atggtttgaaataattttaacataagtgaaattctataatttccctttatatttgccatttctcagctctatccactaatattaaaaattagcttgaggaaacatggagaaattaattttattttcttttattgcattaattatttttacaaatgatgggcaattaaatttttgttttgttgcccaaaaggggaagaataattattttattgtgaagtcactaaacttgcgcaagtgattcactttcaccagcagcaagtttgaagaacaccttcgattaattgtacgacaaaattaaatttaataaa

SEQ ID NO: 70840 - DNA, 311 bp, Heterodera glycines
  misc_feature (148)..(148): n is a, c, g, or t
  Genomic contig location: Contig_ID=SeqID_43077; Location=1..311; Strand=+
  SCN-specific regions: Sequence locations=1-199,232-311
tctacttcatctgctactcgccaattcagcttttcttatgcaggtccaattcttaatacatcaccccaaatagttagctaattactcgttaattatgcccctctctctctacccctgcaggggtctcttcaacttgtccatccatccncccctacgaattcgtccttctgatgaatgccttggccattctttgctccgcttgtaaccctttgctgtacactctcttctccagtcgtttccgcgcgcgaattggtcatttgttgtgcctttgctgcgacattttctatcgccgcaacaataagtgaaacgcc

SEQ ID NO: 70841 - DNA, 368 bp, Heterodera glycines
  Genomic contig location: Contig_ID=SeqID_43077; Location=732..1099; Strand=-
  SCN-specific regions: Sequence locations=1-245,269-295,317-368
gatggcaatggcccaccgcccggcgacgttttctgaatacagcgaaaggaacggaggagacgaagacgcaaacatggaattttttgaccagcgaatgccttttccgtcgacgatcactccgtccgtccttcgatttgtcctccatcactttccctccctttttctgtcgctttgcctttcctttcgtttcgctgtctcccaaaaaggctgatgaatggcatttttcaactttgagctccgtctcaaaattggattgtttgtctttttgccggtgcttctcccccccccccccccctttctcccacatttctttctccgaatttcgtgcaaatgttttattccaaaaagaaaaaatgattcttcgatta

SEQ ID NO: 70842 - DNA, 396 bp, Heterodera glycines
  Genomic contig location: Contig_ID=SeqID_43078; Location=199..594; Strand=-
  SCN-specific regions: Sequence locations=1-173,221-358,380-396
atgggctttcgggatgtggacgatgacggatatgaggaggaggaagcagcggcggtgaatggtggcggtggcaccagcccgatgaatggtggtggcaacaacaaattggcgacagcgacgacgacggcaaaactcttccaaaatggcatcaccaccaacaccaatggcaaaaagggcggcgacgacgacgacgatgggcaggaggaggaggaggcgaatgacggcgacaccaccatcaccgcgcatggaaatggtgggtgtgtggaacagcaaaggggttgggtgcgcaattacggcgggggccagctcgttcaccctcctccccatctcccgaaaaaattttcaaacagaaaattgcatgaagaattttttaaattttcagttttatggtggtga

SEQ ID NO: 70843 - DNA, 787 bp, Heterodera glycines
  Genomic contig location: Contig_ID=SeqID_9278; Location=346..1132; Strand=-
  SCN-specific regions: Sequence locations=1-98,137-364,386-439,461 -590,612-721,743-787
atgaaaagttccctcttttctctccgtccctttttcctcattttttcactgctttttctttcctccaaattccgacttcaaaatgcgtgccctttccaagtgcgtgccttttgtgcatgtgttgaccatgtcgacggagtgcaactgaattgcactgttccagcagaaggggcggcattgcatcttcacaacaatttgcttaatggcattctgccggcactttccttcatgaaccttcccgtgctcagtcttctcaatttggcaggcaatcaactcagtgccatgcatcgccattcgacaatttcgacaacaaaatccacgacagtttcggaaattgaggcaaattaaaagcaattacctaaaataattatgaaattcatttcaaatttaacttcccttttaagtcactctccgccgatcaaatcgaagacaacgcatcggaggagacggaagcagcagaagaatccgcatttgttcagcaacagagcaccaggccgcccaaggaatcgaccgaccaatttgctgagacaattgaaacaacgatcaatggccataaaatgggcaaaatgacaaacattcgacgacgaaagaaatctgttgtacctgttagttaatacaatgaaattccaaattataactgtgtttaattcagtacgattacttccccagagacgttttcccgacgttgaaaaacataattattgaagagactacggaacagacaacaaccacaacaacaccagtgacggtggaacaaactcgccaaacaacaaaaattccaaagtaa

SEQ ID NO: 70844 - DNA, 124 bp, Heterodera glycines
  Genomic contig location: Contig_ID=SeqID_9279; Location=559..682; Strand=+
  SCN-specific regions: Sequence locations=1-124
atgggaaaaagaaaactattacctaaaattcacggcaaaaagggagtgaaagagcgtcaaaagaagcgggaggagaggaaagcgcaaacggccaaggcgatgcaagcccgatgggcaaagaaaa

SEQ ID NO: 70845 - DNA, 56 bp, Heterodera glycines; identical to SEQ ID NO: 52733
  Genomic contig location: Contig_ID=SeqID_43082; Location=247..302; Strand=+
  SCN-specific regions: Sequence locations=1-56

SEQ ID NO: 70846 - DNA, 1168 bp, Heterodera glycines
  Genomic contig location: Contig_ID=SeqID_43083; Location=1..1168; Strand=-
  SCN-specific regions: Sequence locations=1-192,216-1168
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaatttttttctccatcttcctttttgatactaaagcatcagagtgctaaaattaagttgtaaataaaatttggtgcgctttagatctgggcgcatcggttctgaaaaaaataccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcagggggactgccccgaaaacaaaaataaatcgattttttc

SEQ ID NO: 70847 - DNA, 204 bp, Heterodera glycines
  Genomic contig location: Contig_ID=SeqID_43083; Location=1294..1497; Strand=-
  SCN-specific regions: Sequence locations=1-29,51-204
attttttcaacagtccgtttggggtactcaaacatttatggggagcaaaaatccaacgcagaattaaagtacaggctatagggaagctattcccgaaggattcggtctccccataaatctgggcgcatcggctcggggagactgccccgaaaacaaaaaaatcgattttttcaagtgtccgtttggggtactcaaacaattatg

SEQ ID NO: 70848 - DNA, 599 bp, Heterodera glycines
  Genomic contig location: Contig_ID=SeqID_43085; Location=151..749; Strand=-
  SCN-specific regions: Sequence locations=1-29,53-218,240-554,579-599
  Gene Ontology: Mol. function=protein serine/threonine phosphatase activity; Cellular component=cytoplasm; Biological process=sodium ion homeostasis
atggcaaaggaggaatactgtttcgatgcaaaggcggcggcagcggcggggcaatctcgtcgtccttcgacaacggcatcagtacttgtgcaaggagatggccagtcaagcagatttgtggatgcgatcatcagaaaagtcacgcagccgcctcttcaacgcttcacggatgaggtggaccacaaattttggaatgttttaaagcaattaatcaaattttcattttttgcacagatcaccgacgaggaactcaaacaactctgcaaggcggccacggacgtcttccggatgcagccgacgctcgtcaggatccgcccgccggtcgtcgtcgtcggagacatccacggacaattctcggatctgcagaggatcttcacaacgcatggccccccgccggagcagcagtacatgttcttgggcgactacgtcgacagaggagcacactcgatggagacaatcatccttctcttctgctacaaggtgtggttttcagggattgacaacattttacccccaaaattgaatttcagatcaagtacccatcgaacttcatgctgctgcgcgggaaccacgaatgctccaacatcaacaaagcgtga

SEQ ID NO: 70849 - DNA, 725 bp, Heterodera glycines
  Genomic contig location: Contig_ID=SeqID_43086; Location=118..842; Strand=-
  SCN-specific regions: Sequence locations=1-428,451-725
atgccacaaatttacaattctaaatctgaattcactccgtcggcacaggtccctccgcgcggatcgtcttctcattggccggcagatggttgggctgggccttccacgcggtcaaattgggcggccatgtgtattatctgatggtgtacaggtgggggacattgatgtcattgtgtccgttacttacacacatagtcacaattaaaataaaaattctacgcccagactcctgataatgtcattccatttctaaagcttcgcggctctctcctactcgtcacttccatttcacaagtaatatccaaaattgactaggataacccttcaacattaatgcagagacccaacccgtatccattttccatccggaaaaaaaagttaatttttttaatttagaaattgttcaagttttataagaaaatttcaggaaaaaataatttggaaataaaaattttctaaagattatttctctaaatagaacccccgtgggctctatttttcaacctccctcaaaagtgcggcttctttattttttgggggggggcactaatttaggggcgggcgggctatattttaggaatacggtattgaatttcaatttgttttcagcccgcctaccaaccggtggacgaggacagtgccgaactgatgcgtttggcatcgcccagccaaaccttggaaatgctgtttttctcgctgtttggcctcgtcgagccggacagcat

SEQ ID NO: 70850 - DNA, 138 bp, Heterodera glycines
  Genomic contig location: Contig_ID=SeqID_43087; Location=735..872; Strand=-
  SCN-specific regions: Sequence locations=1-110,132-138
cggtgcaaattaataaggcaaaggaattcaggggtttagtaaaagcaatgagttctgagtaggaaattttctgtgccacatatacactaaattttaatcacctgtgaatttttaacatttgatttatttttattcatt

SEQ ID NO: 70851 - DNA, 650 bp, Heterodera glycines
  Genomic contig location: Contig_ID=SeqID_43088; Location=406..1055; Strand=+
  SCN-specific regions: Sequence locations=1-18,40-339,514-519,542-650
atggtgtaccaatcgaaagaacattgccgagttttatttgcacaactcgaggcggtcgaatcaaacacgtaaaaatgggggaagcgaatatttgaaaaatagcgggtgccggggtaaatttattgaaatttgacaaactttcaacgccccgccccttcacattttaggaaaacggaagtgtgaaaatgattgaaaagttaattttgttttttttcagtctccaacttttggccaatacgctcgacgacgcattgacaaaagccgaattggtaaagaaacgtcaaagcgaagatgtgttactgcacatgaccgttctgaacactaaatacttggtaagtggggggggggagagagtaagcagggagagagagacagataaaaggaagagagaaacgaggaggggaaagggattaattgtgagaaggaatgcgagtgagagagagtggtagagacaggaagagacatgggggagagacaaacagccaacaaagagagagacaaagggaaaagagacgcattggagaaaagcgaaaagaaaaggccgtccctttcttcagggctggcagggatggaagaaaacgacgctcaatgtcacccaattgttggaaaagtatggacaattaaactttgacccaatcaacgtcgaggag

SEQ ID NO: 70852 - DNA, 683 bp, Heterodera glycines
  Genomic contig location: Contig_ID=SeqID_43090; Location=287..969; Strand=+
  SCN-specific regions: Sequence locations=1-55,78-94,116-306,348 -397,420-442,464-503,525-537,567-683
atgtccatgaatgttcaatatatgattgcactctgggccaaattatgtaacattgaagagaaaaatgtgagaatattctattaaccacttgccctaaaaattcaatttttcatagggtatgcaagcaagcctcaatttttttttttcaaaaaattttccaacgcgaaagttcgtgcaggctctcatgcaggcttccgctgctgatccctcctccaacacctccggcgcccatttcctgcgcatcaattgcgttactccaatcggtgctcatcggttgaatggggctgaccggactgatcggagagctaatattttcaaaaaaaataaaaaatttgttttaaaattttgtaacaaaatgtaagcctttatacattttacatagtcccggattgtgtcataaaaataaaagttaagataaatttaaaaaaaactgcttttccgaacatttttggcacaaatttattgtttttttttgaaactcaacgtaattttttgaaattttacaggctaatagagagcacaagttacttgttatgaatataaataataaaaatttggttggattcgaacaaatgagaaaggacacttaaccaaaaaactgggccatcgcccatttggccctttccgacataggccaccacacttttggacatgtaatttaggcatttctttataaaaattca

SEQ ID NO: 70853 - DNA, 143 bp, Heterodera glycines
  Genomic contig location: Contig_ID=SeqID_43090; Location=449..591; Strand=-
  SCN-specific regions: Sequence locations=1-143
ctctccgatcagtccggtcagccccattcaaccgatgagcaccgattggagtaacgcaattgatgcgcaggaaatgggcgccggaggtgttggaggagggatcagcagcggaagcctgcatgagagcctgcacgaactttcgc

SEQ ID NO: 70854 - DNA, 1304 bp, Heterodera glycines
  Genomic contig location: Contig_ID=SeqID_9280; Location=122..1425; Strand=-
  SCN-specific regions: Sequence locations=1-179,490-501,585-661,683 -833,860-863,963-1003,1044-1176,1227-1304
atgggggcgtccattaaaatgccaaactgcgtaagtccaaattattagtgaattttggctgaataaacggcttcaatatgttcactcagcgggaaatttggtttttaatgttttcaaccgactataaaagtacaaaaaattatgtcattgttaaaaaaatttaacattcacaagtaagtattaaaataaaataactaataatatttcgattttttatttaatttttattagaaatatacttatatatatatatatatttaataaatcattattaaaaatttaaagaataattaagtcgaatttatttatttattttttttaattaaaattgactaaataaaaaattatcaaatttttgaattaatttatttgaaatataaatagaacgcaattatctaagaaatttcggtttttgaattaattttttatttgaaattacctaattttatttttaaataatttattaaaaaaattaaagttataattaaagagtaatttctcataaattctttatttaaaattgttaaataaagtgaaaaatcttaaattaatttttttatttgaaatatatttattttaattaagcaccaaattcttgattaaatacaattataataaaaacaaatttcttaaattgtttattgggtctttattcaatttgaattttttaaattagttgaaatctttatttttacggtgtaaactgttttttagtctaatgtttgcattagctttatatttaataccatcaaataatttagactcaaagtaattaaacaagcatgcttctgcttgtttacataacctgtgacaaaatagtagaacatttgatgtctgaacatttaattaaatgttaatagtgctttttaatttttaaatgattaaataattcaaaaatattttttattaaatgtatttttaatttaggattttaaaaatctttcaatacaaataatttttatgttttggaaagcatcacacaatttgtctcgaattctccaagaaaaaattgtaaattaaatattgaaataaatttttataatgattgtttataggctaattttcgttgtttttcgaccagcaatcagttgaattttgcaaggatttgtacaaatgcagccgaagcaattagtgatattccaaatggcgccacaattctttttggtggtaatagagaaatattttatttttaaattaatttaaatgtaaatattatttaaataatagagcctatatgaaatgggagaagctggttcttccacgccgttgcttccccctcgcccccccccccccaagaaaataaa

SEQ ID NO: 70855 - DNA, 45 bp, Heterodera glycines
  Genomic contig location: Contig_ID=SeqID_9282; Location=16..60; Strand=-
  SCN-specific regions: Sequence locations=1-45
atgaatattatgccagccaaccttgggaagatgcccatgaaaaat

SEQ ID NO: 70856 - DNA, 214 bp, Heterodera glycines
  Genomic contig location: Contig_ID=SeqID_9282; Location=267..480; Strand=-
  SCN-specific regions: Sequence locations=1-187
atggcaaattactcagtaaaattgccaatttccgattctcaatttgcttggtttattgtcgaattggcctggctcgtcaaccgtgacagagctggttcaataaacactgctttgatgctgcgtcggatgtgtgaattcagggtgatcataatgattgcgaacaagcctttatttaagaaaaatgattatttaaacaaataaaaatgaaaataaa

SEQ ID NO: 70857 - DNA, 320 bp, Heterodera glycines
  Genomic contig location: Contig_ID=SeqID_43093; Location=468..787; Strand=+
  SCN-specific regions: Sequence locations=1-13,36-92,114-208,230-320
atgactgcaaagttttatttgggttcagttataaatcaatttccaattagcacatatgaacaacagttaggcaagggttttatggcttacaaagaattatatgacaaaatggacaaaaaaaaagatgatgccaaattcaacaaaaagtatgctaaagtgccgaaaaacaatgctgaagagatgaagccgttgccggacccatgtgagcaggcaaagctcaaatggaagaagaattgaagaagttgaaagacgaacattgaaattgagaggagctttttcggtgctatgtttttataaaaaaaagcatcgaaaaaggcgta

SEQ ID NO: 70858 - DNA, 1335 bp, Heterodera glycines
  Genomic contig location: Contig_ID=SeqID_43095; Location=44..1378; Strand=+
  SCN-specific regions: Sequence locations=1-624,647-1169,1202-1335
atggcccaaaccaacaataatcatcttaaacatgcttttgctctttttttggtcaccgcttttgtcattttaatcgccgtcgttttggcggaaaaaagtgtcaccaattcggacagtgccactgccgcaaaggtaagtggaaaagagaaaatgtgccttatgtggagcctataaaagtttaaaacacggttaaacagcctaaatttgcatattattgaacaaaaaaaaaagttcacatcacttttcaataagttcactttttgtggtgcgctttttaaaaacttttgatgaacagagggggggggggggggtgccgataggcgccgccggagaaaaacttgaaaattgctgatattttaattgattttgtccaaataatgatcaaaattttgcgattttgagtaaattatgagaaaattaaagatattgggtccaaatgtaaaatttgagaagtttatgcaatttgtcattagtagagaccgactaaaaggcaccaaaaaccgtgaacaaggcactataataggcaccaaaaaataattgaaaaacgcacaaaaatcccgaaaaaggcaagctttttaaaaatttattaaggatttttagggaaaaaaacacgaaatttaatcgaaaaaattaattttgatcatttaaatgattaatatcggaactaatgcccagaaaaaaagatatatgactaaaaagtcagtctttatgaattttctggttatgtaaaactattttttttgttgttgtaaatttgccaaaatcaaataaaaaaaaggtttttcaagtttaaatcctttcaaaaaaacaatttaaacactttccgtaaacttttttcaattgtttggcatcagaaggcctataaaaggttgtttttggtttgtttttttgctctaggacatatgatacccaattctgaaaaatgaacaattcacccgatacgtaaaaacagggtccgttctttccaatttcgtggataaatatttaattgttgaggggatattgatggattttctttcctttattgaattgtttcaattaaaaaacaacaaaaaaatcattaaggatattcaacggatggaaaaattacagaaagcacaggaatatgtggacaaattgaacgaagcgcaaaattattggactgttcgtccgattttatctatcaccgcaaaattatttttaaaattatttatttatttaaggccgtcgttcacaaaaattttgtaattatggacagaaagccatttaaaaaaatggcgaatgggccaattgaaacaccaaaacagcagaaaaaaacgcagcagagaaaggctaatgtaaattatattttagcaa

SEQ ID NO: 70859 - DNA, 705 bp, Heterodera glycines
  Genomic contig location: Contig_ID=SeqID_43098; Location=3..707; Strand=+
  SCN-specific regions: Sequence locations=1-510,532-624,687-705
atgggtggtccgtgtgtagcagagggcgaggcgcttgggcagatgaagcgcgagctcaccgaccgacggatcatcgagttcgttgcgggaggccccaagaactacggcatccgccacactgcgggggaaggctccgaagagcgcgccaacctcaagatccgcagattccgcctgtccaacactgcgcaacaactgctcacctttgaggcgatgaaagacctgacgctagccacgtacaacattgacggaccaatgtgagttttcaacatatcattttgattatagatcacatattaaattgaattttagcgatgatgccttggacaatgacgacctttacgtgtacggaggcggcgaacatcgtgccataagcgtcaatttcccgcaaattgatcgcaatgtgtacgccgatctctacacgcatgaggcccacaaagactacaggcccttctatgccaaggggcgcgttcggcctgggatgcagacgcgcccctttggctatgtggaggatgatggacagccgaacggaggacaacggacgccggacgcatcgacgatagagaaattttttggaacaagatcccacacagcccggacactctgggtggttctgatgttgtgatgttattttatttatttattttttattttcatttaatttgatatttattgtttatgtttaaattgtacaaaatattgtgacca

SEQ ID NO: 70860 - DNA, 671 bp, Heterodera glycines
  Genomic contig location: Contig_ID=SeqID_43100; Location=306..976; Strand=+
  SCN-specific regions: Sequence locations=1-233,301-331,354-541,563-671
atggtcgacgttccggctgattttgctgttctgctaaactccgcgccgccaattagccgaattgagtcaaacaaaatgcattggctgcgaaaacggcaacagacaaatgcgacggcattgcaacgcggcatcgatcagattggccaactcgcgacggaggtgcgaaaaattggaacaaaattagggacaaagaaagaatttaatacttaagtgagtgggaaaaataaattgagttaaaaaattataaaataaaaaatatttttccattttaataaatctcttaaaatatgaattttatttgccgaatccaaaaattaattagtgccatttaatgatcatttttctttcttcctaagagtcgaggtttgaagcgtccggtgaccagttttgcgcgttttgcggattctcccgacgaacaggcgctgtatttgctgtgggaaccgctcacttcggaccaaccgacggcaaacggagggccgtcctcacggatttatggatatttaaaagtgaaattaacaaataaagaactgtgcaattaaccataataattgtttaatgctgctgaattgatggcttatttattaaaaaaacaattttctcattgagcaaaggtcgtccgggaccgacgattgtatttggtggacggagaagggcgacagttcgtcacgacg

SEQ ID NO: 70861 - DNA, 399 bp, Heterodera glycines
  Genomic contig location: Contig_ID=SeqID_43101; Location=443..841; Strand=+
  SCN-specific regions: Sequence locations=1-200,222-399
atgctcggagttggacagctcgggaatcattgccaagtgcgaaatttggacagcggcccagccaaattggaaaagcataatgggcggaatgaaccaaagaaggcgcagaaaaggcagccaatggcagagcaaacaaccggagaaaatcagcgggaaggaaagagtgacacaaacggtgccgaaaacgcaaaggttgaaataggaaatggaaaaatgccaaaccaacctatgatatgccacgactttcgtcgcccaaaacggcgtaaaatgccgggcagaagggacaaatcgctgagcattccaaccaacggagtggacacggcgtcagtcacctggcggaaaatggcgaaatgtttttgtccgtctacatttgcagtttttccatggaatattcattga

SEQ ID NO: 70862 - DNA, 975 bp, Heterodera glycines
  misc_feature (14)..(14): n is a, c, g, or t
  Genomic contig location: Contig_ID=SeqID_43101; Location=1..975; Strand=-
  SCN-specific regions: Sequence locations=1-312,334-659,681-975
ggtcatttttacancgatttgtgcgcatcgatgtggttcacctatctgctgattttcttgagaaggtcgtcctgctgctaagttggcaagctggtctgctcatgttcattggacaggcaaacacggactgacaatcaatgaatattccatggaaaaactgcaaatgtagacggacaaaaacatttcgccattttccgccaggtgactgacgccgtgtccactccgttggttggaatgctcagcgatttgtcccttctgcccggcattttacgccgttttgggcgacgaaagtcgtggcatatcataggttggtttggcatttttccatttcctatttcaacctttgcgttttcggcaccgtttgtgtcactctttccttcccgctgattttctccggttgtttgctctgccattggctgccttttctgcgccttctttggttcattccgcccattatgcttttccaatttggctgggccgctgtccaaatttcgcacttggcaatgattcccgagctgtccaactccgagcatacgcgaatggtcagcggaaaagcaattaatgagagcaatgtcattttagccatcccttttcagtcaatgacttcctatcggtacggtttcaccgtggcagccaatctgttcgtgtttgcctgtctctttctgtttttggcccaagacaaggacaccagcaaaatcaaaccgtccgatttggccaattttcgggttcgacccacaagcaaaattgatttcttgtcggacttttcaacatccaaaatctccactcgttcagaatctcggtctggttgctgttgcgcttggtaccgccgtcacggcacttttttacgggggagttagtgagccgaacagcggacagcggcggatgagccgactgaactcggagagcggcgacgagcaccgattgggacgcatgtcaagcaagaaaatattttatcatggggctgaaatggaaaga

SEQ ID NO: 70863 - DNA, 49 bp, Heterodera glycines; identical to SEQ ID NO: 51181
  Genomic contig location: Contig_ID=SeqID_43104; Location=677..725; Strand=-
  SCN-specific regions: Sequence locations=1-49

SEQ ID NO: 70864 - DNA, 270 bp, Heterodera glycines
  Genomic contig location: Contig_ID=SeqID_43105; Location=792..1061; Strand=+
  SCN-specific regions: Sequence locations=1-78,100-139,162-185,209-270
atgctttttctcctttttgtatttgtgtttttaattataaacaattcaactgacaaaatattgtcagttaatctgtgtaaaaaattgggccaaatttttctgaaatatttggcgaagaatgggcaaatccacaaatggaagaaaatcaaaatgaattaattaatcagaccgatcagttggattttcagaaaaaatgtcaaattattcacaaatttcatgcaataaaagaaagaattaacaaaaaaaaaaaatattcggaaaaaaattgga

SEQ ID NO: 70865 - DNA, 369 bp, Heterodera glycines
  Genomic contig location: Contig_ID=SeqID_43106; Location=359..727; Strand=+
  SCN-specific regions: Sequence locations=1-369
atgcacgcgttttgcgctcgagctatttatcatcgggcttgtcaatccaaagcgaaacaacaaagatgctgttttgaacgaataaagggcataggttattttgaagaagtgtcaaagaacatgcagcaataagcctgcaaaatctaataagtggaaaatacatgagtatagaatttattttcagaaagtgtcaacagacttttggaaaatatatttgcaatttatcaacaattttgagaagtgagttagaaatgataaacttcacgattcaaatcaattttcgttgctctaattaaccgcgataaaaacattcgaatcaattaaataacttctgagataataaggtttatcataaaatttcaattaaaa

SEQ ID NO: 70866 - DNA, 109 bp, Heterodera glycines
  Genomic contig location: Contig_ID=SeqID_43108; Location=449..557; Strand=+
  SCN-specific regions: Sequence locations=1-109
attagggctccaatttttaggcaaaaggctatttttttcctgagctccccgtggcctaaaatgcacgaaaaacatgtttttttgggctgttgttaagctacttttcgag

SEQ ID NO: 70867 - DNA, 758 bp, Heterodera glycines
  misc_feature (716)..(716): n is a, c, g, or t
  Genomic contig location: Contig_ID=SeqID_9285; Location=1..758; Strand=-
  SCN-specific regions: Sequence locations=1-55,77-274,297-406,428-758
  Gene Ontology: Mol. function=RNA binding; Cellular component=nucleus; Biological process=mRNA cleavage
atgaagccagacttaaaagaccgggactttatgtacaaattaattgttgggtatgttttccttgatttttgttttcaataatccattttagccaactcttttacgatggtcatcaacaattggcactgaacttggcacaaacgcttggcctttcgctacgaccgcctcctccatctgacaaactttttcgtcttgtggcaatagctaaacaatttgtggaagatcccgagtctaaagaacgggagacaatcttgcaggtgttgttttgatgactgactttttccttttatgaccatttatttcattgacaaaaggtcggtgggtttgagtctgctgggcttgacttggaattcgatgctgatgttgtcccgacaagtataatatagcatcaaatctgagtaaagacaaatgtttctcaaggccctgaaccaagtttgtacgaaactgtgtacctcaccacacacaaggccccgtgtcgggcggctgctttctctccagatggtattcaattcgcgtttagtgctttacattttaatttctttaggagctcttgtcgccacggcctccaatgattgttcaattaaaattttggatgtcgataaaatcatttccaggcaagttccccaaaagggtgcagtttgttaacctggcccaccaaggattgacgtgactctgagtgagtccggccccgacgcccatcacccgggtcattcggnaccctttatgcccccacctcgatgtgacaaacaaaacactta

SEQ ID NO: 70868 - DNA, 606 bp, Heterodera glycines
  Genomic contig location: Contig_ID=SeqID_43114; Location=44..649; Strand=-
  SCN-specific regions: Sequence locations=1-91,113-236,259-539,562-606
atgaattttctggggtatattgtaaacaaaaatggatatacttcaagcataagcaaagttgaatcaattcttaatctgcaaaatccaaccaatgtaaaggaaataaggcaagtagtgggaatggcaagctttttcagaaagcatattccgaatttttcaactattgtggaaccattaacgagattaactaggaaagagaagcaattcaattggactgatgagcaagaaaaagcttttgaaaaaattaagaaaattctgtctgaaaaacctgttctgatatttccggactattcaaagccatttcacatattttgtgatgcttctaatgtgggtcagggaggcgcattaatgcaatgggattctgaaaaccgagtctataatgcaattgcttattgtagcagaacgctttctaaaactgagagaaattggcctcctgttcagactgaattaggagcaataattttttcgcttcggcaattcaaaccgttcatttttatgtcaaatatcgaattacatacagatcacaagccattagcttttctattaaaaaaggcagaaacacatcaaaagttggctaggtggcttattgagcttcaaaattataag

SEQ ID NO: 70869 - DNA, 81 bp, Heterodera glycines; identical to SEQ ID NO: 66151
  Genomic contig location: Contig_ID=SeqID_43116; Location=158..238; Strand=+
  SCN-specific regions: Sequence locations=1-58

SEQ ID NO: 70870 - DNA, 438 bp, Heterodera glycines
  Genomic contig location: Contig_ID=SeqID_43119; Location=19..456; Strand=-
  SCN-specific regions: Sequence locations=1-92,119-271,297-438
atggcttcaataaacgatttagattatgttcgagattatgattatgtttatgatttagattttgatgaaatggaagaatgtgttgagattttagatcaagaaaatgaaagaaatattaggaattatgatgtgtttgaagagcataactatgctaagagacaaagatttgtggatggtggtcccagtcagggatcaatgaatttggatgctgaggttgcggggtcatcccgtatgactgacagtcaatttgaagataggagacttgagaatttgcgaaagaaaagagagagagataggattagatggcagaataagtcacaagaatccagaaatgtgcgcttagaacagatgagaaatagaaattgtaatgcaatagcagatgaatctgtagcacaaagacggatgcgtttagaacaaatgagaaatagaaattgtaat

SEQ ID NO: 70871 - DNA, 795 bp, Heterodera glycines
  Genomic contig location: Contig_ID=SeqID_1251; Location=33..827; Strand=-
  SCN-specific regions: Sequence locations=1-50,105-131,282-340,497 -550,622-795
atgcaaatggacgcgacagatgcggcggatgtaagggggggggatttttataattattaatttttaattaattaattaattaaatcaaaatagtttttgtaaaaaatgggtaaacacggggggccgggaggaattatttttaatattatttttaaattaattaaataattaaaaatgtttttgtaaaaaaaggggggattatttttattaattttgaaaatcatttaaataattaaaatgtgtgtttgtaaaaaaaaaattttaaattttaaattaaataaggtattttgatttatatggggagaaaatttattagtattttatatcacttaaaggaagcaaaaattttatgtattaaataaaatttaacttcaaatcaaaatatttttaaaattaatttgtgaggggaaatattttttaaaattattatattgaatttattttttaattttaaaatttattttcatttcaatttttcttgaaatattatttttaagcaaaaaactaagttttatctttctcgagaatatgatcattttgttaatttgcctaaattttagaaaattaattaattattttaattatggcattatttttaattatttaaatttttaatttttacttttttcagatatcagttacagattgtgaaaatgagcgcagcgaaagtggagtgaccattgataatcgtggcgaacattctttccatttcatcattgatgaagaggacgacgaaatgcagccaatggaaatggacgaagaagaaaaagcggacgaaggcactaagaggaggag

SEQ ID NO: 70872 - DNA, 145 bp, Heterodera glycines
  Genomic contig location: Contig_ID=SeqID_1254; Location=1867..2011; Strand=-
  SCN-specific regions: Sequence locations=1-145
agggattggacattcatcatattcaagtgtagcggttgaagaacatacagatggtgatcgggaaaaagtgatcgaaatttcgttttgtttatttttcgccaaagctcgtaatttagaaggcaattattaaaaaagctgtggattg

SEQ ID NO: 70873 - DNA, 870 bp, Heterodera glycines
  Genomic contig location: Contig_ID=SeqID_1255; Location=421..1290; Strand=-
  SCN-specific regions: Sequence locations=1-870
atgcgtcgcttgtcacagctgtttttgcggtgccattggacgccctcggagattgcggcgagttgtcgtcatgccagcagtgccgccaccgcccgtcccttgtacatggacgtgcaggcgaccacaccgatggtgaggcggacgggggaggagtcaatgtgacaactattaataacttttcgggaatgtggtcctgccgaaatttaaaaaatggccagcatctctatctacgctttcggttttattttttcgacattttttcctgtaatccgaggggatgccgttcaagcgccctattaaaaacaaacgtttttgtataattgcttgaaccaaaaattgctttgaaaagatttaattaattaagtaattgctgattattttcgtttgtaactttcttgaaatgttagaattctcttgttttctcgtattattacattattcagactttgtgctttcgaatgataccaaaaagatagaaaagttattgtataaaaacccggcattgtcaattgtttggactcataaagtgcattagagccgtacttttttctacaagcacccaaattaaatattcctggctttttttttttgaaatgtaacggaatctgaaattttgaatagagatttattggggctatcgaatgttggtagcatttgcttggcaaaaccggttggtaccagggcgaacgcgttcttagtcgggctttaagtaatccaccatttcactttaaaaccgcacccattttccagacctgggacaaaaccgactggcgcaatgcccgtttcgagtatacgccgaagcaagtgaatccgcataatgcggcccatttgatcgccgagctggcgcccgtgcccagcgaggagcgcgtg

SEQ ID NO: 70874 - DNA, 701 bp, Heterodera glycines
  Genomic contig location: Contig_ID=SeqID_1257; Location=163..863; Strand=-
  SCN-specific regions: Sequence locations=1-62,98-657,681-701
atgacaaaggccgaggtgagcagggcgaacagaacgaatggcatggaattgaaaaacggggctgaattttacagagcatattaaaatatttgcctgagggtcggggttgttagcggaccaagccgtttcatacgagctcaattttttgttataatttttttctttagcaaccaaatccaacaatcttggtatcattcgatagctctaagagtcctctattaatttgccaactttcgaaaaattctgttacggttcaaaaatgtttagaaacccagttttttgaaattttctgagcataacttttttgaacctaacgaaatttttcaaaattttgcagattaataaaggactcttgggactattgaatgataaaaagattgttggatttgcttggcaaagaaaaaagttatagccaaaaacttgtgctcgtacgaaaacgaccccgaccggatgttagcccctctcccgcccgaagcaaagtggggtttggcttctattgagggtttctaagctataattgcaccatctaattaaaattttattttgcaggaattggacattcatcatattcaagtgtagcggtcattcattcgtcggtcatacagaaatgttgcgctgtttttcagtgatttgcactataaatatgaatcgttgtgtaaaatattttgattaggaaatgtctcatttatgaatcgaataaa

SEQ ID NO: 70875 - DNA, 1442 bp, Heterodera glycines
  Genomic contig location: Contig_ID=SeqID_9289; Location=1546..2987; Strand=+
  SCN-specific regions: Sequence locations=1-596,618-866,888-1442
atggaacccaataacaataatgatcaggcaaatcagtgccaacaaaccgatataagcaaaagcattgagtccgcggttttgcccaccatgatggagcttggtggtgatgaagccaatgcttcttcacctcgtgctgctgaaacggcacaaatgccgtcattgaatgccactgccacaaatggtggcccgggttcattttgtgatgggacactgggagcaccaccttacgataatgggcatcaaaatgctgctgtcacgattgcggcggcggcgtcgcttcctaagaccaccaaagcgcttggcgagccggcgaacagcggcgtcgctggcggcggtggtgtcgattcgctcgaccagccgagcgacgatgtcgaggagtcccaccaagcggaagagcttgtggtcaaggaagaatgcatctttccccaagacgagtacatggaagacgaagaggtacctcattcccatccaatccatccaaaccaaatataggaatgaatttggccattcccatatggccatggttaggaagcaaattgctcttcatttactcttggcttattgtcagcgtcttggccaacttttcactctttctcaaagcatttctgtgccaccattctgtcctgtcaaacttctttttcattcatctcacttcgtcattctctttgtttattggttcatactaggcaaaaattgttattatgccatgacgtgaccgaacatccatccccccccccctccatttttattaaattttcttggcacaaaaacagaagtatgtgttacaagcggaaggaatctggcaaaacccctaggaaaattgtactaaaagagcggagaaggaatttttttttatttaccaggcgatttctccaaattgctgttgtgactccccaaaaaaaccccaagtcaaattttagggtgtaattttacagaatatctgcccctttcgtgattagagactttcttagtccaataatacgctcattgttagttgagctgacgcatttggggataagaaaaacaaaacaaaaaatcgctaaaaacattatattgactttgaaacaacgcaaattattgtatttattcgaaatttccttttctaactgttctatcattaaatcgaattcttatccgctttttccattcattttactttttcattggcacaatattttttcgaaaattgttcaccattaaaacgagcatttttttaaaatggaatggaaaaacatccacaattattccatttttttttgtagctgcaactcgtcgatcagcacaatgatgacagtccgccagaaaacggaattgccaccaccaccgatggcaccaatgagcgacagcagaaaaacaatggcacgacagcgcgtgatggggagacaaagcaaaaccaaccgaaaacaattcggatggtggtgccaataatgctgaccacactg

SEQ ID NO: 70876 - DNA, 1451 bp, Heterodera glycines
  Genomic contig location: Contig_ID=SeqID_43122; Location=78..1528; Strand=-
  SCN-specific regions: Sequence locations=1-148,173-666,688-768,801 -939,969-1008,1031-1059,1107-1140,1163-1257,1282-1386,1411-1423,1445 -1451
  Gene Ontology: Mol. function=transcription factor activity; Biological process=mesoderm cell fate determination
gtattggttcgtcgtcagcagctgacgacgattccaaggtgggctcatcgtcgcgatcggccaaactgaagcgcgagttgcgttttcactgcgattggcccggctgtgcatatgcaactgcttacgggggcgacttgaacaagcacaagcgcaagcacacgggcgaacggccttatcaggtgattaagcgatgctgcgatcaaaatgcttaattagagaggcaatttgacaatcgattgttgatcagtgcttggttgctttttaattacgcttgtgatcaattcttaattgccctggtgattaattttaattacgcttgtgatcaattcttaagtgccctggtgattaattttaattacgcttgtgatcaattcttaagtgccctggtgattaattttaattacgcttgtgatcaattcttaattgccctggtgattaattttaattacgcttgtgatcaattcttaagtgccctggtgattaattttaattacgcttatgatcaattcttaagtgccctactgatcaaaatttttcatttgaggagcaatttgacaatcgagtcgagttcttgagtaactagttaatatttagattatctatatatgttttttaaatttttaactaacttaacattcatcaaaatcggttaaccgtagagcaacaaaattcaaaatttttaaaaatctgacacaaaatagcaatttttgtcggaaaattcgggtttacccatcccattattttgtttttctggatgcgttacgcctgataaatattactatattttataatttttatttgtttgtacaacagtgtgatcagtgccatgccacgtttggtcaacactcttcactttcggcacaccgatacacgcacagtgacatgaagcggtttcatgttcgtttatttattggtttattcaaagaaactttcatgccctttaaaagtttttttaaataaaaaaaaatcaggaaaatctttttgaacttttcaagaaaatcccgaaaatatggtcttcacctgttttttcttttatgaacaatttcctttatatctatctttaaattaaataattttttcaattatttttttaagaatttttttttgatttttcagagacggaaatgtccccattttattaaattaggtataaacatttattttgcccttttttccagtgtcctcagtgtgaatattcgaccaataaatcatcggattggacaaagcatttgaagaccggaaagcacaagaaaagtctttaataatgccatcattattttattggatttctcagcatatttttttaaccaatttatttaatttgccatcaaaatcccataaattcaaatggttttgaaaattcaacaatttttttgtgtatctgcgcatttcttttcctatttttgacgacaacaattccatggaaaatgtgcccttaaaaatgcaataaa

SEQ ID NO: 70877 - DNA, 984 bp, Heterodera glycines
  Genomic contig location: Contig_ID=SeqID_43123; Location=84..1067; Strand=-
  SCN-specific regions: Sequence locations=1-120,163-168,198-199,229 -296,321-369,391-439,526-549,574-705,729-740,789-984
acattggctcaacttttgaaggtcacgcgcagtgcacaacgacgtgaagcagcggaggacgcggtgccgccggcaaagagacaaatgggctttcgaagaggtccacttgcaaatcgtgagtttaatttaaaaaattaaataaattttaaaattaattataatccattacatttcctttatttattttttgacaatttaagcgccgccaccaccaccaccatcacaaattgaagatggtttgccgttgccaatgccaccatcaaatgccgaagtcgtcgccgaaccaaatgccacaacttcaacaacaacagcagcaaaagtcatcgccagccgaaataccggctgctctacatcatccaccgcattgacaatggtcacgcgcagtgcacaacggcgtgcagcggaggaggaagcggttccggcacttgcaattcgtgagtttaatttttaaaaaattaataaaaaaaatttaaaattgattataaattcattgtatttcctttattaaaattttttgaaatttaagcgccgccgccacctgccggctgctcatcatcatcatcaacagcagcaaatgttcctcagccgtcgtcgtcgtcactttccgccgaagaaatcacacgacaaaaaaagagggataaaaacaacaaaaacaaattcaacaaaaaacaggcaagctttaataaaaagtttaaatttcatagcatttaaataattaaaaatattaacctttcatagtcttttaaaattattataaaaatggttttaataattatttttaaaaatatcttccaaatttcttttctttttagccgccgcccccatcaatccgcattcctaagggcaaaacgccgaagaaggtccgtccacgccgcccggaacccgaccagccggacgaccaatatgagctccgggcggtgttggcgaccgccgaagtggtgtccgggggcacgacacatctgtgtctgtatgtggatttccttg

SEQ ID NO: 70878 - DNA, 56 bp, Heterodera glycines; identical to SEQ ID NO: 52733
  Genomic contig location: Contig_ID=SeqID_43125; Location=635..690; Strand=+
  SCN-specific regions: Sequence locations=1-56

SEQ ID NO: 70879 - DNA, 693 bp, Heterodera glycines
  Genomic contig location: Contig_ID=SeqID_43127; Location=281..973; Strand=+
  SCN-specific regions: Sequence locations=1-56,88-345,367-511,533-693
atgactttggcgttttcctttgctgcaccgcttcaaaagaaggtaaaaaaatgctcattaaatgtaattaaatttaattaaaaataagacacgaattggagttacaaatgttcggcaacccttcgaattgtctctcaaaagaatgagacggaacattacacttggaaattcattgaccacatttttaacagtaaatcaagtcacttggctttccccgctttattttcatttgtggtgagtgtcgaccaatggaatttcgttttttcagttaaatttggagctgttatttgttttcttgatatcatctttcctcaatataagccccttttgagggagcttgaaagattggagcccccggcggaaacctatttaaatagttaccggacaagtggttcgatcggttttaccgataaaaaaaccgaataaacaagatcgatcgtaccggtcctctaattttaagactataaaatcggtatcttggatctgatcatatcattggtacaggataatctttattttaataaattaaattcagcgattgatggatccgagcaaaggacttcacaacaaaattgcggacaaagtcacattggccattgacatcactgaagtggagaaattggattcgaatccaaacaaacccaacgggacaattgtaatggaaattgacagattgtcgaactttgcgcaaag

SEQ ID NO: 70880 - DNA, 254 bp, Heterodera glycines
  Genomic contig location: Contig_ID=SeqID_43131; Location=877..1130; Strand=-
  SCN-specific regions: Sequence locations=1-25,48-121,146-254
atgtccaaatggattcccacattttacacattgaaccagaaagttctcaagcaaatacgcaaagtttcttcgaagaaaataatcagctcaactttgaggtcacctttgttcattttcctcatatttcctgtatttcccttaaattatctcacaatttgctaactcttttccttatttttgttttttagattgatacgactgaatctctgacccccgtggctgggcacatttgtgtcgaataccgaggtgcctaa

SEQ ID NO: 70881 - DNA, 364 bp, Heterodera glycines
  Genomic contig location: Contig_ID=SeqID_9292; Location=404..767; Strand=-
  SCN-specific regions: Sequence locations=1-18,40-164,186-364
atgtcttcttttgccccattttctgctctttttctgttggctatggtgctcaattttcattctttggtgggtcaattttggccaatttggcccattttcgatcatttttcagaatgggttgatcaaacgcgagtccgccctttccaacggtcgtccgatcactttttgttcatttgattattaaataattttagtagaaattgctgaaaagaaggacgcactgaacgaagagttcacgaggaaatttggcgatttgcgtgagggatgttttccacggccgaaagggaaagggtgccgatgcacagtgaagggaccaatgggacatgacgaggagaagcgatttgacagggacgaggagtgccga

SEQ ID NO: 70882 - DNA, 1417 bp, Heterodera glycines
  Genomic contig location: Contig_ID=SeqID_9292; Location=1602..3018; Strand=-
  SCN-specific regions: Sequence locations=1-949,971-1002,1025 -1309,1331-1417
caggacaactgctcatggaatgcccaatgctttgatttgccggacgacggcgacgtgccgagttggcgctgtgtgtgcaacccgggcttccgtgggaacggagtcaattgcacgggtcaatcagtgccatggaacggcctgaataccatttgtccaattgcagatgcttgtctgaacttctgccttaacgatggcatttgccgtaagaatcgcttgggtcacgtggagtgccaatgcaaggagaacttctcgggcgaacgctgcgaaattcgttttcaggtgttttttgttggttttgttttgatttcaatgctttttcctttaagccgcgatcgcaaaaattggcttattggacgggttccattgtgtgagtttgggttttatcatttggtaaatgtgctgtcacttggtcagttccgtggtattccttctcatcattatcgttgtcgtcatttggatgatttcgttgcgtttcaatcgctcgtcgtcctccgaggccaaattcagtaattcttcgcttccgttttggttgatcacttatgtaatctgctgatcatccatgacccccatttgctttccgatcattttttccttatgtccttcgattcgatcacttttttcttgtctcccttttctcgtttaccatccgatcactttttgccatcatttacaatttgtgcccttcctttgtctgatcactccccctcctcattcttcctcattttgtctttttgatcagtcttcccccacctttgcgcagtgtcctccctggagaagccctccgtgttctcctccgtccagcccgactcgccgttggcctccaactttctctacggccgtgccccgccccgcttggccatagatcggtcccattcgtcatcccttgccggctccatccgtcctcccattggcttgtactacgaggatgaacagccgtatgagcaaagtgctggcggcggcactttgccgcgtggagcggcgaggcatttgaggggagggagtcaaagccaagaagttggagcaggacagaaaggacaaatggactaatgtgaccattttaggcaagaagtatgtttttgggtgggcctgacggaagcgattcgtcgactgtccaactgaacaatgcgttggtgcccccggggagtcggagccctgctggtgccgagtctgaatccgatcagagcccgggcggggccgacaggcaaaaacagcccattgaccaaatttaaatttcttttttttcagtaatttttcggccactcgcgaattggaacaacggttgaggtaaaagaaaaaaaggcaattggttgtcgatggattttaacattttaggaatgttcaacagcatatgtacaggcagaacaacgagcaatgaatagagaaaatgaagaaagtgccaataccaaatcagacggaa

SEQ ID NO: 70883 - DNA, 1017 bp, Heterodera glycines
  Genomic contig location: Contig_ID=SeqID_43133; Location=136..1152; Strand=+
  SCN-specific regions: Sequence locations=1-351,373-737,773-1017
atgtacaatccgcaaggcattattactctggcacagcataaagtagcagagcttgaagccctagccgacattgattggcggctgcacagctgctttaacttaagctgtgtgcattttagcctgccagacccgccaaactcaattgccaaaaatactgacgcggcaattgaagagtttttctttggcgatgatgatttgaatttgcctccagggcaaccaaatcctcgtccacagccaaatacccctccgccacttaacagcgaccaacagaaggtctttgatgctgttttgttggcaatacagtcgaaccctagggattcgactgtcccccgccgtttcttcatatacggcgatggaggcacaggaaagacattcctgtttggccaaattattaggcgcttgcgaaaggccccatacacctacaaagtgcttgctacggcatccactgggtgtgcagccattttgctgccatatgggaaaacagcccattccacgtttcgtctgggtagagaagtgtcattagacaaactcccaagcattccgctggagagcttctttgcccgtcggattcgtgaggcccaactcatcatcattgatgagatcaccatgcttcacaacacggtgattgaggtcatcgaccgagtgtgcaaagagatggcaattcgccagcacaaggatctcctcttcggaggaaaaacggtcattttcagcggtgacttcaaacagtcgctgccggtcgtgcctcatgaaggcttaaccgctcaggtgacagcctgttttcaaacgtctccgttgtttggtcaattcaccacgatgaaattgaccatcaaccagagactgggccaaggtcagcaagcgtacttgcaaatgtgccgccaaatcgggctcggagaaaccggagagcacttctggattcctccgcagttcctcgttaagagcaaggaagagctgatagattatgtctatcctaacttccaacaactccttggcaatgacaaggagctgctcaatcgttag

SEQ ID NO: 70884 - DNA, 348 bp, Heterodera glycines
  misc_feature (5)..(5): n is a, c, g, or t
  Genomic contig location: Contig_ID=SeqID_43137; Location=696..1043; Strand=-
  SCN-specific regions: Sequence locations=1-348
ctttngaaaattctgcctgacaacgtcctgcagcgttttgttgtcggatcgacgcatggcattgtgttacaattggatttgaacggcatgattttgcgctcttggcacgaccccgagggatcagtgatttcacacatttcggaggtctcaaaaaatttttttcaatctcatggaaatcatttaattaggttgatgatgatggaggcgattttctgtatttgtccagttttgtgaacaattacattggaagaatgtcgaaggaatgaagaatccaaaatttggaatgaaaagccgataaaactgcccaatttttcaaaatatttttttttgataaattcttgactttta

SEQ ID NO: 70885 - DNA, 213 bp, Heterodera glycines
  Genomic contig location: Contig_ID=SeqID_43138; Location=853..1065; Strand=+
  SCN-specific regions: Sequence locations=1-11,106-213
atggtcggctcgcagcagcagcaacagtaccatttgctgccaacgcagcagctcaaccacaacaggaacaagcagtacacgacacaacaacaacagcagcaacagttcacctcgccgtacgccacctccaactacggttaccacgaactgacccatccaccggcctacagtatgagcatggtcggcggcggagacgcggggcaacgacgatag

SEQ ID NO: 70886 - DNA, 740 bp, Heterodera glycines
  Genomic contig location: Contig_ID=SeqID_9293; Location=3578..4317; Strand=+
  SCN-specific regions: Sequence locations=1-216,242-321,467-642,669-740
atgtcaaacaaattaattcagtttttcgtttcgctcttcatatctttggctgcatgcgggcacgtaccgccaccaaatcactggagtgcatcgttggacaagccaaagtcaggagctttaccaaaatggacactgaatcgtcaggaggaggaggatttcaacgaagactttggtaaaaaatttgtcttcgttagctatagattttaaatatctaaatgtgatttaatcatttaataaacattaatgacgagcttaataacttatttcagggcgagaaactcaatgtggcctaaccaagcaccactttcaatatcgtgttagtatttaaataaatatatttttaaatgaaaaatgaaaattaataatttttcttctttgcgttttatatatttttttagattgttaatcattgtttatctataaacttgataattttaaaatattatttattactaattatatttaagtcactttttatcgataatgatttttattttttccgacatacagattgaacatggacaaattgcaccagataacgactggccatgggcagtatcagttaggcttgagtgtgaaacgaaacaaagtgcaaagcgagaggtgcttgggatttgttctggcgttctaataggcgcaaaatggattttgactgctgcacattgtctatttgcaactgatgatattttgcgctgcaaaggagtcgaacttaatggactaatcccagaaaagggtgcacg

SEQ ID NO: 70887 - DNA, 599 bp, Heterodera glycines
  Genomic contig location: Contig_ID=SeqID_9294; Location=157..755; Strand=+
  SCN-specific regions: Sequence locations=1-411,448-599
ctagcttccctggtgtttgcccttactgtaactggatcgaagagaagacgaaaggcgaagtcaaatgcaatggaatcgcccattaatgcggttgctttcgcgtggatgtttacgatcatttggacaacactgacgaaaaacataaaagttgtgaaaattgaagttaaaatgttgataaactaattattaaaggacgctttttattttggaattcctagccttaagttttaaactgataaaaatttttttaaaagaaaagatatttgaagtaaaaaatttttcgaaaagtctaaacaaattttttggaaacatgttaaaaatgtgataaaactacaaatattttttatgtaccgaacatccaaattattttatagatgctgaaaagccattctaatccgaaaattagcgtagaaaatttattaaaaataatttatatttatttttttacccaacatttttttattgaaaaatttcgtgcttcgaaattcgaaaacttcgcgtttttcgcttcgaatttctgttgccatctaaaatgacctcctgtctcatttgcaattttgacttcttttttaataatacaaagcaaatcccttattcta

SEQ ID NO: 70888 - DNA, 552 bp, Heterodera glycines
  Genomic contig location: Contig_ID=SeqID_43146; Location=351..902; Strand=+
  SCN-specific regions: Sequence locations=1-40,62-132,155-273,296 -412,434-552
atgcagaacactcagcgaactgagccgaaggtcagtggcaattattgttggatttttaaaacgaatcgcagactaataaaaaaaaattgccaaatttgcgaaaagacatttgttggattattagctaattcattttaaaaatccatccttagaagtgccggcttttcttctgttattaaatccaaattaaatgatcacagttctcttttgtaggctttggcttatggtaggattatttatgagtgttcactgtgctcaattggccacggatttccattgtccccaagggctaaaatggcggagacataaaagtgccgggtgttcgcctaagatttggccaagataaatggtcggctaatacatcaccaaatgttgcctccaaactttccatttttggctcccatttttcatatttgaattccattttaaaaaataattcatgtacgaaccttttatataaatggtttttttggggttcgaatttgggaacatttaaatttttgcacgaaatatttataaatttcttaaaagttcaaaatttatgttctgaaa

SEQ ID NO: 70889 - DNA, 325 bp, Heterodera glycines
  Genomic contig location: Contig_ID=SeqID_43147; Location=10..334; Strand=-
  SCN-specific regions: Sequence locations=1-325
atgcacgcgttttgcgctcgagctatttatcatcgggcttgtcaatccaaagcgaaacaacaaagatgctgttttgaacgaataaagggcataggttattttgaagaagtgtcaaagaacatgcagcaataagcctgcaaaatctaataagtggaaaatacatgagtatagaatttattttcagaaagtgtccacagacttttggaaaaatatatttgcaatttatcaacatttttgagaagtgagttagaaatgataaacttcacgattcaaaccaattttcgttgctctaattaaccgggataaaacattcgaattcattaaa

SEQ ID NO: 70890 - DNA, 375 bp, Heterodera glycines
  Genomic contig location: Contig_ID=SeqID_43147; Location=370..744; Strand=-
  SCN-specific regions: Sequence locations=1-375
atgcacgctttttgcgctcgagctatttatcatcgggcttgtcaatccaaagcgaaacaacaaagatgctgttttgaacgaataaagggcataggttattttgaagaagtgtcaaagaacatgcagcaataagcctgcaaaatctaataagtggaaaatacatgagtatagaatttattttcagaaagtgtcaacagacttttggaaaaatatatttgcaatttatcaacaattttgagaaatgagttagaaatgataaacttttcgattcaaaccaattttcgttgctctaattaaccgggataaaaacattcgaatcaattaaatagcttctgagataataaggtttatcataaaatttcatttaaaaataaa

SEQ ID NO: 70891 - DNA, 730 bp, Heterodera glycines
  Genomic contig location: Contig_ID=SeqID_43148; Location=1..730; Strand=+
  SCN-specific regions: Sequence locations=1-221,247-335,358-730
  Gene Ontology: Biological process=regulation of protein activity, epigenetic
gtgcagaaattcacacgggccaaggacgagcagtactacaacaacttggcctatgtaacaattgtacaaataggcatatttgaagaaagctgtgtttacttaaggtggaaaaaccgcaaaaagatttccccggcttggagttggagccggtgcagctgaaggccggccaagtgtccaggtatcaaccggtgcacgagaagttggagacggtcgcgctgagagagttgaaagagaaggaggcaaagaaagaggcggagccgttgccggactgggccagcggagaggtgaagctgggcgagccggttggaaagtgagcgacggaagggatgacaaataaagaaatgcttaaaaatggcatttagaatctcacaaggtcccgagcctgagcgggagccgagcattccgcaccgggaccaggtgaagctgaagacggccaagccgaagccggccaccgaagcgccgccggtagagcacgtgaccattgaggaggaccgagcgaaaatggcctcaatccaacagggccccccaattgagcaagagccatttgtacggatggcatttagcaaataattaattagggtttattatttcgaaatcccatttgaaggtggcgcacaaagaccaagtgcagataaagcagcagttcaaaccgaaggaagtgaaagtgcacgagcagggcaaagtggagggcgcggacaaacagctcaaagacattccgccagtggtcaaa

SEQ ID NO: 70892 - DNA, 76 bp, Heterodera glycines; identical to SEQ ID NO: 53797
  Genomic contig location: Contig_ID=SeqID_43151; Location=118..193; Strand=+
  SCN-specific regions: Sequence locations=1-76

SEQ ID NO: 70893 - DNA, 155 bp, Heterodera glycines
  misc_feature (27)..(27): n is a, c, g, or t
  Genomic contig location: Contig_ID=SeqID_43151; Location=863..1017; Strand=+
  SCN-specific regions: Sequence locations=1-32,59-155
taagcctaaactttttggcctgtttanaaaggaattaaaaatttttaaaaattttattcatctcccttttgatagaaaaagcatcagagagccttatttaactttaaattaacatttggtgcgtttcagagcagtttctgaaaaatatttatgaa

SEQ ID NO: 70894 - DNA, 1746 bp, Heterodera glycines
  Genomic contig location: Contig_ID=SeqID_9295; Location=148..1893; Strand=-
  SCN-specific regions: Sequence locations=1-90,134-452,476-561,583 -627,659-810,872-932,954-1040,1073-1166,1242-1557,1596-1746
atgcgacggtggcttatgatattaattgttgcagtggcatttgccgcattagcatttggcccaatttcggttaaatgtggaggtaaaaacaaattttatatttaaattactaaaataaataaattaataatttgtagtgcttgaggatgtaaaggattatgttgaggcattttccaacatcattgtgcccgccggaagtgttggagaacaactaaaaatgatatccctgagcatgccaagattggttcattggcgggtcccgttgggacctttgcagctttggccatgcagaaggcttttgaggttcggtcaaatcaccattcttcaaaaatgcatacagaaaattatattaaaaaccgctccaaaatttgtttgttttccattttgaaaaaaaggcaataaatttatgcttatgacttacaccaaatttttgtcgaaaagccttacttcttaataatcccttcctcctatttttcagccagaaagtgaagagctacaggcattgaatttgttgcacgtcaccatgattaagcagttcaatgggctggaccaacgaattgaacaccttggtaacaaattgattgagcatatggccctagttgaatacgatcaggtgtatactatgagtaataaatatttaaatatattttataaatatgttaagatgattacccatccgcttgacattattttgcgtgtatacaaaaaaattaccgacccaagccgaaaccggactctctaccgaaaacaatttgtccatttttgtacgtaccatttatctccacacaattcgctgcttgtaactatgcgataaaaatataattttaaaaaatataaatattttttagttacactaatatatatttaaattcagtggctcaacaaacgagtgaacctcaattgcgttaagccgacacaggaagaagcagacacctttgccaaagccagcaaaatttttgacttaattgacaaaaactcaacaaactttgttcacctaactcaacgtcgatacgccgactttcgaaggagtataataattcttcattttttgttgtttaaatttgattttagaaattattcatcagctatcattggccaaaaatatctcattgttggattcagttaaaagtacttaaaaatatttttttaaacatagcccattgctgaatttaatttaattaaaaataattaatatttattaaaaagtctcaattatttttatttgtaatacttaattaattcagataaaatatatggtccaagctttgcacttgagagtgcaattgtcgatttgcatcactcgcttaaaattggtctttatcagcgaaatcatggcaggtaagaatggttaattttacctaagttaaaaatttgataaattgaaacttttatttacaattttattaataacaaaaaacctaataattgtgtggcagcgccaaaattttatcttttagatgcattttgaaggaaatttctgatgcgaacgaaaacattcgtgaagagttgtatgaattgattttaatgattgaattggactcattaaaattggtcctctttatttaaaaaattattatattattaattctttatttgaaaacagatctcagtcggctcattgtgtgccaatgtttcgcacaacggcgacaaaaaagggactttggatgagttatcggatcttaaagccttcggcgtcaacattaccaccggaatgcgaatttatagtgatcaaaaactcgtaataaa

SEQ ID NO: 70895 - DNA, 395 bp, Heterodera glycines
  Genomic contig location: Contig_ID=SeqID_9296; Location=1319..1713; Strand=-
  SCN-specific regions: Sequence locations=1-156,178-190,226-367
atgccatcggacaaattggcgggaaaacattccaacagttacggataccaaagcgatggcaccttttgggttaacggtttctgcgtaagtggaaagctgggattttcggagggggacacggtcggatgcggcgtcaatttggccaccggacggatcattttaaccaaaaatggacttcgattgggttggcaaaaattaataaatttaaatttataaattaatttactgtcagacacaaccaaaatgttcgccgtggcttcttctgcagatgacccactgtttccttgtgtttctttgtgcgaatcaaatgacaaaattgtggcaaattttgggcccaattttaaatttgatccgtccgctgttgaagtaaaaattcttttaattaaataattaaa

SEQ ID NO: 70896 - DNA, 49 bp, Heterodera glycines; identical to SEQ ID NO: 51181
  Genomic contig location: Contig_ID=SeqID_43153; Location=248..296; Strand=-
  SCN-specific regions: Sequence locations=1-49

SEQ ID NO: 70897 - DNA, 911 bp, Heterodera glycines
  Genomic contig location: Contig_ID=SeqID_43157; Location=219..1129; Strand=-
  SCN-specific regions: Sequence locations=1-122,153-232,299-361,401 -568,749-752,774-782,889-911
atgtattatttaagcccttttgtacgaaaaatgccaggttcgtaaatttaaactcgacttttgctcgaattaattttggggattcgggattaaaaattgatttgacttttaaaatttaaagacccagggatgggccccaaaaatttttggaagtccatacttcctggggtcaaaaatttttcgtaaatcgaattccgatcccaaaaacataggaaatctgaagttaagttggaaattttttaaaatatataaaatataacaaaaaattttaaacattttaataggaaattttaaaattcttaaccaagtaaaagatgtttcaaaaatgcttttggtatatcaggttgaaaaaaaattcagtgattttcagcaaaaccttttttcatgttattttatattgttttagaacatttttgagaaagggattattttgttcaccttttttatttcagatgaaattgtacaaaaaggctaaaattcaaaaaaaattttgaaaatttctgtctttttttgttacagaatttcggaaatcggattttcgtgctatccttgctacgtacgttgcataagagagagatagagagagagcaagagagagagagagcgagagggaaatcatcgagaggaagacaaagtgagagagaaggaagagagagagagagagcgaggagagagagagagagagagcgaggagagagagagagagggggggggtgagaagcgagaaaaagggattgagagcgagagaagagaggaaaagtgagttagagggcgaggggataagagaggaaaggaggcagagagagaaaagaaaaagagagtgaggaggataaagagagagagagagaggagagaacagaggaaaagagagagagcgagcgagagggaaatcaatgagaaagcggaataaa

SEQ ID NO: 70898 - DNA, 531 bp, Heterodera glycines
  Genomic contig location: Contig_ID=SeqID_43159; Location=234..764; Strand=-
  SCN-specific regions: Sequence locations=1-139,161-269,292-323,351 -400,422-432,454-531
ctgccaaatttggtgtcacagaattgtttagcccaaatgatcgtccaaatggcaaatcattgcccgaatatttgcgtgagaaatatgatggtggccttttaattgcattcgaagctgctggcagtcatttggcagtggtttgtcaaattaataatcataatagcccaccaaattcaaaattgtggtcttctttcatttttggttatgataactgagtcactagtgaaaatggatttagtaccaatatttttttattctttatccattttttaatgtttaatagattattcaaatcaaattctataaagaaaatttaatttagttttttctgaaaaacattaaaagcattttcatgctgcctcttttgccttgcacatatataatagaattatagtcatttaaaatttttaagtcattaaaacgtaattagccgaacttatttgttataattggaagatctgatcaatgagctattaaatattaccatgaaaaattaatttggttgaaattcagtcaaattatgaaaataaa

SEQ ID NO: 70899 - DNA, 304 bp, Heterodera glycines; identical to SEQ ID NO: 53844
  Genomic contig location: Contig_ID=SeqID_43160; Location=590..893; Strand=+
  SCN-specific regions: Sequence locations=1-304

SEQ ID NO: 70900 - DNA, 437 bp, Heterodera glycines
  Genomic contig location: Contig_ID=SeqID_43161; Location=126..562; Strand=-
  SCN-specific regions: Sequence locations=1-437
aaaatggtgtaagtaaaatcgtaattacgctcaaaaagcttttcaaacaattttagcgcttccaattccttctacaatcgcctttatacatcccattatgagcgctaaaattatcagagtgccgaaaatcgcatgtgatctaagcctagcaaaaaatggtgtaagtaaaatcgtaattacgctcaaaaagctcctcaaacaattttagcgcttccaattccttctacaatcgcctttatacatcccattatgagcgctaaaattatcagagtgccgaaaatcgcatgtgatctaagcctagaaaaaaatggtgtaagtaaaaatcgtaattacgctcaaaaagctcctcaaacaattttagcgcttccaattccttctacaatcgcctttatacatcccattatgagcgctaaaattatcagagtgccgaaaatcgc

SEQ ID NO: 70901 - DNA, 989 bp, Heterodera glycines
  Genomic contig location: Contig_ID=SeqID_9297; Location=427..1415; Strand=+
  SCN-specific regions: Sequence locations=1-203,226-430,457-578,600-989
  Gene Ontology: Mol. function=RNA binding; Cellular component =cytoplasm; Biological process=pole plasm RNA localization
atgccaaccgaatttaaggtgcccaaattcaataagtctgacactcttgtggagtttcttttgggtgagaatggtgccggtcggcgggaattggaacgaacgaccgacggaggttatttataaattaaaacgaaataagtattaaaaagacgaagcgataatgcccaaaatcataaatttcacaataaattctcatctttattaaatatttggcagaatattggaagacgcggaaaacgcttgtttttgtggagcgaaaacggagctcggacatgttggcaattgcacttcgacagaacaacatcagggcgttgagcatcaacaggtcgggaaagagttcgaccatttcccgattctccctttgtttcagtgaccgaactctgaagcagcgcctgggcgctgccgaagactttgcctcggggaaaattcttgttctggttgccactgatgttgctgctcgaggactcgtaagcattgcttggagttgtcctcccattttgcttattttctttcagaattttccgggagttgaaacggtgatcaatgttgatctgccggaacaggacgcctatgaacgggtgaggagagggggcgggaatctcccagaagagcaaatttaacagttcgatggggaaactttggatatgtccaagtttcgtttcgaacgtccatttctttttatatcttttaacaattgttctctttcagtacattcatcgcattggtcgtaccggtgcgtcagccattcccccccccccccattttccccgttaattcccatctttaggccgtgtgggaaatgccggccacgcaatttcatattttgacccggacagtcccagcgaccttcaaaatgccggcgaatacgttaaggtggtgccgttttgctttagttttgttttattttatgtttccattttcagattttggagaccactggtcacgaattgcccacttttttgcttgaaattgcgaaagggcaaaagtga

SEQ ID NO: 70902 - DNA, 1696 bp, Heterodera glycines
  Genomic contig location: Contig_ID=SeqID_9298; Location=787..2482; Strand=-
  SCN-specific regions: Sequence locations=1-649,671-780,802-1309,1332 -1423,1447-1696
atgaaagaattgtcggcacaattgagacagtgcgaaagagaaaaggcggacctgacgaaaaaggcactgattttggaggagcaagtgaacggagaagcgaaggaattcgaccggaggtttagggagagagaccgaattcaaagagaagtgatggaggacaatggccgactgtaccaaaagtgagttgacatgggaagagaggggaggacgacgaatcgaatcggaggaccattcagaaaagatcagctggaagaggaatgccgaagcatgacggaaaagctgaaaggggccgaatcggaaattgggaggagggaggaaaaggtaaaaaagagggggggggggacggatcgggggaaaactaagaagggggagggaatgatgtaaaaagacggagaacagcgaagaagcacagatcaaagaactcgttgatcaaattggggacaaagagcgcaaaatgagcgaattcgaagccaaaattggccaagtggaaagagaaagggacgaagtggcggaccaattgaggaggacgaaaacgcattcgcaccagggggacggacagccgatcttctcttatcagcaggaatagggcagcagcagaagagcaaacacattgtgatcaatgaaattatattaattgacaatcacttttctaaattattatggcattttaaatgattgttccgctaaaataattttgccatgcgattgattcagattcatttaccaatagccttttaaattcttttacccatttttggaatttgatcacaattttgcgtaaaattctactgattgattggtctttccgtcatcctccgatgtccgttagcccatttgtcagatgatttttctgttgctgttgttggcgtttccttcttcggcattccgaatgcgaagatggcatcaaattgcccgtctcacggaacctggaaaatgaatatcgaatcgccatccgatggaaatggggggggggaggacctggtgatgattttggagacgcatccgtgcgaaatgcacaactgtttggagatggcattcaccttcatgcccccgtggaacagatgaatgatttgggccctctcctccatgctcagaggtcgacctgacattcaaattacgaagtgattttcatgcctttccgttggtcgtgaacctggacaatacgagcgtccgtacagatttgtgccgcggccggaagctgaatcaattgtgtgaattgctttgcatttctcagcacgccctccatcgcgcattacccttgtcaacattgcgctttcttctcatcctcgtccccaaaattgggccaactttggcgttgacattttgcgatgacgaggatgccatcttcgaggagtatttgtgttgctgtagctgatcagcacaggagggagtgaccatcaaacggtagtgctgctgctggaataatgggtgcagcggcatttggtggttgggcgggagggaatggtgcgggaaaggtggcgccagcgaacacggcgtaaagggaccgatagaggaagcggaggacgacgaggcggagcagaacgaggagatggctgaggagcagtgccccgggctgacggaggagtgcgacgacagacagtcagaagaggcggatgagccgagcgcatcccaacggcccgggggactttttaggtcggcgagagggtccaatgttaaaaagggaggtgcggcttga

SEQ ID NO: 70903 - DNA, 173 bp, Heterodera glycines
  Genomic contig location: Contig_ID=SeqID_43164; Location=125..297; Strand=+
  SCN-specific regions: Sequence locations=1-75,117-173
taggtgttactgtaatattcggagcttgggttatctttggcatttccgttactgaacttggtttaggcattgaaatttcacccttgaattttattttttgggttggttttacatttgattcgaaatttgtttttggtacttttggtaatttggtagtatgtgaaatggtatga

SEQ ID NO: 70904 - DNA, 61 bp, Heterodera glycines; identical to SEQ ID NO: 66666
  Genomic contig location: Contig_ID=SeqID_43166; Location=302..362; Strand=+
  SCN-specific regions: Sequence locations=1-61

SEQ ID NO: 70905 - DNA, 702 bp, Heterodera glycines
  Genomic contig location: Contig_ID=SeqID_43170; Location=304..1005; Strand=+
  SCN-specific regions: Sequence locations=1-161,183-443,465-702
atgttatccgaggacggaagcagggacaatcaaatggtaagcgagcagagaaatcaaaattcctagataaaaaaacatttttaatttaggagcgaagtcttgtacgtggagttgaaggacatgatgatttgtcgaggcgaatcggctcgctgtcgctgcgcacaatccatcaacaacaacctgtcacactaccagcttatcgtggacgaactggaccgttggctgatggacaacaaccaactcaatcggcgggacgtcgtcgaacaagaagaagaggaaaacgtcgaccactcaacctggtgaaggcactgtgtcgtttcaacgggggctgcatgccatcagttttgccgcagatgattcagaggagaagaatggaaaatttgggttttcttcgtgatctcaggctgcaaacagtgcatctgaagaataacattatgatttccgccaattcattttcatttcatagtgccggcagtttgcttgcctaccgtggctatttgtccataacggtagagcagcacttgtacgttcgccaccgcgttcgtcttagatttcccttcctgccctgtgttgcgcagtatgggggaaatcaccatcattattattttccattagaactgcttgaaatatgttcacgtccaactgacgaatcctcctaatctactcatcttccgaaacttttattgttagttattgtgaaaa

SEQ ID NO: 70906 - DNA, 1333 bp, Heterodera glycines
  Genomic contig location: Contig_ID=SeqID_9300; Location=1507..2839; Strand=-
  SCN-specific regions: Sequence locations=1-261,293-314,336-734,756 -902,926-1082,1105-1333
atggttgctgttcgccaagctctcctcgtctgcatcccattgcttttcattgtcctgaatctccctcctattcatctgcagttgagaattggatcctcgggctcatacaatgcatggatccaaggatcactaatacgtggatcgaaaaatgcgttaaaatctgtattagtcgtatttcagatttaaaatccctaggaattgacaaaaatttcacatcttttcgatgtactgaataaaacaatattaaaacaaaaatcatttgcaactttaaaaagaaaatttgttgaaatttcttacaaaaaccgtactatttcatttatagaaacccaaaatatttagacaaggaagtttttttaaaggcatttaatttaataaagccaaaaatccttggcatcactgtggaggtagatatattgatttattgttctgcggaccaggaacaaagatccatctcgttggatcatttttgatcatgattgttatgcataggaatcaatttgagcttcagttatatatccgaatatatatccgttaaagcatggatcggtgtgctgacccgagcatctccgatccttttaggaatacggctactggactttggagctggaccatcgtttggtggcttatgacggacggagacgagcaatatcggaaaacattgaaggaatagcaagcgatatgggcacagtcgcaggaggagccgcaggatttggtgccttagttgccacaatcattttacctggccttggcctggcagccgctccgctagtgggtgcggcagtcggatcattgattgctggtggagttggagcaatcggaggatttttttacaattttggtaaatcattcgcctgtcatgtgagtaggggggggggtggaatggagcagaaggaatccagggatagaaaaagaaaagcatggtggattatgaaaatgtttaatctctttttttatgatttttgcgagagcggaatgcaacttgggggtcggcaccagggccgttgcggtgccaaaatttgttaaaagttttcgccgaaaaaatctgcaaattttgcgcataattttcttataaaaaaagtgatattatgccataaaatttcaaaattgtctgcatcgaaatccccgaaacgacatggccccgaaacttgatgagattttcgtttaagaccagctgtccgcatgaaactgcatgttatcgccttgaaagtgatgtttcatggatgtgctgcacacaaaatttaagacggaaagttgtcaaagattttgccgaggtaatatgtaaagtgttgagaagaaataatgtttaaatcgcaatgataactggtagaataaa

SEQ ID NO: 70907 - DNA, 167 bp, Heterodera glycines
  Genomic contig location: Contig_ID=SeqID_9300; Location=164..330; Strand=+
  SCN-specific regions: Sequence locations=1-167
ctttagataattattttttgctttttttgaaacttcgattgcattgattgtgaaccgtgtcccttaaattcctttcttcctcgacgtgtctcgcgcgagttcggctaaaaataccgaaaaagctgaatatcaaagagcaattcaaaacagtggcaaagacctttctg

SEQ ID NO: 70908 - DNA, 461 bp, Heterodera glycines
  misc_feature (390)..(390): n is a, c, g, or t
  misc_feature (399)..(399): n is a, c, g, or t
  misc_feature (442)..(443): n is a, c, g, or t
  Genomic contig location: Contig_ID=SeqID_43173; Location=56..516; Strand=-
  SCN-specific regions: Sequence locations=1-320,342-461
atgttcggcataatgtgccgtccggttctcttcatggtatgtgccttcttcgtattgttttttgtttacgccaccaagcctgaactgttcatgcccaaccatgccccaaccgatgaaaacgaaatcccaaacatcggaaaagctgaaccggatgcaattggccgttttggacatgatcacccgcgcaactcggacacggaaacggaaaagcccgcgcacggattcggtatcagtcccgaattttaacccgttttggcatttttgtagccaattttttgggaaatgaaaatggaaaggccaatgacaggattaagacgtggaaaaaatcatgaaaaatggttaatcggcttcatgtccttgttcaaggacgtcaaaaagcaaggacaggangaaagactntggaaaaccatgacaaaatggttaatgagcttcgtgtcctggnntcaggacgccgaaataaa

SEQ ID NO: 70909 - DNA, 1038 bp, Heterodera glycines
  Genomic contig location: Contig_ID=SeqID_43174; Location=132..1169; Strand=-
  SCN-specific regions: Sequence locations=1-1038
atgacaaccacgacaaccacgaagacaaatccatggacaacaacaagatgggcaccgatgacgactaccaagcaaagatggactccaacgatgtcaagcagcgcatcaacttggacgacaagacgaacccgaatccaatacgtcacgaaagcaagaagccaacaaacggatgcaacgacacctcccggcacgatcaaatcggcaaaatcagcaaaaagagacttgggaacgaaccgtgacggagcggacgttttctggtgttccgacaggggcagtacgatttgggaactcaagggcacggaaaattcacctttctgccgtcccccgccaacactcactgctcaatggcacaatctggcaattgagctcttcgcaaaagtcatcaagccagagcaaatcgcattcgcatggcattgctccatcaaacgtaccagtgaacgttattatacaaatttgttggccgataagttcgtcaccattgagaaggaatttccaccggtcaacaagcggatctgcaaacaaatggccattcaccaggaatgcccattcgccaagtctgaaatgacgaatcacgaagcacaattgtggtcaacgaatgacgaattggaagtcaacttccctggaccaatcgccggacttttcaaaggcgaacaaatcagcacggcgacaaactgctttgctcaaccagcaacacttttcgtaaaacggcacaatctgcagatgttttcgccagtccaccaaattcagaactgtcaatacgcaaccgaattctgccaactgcccgacaactcaaccctgatttggaaatcaacctgcaatggcaacgaatgccaaacatgcgactacgatcgagcggaaatcatcagcggaaaatttaccgcagcttatggagaaacagtagccacttggatctccgaagatcaccaaaaggcattaactttcgccaaaaatgcgccagaactcatcgcctgcgatggcacacgcatcgtcatgtccgaacagaacttcggaattgccaaggagcaatacgacgacatt

SEQ ID NO: 70910 - DNA, 796 bp, Heterodera glycines
  Genomic contig location: Contig_ID=SeqID_43176; Location=579..1374; Strand=-
  SCN-specific regions: Sequence locations=1-214,289-537,571-632,654 -708,737-796
atggagctgaaggaagaaagggaattttgggcatttttccgtcgcctgctgcgatattttctcagtttagaaagtcattttatggcggcagcagctcatcagacgaaaatgagacaactaacactgaaaagcatgcgagctcatcaagtaatcatcgccaagggcagtgcaggacagggctctccgttcttggctaatcctaaggacaatatccttaataataattttaaatttagattttttcaaaataaatatttttaaaattcttttttaaaaagatttttttttgtatttacggatgagtatgtaaatgttatacagtcatatctttttgtcaattccttaggactatatagcttgactttgggataatgctagattatcctatttacatcctgtagattattgaccaacgaaaatttttaatttctatttttttaatcttttttcagttagaaaaacttctaatttaacaactaattaaacacaaatccaaattaacattttcttaaggctcgccaacaacagagattttgaaagaaagaaaagaagcagaagaagaaaaagaagcggataaacaaaagtcgctgcagacggaagttggagaaacggaagaaaattgggacaatttatttttggaaagaaaaacaaaatggaactgccctgaaaaggcgaacgacaaacaaaggtggacataaaaataattggattaaaataatgaattaaaatataaaatggacgaaaatggattaatccgactcatggacggtaaaaaacggaaaaaattgccaataaa

SEQ ID NO: 70911 - DNA, 479 bp, Heterodera glycines
  Genomic contig location: Contig_ID=SeqID_43179; Location=451..929; Strand=+
  SCN-specific regions: Sequence locations=1-165,200-209,231-286,325-479
gtcactcaatggcacatcaaattaccttttggcacttttctcctttttcgaaattcttcaccaatttggccattttctgttcgtttacatcgcattttatggacaaaatttaattgagtatcgtttggcagcaaagattgtatttatctcatcacttggttatggtaattttaaaaattttaaattttataaattatttggcaggtgcaatttatatttcaatgcttttcactggcgttgaccgactaattgtaataatttttgacgaaatgtatgcaattattgcttattaaaataaataaattaatttaatttaaatttataggaacaataagcataaaattcgtttgtatttggcaactgtcacaattatgtctgctttctgcggttgcatttctactgtttcactgtaccaagatgcacaattgcatggtgatttgatgatcaccggttgcactgtcgatttttttatggtttaa

SEQ ID NO: 70912 - DNA, 695 bp, Heterodera glycines
  Genomic contig location: Contig_ID=SeqID_43181; Location=7..701; Strand=-
  SCN-specific regions: Sequence locations=1-109,132-169,204-695
atgaattctcttaaacgctttcaactcccggagcaagggacacgacagcaagaggagttggattcagttgaaccgaaacacatcagcgatgtggtcaacttcaattcggccggcgttttttatgttttgggaaaagtgacaaatatgcagtaccgtgtttacaaagtccaaattaaattaattaattaaattattaattttttctagtttaggcatgcccatttcgttccaaggggctcatttgccgccgaaaattgtccgatgataacatgtgtgaggcgtgcggccaaaaagcgattgctcccatccacacggtgtttgttcgtcttctgctgcaggatgttgaacaagcagacattgctcaacgtgtcaccatgttttcgagtgttgctgaagagtttttgggaatgaaagctgccgaattgctagccaaggagaaggagccggaaagccttgcgaaacacttggacgatttgattgctgtgaagataattgcgaaagttaacattaaggttttttgttgctatttattatgtatttgacaaaccacgccctaggcgaacaatcagacgtacactggatttgattggattgtcaatttgttcaagaagtgcccagggaatgatgacagtgatgtgccaaaagaaaaaaatgatgttgaagggattgcaaccaagaaggccaagaaaaattga

SEQ ID NO: 70913 - DNA, 3315 bp, Heterodera glycines
  Genomic contig location: Contig_ID=SeqID_9302; Location=1273..4587; Strand=+
  SCN-specific regions: Sequence locations=1-193,216-762,784-902,924 -1223,1245-1544,1572-1579,1601-2058,2080-2450,2472-3315
  Gene Ontology: Mol. function=extracellular matrix structural constituent conferring tensile strength activity; Cellular component= collagen type XI; Biological process=embryogenesis and morphogenesis
atgtttcaatttgcgctgtttctgctgttactaattgttgagttcgctgacattgctaatttatttcatttgtctcagttggaaaattccctcgggcaattcccgacgagtagcacaactgagaagacaatcacagaatatgtgccgtggctttaccgattcggtcaaaagctaatgcgtgagtttaagagacaaaaaatttaaaaattaaatttcgatggatcaaaggatttaaatattttcagcgtgccaagacaatattccatcggacgaatgtcagaagcatgaaaatgattgccaagtgattgttggaggggggggggaagcatagaagggatagaagaagcggtcaatggcaactcgtacaaaaggcaactcgtattttacaaaataaagcctaagcctaggcctaacctaagcaattgtacgagttgccctttgagttgccatgacaccgaagaagcgtctgactttccggaccaatgttttaccagttgaaccactgagactgcagtccatcacagaggggggggggactgattagcgagagactaattggccaatcaaagggtgactgatttgcggggaaagaatgggtccatcattttttaagtgcaactttccattccctctttcccaggataccataaagcgccgagagatggcattgttctgttgtggcacctgccgaactttgtatccgaattttttgccaaaacaatcggggagaaaataaggcaaatgcaaaagttgtgaagattatttcaatttttattttcattgcagaggaaacatcagaagcaattacgagaaagagcagataaattaaaatggacaaattttcttttattgttttattcacagggcgacaaaattaacaaagcaaatgaaattttatgataaaatgttacaatttctgggtttttatggtctaatcgcgagaagaacaaatcgaagtgaatgcaaagaaaggaaatgatcagaaaaagccattaacaagaaaaagcgagagataaacaaacacttgcaacaaaacaagaaaattagtgaacttttgataaaataatttctgaaattcaaaaagtttgtcatttcatcatttcttagtgctttttcgcgatttttgagtcatttaattttggggcgccggcgatgccgacagacgccgccgggtaacaattggaaattttggcctttttcaaaattcctattttgtgtctgtttggattaaaaattaatacattgaatgacggtctaactcagttgggcgcactccaacttttgatgctgctgctgcgcattgtgcagaatgtgctaattaattctatggcttatttggccaattgagcgatgaagcgagcaaaaattcctttgattttttgttggcgattgttttgcgtgaaattgtattttgataaatcctccaatgccactcctttgcctgcttcgcttcccttcccttgtccatatggcttttttcccatgctttatcccatgcttttcctccatttccctgtgcctcccctcggggcttacattccatgccctccctcccccaccccacccttctcattcatcccgttttcgcttctctttttgcctctcctataattcgattattctccccgtttatttcccaaaagtgccgcgccgtcgtaaaattccttcgtcacttttttcgccaattgcactgcgcattttcgttaattttttcacgccattctttcgagtttttcaggaatttccgtccttagccgcgaaagtgtgtttaattggattgacgattttagcgaagaacgatgtgcttttgttgtgttgcactgaggcggaatcgtacacagcggcggagcgaaagtatttaagcgacaaaggcaacggacagtcaccgaaagagtgccgaaagaacgaagaaatgtcggcacacgcggcaacgagcggtgccatcgcattcagtggagcaacagtaagttaatggcaaaaaaggagagggagggagtcaaaaatgggaaagtggcagagtgatcagcagtgatcagtgatcagtcactgctcgttaagctcgtcctttgtttgggctctctgttgtcggtgtacaacgaaatgcaaagcatttggggcgaattggacgtggagatgagtcagttcagggtgagagaagagtgttttgtggcaattggattaaaattaaatgtaggcccaagcggacggactttgggacgatttgctgacaatgggcgcgggcacttcctcaaaccgaaagcgacgagcagcgatcgaaagtgcggcggaggacgacaatttgccgaccaatcgaaaccgccgaaatgggtacagcgtcgcttctgctgttcctgcacctccttgcagtgagacagtgaaccaaactcgtaaatgccttaaattcataaagagtgcgaagcgatcaatccatgcccacacggagcggccgggccgccgggagacaatggcccgccgggactggcgggaatcccgggaaaagacggtttttccggggtggcggcgtcggattggcacagtgggccgttgaagggatgctttgtgagttggtcccacttgacgagttcattatattttcttacacaaagtcctattcagaattgtctcgccggtccgcaagggaaccccggcgaggcaggacgacccggggttcgtggaatgtgagtttggaagaagacaacacttttttgattggcgaacattaatttccaaaatgtgtaggcgtggccccaaagggtcgcctgggatgccgggccgtgacggagtgccaggactgcccggaatacaaggggacgaaggcgagcagggcaaggacggattgccaggaaagggcggcgaacacggacaggacgctgaaaagccaatcggacgacgggggccaaagggcgcaccaggagaacatggcaatgaaggaccggtcggaagcccgggcaacccgggacccatcgggaaacagggcccacctggtcaattgggaccgcgtgggttcgaagggcccccgggggcggacggagacgaaggcggacttggcacgggagggaaaatcggaagagacgcggcttattggtcggtttgggcagcaggcacaaattcaagacaaaggataacactaatggcattcattcagtccatgcccgggccgagaagggcacaaaggccgagggggcggcgcagggatcgaacacggaggggcacagagagaaggcgaatacggcggaaacaaaagtggtggcgcatatcgccgaagggtgcactgatcggaaaagcggaggaaaaggacgaagaaacgataaatga

SEQ ID NO: 70914 - DNA, 251 bp, Heterodera glycines
  Genomic contig location: Contig_ID=SeqID_9303; Location=132..382; Strand=-
  SCN-specific regions: Sequence locations=1-78,102-189,210-251
atgtgtacttttgtgggtgctggagaagactctgtatcatataaaaggttggatacgcactgacactggtgagaaaagagaggaggaggcaaagggaaagggcattttggacaaatgccattgggagacaattaaatggagcaattaacaactgctaattaatcaacgatgatccaactgacaaaaaaaatatatatatatatatatatttaagcaattttaaggaattcgaaaacttaagaccaaaaaaa

SEQ ID NO: 70915 - DNA, 388 bp, Heterodera glycines; identical to SEQ ID NO: 51536
  Genomic contig location: Contig_ID=SeqID_43182; Location=653..1040; Strand=-
  SCN-specific regions: Sequence locations=1-20,42-275,297-388

SEQ ID NO: 70916 - DNA, 415 bp, Heterodera glycines
  Genomic contig location: Contig_ID=SeqID_43191; Location=391..805; Strand=+
  SCN-specific regions: Sequence locations=1-214,238-415
atggttgccaaaacgcgtggatggcccagctggaaattttacgattatatgcatagccgacttggtcaacgtggactttttcatcaagacactgtgcagctgatgcgccaaatcaaagcaccattggatttggacgcatacgacgccgacacgtacgtacccctggtcatcagccactggaacaatgctcaacaacagcagcagcaccgttttgcactgttcatttttggaagcaccggacactacaagccaatctacaagtatattgacagcacttacgacacaccattggttttatactttaacaacaatcatttcgatggtgtacacttcctcagcggactctttggcggcaaaaagtattgtctggagtgtgagaagccttacaagaagccgaaggaacacatgcaatcat

SEQ ID NO: 70917 - DNA, 668 bp, Heterodera glycines
  Genomic contig location: Contig_ID=SeqID_9304; Location=397..1064; Strand=+
  SCN-specific regions: Sequence locations=1-668
atggtgaaattggaaaattcgtggattgatgcaagcaatcaagaaagtccttacatttctacattagcttcttcgggtctagcggcatttcacaaaaaatttcggcagctttatgggcaacaacaaccaactttaatcagatgtgcggcttttttggatcctaatatttgtgcagttttgccaaaaatcgttgcgactaacagcaattggggcaaagttgcagaggtaaacgttaagataaatttaaaaatgatggaataattaagatttgtgctaccataaaaacagttgcacaaataagacaccctgattgtaattcattaattcctcggccttgtacttcgccaagtctttctggttttgatcgttctccgagagcagcgattgacattgaaatcgaccgatatatgaatttatgtgacagtctttttatgaaaattgatccattaaaattctggtccgaaaaccagaaatccttgccaattcttgcatctcttgcgcgcgaatttttgggcattcctgcaacatcagtgagctgtgaaagaattttttcccgatttgctgctttaatagttgattttcgtcgaaataaattagacccatttcagatttcccgtcttattactcttcaatccctatttcgtgatacttaaattgtgtatcattta

SEQ ID NO: 70918 - DNA, 494 bp, Heterodera glycines
  Genomic contig location: Contig_ID=SeqID_9304; Location=1105..1598; Strand=-
  SCN-specific regions: Sequence locations=1-428,451-494
atggccaaaaatgaaattttagcgccgaaaaatgttgaaaaagaatggcaacaaaattatgccgaaatttgtaagaaaattggagtcagccgagacataattaacaaatggaagaaacaatttggaattcgctgtaaaagaataaaggaggaacaaaaaatagaaaaaatgaaaatttattgggaaataaaaagtgaaaatccaaaaatgagtgatagaagaaataaacgaggaatgaaaaagggataattaaattaaaaattgtggcattttgttgtcctcctttagccttttgaaaattcctatttttaggggcgtatatagagaatgacaaatcaacctttttattactttttgcggagaatcaacctcaatgttgatatttaattaaatcaacaaacattacgccatcaacttaaatatcaacgtaatttttaaaaatttaaaaatgaattccattatttatttattctcgttgaataatttttaataaa

SEQ ID NO: 70919 - DNA, 1264 bp, Heterodera glycines
  Genomic contig location: Contig_ID=SeqID_9304; Location=1957..3220; Strand=+
  SCN-specific regions: Sequence locations=1-19,55-102,239-284,306 -778,820-1264
atgaaattatttccgctactattattaattatattatttttaattgtaaaaattggatcagaaaagaaaaaattgcaacaaaagtcatttggcgaaatatttggagaaaaatggcaagaaaaagaagaagaaaaacgaaatgaactcaaaaaaagagaaataattggaaaatattataaaataaaagagaaaattaagcaaaaaggaagaaaatactcaacaaaagaatggaataaaattgatggaaaaatagcgaaaaaattggggacaaatagcaattatattcaaaaatggatcaaagaatttggtcttcaaaaaaagaaatgctataaatcaaaaactgatgaagaaaaattagaaattgtgcaaaaattcattgaaatgacaaatgaatataagcaaaaaaaaaaatattcgcacatcgaatgggcaacaaaattatgccgaaattggcaagaaaattggagttagtcaattcacaattaaaaaatgggaagcaacaatttggcatacgctataaaagaataacggagaaagaaaaaatggaaaaaataaaaatttattgggagaataaaaagcaaaaattcaaagatgcatgataaagaatttgccaaaatgatggaaattgatagaacgaccatttcaaaatagaagaaacaatttagaaacaaaaatgattaaaataaaaaatttagggaatttggagaattattttcgaagaacagcagaagaagagtgattattagttggagcatttctttttgaaaatttcgcatgcaaattttaatttttctttattttttattttaattaatttttgaatttctcttaagtttttttgtggaatttagatataaacaaattttgaatacgttttatcaattaattgaattttaaaattcacaaaatacttttaaagtaatattatttccacaccgatattagggatggggagggaacagggctgggcgcaaatgcggattacggaaattgcggggtttttggagttgaggattacggattttttggatttttccgcaattttgatccgtaatttgacttttggattagttttcgagactaacaccttaatttgggtattttgcttagaaaatagcggcattctttttgtcgcacctattcatattttatgaaaattcataaaaccatagccatgggatggtgatgaattccctccaccaaaatgaaaaatgaaaattttccaggaaaaattggcatttttttaatttatcgatttttctta

SEQ ID NO: 70920 - DNA, 111 bp, Heterodera glycines
  Genomic contig location: Contig_ID=SeqID_9304; Location=3590..3700; Strand=-
  SCN-specific regions: Sequence locations=1-111
atgacagtcctggtaataagctagtaaataaaactataataattaggtcgaggattcttatggatttccatttgaaaattaaaatttttttactttttttgttgaaataaa

SEQ ID NO: 70921 - DNA, 634 bp, Heterodera glycines
  Genomic contig location: Contig_ID=SeqID_9304; Location=3833..4466; Strand=+
  SCN-specific regions: Sequence locations=1-229,251-279,394-522,559-634
atggttattaattacattaagccattaactcgtcatctatcgattgaaacaccggccaatttggctgatgccttgggaatgcacactccaaattgggctttttatcactacagttcgcccaattatcggtcagcgtggccatggcgaatgttccgtgaccgtttcgatgtaagaagcaattggcaaaaatgcaaaaccaaattaaatgcattttttggcaaaaaatcgtcataattttctcgaaagtaatcaaaaaatcactatatttttctattaacctaataaatttatgaaaataaattattttttattaaaattattttaatttgcttaaattttaaattttactttttactttattaatgaattaattaattaaattacaaattttatctagtgtgaacaaatcatgtacaataagcacttttctgtgcagcccatctacagaaataattaactttaattaagacgatcaaaaaataattaaagtgaataataggcatagtttcatattaattctttgattggttcttaaatttattatattatttgggtgatgtaattccgtcacaaaaaatgtcaattcaaatttacgcaaaaagaaacataatgccaaagaaattttttattgtaa

SEQ ID NO: 70922 - DNA, 342 bp, Heterodera glycines
  Genomic contig location: Contig_ID=SeqID_9304; Location=4823..5164; Strand=+
  SCN-specific regions: Sequence locations=1-342
atgattcgtaataaacttgaaattctacaaaaaagtcggaagaagcgttatttgtcagacatttcaaacacaactgaggaggccgtgaatttgggagtgaaattcgtcgaaccgaatgccgtgagaacttctgacagcgttgaacaaccgaatttgaaagaggctgaggtctcaacaatgacttttgagcgcggaaaaaccaattttgggggagattgcctatggttgaacggtatgtttgaagtgccgcaaaaaatttaatttccaaactattcaggatttgtttcacacacctctcaggaaatcgctgaagatgcacaaatcgagttgctcatcatatga

SEQ ID NO: 70923 - DNA, 196 bp, Heterodera glycines
  Genomic contig location: Contig_ID=SeqID_43192; Location=125..320; Strand=-
  SCN-specific regions: Sequence locations=1-140,168-196
atgacaatttcaccgcccgttgagcgatacattgacagtgtgtgcgatttgggaccaatttttacggaaattggccaatctctgagggcacagaatcatcagccgagttttgtgctgacaccgaccggaaacattcgaagggccgagcagcagcagcagaagagagaagtggcagaaaacagcgaagagaacgcag

SEQ ID NO: 70924 - DNA, 853 bp, Heterodera glycines
  Genomic contig location: Contig_ID=SeqID_43192; Location=466..1318; Strand=-
  SCN-specific regions: Sequence locations=1-50,72-181,207-449,471 -537,559-853
atgccccatttttgctaaattccaaaaccaacaacaagaacagtccacccattttctgcccccaccaatgacatcaagcagtggagatgaatggcaatcggcgtatgaatgtttgccgcaatggacaaagcaaatgccaaagatgccgccagaaacggcaccaaagccacaacaagatttggtaaaaaatattgctgtttaaatttcaaaagtgatactttttagtcctcctctttcccatcgttttgtgccgcgtcttttgccgagtccgtccaatgctccgtcaatctgtgcaaattccacgcatattcacgacaattggccgcaaaaagcatatggccaatgagtgattcacaagcggaaatgttccaaagtgttgtgagcgttgagggtaaagcaaagaaaataagaggaaattataattagtattaagattagtactgtaattagtatttgtgttgggttctgtcacgccgacaccccaaaatgagaggatcaaacactgacttttcgcaacccaaccccgaaagcgcttcctaattatttttaataaaaaatgtatgaatgactagtgaatttttttaatttaggaaatcaaaggatacgacccattttgaacgagtcggcaactttctccgagcatcaagcgaatgacgaagtgcgcaatttgatgggtgcctcgggcaccgtttcccccccggcgcaaatgcacacttcgccagagacacaaagtgattcaaatattaccagaaatacaacaattttaaatttggtcagatcagcaatcggtgagagtggaattcagcggacccgtcaattttttgcacgcgacaaatttaaatgtgacaaataa

SEQ ID NO: 70925 - DNA, 56 bp, Heterodera glycines; identical to SEQ ID NO: 52733
  Genomic contig location: Contig_ID=SeqID_43193; Location=202..257; Strand=+
  SCN-specific regions: Sequence locations=1-56

SEQ ID NO: 70926 - DNA, 408 bp, Heterodera glycines
  Genomic contig location: Contig_ID=SeqID_43195; Location=72..479; Strand=-
  SCN-specific regions: Sequence locations=1-91,113-127,149-197,362 -366,389-408
atgtttaatttttccatcccagatgagttcgacaatgtcactctgatgtactccaagcatgagaagatcccgatgaaggacttcggctcggagatccgtgccaccatggacattgaccatctgctgaacaaggcagtgctgctgttggacttgcaggagacgtcattggaggaaatttttgcaaagtaaaaaaaagcattaaaatattattatttttttaatattcgaattaaattttttaaataaaattattttaaaaattatataaatattgttttattaaatattccaattaaattttaattttagtaaaaatgaaagattttagaaaaattttagtttacaaagaaaaaaaatttttggaaatgaaaaatatttaaagcataacttaaacacattttaaataaa

SEQ ID NO: 70927 - DNA, 375 bp, Heterodera glycines
  Genomic contig location: Contig_ID=SeqID_43197; Location=53..427; Strand=+
  SCN-specific regions: Sequence locations=1-375
atgtgcgtcactcttcccttgcattggttgcccgtactggatccgctggtatcaattctctgtgtcagtgactaccgtaaggcgctggccaatttcatccggtatacgatatgcaggagacaaaatgccgttgcacaacagcaaattccgatgaatatcctccaaaataacaatcaaaaagcgcaacttcctattgttgcgtcataattgcacaggtgaattctttgtctttatttaagaactaccaaataatatgagaacgattcaagttatgcgcgcaatgttcattggtcagacattaaaattttatccaaattcattgagtttaaacttcttattcagattttgaatttttcctcgtttttttttattaaa

SEQ ID NO: 70928 - DNA, 1074 bp, Heterodera glycines
  Genomic contig location: Contig_ID=SeqID_9305; Location=1339..2412; Strand=+
  SCN-specific regions: Sequence locations=1-118,140-268,295-732,756 -995,1017-1074
atggcgcaaaaaaagggaatggaaattgtcaatcgctttggaaaagcattgccaattccgaaaatccaattgcctcgtaaagtcactggatttgagtgcatcaagatctcgtaaatacaaataaaaatcccaaaatttatgttggcggcgcctatcggcagcgccggactcaaaattttcaaatttttatccaaaaaacgcaaatttttaggaaattattttaaataaatcagtaaattcaaaaatttttccgttagaattatctatccttcaataaattattgaaaattttttagtttaattgaccgcaatgccatcgcttttctccaacgttttcgccaccttttctccgtctgtccaattaatttgatcaccgatatgttcagtgagcgtattttggagtttattttgcaaaacatttggccaatgatcgcgaaaaatatttgtgcgatatatttgatgaagtacactttccgacatttgcgtaaattcgtcccgacaattctcgacgattgtccatcacttcgcattatctctttccatgccggtgtcgactatttcttcaccgaatttccgcccgatgacagtgccatggcatcggatggacaagcgctggctaaatggcttctcattccccacccggacgatgtgccaaaggtgctcaaatgctggttgaacatggaaaagggaattggccgttgaaaattgcagcgttcaaagcggtacataccgtaattaattaaattttaaattttctcgattttatgcatttgtcaatgcttcatctcatgccaatttcattgctgtcgtttggtgtcctccgtcttttgctgactctgttgtgccatttgatctgaccaacgaattgactcgggaaaaactggcgcttaaaaaagtgactgtttccacccttttctgttggtccgttgtccaattgcgcgagacgcgagcaaatgggcaaaatgggaagaggaagcgattggctggtatattgatgatcaatggaatcaaattgacataaaaattttcactgacggcgacatcagggacgggttagcgaatgcttattaaaaa

SEQ ID NO: 70929 - DNA, 792 bp, Heterodera glycines
  Genomic contig location: Contig_ID=SeqID_43202; Location=221..1012; Strand=-
  SCN-specific regions: Sequence locations=1-44,69-128,157-221,244 -263,285-433,455-468,490-615,637-792
ccgcattttctggagaaaaagttcaacatcactgacacgcgcggtaatttttaaaataataaaatattgaattcctttttcttatttaaggagtttttaatcttcacgcattgccaggttggaaatggaatttaataaaaataaaaaataatatttcccggtaaatatatttattttcgttgccaattcatttaaattttatttgaggaatcattggcgttttggccagctcattggcacttgcatgctaccagaacaactcattcccggagaagtaagtgaatgccaaagattggattggaaattttttttatacgttatagttcccgaattgtgccgtccggacgttacaagtttgaacaggcattgtaccagctggcggggttgggcatcactttggcatttgccaccgttgttggcgccatcactggtgaataaataaataattttaattgatatgcactttttaatgaaaacaaaaatttatttactaattgtttaggtctcatcctgaaaatcaaattgcttactcatatccgagaaaaggaggtgagaattatgcaaaaaatatttccaccgtttttttctttctacattttcaaaagtttcaaaattatattttaaatggctttaaggtgtattgtgatgcggactttttcgaagtacccgaagactatgactttacaacgagggtatgtaattttttggaaaaaaaacctaaaaaaaatttattaccaaaatcttttaaaggttaccagccacattgaccatgtcgaactgactgagacaaga

SEQ ID NO: 70930 - DNA, 51 bp, Heterodera glycines
  Genomic contig location: Contig_ID=SeqID_43206; Location=54..104; Strand=-
  SCN-specific regions: Sequence locations=1-51
atggcgccagcagaccgagcggctaaagaaatggaatacgcactgaacgaa

SEQ ID NO: 70931 - DNA, 49 bp, Heterodera glycines; identical to SEQ ID NO: 57477
  Genomic contig location: Contig_ID=SeqID_43207; Location=576..624; Strand=-
  SCN-specific regions: Sequence locations=1-49

SEQ ID NO: 70932 - DNA, 468 bp, Heterodera glycines
  Genomic contig location: Contig_ID=SeqID_43210; Location=1..468; Strand=+
  SCN-specific regions: Sequence locations=1-7,35-39,73-154,222-357,393- 468
tgattcggtggatggtggtgcatggccgttcttccttttaggagcgatttgtctggtttattccgataacgagcgcgactctagcctactaaatagttggctcattgcttctgtgggcacaacttcttagagggattttcggtgttcagccgcacgaaattgagcaataacaggtctgtgatgcccttagatgtccggggctgcacgcgcgctacactggcaaaatcagcgtgcttgtccttccccgaaaggggttggtaaaccggtgaaaatttgccgtgattgggatcggacattgcaattattgtccgtgaacgaggaattccttgtaggggcgagtcatcaactcgctctgaatacgtccctgccctttgtacacaccgcccgtcgctgcccgggactgagccatttcgagaaattcggggacggttagtgttccggcttcggtcggtatgcagactggaaccg

SEQ ID NO: 70933 - DNA, 1591 bp, Heterodera glycines
  Genomic contig location: Contig_ID=SeqID_9306; Location=1599..3189; Strand=-
  SCN-specific regions: Sequence locations=1-180,209-277,336-457,705 -1141,1163-1241,1285-1356,1383-1465,1489-1591
atggacaattttgaatccaaagtggtcgctcagttcgggcaagttcacactgcaaaccgcgcgaacgcaaccgtggtggcacttgaccatctgctgaacgccgatcgtgacattttcagcgccggtgctgttgttgatgtatgtaagtgccatgccggacacacattggatagccgcgactaaaaaattgaaaaataaatataaaaaacacatgactaccgtatatgtacaaaaaaagactcaatctttgaaaaaatacggtagtgaaataatacggtaatttaaaaatgaattatttcgttatataattataataataataagaatttaaaaaagaatttgcttacccggaaaatgcgccgccgcgaaagccaaaaacatcgtgattttgagcagaagatgatgatacatggaagacattgtaacagagagttaaaaaagacaatttgcacaaatctaaaaataaaaaatgttattatatatttgtttaaattaatttaaataaaatttcatcaattttaggaattatatgttaatgtttaattttatgaatataaattatttcattaaaaatagtttttgcatttaaaaatatccgaatgaaaaattagattaaattaatttaaaaaaaattttcaattttaggaattatgttttaatgattattatttagttaaaatattgaataaaaatatatttatattgtttgaaaatgaattgtctattcagaaattgaatatttatagcaaaaaaatgatgggccgcctattttcgcatttgttttacgaaatatacgaaacatttttgatgatctaacaacgctgattaatgcgattggagatgtggcaaaagcgggcaaaaaggcgcaaaatggacaaatgggaaaacattattcataaaaagagggatgaaaagtcgcaaaatggacaaatgggaaaacattattcataaaaaaggcgacgaaaaagcgaaaaataatgaatcggtaaaaaaaaagatgcaaaaatgatggtgaatcagcagcagcagaaagaaggatgaattggatgggcaaaataattttttttttctgttcttccgaagacaaaaaatgtttcgaaagatgcaaatgatttaatgggaaaatggaaatttgaaattcaaaaataatttaaaattaaatggacatataaatttaattgcgaaaagaaaaacactgctcactaaatgcttattccagcagagaaattgggaagtaattgtctcattattgttattattataattaagaaaatgtgaaaatgtggaaattttaaatgccaaaattggatttaaatatgtaaaaaaatgacaaaaatgccgtagaaaattatctatctccaattttaaaaaataatttcaacgaattttttgagcaaattcgtcttgaaactattggttcagtttaaaaagcacataaatttccagtaatactcaagactggaaattttaaaattttcagcattcgaaacacaaaaaagccgagactttaactaggacgagacacgggccgagacttttttttgaaaaaaaaatttcttaatactaaaataacccgacaaaaaaaaataaa

SEQ ID NO: 70934 - DNA, 1167 bp, Heterodera glycines
  Genomic contig location: Contig_ID=SeqID_9306; Location=2770..3936; Strand=+
  SCN-specific regions: Sequence locations=1-85,144-212,241-783,805-1167
atgtcttccatgtatcatcatcttctgctcaaaatcacgatgtttttggctttcgcggcggcgcattttccgggtaagcaaattcttttttaaattcttattattattataattatataacgaaataattcatttttaaattaccgtattatttcactaccgtattttttcaaagattgagtctttttttgtacatatacggtagtcatgtgttttttatatttatttttcaattttttagtcgcggctatccaatgtgtgtccggcatggcacttacatacatcaacaacagcaccggcgctgaaaatgtcacgatcggcgttcagcagatggtcaagtgccaccacggttgcgttcgcgcggtttgcagtgtgaacttgcccgaactgagcgaccactttggattcaaaattgtccatgcgtttggacacggaacttacagtaagtccgacctctaatgtttctttatggatggtcaaagtaaccgtagaaatttgtatcagagtagtggtcccggcgggaatcaaattgaagggcaaaaacaattttttttttttttttttgggttttgccaaatttttttctcaatttttgttgaaaaaaatataccataaaaattttgcctttctcgcaacgcctattggcatccatagcccaaaaatcacactccgccccccctggccctcaattcagcaatgttttcccactttttttttttgaaaattgcgcggcgttttttgagtttgaaaggcatacattaaaatatgccgttactgggcgaaattaattttataaacaacaacaaaaaaatcctttctgccccattcagagttgtacgggaatcggccggttgcggttgtcagcggatgtgcggcaccgaaaaatggcacggccacggaatcggcagccgacattttttttgggaacggaacgatcggtgggaccgagtgcaagcaagtggcagtgtgtaccactggtgaactgtgcaatccgaaaccatcatccgcgagccgtacttcatctgctttggccattgcgtttccggttgttgtcgcgcttggtgaacaataaaatttgttgaaaatttatttaaaatttgcatattttcttttcagtctcctccatggtgtccggctatgtgcagccgttctgagatggcgtactga

SEQ ID NO: 70935 - DNA, 647 bp, Heterodera glycines
  Genomic contig location: Contig_ID=SeqID_43213; Location=125..771; Strand=-
  SCN-specific regions: Sequence locations=1-37,59-117,139-172,241 -347,375-552,574-647
atgactaattggacagacaccctgtgtttgcttgccggagcagaaacatcagcagatgaactgtccatggttgggcggacaatacgggagccgaacattcggcggcgccatttgggtggttgaggaggaggaacaggatggtgatagggtgggacctaaactcgaattcggcattttattaaataaaaatgtaaattaaaaaatatatattccatttttaaaattttgatttaaaaataagaaccgaattagagttattgttcaaataatttttagatctagtcagaaaaagggacatgggaagctttggcacaccagcgtttcggcgccaaaattttttcttatgcaattaaattttaaaatttaattattatggaaagcacttcatttttgcttaattaaatgagtttgttaccaaaatactggcgctgaaatgccaaagaattaactaataggagggagaaaaataaaaaactaaattgagaagatgacaaaattaatcaggcggatattttgaaaaaatgcatggtgatcaatcaaagattaatttttaaatcttaattagtcagataaattttatgatttatagaaatggttgatatttggagaccgtcatgacggattacaggatttttaagagtaataaa

SEQ ID NO: 70936 - DNA, 494 bp, Heterodera glycines
  Genomic contig location: Contig_ID=SeqID_43213; Location=935..1428; Strand=+
  SCN-specific regions: Sequence locations=1-141,164-303,344-494
atgaacactgctgttgtggtgcgcccacgggatcgtcaacatttccggcacagcaatgtgcccccggtgttaaacattcttgatcaggcaaccgatctgtacggtgatctttttcggatggtaatcgatccggaagggattaacggaggcagcggcggtggtgcgcaagtcataacatcagacgaggaggaatacggacgatgatagcagcagctggattttgttttttttactcttgattcactggggattcagtttttggcattaaaaattgcaaaattggcactttattggtgccaatgcatttaaaaatttaaaattaattaagaatatttaaaaaatagtttcgaattttgccaaaaaggaattcctgatcatcctttaattgattgtcttttctcaaatgattatgatttattattattcccatatcttttatctgttcctcattctgattttctgttctcttgtatgatctggatttttttattaaa

SEQ ID NO: 70937 - DNA, 321 bp, Heterodera glycines
  Genomic contig location: Contig_ID=SeqID_43215; Location=200..520; Strand=+
  SCN-specific regions: Sequence locations=1-138,184-321
ctgaaaagagttccggtggatgaatgtgaaaacattggaaaggaaaagaggccaattgcgggcggagaaacgtcgtcaaattccactggcagcggagagaacaaaatttgggcacaatcgccgcaggggaaaattggcaattttaaattaattatttttaaaatcaaaattataaaaataaatgttaatcaagccaatcgatatgaaaatgttttgcagttgttttcgaatgcggcagcagcggaactgaagaaacgaacagttcataaaaacatggaaaagtgtgcgtggtgagacgaaccgaaaatagtctcagtgtca

SEQ ID NO: 70938 - DNA, 304 bp, Heterodera glycines; identical to SEQ ID NO: 51570
  Genomic contig location: Contig_ID=SeqID_43216; Location=61..364; Strand=-
  SCN-specific regions: Sequence locations=1-304

SEQ ID NO: 70939 - DNA, 228 bp, Heterodera glycines; identical to SEQ ID NO: 65316
  Genomic contig location: Contig_ID=SeqID_43216; Location=694..921; Strand=-
  SCN-specific regions: Sequence locations=1-228

SEQ ID NO: 70940 - DNA, 1292 bp, Heterodera glycines
  Genomic contig location: Contig_ID=SeqID_43218; Location=1..1292; Strand=-
  SCN-specific regions: Sequence locations=1-45,67-855,877-891,913 -970,992-1080,1156-1188,1211-1292
  Gene Ontology: Mol. function=translation activator activity; Cellular component=cytoplasm; Biological process=spermatogenesis
aatgctcgattggatgatgcgggtaagaaagactccgctagcaatatttaataaattcatattttccccaagaaaacacattgatgcctcaaaaatcgtctcttttgctttggatgaggcggacgtaatgatcggccagcagggataccaagacaaaagcattcgcatacagaagtcggtgccattagtgggaggataaattctctcccccaccccggaaatgaaaaatttaaaatttcccaaaaaatttttgaaaatttttactcaatttcttatcggacttcattaaaatttcaaaaaaaaactttcctgtcggcaccgccggaccccattgtattaatattttttgaaaatttacaccaaaatggcagcattttttgatgcaaaaccgctacaatttctgttttcgctaagcgctaaaaatcttgaaaaatgacactggagaaaaaattttctggctacgggcctagtccttgtgtcccttttgccaccaattaattcattcccccccccctcccgatttagcgcgattatctccgctaacccatcgtgccaatgtatgctgttcagtgccacttattccgatgctgtcatcaaattcgccgaccaacttatcgccgacccaacactcatcacgtatatatttttggtttaaacatttttcaatcccacatttttctttttgttttagaatccgtcgtcaagaccaaagtttgccgtacattcgccagtattttgtgcgttgcaaagatcgcgaggacaaataccaatcagtggggccattttgatgagttttcttttgtcctgcccgttagccagggagggggcttaaatcaaaaattgtcaagaaaaatgagaaaattttttgaaaagttaaacatttccttactaaattgcattaaataaatccatgtcgtcatccgcaaataaaatttttttaaaatgtgactctctaagaattaaaaaattatgttttttggtgttgttttggataccaaacccttgaagaagtcaaatctttgggatgggtccaagtgcttaaaaagctattcatcttttccgtcctttcatcctacaccgtctctctctctctttctccttctctatcatcccttcctctctctctccatttcactctccctctcttttctctcttaccccctccccccgcgtgcgtgcgtttctctttcccttcttttgcccaccatatatctcctctcaatttatcgtaaattgtggcggacgaccgtaaaagcagccatctctttctctccaccatcgttcataaaatg

SEQ ID NO: 70941 - DNA, 678 bp, Heterodera glycines
  Genomic contig location: Contig_ID=SeqID_1258; Location=33..710; Strand=-
  SCN-specific regions: Sequence locations=1-99,130-489,567-609,636 -649,671-678
atgcatgtggattttgacccattggcggtggactggtcccactttgcggaaccgccgccgcgcatggacaccatgttgatgagtggtggagggagttcaatgggtggcggcggtggtggtggatcggcgtcgtcttaccccgtcttcaccggacttccctatcaacgcggagcgggcgggattggctcaatgtttcgcagcttccttcgcttcttggtaccaattggtagacaggcgggcgcggcgattggtcgccagggactggagaccggatcacgtgtgctctcacagatgcttgaggggcgaaatgtgaaggaggctatgacggaggagggacgtgccggacttaagaacttgctggacaaggcggcggacaatctgagcaggcagcgttccaccgcagccgctgccactaccaatcacgggggcgccggcagaggtggtcgtggtggaggcctgtttgactttaaacgttatcgaaagattgtgaataacaacaacaacaacaaacgcaagtcgtcgtcgtcgtcgtcatcgtcaacaaacaacataaaaaagaataaaaaacggcggaccggcaacttacaatcaactgttggcccctcactgtcaacaccagcagcagcggccgccgccaaaacaaaaggcgttcgttttgacgcattgggttccttctga

SEQ ID NO: 70942 - DNA, 1327 bp, Heterodera glycines
  Genomic contig location: Contig_ID=SeqID_1258; Location=2520..3846; Strand=-
  SCN-specific regions: Sequence locations=1-1327
atgagaaaactacgcgtgaaaagcacaaacaaagtcaacagcaacaacaagaatgcagcactgcaggcccaaaaacgtgagctgttggttgaaaaggtgttggatgagctgtacaaggacacgcggtccaatgccgcgttcaccagtgtggagccgctgctgcttgaggcacgtcgacaacaccccgggcgacacatcagacgggccgaggtgcgccgttatttggcccgccagcgcgtgtacaccctgcaccgtcgggctgtccgtcgtttccgtcgtctgccgacgcttgcgtcaggtctgcataccgattggcaagcggatctggccgatttcacagcgctgaagcggcacaatcgcggccacgcgtacctgttggtgtgcgcggacacattgagccgtcagctgtttgtggagccgttgaagagcaagcgctcctcggacattgttcaagcttttgagaaaatattccgccgggttggctatgtgccatggaagctgatgacggaccagggcaaagagttcaccgccgccccagtgcaacgctttttggtcgatcaagaggtgcaacaccattgcatgcacacctcaccccagtggcatgccggaattgcggagcgtgccatcagaagcatcaaggtttacccgaaatgacaattttttccctttcgttgtccatcatgtgtaacaaacatttaaggaaaggctgtaccgctactttacacatcgcggcgcaaagtgttggacaggcgtcatacagcacattgtgactgcactgaacgggtcgccgaaccgtgcattgttcggtctcaggcccaacgacattaattttggcaacgcggagcgcgtacgacgcaaccagctggagcgattagctgccggccaacagcagcgacaaagcccacgcgcccgaccccctttccgtgtgggaaaccgtgtgcgtattgaaaagcacaagcacgtgttcaaaaagggctacctgcctcgcttcactgacgaactgttcacggtggcagaagtacgcacctcacgactgccgatcacctacaagctacgggatgacgacggtgaactgctcaccggctggttctatgcgcaggatttgtgccttgttcttccgcctccacctccgctacagtcaaaaagagatgaacccattgctgataaagcgggagctgctgcttctactaccgtggggcctgtgtacgacattgaacgtgtgctgagaaggcggagggggcgcgacggtgcggagcactgcttcgtcaaatggaagggctattcagctgcgcataacagctggattccggccacatcaatcatataa

SEQ ID NO: 70943 - DNA, 1571 bp, Heterodera glycines
  Genomic contig location: Contig_ID=SeqID_1258; Location=5641..7211; Strand=+
  SCN-specific regions: Sequence locations=1-717,744-791,821-827,867 -1293,1318-1339,1364-1424,1456-1550
atgcttgtcgttgctaccgtggctgctgatgcacgtggtgcgtacaccacggtcagctccccggggtatatatgcgttttgagacgcatcagaggtcgtgtggtggggtgcatgtcgatcaacagatagccaaacgggtccgctgttgcgtcatcataggcctccagaaaatggtgcagtgcacccgggcccgggaacagctgtatgcccagggagcgaacctgtagcgcccctgccgggttcctcagcaacaccaaatagtgcgcgttgttgcgcgcgatgcgcagctctcgtgtgaacagatgctgtgtgatcaacacaacgctgacgccccaattgtgggagccacgggtgaacaacagatcaaggaacggggcacgcatgccgaccatcaggtcatccaacaccaatagcagtctgccgccgcacgctttggctgcccgcttcaccgcctcctcatcgggaagcgcgtggcaggggcggacccagcgccgccgcggttgaccccccttgtactcctcctcctcctcctcccccgtctcagtttccagttgttgtagtcgcagcacgtcttcattcacttccccataacagtagagcacacccgaaatgtgtgcggggccaaccagggtgtccaggttggccaacattcgcaatacccatttcgttttgccactgcccgtacacccggacacacacattgtgaacggatgcttgaaaacagggggcacttgttgatggcggagaggttgctcttttgtctgctgctgcttcattatgccgtttagctcttgccccaaaataaaaacaaaagacatttgacacattatatatatatatatatatatatatacatatatacatattaaaaagcaactttacccccccccccccctcccgcacatctcgcatattaacatatataaaaaagtttttagcttccgagtttttgaataatcattcaatggacatgttccggttcaaagttcataacgctgtcaaagacaccgacgacgccgccgccgactctgctgcacacgatcaatgtcaacaacgccaacagcgcgaggttgcgtctcctcgcacaatgccgttgtcgttgttggttgaagagcaagctcatgtgtcagcagcagctgaggctgctgccgaggcagcgagtgctgttgaccaaaagatgtcggcagcgccaaatgacactcccgccatcactgacacgaaaattgattttatgactgatgaacaaacagtggcggcagcgccgccgcctctattcagtgagattgaaccgacgcagcagcagcagcagaaacaacaacaggtttgctctaaattggtgtcggttatttaattttttatcaagaagattcagtggcgtacagcggaaatcatcgcaccgaaagtggagctgtccgccgaggacaatggtgatgatgatgatgatgatgatgatgaggctggacaacaggtcaaacaggaggcggacagaaacggcatggatgcacatcattcaaattgtgcaaaagggccccttttgttcattgatgaacaggagaatgaggaggaggaga

SEQ ID NO: 70944 - DNA, 1567 bp, Heterodera glycines
  Genomic contig location: Contig_ID=SeqID_1259; Location=432..1998; Strand=+
  SCN-specific regions: Sequence locations=1-71,147-570,594-693,726 -900,945-1496,1532-1567
atgcagtttgaagagatggcaagtacatgagaattcagattcggatattgtgaactaaatcatctaaatgcttaaatataattaatgtttgaatagttttaattgaaacaaaaaagttataaaaattattttttgttaattaaaaagcaagttacccccccccccccctcccgcacatctcgcatattaacatatataaaaaagtttttagcttccgagtttttgaataatcattcaatggacatgttccggttcaaagttcataacgctgtcaaagacaccgacgacgccgccaccgactctgctgcaccacatgatcaatgtcaacaacgccaacagcgcgaggcgcctccccgcacaatgccgttgtccttgttggctgaagagcaaactcatgcgtcagcagcagctgaggctgctgccgaggcagcgagtgttgttgaccaacagatgtcggtagcgccaaatgacactcccgccattgctggcacgaaaattgattttatgactgatgaacaaacagtggcggcagcgccgccgcctctattcagtgagattgaaccgacgcaccagcagcagcaaaaacaacaacaggtttgctctaaattgatgtcggcaatttaattttttatcaagaagattcaggggggtacagcggaaatcaccacaccgaaagtggagctgtccgccgaggacaatggtgatgatgatgatgaggctggacaacaggtcaaacaagaggcggacaggaacagcatggatgcgcatcattcaaattgtgcaaaggggccccttttgttcattgatgaacaggagaatgaggaggaggatagtgaggaagatgagcacatttcaacaacgcatcgaaggcaaggcatggactcgtcatttgactacgaagacgacgatgatgatgatgacaatgacgatgatgatgatgatgaaatggaatcagtcagcggatgtgcggaatcagacaaatgtggtcactgtcaccacccacatcagctaccacgaaatgctttggaggtgctcaaaatgccgctcattgactacctgtgtgcgctgaaccatggatgcagcgtgggagagctgcaggccttgttcctgtctaagggcgcacatggtcgcatggtcacccatctgcagaagcgctgcctactgcgcactgtccatttgcgccccaccgagcgcaacatcacactacatgcacacaattttagtgcacgaagcgccagtctgacctttgcctgcggtgggtatctgaacctaacggtgagtctcatccgtttatcgcttaaacaatggacaaataaatataatgatggtccatcttcggcttcaggtacgtcaatattttttcgcaaaacatggcgttcggctgcgccatccaagtctgcccactctggtggaatttggaggtggaatgcatgcttcatactacccgcttgagtgcatccaggtgcacgtcgcggtgactgcaccggaggacgctgccagcaccacctccaccaccactaccaccaccaccgcatcaccaactgcgtgtgtccgcctcacaaactaa

SEQ ID NO: 70945 - DNA, 3118 bp, Heterodera glycines
  Genomic contig location: Contig_ID=SeqID_1259; Location=2977..6094; Strand=-
  SCN-specific regions: Sequence locations=1-135,159-409,432-564,588 -1196,1219-1653,1675-1815,1837-1856,1878-2268,2290-2301,2323 -2423,2456-2507,2529-2562,2584-2648,2671-2695,2718-2823,2847 -2919,2947-3021,3043-3082,3112-3118
atgaaaggagtttggcttttgccgaatgaaagcattgatcagcttggagaacgtgtctcggcaatggtccgttgtgcatatcccggcctcactgaacagctgtacgacgaatattcggccatgcacttcattagggccctccctaacccagaattggctaccattttggaaatgacacgtaaacctggagcgacgttcgacgaattcatcgcacaagcggcacgggcagaggcaattcaaaatgccgcgcgaaatacgtggcgaatgactaaattgtcaagccatggaacatcccaaaatcagcgaaggcacgttgtttgctataattgtggccgagtcggacacacttctcggaattgctattcacagtcgacacaacagacgcaccaggacaacccaagcagcaatttccagccatcagaatcattcaggaaccaaaattctcactttcaacaaaatgatgaaccgccgaaaagggaaaatttgtttataggagccgtaaatttggaacaccggtctgaaatcgaacaattcttcggaaaaacaacgaatttgtcggaaaagggtagattttgggaagaaagcccggcggttggtaaaattttggcagccaaagtttcggtgtttgggcgtaaattggatgcaatgctcgacggcggctcccaaatttctttgatttcggccaaattcttcttagaaatcatggacaaagtaagccaaaaggacatcgtcacccgctctgaaagccggataatcgacataaatggaaaggaagtgaaatcttttggaattgttgctttgccaattcagagaggaccattagaagcgaaaatccgtgtttttgtggcccaatctacatttggctatgatttgcttttcggcacaaatgccatggaccaattaggtttcaaaatgcttgacgcagtgaactgccgcattgtagacttttcgccagcttcgaagcccgaaaattcgcctctgatcactttcaaaaccttcgtgtgccatggcaacaccagtaccaacagagaagggcagaaaaaggggaataaacataggtcggacccaaaaaacgacactggtaccaagaaaggtaaagtggtggagaagaaatcaaatcgaaatgctgtggacaataaaaggagcccattattcaacaaaacattcgtgccccaactgaaaaccaaagaaattccgatcaaaaattctgaaaattttggaaaaagtgcggcaaacaaacagccattgaattcggttcaaatgaaagtgggcgtgccaaacgaaaaggcgatgaagtgtgtttggaaaaggcaaaatttgggccaaattcagttagggacaactgaaaatttgggtagggggaagatgaacccaaaaatggcttcgtcgtcaaattgtaggttgggtctatgcgaccgccaccccgattgtcgttcccaatcgccattccatcgcggcgagaatgacgcaaaacttggccaaagagttttttatcgccgagaaaagcaccgaaaagagcccgaccgtggaatgttaggagacggacgccggcacaggcttaactcgccaccaccaatcggatgccgaatggattcaaaaggcaggggacgccttttctcggagggtcgggatgtgttaatgtttgattattggcattttatttagtaattatgttgtcccttcttaatttttgtctcattgcctgtcattgtagtctctcgcctaatctatattttgccactcccttcccagcagaaaatgttcccccccccccgtcttcccttcaattcattctgttggcagtgcactttcatatttgtattttgttcttattttcctccgactcttctcccattttattgttgcggttttaaataaagtgatttgtctccgtcttggaaatatttgtggaggagaagcagtgtattagcccgacccgaaaagcattatttagcacgcgtcgcatgttttgtgacgtcccatgctcggctgtacctgtacgactggttggaggaggtccgacgggtgggcggtcgatctctgtactgcgacacggacagtgtgctgtacgtgaagcagcgtggcgctgaaggtgtgcgcgagggcaacgcgttgggtgacatgaagcgggagctgcccggccgtcgcatcatcgacttcttcgccgccggcccaaagaactatgggttccaacacgtggacgcgtgcacgggcggcgacctgaaggcggagcgcaaggtgcgctcttttgagctcaactatgcggcggaccagcagctgcagtatgagcgcatgcgccagctggtcatcaaccactttggcagcgggtaaatacgccaccactcccccatgttggggcgaatggggggaggacaccgaggcactctgatcacaccatacaattaattttgatgattttcaggcagcagcatcaacaacaacaacaacaacaacagaggggtcacgcggctgatgctgctgacggaagcgatggccaggaggagcgcaccatctctgtgccatgccagcggtttgtgcgcaaccgccaggcggacatcttcacgcgccgctccacccgcgtgtaccggcccgtgtacacaaaggggcgcgtgcttcggcggggtgcagcagagtgtgttggtgagtcacaaaataaaacagaaaaaacaatagggacaatagcaactatgatgaccacacacacacacacacacacagcaacaatttaaatttttcagatgaagtgccgccgcagtccatacgcactcgcccatttggatggagctgttgtgccggtggcggggcatcacccgacagcacagtgatgaacgaggaggaggaagagcccatgcaaatggctccctctgcagctgaccaggaggaagaccagtggcgggagcatgtttggccgaacgacattggtgatgatgaagatgatgatgatgagccagggccggaacggaagcgtgccagggtcgaacagtgcgtggcgccaccgccctcaccaccacagtcaccgcttcgcgagccggatgcagagccggagccggtggccggctgctccacttgggatcagaccacacggcacacaaaacatatttgtagaaataatttttaa

SEQ ID NO: 70946 - DNA, 850 bp, Heterodera glycines
  Genomic contig location: Contig_ID=SeqID_9307; Location=446..1295; Strand=-
  SCN-specific regions: Sequence locations=1-185,208-429,453-850
atgcaacgtatcggcttcatcggactcggaaatatgggtggacacatggcccggaatttgctgagtcgcggtgcccaactcgtcgtttacgatgttgaccaatcaaagttggagacaattcagtcggaacgtggaccatctgcgctgaaaattgccaaaaacccagcagaagttgcatcggattgtattgaaatcgtcacaatgcttcccaccagttcgcacgttcgctcggtgtttgtggacaaatttggcattttggagtagggttttgggtactctaagtttcctgacagatttcacatacattttcaaatgcctataaatgtgttttagaaattagtgaaaataagttttaaggggttttgggggtcgctgatcacgaatgcagcatccgtttttcccaatttcgaacccctgacccggactcgaacaaaaataaaattagaaaatttgtatggatgatatcctcattggcatcttacccatgagggtattattggtacaggaagcctataaattctttgtccttgtacagctcttataatgaatggtagcgctgatctgagcccggattcgtgatcagcgacccccaataccccttaaaacttattttcactaatttctaaaacacatttataggcatttgaaaatgtatgtgaaatctgtcccctaaactagacaagtaccaaaaattactcgaaaaatttatggtttgtctaaaattttcattttttttttgaattttcctaaatttttactttcccagcgagaaatatgcccatttgcgggacaatctgcgccaattccaactccatttggccgagctggacgaactgagcccgctgaagca

SEQ ID NO: 70947 - DNA, 260 bp, Heterodera glycines
  Genomic contig location: Contig_ID=SeqID_9307; Location=1622..1881; Strand=-
  SCN-specific regions: Sequence locations=1-11,35-260
ataaatgaccaccccgtcccctttccccgtttattgtctcaatttcacacaatggttctcttaatccgttgaagaagcgccattaacaaagccgtttgaataaaaagacatcgctaaagcccccatatagcgccataacacccacaaaatccaatctcaacatcaaattccccgtgatgatttatttaatgaattccgatggttggttgattaattgatcattcttaatgtgtttgaaatgaataaaggtgtcatgttgc

SEQ ID NO: 70948 - DNA, 2384 bp, Heterodera glycines
  Genomic contig location: Contig_ID=SeqID_9308; Location=25..2408; Strand=-
  SCN-specific regions: Sequence locations=1-399,424-1418,1440-2384
  Gene Ontology: Mol. function=transmembrane receptor protein tyrosine phosphatase activity; Cellular component=trans-Golgi network transport vesicle; Biological process=exocytosis
gttgcgactttagcgaagatttgtgcaccgatggcgaagtctgtttgccggacgggctgttcggccagtgctattcggacgatgagtcggctttggtcaggccgctggtcctcgaccggcccatcaacggcgtccagtcggagctgcttcgtgcggagctgactcggctggccgagctgggactggattggccggacgcacgtgcccagtgcgtgttggcctatttcaaattggccgtggcttttcgcttggactacgacacggagttctgcacggtgcgcaacccggagaacatttgggcactgattcaggtcagtcccatgctttaaacagattcaaactgtacaggccaattcagagggtacaaaacgcacttttggccgaagcggaaatcgaacgggcggaagaggaggacgaggcggaatcactgcttgtcaccgacccgcgagatgaagcgggggacggaggagcagctgccggacagggacaagctcaattccaaacggcggaagacgacggaggagaggctgtggaagtgataccaattgttgtgttggacggagggcagggggaggacgaagacggaaaagaccgaatggcatacgaaatgtacggaaaagcggagagggaagtgccgaagaagaccggcagcaaaaacgaaaccaaaggtaagcgaagaaatgaacggacggagggggcggggggaatgaaagacgaatggtgggactgaaaaaagggtggccaatgcaaaggaatgcttttaagcggaaaaggcgatggacaagcgcacaacggacgcactcagcgcgacggaggaggtcgagttggaccaattcgttcacaatttgctcgacggccgaccagcggcggagcgacagatgggcgcactaagcgaacgtcagctgagccgattggcacgattcattcgccaactgcaaaacgtagtgcaaaacggtgaaaagcggagggggacggcaaacaatggacgaaaattgaaaactcagttgaagaaacggtgaacgaagcgcaagaggaacagctgcaggaagaggcgccgccgccactgctcgcggaagccgaagcagcacagccgacggaggaggacgcggtggaccacgtgctgttgctgaagaaggactcggagcagttcaacaacgccgacatgggcctggcaaacactgtgcacaaaatcggtaactcagatgcccacaatgaattgcatttgcattttgcaatttgaagtgaaaggcggcatccaacgtgtggagggaaaccgcgtctatttgaaggtggccaaggaacagctgacggaggaggagctgtacaagctgatcggctacctggacaagaagattgcgcagccgaacaacctgtactttgacgagttcctctacgaaaatggccagttgtccttccgcatttctcgcctcggcgtgttgcaaccgaacaaagacaaaaaggacggcaacgcggacgccgcattggaaaatgcgagcggagtggcgcaggcggtgtacaaacgacggaaggacatccaaacgttggccggcatccgcgtggatgagacgggcatcggaagcggagtggtaaggcgtggatgaagcgatgattctatgtcttttacgctaattgccaaccaattaaaggacgtcgtcccggtggagcgttctcagcgcgattggctgttcgtgccaataatggctgtttccgccatgaccatcttcacccttctcgttgtgttggctgctaatttggtccgaatgcgccgtcatcgtcaagaaggcccaattttggcaccgtgccgagacggaggcggcaaagcaggcggctcagtttgcgacgatttgtgccgtcagcgaatcgcagaggaaggcaacatttcacagcgtatcagcagcggacgaagtgccggggatcgctctaaacactcaagcacttcctcgtggcctgcgaaaattgtcggcaccgaccggtgccgaccagcaattggacatcggcacgggacatgtccttctcgcatttttgaaggagcacatggaaaagccgggcgaagtcagcaaagagtgggagtcggtgaaggactacgcgaacgcagcaggcgaagcgacggtcgcacggcgagcggaaaatgcggcgaaaaatgtggacgcgacagtgctgccatgtgagtaccgaacgacttgggaaaaataatggcatagttcaccacacattcagacgatgactctctggtcactctgcacggcttcaactccacggaaacgctaattgacgtgtcctcatccgttgccgagcactctcccgcttattacaacgccagcaaaatatttgatgccaacccagagccgacatacattgtggcacaggcaaagcaacagaacacc

SEQ ID NO: 70949 - DNA, 262 bp, Heterodera glycines
  Genomic contig location: Contig_ID=SeqID_9308; Location=2149..2410; Strand=+
  SCN-specific regions: Sequence locations=1-262
  Gene Ontology: Mol. function=transmembrane receptor protein tyrosine phosphatase activity; Cellular component=trans-Golgi network transport vesicle; Biological process=exocytosis
gtcgtagtccaagcgaaaagccacggccaatttgaaataggccaacacgcactgggcacgtgcgtccggccaatccagtcccagctcggccagccgagtcagctccgcacgaagcagctccgactggacgccgttgatgggccggtcgaggaccagcggcctgaccaaagccgactcatcgtccgaatagcactggccgaacagcccgtccggcaaacagacttcgccatcggtgcacaaatcttcgctaaagtcgcaacct

SEQ ID NO: 70950 - DNA, 144 bp, Heterodera glycines
  Genomic contig location: Contig_ID=SeqID_43222; Location=39..182; Strand=-
  SCN-specific regions: Sequence locations=1-18,41-144
atgagcacaaaattgctttatttggtttaatattcaacaagttataagtcaaaaaaaatttcataaaatcttatatattaattccaggttttgaatgatgcttggcgtattaccaattttgcgattttgggcctaattttttaa

SEQ ID NO: 70951 - DNA, 1159 bp, Heterodera glycines
  Genomic contig location: Contig_ID=SeqID_43223; Location=81..1239; Strand=+
  SCN-specific regions: Sequence locations=1-225,247-463,485-759,781 -1077,1101-1122,1154-1159
atgacgaccaaatccgcggccgcgacaattgatcatttgcgttatctcttcactcgtcatggaattcctgagacgctggtatcggataatgggacgcaattcgccagcacagaatttgccaaattcatggccaacaatggaatcatacacctattctcggcaccgtacaatccaatgtcaaacggacaggtggaacgatttatggacactttcaagagggcttttaagaaaataaaagggagggaacggcaaataaggaagtgatcgaaacttttctgatcacttaccagacgactcctaatgattcgctctcggaatcaaaatcaccagctgaaatgcttctcggacgcaagccgcgtaccacgctggatctgctcaagcctcctccaccaaggccaacggagagagatgagaaaatggagcgaaatttcaaccgaagatttggcactcgtactcaaaattttggacctcatgaaaaagtttgggcccggcaccgtctatcgcaaaattggaaggcggaaccatttttaaaagcgccggagtgatctacaaagtgcgatttggcgatggaacagctgggcgcttccacgcaaatcaactccgcaggcgtcagacatcaactgatcagtgcccattaaatgtttttaatgatgcatttaatttgccaattccacgggaaaatttggaagacgggcaggaccctcaaaatatgcctgaccctattggggaaccggacaatgttgtggaacaacaaattgtagaagagcagcagaacattccgcaaaatcgccgcagtcgatcgccaccgccacaacaggtgcgacgtcgttctgatcgccaccgaaggccacctgtgcgattttcacccggatgagaagacttaaaaagggaggtgttcgggtggtaacacccaaggaccaaaaggaagacattttttgttcttttgttattttcttttgatgtctcactctctctctgttccatagtctctaatcgctgtctctgttcttctcgtactctgacctattgattaaatgtccatccttccccatgatgcattcattcatggtctcaatatatttttgttgttctctcttctccaaatattgtgcttctccgtccaatttaatttatttatttgttatttaattttcttcaa

SEQ ID NO: 70952 - DNA, 361 bp, Heterodera glycines
  Genomic contig location: Contig_ID=SeqID_43224; Location=118..478; Strand=-
  SCN-specific regions: Sequence locations=1-59,81-152,175-306,328-361
  Gene Ontology: Mol. function=general RNA polymerase II transcription factor activity; Cellular component=transcription factor TFIID complex; Biological process=transcription initiation from Pol II promoter
tttttggttgctatttatagaaggggtatataaagggagtgaaaggaccatttgattggtacattgtatcaaaaaatgcaaaaaccgataatcgtaaatataattgctttcgctaatctcggtaccggaattaaactaaactctctgacgatcaccgaatgcgaatttaagtataaccctagaaaattcaatgccgcggttatcaaatgtacaactcctatcaaagccacggcattattatgggaatccggaaaaatgatatgtctggggacgaaaagtctgatagactgcgaaaatgctattaaaaaatttatagaaataattaagggcttggggtgtccgggggcttcttacaccggac

SEQ ID NO: 70953 - DNA, 220 bp, Heterodera glycines
  Genomic contig location: Contig_ID=SeqID_43229; Location=1..220; Strand=-
  SCN-specific regions: Sequence locations=1-220
cggagctgcgcaacgtgcatccactcggcaagtcgccggtgctgcaggacggtgagctggtgctggccgagtccggcgcgatccttgactaccttgccgaccgctacgacacccagcgccagctctcgccgtcaccgatgccggccgaaggcgccgagcgcattgcctaccgctactggctgcactacgccgaaggctcggcgatgccgccgttgctgct

SEQ ID NO: 70954 - DNA, 259 bp, Heterodera glycines
  Genomic contig location: Contig_ID=SeqID_43230; Location=1..259; Strand=-
  SCN-specific regions: Sequence locations=1-56,78-125,150-259
attttctaagaaaaaataggagttttgggggcgcggcggtgccgataggcgccgccggggaaaaaattggaaattttgatcatttataaacagtttttcactgaaaattagccaatttataggtaaaattttgaaaaattttatgggaatttaatccaattcttaggggtgtaaaaatcgcatttcgcgcccaaaaagcgaaatgggaaaagcgaaatgggaaacgcccaaaaaatgcgaataatgcgaaaggcgaaat

SEQ ID NO: 70955 - DNA, 834 bp, Heterodera glycines
  Genomic contig location: Contig_ID=SeqID_43231; Location=337..1170; Strand=-
  SCN-specific regions: Sequence locations=1-5,40-676,698-786,808-834
  Gene Ontology: Mol. function=ubiquitin activating enzyme activity; Cellular component=cytoplasm; Biological process=reproduction
atgacgcccattgactttgagaaggacgacgactccaaccaccacgtcgacttcgtgacgagtgcctccaatttgcgagccgagaattacgacatcgaaaaggctgatcggatgaaagtggattgatttctcgacggatttatcccgaatgatttcgcattcagacaaaacaaattgcgggcaaaatcatcccggcgttggccaccacaactgcgctcgtctcagggctcgtctgcatcgaactctacaaaaccattgaggcggatggaaggcgctcgacggctcagatcgaacacatcaaaaatgcatttatcaacttggctacgcctttcattgcgttcagcgagccgggcaaagcgcagaagaagaaggtgagttttgattctgtttgggctatttccgtcattcgttattttctccgcttttcagtacctcgacattgacttcactctttgggaccgtttcgaagttgacggaccgatgacattggggcaactgattgattgggttgaggtggtcattgcttccaccgtttaactttttgcatttttttctgttcgtttagagtaagagtggcctcaccgtttcaatgatttcttccggcgtctcccttttgtatgcgttctttcagcccgcagaaaaagttgccgagcgcaagaacatggagtgagttttaattggctttttgtttctgtttaattgtcaaacttcagtcttattgcggttttcgaggaagtgtctcgtggcaaagtgccggaccatcgccgagcgatcgttcttgaggcgttgacccagaatgaggaaaacgaagacgttgatatcccattcattaaa

SEQ ID NO: 70956 - DNA, 503 bp, Heterodera glycines
  Genomic contig location: Contig_ID=SeqID_9310; Location=15..517; Strand=-
  SCN-specific regions: Sequence locations=1-349,372-503
atgaaattgattttctccgtctttttattttgttcttcgtccatttttatttcgctggaaaaacacgaaaaaacgaagaaaattcagttgaattttactgaaattggcgatttcattgaagcattaaaacagcaaacgcaacacaaaaattcaatggaaataatggcgaaaaatgggcgcgaaattgtgaaagaaattacggaaaattttcaaaattccgcccaaaaagacattcaaaatttgttggatgaaattctggacaaagtttggaataccaatggattaattgcagaaaaatgttttggtaaaatggggcaacaaaaagtaaaagcgaatgaaggaattgccaatggcaatgccattgaggaggaaatgagtggggaattggcacggcacgaattgagcagaatgggcagcaaagtgatcaaagatacaatgttcaattattaccaggaaaatttgctcgcaaaaagcaaagtgtacaaatggtggattcggtacag

SEQ ID NO: 70957 - DNA, 609 bp, Heterodera glycines
  Genomic contig location: Contig_ID=SeqID_9310; Location=798..1406; Strand=-
  SCN-specific regions: Sequence locations=1-226,252-513,560-609
atgtattgcgtgcatgggaattccgcggacagcacaccgcagcaatacgcatatccgaacggaattaactcaaccggcacagtgacaaaaggggcgggggacggcactgtaaacatcgactcgttgagagtgtgccaacaatggaaggaccagggcaaattggtgggtggaaagagtcggacgctcaattagcaaagataataaaaaaaattaattagcggattatgggaagaaagagagagaaaaaagagtcaataaattataaacgaaaaacaaattaattagactaatttaaggtgaatcaagtggtcgaaattgcaaatgtttcgcacgaaggaattttgcacacccggcaattttacgatgtgatcgactcaattcttattgcctgagtaaatgaccttatttgttagtgattgtcggacgacgattagtaattattctattttctgtaaatttggtaaagataattttgttttcaattttcattgatttatttactcttttctttagaaaattaattattattttaaatgatagttttattttttcattttatccaccttttattttttgttttgtttaaacctcattgctttaacaaataaa

SEQ ID NO: 70958 - DNA, 119 bp, Heterodera glycines
  Genomic contig location: Contig_ID=SeqID_9310; Location=1828..1946; Strand=+
  SCN-specific regions: Sequence locations=1-46,68-119
atggcgagggaggcaaaggttcggaccaaatcgcgaagcgacgaattggaaataatcagagaagcaccgttgaacaaaaaactgttgggattgcctgacagtttgagtaattgcttcaa

SEQ ID NO: 70959 - DNA, 618 bp, Heterodera glycines
  Genomic contig location: Contig_ID=SeqID_9311; Location=97..714; Strand=+
  SCN-specific regions: Sequence locations=1-423,467-550,573-618
atgaaaggttagttcggtgggccaaaatattgttgacctaaaacataaaaataaatgatttgctaaaaaatgttttaaaatgtacaaatgttttgttaagttttttgtaaaataaaaataaattactaccaataatatgcaaacatttttttttggataattacctcaaaaatgtcgtccgtacattgcttattctcaacaacatgtccttgtatttgttgtggcgctaaaggaaaagcctccaatggctctgtaatagctggttgattctggatgaatgtgaaacgaaatgaaaaaatataaaaacaaagaaaaatttttgattactgtatataccgtttcaaaataattttccagttcatggaaatcaaatggcaatggacttggcgtctggtgatcaagggtcggctgggccaaaaatggaaaattaaatcataatattgaaaataatttttaatttaaattactgggattgggtcaatttccatttcgttttcgattattttgtctaaattaatcaaaataatttacgtaattgaaaaatttgttttaccaaaagaaagaaattgtaaaattgtaggagaaatggacatctcaagtaaaatttggagtattaga

SEQ ID NO: 70960 - DNA, 852 bp, Heterodera glycines
  Genomic contig location: Contig_ID=SeqID_9311; Location=2016..2867; Strand=-
  SCN-specific regions: Sequence locations=1-195,224-482,504-547,570-852
atgtacgtggacggccacggctcgaatttcccgtccaatttggcttcttgcggtgccatcccttcgccgtattcgggcactttctcactgaaggcgtgggtggcctatgccttggccatttccgacccgttcgatctccaaaagtgcatcctttatatgatgtcgtacgtcaaattgaaattatttgctttgtaatttggcatatgcttaaaatctaaaacaatttcggttgaactgaaattgctccccgaaagtcggggcaaccccaaattgatgcttcacgacataaagaaacattggaaatacgtgtcggaattgtatatttttcagactgtcctatgacagtgcgagcggagcctacagaaatcggaccggaatgaatgtcacattcaccgcaagacgcccatttggcctgttgctattatacaatatataaaataaatagatgaatcttttggcttttttggttgaaattttggctgattaagcaaaatttaaaattccattaaagaccacataaccaaaccaatccatttatagggaactgctataatataccattttttgaattttaaatactttttttgtcgttgaaatttcggcactttccttttcccaatgttcagcacgtgtccgatgacttgtctgctcactgatagcaaccaaagctgcaatcccaacgagaactccacgtcgacagatgtgtattttggggcacttatcagtcacttggcccaatttggctatgtgaagggatgcaaccttttcggcgccccttacgattggcgtttggcaccgcaactgagtgccgacaatttaataattatatttgaagaatataaatgttcttaa

SEQ ID NO: 70961 - DNA, 224 bp, Heterodera glycines
  Genomic contig location: Contig_ID=SeqID_43238; Location=233..456; Strand=-
  SCN-specific regions: Sequence locations=1-66,88-139,161-224
cattcgttttgccattttctttggcttaattaatcaatggcactttcgccacacattcactaattacccaaatgctttgttttgccacctcaaaatgttttcctcaaagcttcgaccaattcaaaagccgatcagttccactcatcttcatctttttgctgacgattcatcttttatttgcggaaattgcttcggaaaagtcatcaaaagaaacatttaaagat

SEQ ID NO: 70962 - DNA, 273 bp, Heterodera glycines
  Genomic contig location: Contig_ID=SeqID_43239; Location=298..570; Strand=-
  SCN-specific regions: Sequence locations=1-142,202-230,272-273
atgagaaccctgccttattttatcattttcattacttcacgtgaaaaattgttggcaaaaatggcggaagtaaatagaaacaaggatattgttggctttttattaattctgatatataaattaaagaatttttagctcagtctttatattattttattattactaaaaaagaaaattaaaaatgtttaaatttcttattttcaatttgttattgcttggaacacgaatttttcaagaaacaaaatgtcaaaaaggttatttttaaaaaataaa

SEQ ID NO: 70963 - DNA, 268 bp, Heterodera glycines
  Genomic contig location: Contig_ID=SeqID_9313; Location=899..1166; Strand=+
  SCN-specific regions: Sequence locations=1-120,158-268
atggctggcgccaaagtgggcagttccccaaaattgaaccctcccgggacaacttgagggatataagtgtgttctatacatatcctcaaaactaaattcttaaaaaaataaacactcatctcctgaaaacaaaaagaaagattttaaaattttaaatttacacatatacatgatcagtaaattattgataattaaaatcattaatttcattacaggaaatcagtagaaaggcgattgtatacgtatgaataatataaagcaaataata

SEQ ID NO: 70964 - DNA, 206 bp, Heterodera glycines
  Genomic contig location: Contig_ID=SeqID_43242; Location=194..399; Strand=+
  SCN-specific regions: Sequence locations=1-206
atggtgccgtttgaattggtgaacgaatggacaaatgaaaagctgacattggccaaagcaaatgaaaatgaattggacaaaagttggataatgaaacgatgcaaaattattggggagacagcggcggtcaattgggaagacggaaattgggacaacaattgtaacaatgtgttcttttggcttgaaggtgacactaattgcattgg

SEQ ID NO: 70965 - DNA, 107 bp, Heterodera glycines
  Genomic contig location: Contig_ID=SeqID_43242; Location=391..497; Strand=-
  SCN-specific regions: Sequence locations=1-64,87-107
cgtacgtttcagacctctcacagtccaggaaaaaaatatggatttccatgtaaatgatagccctaattattacacaaatgccttttttaattgctcacccaatgcaa

SEQ ID NO: 70966 - DNA, 325 bp, Heterodera glycines
  Genomic contig location: Contig_ID=SeqID_43244; Location=1..325; Strand=-
  SCN-specific regions: Sequence locations=1-192,215-325
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttaaaaaaattttttctccatcttcctttttgatactaaagcatcagagtgctaaaattgacttgtaaataaaatttggtgcgctttagagcactttctgaaaaaatatttatgaaataaaaaaat

SEQ ID NO: 70967 - DNA, 263 bp, Heterodera glycines
  Genomic contig location: Contig_ID=SeqID_43245; Location=1..263; Strand=-
  SCN-specific regions: Sequence locations=1-67,89-187,209-263
gcgcgggcagcatcgtggcggcacccgggcagacgccaaggctgatcgctgcgggcaaccccggcatggcggtgggcggaatgggcgacctgctcaccggcatcattgccagcctgcgcgcgcagggcctggccgcgttcgacgcggccgcggccggcgccttgctgcacgcactcgccggcgatgccgctgccgccgatggcgcgcgtggcctgcttcctactgacctgctggcgccgctgcggcgactggccaatccggac

SEQ ID NO: 70968 - DNA, 121 bp, Heterodera glycines
  Genomic contig location: Contig_ID=SeqID_43247; Location=316..436; Strand=-
  SCN-specific regions: Sequence locations=1-121
gaaatggaagaaaatacaggaaattctggcacaaagcccactgcacacattcgcttttccatcccggcactgtttgggacaccgtcacgcattttgtgacgccagtaagcgtgccgccggg

SEQ ID NO: 70969 - DNA, 155 bp, Heterodera glycines
  Genomic contig location: Contig_ID=SeqID_43247; Location=638..792; Strand=-
  SCN-specific regions: Sequence locations=1-155
atgattgcacgtaattgccgaaaaaattcgagaccaatttccgaatgttgaccgactaattgcaaaacgaaagccgtctttatcaaagcgccttaccgagtcaaaaaatttggaaatttatctcatatgcaatttcaaccaataaatttgaagaa

SEQ ID NO: 70970 - DNA, 867 bp, Heterodera glycines
  Genomic contig location: Contig_ID=SeqID_43248; Location=113..979; Strand=-
  SCN-specific regions: Sequence locations=1-657,679-718,745-814,836-867
atgccagttcaagccagcccattagcagcactgaaacggcaccaaccgcaaactgtttggcccgttgccggtgcgtttgccgactgcaccgcgcaaaacacggtcagtcgtcagcaatagtgggtcatctcatctccttcgtttctaggaattatttccgagactcgagaccaaaaaagatgagatttttctcgagatcgaaatttttttcaaggaattttcttgtgtacttaaaaagcgacttcaactttctataaatttaatttaaaaagatttgctgaaaatttttttgcttataaaaatttttaggctcaaaacttgcgaattttttagaaaaattttagattttctttaggaattttctatctaacaataagcctaaaattttttagagccaaatgagttgcataaattttgaattaaaaaaagagaaaatttttttgaattttttctacgtttccttgaaattttattttttcattttatccacgcccactttcaattcaggtccatgtcgacgcatttctgttcgatgacgacgatgttgatcagttggccgccgatggcattctgcggcgccatttctgcacaaaatgccgctccaccgacgtggaacagttcaacttcatctcccattcgttgaccattgatgaggtgtgtgcttgtgctggtgttggttttcaaaatccaatgcattttcttattgaaaaattatagaaaaatttaaattttgtttttatgtattttgtcgcaattctcgcccaccaaagggtccgatattatgtattctagaaaaatttatgttttttttcaaaatggataaaattaggtttacctaaaaataggagccacggcgggacaaataaa

SEQ ID NO: 70971 - DNA, 65 bp, Heterodera glycines
  Genomic contig location: Contig_ID=SeqID_43249; Location=737..801; Strand=-
  SCN-specific regions: Sequence locations=1-14,36-65
aataaaaattgggcttcgccttcggcttcggcttcgagtgcaaagccgagcttcgcccagccctg

SEQ ID NO: 70972 - DNA, 138 bp, Heterodera glycines; identical to SEQ ID NO: 50950
  Genomic contig location: Contig_ID=SeqID_43250; Location=193..330; Strand=-
  SCN-specific regions: Sequence locations=1-138

SEQ ID NO: 70973 - DNA, 678 bp, Heterodera glycines
  Genomic contig location: Contig_ID=SeqID_43250; Location=333..1010; Strand=+
  SCN-specific regions: Sequence locations=1-59,81-678
gaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactcgccccgaaaacaaaaaaatcgattttttcaagtgtccgtttggggtactcaaacaattatgagggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaac

SEQ ID NO: 70974 - DNA, 1317 bp, Heterodera glycines
  Genomic contig location: Contig_ID=SeqID_9314; Location=1236..2552; Strand=-
  SCN-specific regions: Sequence locations=1-338,360-466,502-670,693 -761,783-1317
atgacaccgaatgggggcaagcgcatgagacttggcggagccggtcgtccagttcagcgcccggacattgacaatgcactggccgaatgggtcaccgaaagacaaaaaaatcaacagcccgtgtcaaggagcatcattcaaagaagagcagctgaactgttcatggacactggcaccaaggtgaaaaacggcggttctattcccgcaatttaagcgtcccatcagtaaagcatcctcagtttcttaaacgccatagcttttttcttgatcaatccaaatgatgaatttcagtcgggtttctcgacgtaatttttttccgaatgcaaatattttcacttttcttgtatttatttataaattccctaaactttaagctttcgattgataccaagaatgtttggattaccgagtaagaaaacaaaaagttttggcctaagatcactgaggatggtcactgatagacgctaaaaaactgtaataaaagaaaatttttgtttgttcaggcctcagttggatggctgcagaaattcctgaggaggcatgattttgtgctgcgcaacaagacatcaactgatgattgtcagaagccgtcgtccagctgatgtagcgagcgcagaatggagtccggagatgacgcgatgcatttttcatttaatggcagttttctactgttcattttgttttgtaaaaaatggtgtcatacaatttacatttatcccccggggcgacaaatggagagacgaaggataattgggagacattttttgggaaggcatcaatcagtctttttccttcatttgcaatttggttcttcacttgaataagaaagccccagaaaacttaagcatgcaaaaaaaaaaaccgtcacaaaatgagtgtggttttactaaaataccaatatagcgtagcctccacttttcggatgtaaatttaattaaagcgaaacgtgtagtaaaaagttggatgttaggatgaaataatctccgagttggtggtgcgcaaggaaaagcatcatttttttgataaggcagcaaatttatcacacataggtaaattaatttcaattatttgtgccaagttatattggcgagcagcaaaatacttggacaaattgatcaaattaatccattacttgaattattatatgtatttgttttatttgttgttagtgttattattctctacatatctcttttcttttgtttttgtgaatttcaattgtgccgacaattaaaacttgtaatttttgtcccctttccgtgtctccttatatggttggaaacttaaaaaaaacatccacaaaaatgacaaaataaa

SEQ ID NO: 70975 - DNA, 158 bp, Heterodera glycines
  Genomic contig location: Contig_ID=SeqID_9314; Location=2713..2870; Strand=+
  SCN-specific regions: Sequence locations=1-158
atggcgtgctgcgccaaaatggccagaaaaattcacttttttgaggttttttggccatatctattcaagtgtaaactaaattttttgaaattttgtaggttaatcgggactgtcatgcgcttcaagaccatatcaagattatttaatttggatgacaa

SEQ ID NO: 70976 - DNA, 565 bp, Heterodera glycines
  Genomic contig location: Contig_ID=SeqID_43252; Location=434..998; Strand=+
  SCN-specific regions: Sequence locations=1-115,199-239,299-317,353 -371,393-565
gtgtagccaaatggattggcacgggacgaaaggaggacaaggagggccaaaccgagaaggtactttacaaattaaactaattattaatgaataattttctaaaatatttcggcacaatttattttaaaaaatataaaaataaatgaaaaataaaaaattgatatttttaaaaagtattttaatcaaattattaaaaatcacataaactcaagtaaaaaagctaaaaaaaagaactttaaacttatttttatttttctatttatttgtttataattctattcatttttaattatgtattaaaactttaaaaaatttccatttaaatttacaaaatatttttaaaaattattttcactaattttttcagatttattttgacaaaaattttgttttgctggaacgtccgcctggccatcccgggcctggccacttcaaatttgttgcccattttgcctattcattgccatttgagtgcccattgcccagcgggtgcgagacaagctacgagagtgggtcggcacacattcgttactttgcgcgtgccattctcgagaccgagcagcgg

SEQ ID NO: 70977 - DNA, 687 bp, Heterodera glycines
  Genomic contig location: Contig_ID=SeqID_43256; Location=83..769; Strand=-
  SCN-specific regions: Sequence locations=1-687
gttttcggggcagtccccccgatccgatgcgcccagatttatggggagaccgaatccttcgggaatagcttccctatagtctgtactttaattctgcgttggatttttgctccccataattgtttgagtaccccaacggacacttgaaaaaatcgatttttttgttttcggggcagtccccccgaaccgatgcgcccagatttatggggagaccgaatccttccgaatccttccggaatagcttccctatagtctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaacggacacttgaaaaaatcgatttttttgttttcggggcagtccccccgaaccgatgcgcccagatttatggggagaccgaatccttcgggaatccttccggaatagcttccctatagtctgtactttaattctgcgttggatttttgctccccataattgtttgagtaccccaaacggacacttgaaaaaatcgatttttttgttttcggggca

SEQ ID NO: 70978 - DNA, 533 bp, Heterodera glycines
  Genomic contig location: Contig_ID=SeqID_43257; Location=339..871; Strand=+
  SCN-specific regions: Sequence locations=1-100,124-345,367-477
atgtttgttgtcgcccaaattgcaccgctgactttggcactgttgctcatcacccttttgatggcttctgatcgatgtgccgtggcactcaccgcggggcttggcaatggtgtgaatgtgcagcccagctactacaacagtggcaaagtgtcgcttggcctttcccagttgaaaacgttggcaacgaaagttaaaactgtgcggattgaggtggagccgttcattcccatttcgttggccaagcaatggatcagtgaggcggccaaaaacggcttttccatcattgtcacttatcataaggcgacagtgttgggctccaacgatgcaagtaagcagaaaaaatgccaaaagcatggaaaatgtccaagaaaatgccgaaaatgatatcgcgggtcgaaaattggatttttcagaaatctcggcctcgcttttgaattgttcggtcatttattagcaagacaaaaacaaaacaaaaagttaaattaaaatttttttaaatttagttagattattttttaaatttttaaattaaa

SEQ ID NO: 70979 - DNA, 438 bp, Heterodera glycines
  Genomic contig location: Contig_ID=SeqID_43261; Location=312..749; Strand=+
  SCN-specific regions: Sequence locations=1-32,54-438
aaaatggtctaagtaaaaatcgtaattacgctcaaaaagcttctcaatcaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaaatttagcgcttccaattccttctacaatcgcctttatacatcccattatgagcgctaaaattatcagagtgccgaaaatcgcatgtgatctaagcctagaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgc

SEQ ID NO: 70980 - DNA, 511 bp, Heterodera glycines
  Genomic contig location: Contig_ID=SeqID_43263; Location=229..739; Strand=-
  SCN-specific regions: Sequence locations=1-62,84-198,220-351,378 -460,503-511
ttcggggggactgccccgaaaacaaaaaaatcgattttttcaagtgtccgtttggggtactcaaacatttatggggagcaaaactccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatctggtgcgtttcagaaccctttctgaaaaaatatttaagaattaattttgcaaaaaataaataaaaacgaaagact

SEQ ID NO: 70981 - DNA, 323 bp, Heterodera glycines
  Genomic contig location: Contig_ID=SeqID_43263; Location=804..1126; Strand=+
  SCN-specific regions: Sequence locations=1-79,113-255,280-323
atttataagcatttgtagggttctcagcagtttccctgcaaaatttggtgagcttctgatcagtctagaacgttgggtgataaaatgaaaaaaataattaaaaaaaaataatgctggtgtggtaagtgtgaagaactgtgttcctccaggcaaaaaattctaagaaaatttataagcatttgaagggttctcagcagtttccctgcaaaatttggtgagcttctgatcagtctagaacgttgggtgatcaaatgcaaaaaataattaaaaaaaaataatgctggtgtggtaagtgtgaagaactgtgttcctccaggcaaaaa

SEQ ID NO: 70982 - DNA, 946 bp, Heterodera glycines
  Genomic contig location: Contig_ID=SeqID_43267; Location=141..1086; Strand=-
  SCN-specific regions: Sequence locations=1-34,75-201,223-453,475 -627,649-946
atggcaaagaatgaaataattaatcaccggacacagaaaagagaagaaaaacaaagagaggacaagaaggaaaatcgaaatgacatggaagatgtgagagaggagaacattttcactttcgaaggactcttcgaagaagcggacgacgaaacattcgtcggagataaaagagaaagcggagcagctaatgggcctaagcccgaaattgcaggagaaggaaaggatatgcctgaaatggcaggagacacaacggatcggcctgagataacgggggaagaaaaatataggcctggaatggaagtggagactgtttatctcttatcgcttgcgcgggagaatgaaactctgaacgtgaaatgcgattggccttttcgttcgaaaggtatggcatcaaaaatacgaaacattcgttttgtttttttgttaatgcgaattcagaatgttgtactgttcgaattcttcaacagaagaacagtgaaagaaaggatggggcaacacaaattgaagaaggatttgaggaagacggaacgatggccacagaaaaaggggaggagggcgagggaaggcaaagggaatgccaagctacggaaaaacagttccaccagccgcgaagctccagaagagcgccccggccccacctgcgccgtgacaggccgcccccactgcccctgttcatttgtggccctacgccccccgcttcttcctcggtcgtccctttccacgacccttccgtcgggggatgctctccctctccatccaccagcacaatctccccgccaatcccttcaaatgccatttattccatccgaatcggcggaattcagcttcgcaatgtgccaccttcgtcagcggcctctcaggaaaaggacgtgcaattggtggtggccattcggctggacagaagggaagtgttccggtcgtgtcccgttcatctcaacaggaactg

SEQ ID NO: 70983 - DNA, 1010 bp, Heterodera glycines
  Genomic contig location: Contig_ID=SeqID_43269; Location=237..1246; Strand=-
  SCN-specific regions: Sequence locations=1-75,97-147,169-1010
atggacgcagaagcacgcgatgaaatgagacgacaaacgaccgatggatgggagaggatgcagaagacaaccgccgaagaggaaggaggaggaggatacattcaactgaccctattcccatatatgatcccaactgtacagattgtattattgtatctcactgtatgtacagtatttgtcgcccggttatcgtttaagcgaccataattgtctgttgttggttgatcaccattatcaatgtgttgtatctctgtgttatcatttcaaatgatttgtgattaattgttggcctaatgtgtgtaaataatgtgaagaatccaaagatttgtttgtgtttttgctccctttttcgtgccttttcatgacttatttaattttttggtgcctattatagtgcctttttttccaggcttttccatgctctaaattagtgttcagaccccgacccatcccccggggacgggacaggttttttggcctgcctcccccctgctcccgtgactcagactcccgcgaccttcgcccccgcgggggtgagtactctttcaagtttctaccgtaaactgaaccctactgattttatttatttttttatactgaggaaagtctcaagcaattagtgaattttcaagaaaatatacccttaagaatggcatttcttgggataaaaggcaaacaattatacttgtatttttttaactttttaaaccacttttgataaaattttatgtgataaatagggatgccaaaaatatgcacataaaatcgtaaaatatgcgcataacataaaatcgtaaaatatgcgcataaaatatgcacataaaatcgtaaaatatgcactaaaaatcgtgaaatatgcacaaaaaattttccaattgagggtgtaatttctcaaaattactccccttttaagcaaagcaaattgagagaaacaatcaattaatgtgagaaaaaaggaaaaacgacgacgaatgggtcgaataatcaaatgaaaggaacgaatgaataaa

SEQ ID NO: 70984 - DNA, 101 bp, Heterodera glycines
  Genomic contig location: Contig_ID=SeqID_9318; Location=509..609; Strand=-
  SCN-specific regions: Sequence locations=1-101
atgggtgacaaaaataaaaacactataaaattggcaatttcggtgatttgcacaggtcttctgacagcccttctgttagtcataatttggctcttaacaaa

SEQ ID NO: 70985 - DNA, 1060 bp, Heterodera glycines
  Genomic contig location: Contig_ID=SeqID_9319; Location=86..1145; Strand=-
  SCN-specific regions: Sequence locations=1-244,266-517,539-896,921 -950,994-1005,1028-1060
atgtggcttatggcaatcttcgctttttggcttaaccttttccacatcgttttgctgacctggtccgattacccgcgtgaacattacaaccaggcgatggtcgaattggcgcttcgtgttcagcaggagacgggggtcaccgctgtcaaattcacttcgttcacttgggctgtaaatgcgccgtccttttgccatttccctcccccgtcaaaaagtgccgttttcaccctttcagcgttctttcccatggctttgccacgtggtcattatggttgtccttttctcctcctgttacattgtcattggggtgcatttgctatgccaatcgaacaaatattttgtccatttacagatttgtgccgtcaaaatccgtcgttacgtcggcaatactttcgcccagggccaacaggaaaatgccacgggcggaatttgtgccacgacttcgctgcgaaagcagaaaatgcgcgaatataataatgaaattacacgcgcactgattgtccaggtgcgttgccaaccaaaaggaacattcccaaaatggaagtgacaatggcaggccgttctgcccaccttcgaggccgctgcaatgctcacccaaattttcctgcccatactgtaccccaaagacactacagtattcatcatccttttcattgccatccctctttattttgcgccggtcggttcgctttttatgcccataaatgccaaaagctttcccattttgtcaaaggttctgaacccgttggccaccattcttctcgtgaagccgtatcgtcgtgccgttctcgcgttcattttgcgccgtcgtgccgatgttcgcgtttcaaccggggcatttgtggaacggacgaaccacagcaaattcccaagctcaaccgcattcagtacgaacatccaaggacagcagcaacagcaaatgacaacgacggaatagccgaaaagtgaacaaaaaaacatttaaataatttaatttaaaatatatatattttaggagtgtaaacggagaagcagaaggaaaaggagaacaattgaacaaaaaggcaatcatttcaattga

SEQ ID NO: 70986 - DNA, 148 bp, Heterodera glycines
  Genomic contig location: Contig_ID=SeqID_9320; Location=258..405; Strand=-
  SCN-specific regions: Sequence locations=1-13,36-148
atgacgacgaaggagaagaagtggaagaggaacagccaactgccagagaagggacccaacgaccagaatttgtctgagagagagagagaggtgccgaacccgaacaaaggatgccatggcgaatggacgaattgtgccaatgccaaat

SEQ ID NO: 70987 - DNA, 175 bp, Heterodera glycines
  Genomic contig location: Contig_ID=SeqID_9320; Location=903..1077; Strand=-
  SCN-specific regions: Sequence locations=1-175
agtgcaatttcagcactttgagtgccaaaactttgcctctttttattggaagagtttggacgtgttaaaactgaacggaaatccttttgtaagcattggacggataaagcatcacaaatgcttgttggctgttcagttgtgcgattgcaaattgaaatggatggtggacatgaaa

SEQ ID NO: 70988 - DNA, 568 bp, Heterodera glycines
  Genomic contig location: Contig_ID=SeqID_43279; Location=1..568; Strand=-
  SCN-specific regions: Sequence locations=1-5,28-163,229-287,309 -502,529-568
atgatttatttatttccattttcttttaagggaaatctgtcacggattattttgccacacttaaattttgatctgcttggcattgagttctatgtgaagtttccgaccaaccttcttgtcacgattgcttttagcagtaatgcgccatttctttatatgttagatttaaaaaaaaataaaataaaattttaatttaatttaatttatttattttattttattttatttgcagcactgaccatcaaaaggcattccgttcacaattcaaacggatctttggcaaaaacgaatcaaaacatttaattgttgcattcgctaattaatttcatcgaaatttttaaaggcgcttcaaaacaaaaacgaaaaaattgactttcgattactaatttttttgataaaatttagcgattaaaagctcttacctcaaaatcgaagctttgcgctgtctatagcgataataattctgttggttttatctttaatatttattctaagtaccggcttatttttattttaaaatagaaacgtgtgggtgctatgacgttagtcaaaaaaccatcaaaataaa

SEQ ID NO: 70989 - DNA, 519 bp, Heterodera glycines
  Genomic contig location: Contig_ID=SeqID_43281; Location=299..817; Strand=+
  SCN-specific regions: Sequence locations=1-20,42-519
atgtacgagatgaaggtccaggcgcagaagaaaaagaacccgaaggttgtgttccgcgactcattcaaccttatgccttgtgcgctcggacagctggtgcctgcctatggattggatgtggaagaaaagccgttcttcccgcatatggtcaatcgcccggacaactacggacgacaaatctacccgacaccggacgactatctggcacaaggaatgatgccagaaaagcggcgacaattcgaccaatggtacgaacaacaccgccaagcaccatttttgcttgacgaggcattggccagctactgtaaaaacgacgtcgacattctcacggcagcgctcgtcgctttccgccgtgaattttttgagataacaaagaggcaggctgtaaatgagacagacgaccaagaaagcaacgccggcattgacgttttgcgggagtgcatgactatcgcaagcgcctgcatgaaacactttcgcagcaaccacctccctgctgctgcaatacgagagcagcgatga

SEQ ID NO: 70990 - DNA, 888 bp, Heterodera glycines
  Genomic contig location: Contig_ID=SeqID_9321; Location=182..1069; Strand=+
  SCN-specific regions: Sequence locations=1-17,47-825,850-888
atgaacagacggtgaagaattttttgaaaaaaaaaaaaaaaaatttcttataactttgctctaaagcaaccaaatttttcattcgtaatatcattcgataggcctaaaggttctctattgcctgaaaaattcaaaaaaaaaaattttttgttaactcaaaaaagttatggccaaaaataaataatgactccgcccccgttaatttgtttgactcaataaaagtcgattggacgcatagaatgagttcattatagccatttttcccatgtttcagctggatttgtaacgacgtgtggatggacattctgccatcctttgaccatgctcaactcggactcaaaatcgcattgctttcgccccgttttgatgcgctggtggacacgcattttgatggcaaaagcgagttgacgacttggaaatggatcagaatttgcaaggatgaagcccaaccaccaaaagcgaaagtgtctgtgccggtcggtgccaattttgtgcagcaatctccgtgggagccgatggatgccaattttgtggattttccgttgccggaccttccgctgccaaacaaactccgaattcgtttcatgattgagtaagttatgttttttttcaaaagacatgaaatcatatttccgagcgttttcgggatcactggtcacgaatctccgggtcggggcgaatttgatcgaaattaatgtcaaaatcggattaattcctaagaatttttttaggaaaaatttctaggtttgaaaattaaaaaaaaattttcggaggggaaacgacgggggaaatgaagtgcaccccctaagacaaccttagttcaagaaaaaaaaattttttttttttaaaggggaggggggtaccatcgacagtattaccattttttaa

SEQ ID NO: 70991 - DNA, 1358 bp, Heterodera glycines
  Genomic contig location: Contig_ID=SeqID_9321; Location=1362..2719; Strand=+
  SCN-specific regions: Sequence locations=1-334,358-788,828-1107,1129 -1358
atgtgtaatttgatgttaaacaatgcacaccacttggaccaattgtgccgtcgcatttcgccaacgctgctcactgatcttgacaaattgaattggatttattcgggacgtctgttcccggatgtgtgtgctgctgatggctcaaatgcatctggtgctcgccaagtgctgtacaaatggttgcacacgccgacaaaagatggcacgccaaagaaattgtattgccgtgagacgattggttttccaaataaccaatgggtccacaatttcaaagaggtgtggtggtccgcaatattggtacttgtacagaatttagaccagggatggcattacgaggccccaaaaatttttggaaaatcagaattccgggggtcaaaaattttcggaaatcgaaattccgtgccatccctggcttaccacacaaaaaatttgtttttaatgataaaaacgtatttccaaggatattctcggggtcgctgatcatgaatatgacatccattccgatcaatttcgaatcccgtgcccgaattcgaacaaaattccaaaattcttttcaccaaaatccacctttattgtccaaaatcattcaaatatactgaattattgggatggctattccaagcatttgaatggattttgaacaataaaggcggattatggtaaaattgaattttcgcttttttcgaattcgggtccggggtttgaaattggtagaaatggatgtcatattcttgatcaatgaccccgaatacccctggaaatacgtttttatcattaaaaataccaacaaaaaaaaaagaaaaaaagtttttttaaatattttttatgtggtctaatcttaatctgtacaagtaccgccatatttttcgtgtcaaattgttgtttttgttttgccaattttgtgttgttttttaggaatttccccgtgccaccacttcggccagttacaccatcaatttcaatttgtatttggtcaaaatgcgaatttggccatttgagttggtcaacgaacggacgaatgagaggatgacgctgatcaaggagccggatcgtggtgctcagctcggtgattggctgctgaatcggtgcccattggccatggcggatcagcagcagcagcagcagcagaaagtcgaaaattcggatgccaaattgaactcagtgtacttccgtcttcgtggtgattgcattgggtgagccaacagcagcagaagagatgacagtaaaattttggaaaaatttgcgacgatttttttttttttgaaattataatgaattagaaagttttcgaaaatttttcaaaagtcgccaaaaaaatttttaccttataatctcttcatataaaaaatttttttaaa

SEQ ID NO: 70992 - DNA, 1150 bp, Heterodera glycines
  Genomic contig location: Contig_ID=SeqID_9322; Location=290..1439; Strand=-
  SCN-specific regions: Sequence locations=1-494,516-1150
ctttatctgcgccgattgttggcttttggtgttcgatttccttgcgccttctcaacttggcctcggaattgcactgatcagccgtcgatttgacttctacgttgatgaacacttcaagacacgcaaatggatgttgaacaaacaattgctaattacatgggacattgaagaaaatggcacgaagaaaatgcaaattatcgatgccgacagaaaagaaacattgccaatcccgcaaaagcctttgccgaacaaagtgatcggattcagcggacgcattcagatcatgtaaaaactgattagattgagactgatttgtgaccatcattttctatgcttttcagttacatcgatcaaaatgtgctcacttttctcggccattttcaccgttttttcgccacttctgcaatggatttggacattgtcattgaaaatggtcgcattttggaatttgtgttgcacaacatttggccaatgttccgcgattcaattcgtcgcttgtttttgaacgccatcgcttttcgctgtttgcgtcaattggcgccgtcaatgctcaccgattgtccatccctttgcgctgtcgtcttcaatgacggcatagtgtccgaatttccgatcgatgacagtgccatggcgtcggatgttcaagtgctggcaaaatggctgttcacgcctcatccggacggtgtgccgaagtggctcaaatgctctgttaattcatcggtggaacaatggtcatcaacgatggaacaattcaaatcggtggattattcaccactttttatgagttttttgtccctttttaaggcattttccaatgcttcttcaccagtgactttctgcattttcttgacgctttcatccactttaattgactttgttatgccatttgatctgatcaacgaagtgactggggagcaattgacactggaacatcatgatacaaaccattgttggctcacgcgttgtccaattggatgggatgagatcaaatgggacaatgtgtgggaggaagtgagtgctgctcgaccgaaacagattatcatttggatcaaggacgatggatttgacgaggggtgaacaatttaattaaaatgatcaatgcttttttggtaatagtttagcttgatatgacatctttttcaaaaataaa

SEQ ID NO: 70993 - DNA, 49 bp, Heterodera glycines; identical to SEQ ID NO: 51181
  Genomic contig location: Contig_ID=SeqID_43286; Location=588..636; Strand=-
  SCN-specific regions: Sequence locations=1-49

SEQ ID NO: 70994 - DNA, 155 bp, Heterodera glycines
  Genomic contig location: Contig_ID=SeqID_43289; Location=58..212; Strand=+
  SCN-specific regions: Sequence locations=1-32,59-155
taagcctaacttttttggcctgtttaaaaaggaattaaaaatttttaaaaattttattcatctcccttttgatagaaaaagcatcagagagccttatttaacttttaattaacatttggtgcgtttcagagcacgttctaaaaaatatttatgaa

SEQ ID NO: 70995 - DNA, 212 bp, Heterodera glycines
  Genomic contig location: Contig_ID=SeqID_9323; Location=428..639; Strand=-
  SCN-specific regions: Sequence locations=1-27,50-67,90-146,175-212
atgattctggatcatactgtaaattttcattgaaataatattttgaaatttttcagcacccatacgctttattctttgtaattcttagaagtgtcgttttattgtagtcaacataaattttagtgtcccgacctacccctaattctatctcatttaaaaaattttttataagttaaccaagagccatttttccattttgttaggccattaaa

SEQ ID NO: 70996 - DNA, 601 bp, Heterodera glycines
  Genomic contig location: Contig_ID=SeqID_9324; Location=239..839; Strand=-
  SCN-specific regions: Sequence locations=1-226,268-378,400-601
atgcgacgaaagaaaggccaaaagaatgaaaaaggacaaataacaaaacgaaacaaagttaagttagaacatgacggcgcactctataacgacatcaataacattcacctcccccaaaatgatcacaattatgccaatgccaatgtgaatcccgaaaacattatcaattttctcactggtgtttcccgaaactatgaaatgcgaccttagtttgttctgaaatttgttattttttgttatatttttataaaattttaattattttttccgtttgacgcacatccgccaaactgacaaattattgtagaagatattagccgcaagaaataaaaaaattaaaaagttaagaaatttgtccgaatgcgggttcggattcgaaacatggatgttttgcacaaatccgaccaatttcagtcctaaacagctactcacgcgaaaacgtaccccacgcgaaaacggccacgcgaaaacgtaccccagccacgcgaaaacgtccccacgcgaaaacggccacgcgaaaatggccacgcgaaaacggccacgcgaaaacgaccccgaccgctcgtcggcatgtgaagcggcgcagaatgagaagaaatga

SEQ ID NO: 70997 - DNA, 318 bp, Heterodera glycines
  Genomic contig location: Contig_ID=SeqID_9324; Location=1019..1336; Strand=-
  SCN-specific regions: Sequence locations=1-318
atgtccgacctgctctcccaaaaacgtgctgcccttaaacgggcccaagaagagttagccgaggcagaaaggaccaaccgccgcccgactccggcccctgctggacgacccctttctttggctgccatttgcccttccccatccaaaaacccgccctcgccaatcgcaatgccacggaagcagcaccggacgatttgcgggccatactccatcgacaatttgctcgcctcgccactgatcaagaggctgccgcccaatggacagagcgccgaaagcgcgaaattgctgaggaagcggaacgagtgcttaaagggctga

SEQ ID NO: 70998 - DNA, 1017 bp, Heterodera glycines
  misc_feature (977)..(977): n is a, c, g, or t
  misc_feature (982)..(982): n is a, c, g, or t
  misc_feature (996)..(996): n is a, c, g, or t
  misc_feature (1005)..(1005): n is a, c, g, or t
  Genomic contig location: Contig_ID=SeqID_9324; Location=3113..4129; Strand=+
  SCN-specific regions: Sequence locations=1-83,284-295,455-676,699-1017
atgcccaatggagaagggccaagaaatgcccataaattcgactttggattcaaggaacaccagcggatagggtaagtgtttttaataaaatagaattaaaatagaaaaaaaaactaaaataaaaaaatcaataaataaatttaaaataaatacattaaatttatttaatgaagcaaaaaattctttaaagagaaaatgaaaagcaacaaaaaaaaccgaaaaataaattaaaaatattttaaaaataataatttaatgagccaaaaataaataataattaaattttaaaaaatcaaaaaaaataaataataaagaaaaaaataattaattaaaaaatattaaataaataaaaaataaaatttaaaaaatcaaaaataaattaaaaataaaataaataaaataataattaaagtaaagaaaaaaaataatttaattataataataattttattaaggattacaaatgcggataaattttgcctgttttacgcgcttgtggcgtctaaattttatttggaagtgcatcgaaacatttttaatcgatttatgaacaatattatgagacagagggacgcagctattgagcttttacataattgtggaattgatattaacgaatatagctatggtgtggagcaattgccgaatgttcagaaatattgggtgggtttaaatgaaaaaatgcaaaattaataaatttttcaggatgagatttaccccggaaagtaccgggttgtggcatttgagaagtcagctgatccgcggaaatcgatccgtgttttgtggaagggccagatggggcgagagaaggtcgtaccgatatttttggagaatggtcactggaatggtctgaagaattacgcttgcttttttaatcgagggaaaaaattttgtgttgaatgtgaatgcttttacgatcaggatgtaaaacatactttcgattgccgggcaaggtgttattattgcaaacagagtgngaggngtgccgtgtcaaanggagagtgnagtgaagattga

SEQ ID NO: 70999 - DNA, 650 bp, Heterodera glycines
  Genomic contig location: Contig_ID=SeqID_43293; Location=305..954; Strand=-
  SCN-specific regions: Sequence locations=1-650
gcttttccctcggcttcatctcccgtcaatttcattgtcaccattcgctttccgccgccttttgctgactccgttgtgccctttgtgctgaccaacgaattgactcgggaacaattggcattgaaaagaactgacaatagccatcgttttctgcttgtccgttgtccaattgtgcgagacgaaagcaaatggacaaaatgggaagaagaagcgattggctggcgattttatgatcagtggaatcaaattgacattcaaatttataacgaggacaaagttggggacgggtaagcgaatgatttttcagaaaatccaaatttattgcgttttcaatttttaggcttctcgacgcaaatcccggcccgagtgatcagcagacagaagtgaatgaatgatttgctgagaagtgatcgatcaatttgaattatggaataattattgacgtgctcatagaaaatgttatttttagcatggaattaattgatcatcgtatatttgggttttctatgtcttaaggataaatttagtgatttctttaaacttgaattttggctgaaaacggatgtcgcaaaaattaaggaaaattttttcttagaatttgtcatttttaattctgaatccctcagaaaatctttttttaatttattaaa

SEQ ID NO: 71000 - DNA, 194 bp, Heterodera glycines
  Genomic contig location: Contig_ID=SeqID_43294; Location=145..338; Strand=+
  SCN-specific regions: Sequence locations=1-54,76-194
aatcgcacattttggccaatgctcaggagcaaattcagcacttggaattttcgctggtcaccggcggcaaaggaatggagagggaattggccagccatcggttggacgacaatgtcgccacggaactgaaacttgtgctggccgccggcctctacccgcagttcggcgtcgtggacccgaccaacaatttccga

SEQ ID NO: 71001 - DNA, 161 bp, Heterodera glycines
  Genomic contig location: Contig_ID=SeqID_43294; Location=412..572; Strand=-
  SCN-specific regions: Sequence locations=1-161
ttttccggcggcgcctatcggcaccgccggacctacatttgccactatttttacaagttttttgccgtaaaacggccaaaatagggtcatttttagtgaaaaagtgcagttgttacccagctgtggaaaaaaagttattggttaaatagaaaaaaaaaaaa

SEQ ID NO: 71002 - DNA, 223 bp, Heterodera glycines
  Genomic contig location: Contig_ID=SeqID_43295; Location=382..604; Strand=+
  SCN-specific regions: Sequence locations=1-223
atgttttcaattgttggaaaaaaggtcttcaacactacctcgtgcaattttctttcgaaggcattttacgctcatatgagcaaagatgaaataatgtggcattggcctgcgcagagtaaattttggttgtttttttcaattttgaatgtttgtctaaatgttacaaattctcagaatttgaccaacatttcatcgattacttgaacaagccggacattgacgg

SEQ ID NO: 71003 - DNA, 338 bp, Heterodera glycines
  Genomic contig location: Contig_ID=SeqID_43296; Location=1..338; Strand=-
  SCN-specific regions: Sequence locations=1-111,160-160,182-338
attatgagccacccaatttggcaaatcggtctttttaaacgcattaaagaagattcagtcgattgcttggagtgtaagcaaaaaaacgttattaatgtttcatcttcatcattttttggtttaaaaatatatttgaatacttttttatactttgaaagacttttttattaatacagaattttttgaaatttcctaaaatccgcaatcctgcgcaggatcctgcagattttaaatgcaggatttgcaggattaatcctgccggatcctgtcctggaaaaaattttgaattccaatcctgcaacaggatccgccaatttgaaatttccgggttctattaa

SEQ ID NO: 71004 - DNA, 349 bp, Heterodera glycines
  Genomic contig location: Contig_ID=SeqID_43301; Location=603..951; Strand=-
  SCN-specific regions: Sequence locations=1-66,89-349
catgtaaataatttttttccatattcatacaaacgctttttttgaacaaaagttacgatttttatttacatattttggtagatatttttgaggttttgtacatatttctttcacatttcgtgatttttttaacgaagcccaaaaacgcgaagttttcgcccgtccctgggggtgaaccgccggccgacgattccctcctgcagcagaagggtgattaactttgacaatttttgagacattatataaataaatcattcaaatttatgcatcatttgtgatagtgtccccttctctaataatcccccaacattcgaatatcatccgatcactgatcaaactgatcaatcag

SEQ ID NO: 71005 - DNA, 388 bp, Heterodera glycines
  Genomic contig location: Contig_ID=SeqID_43305; Location=254..641; Strand=-
  SCN-specific regions: Sequence locations=1-20,42-275,297-388
atgccaaaacaaaacgaaatcgttttaaaatattcctttctggacttgacttggtttcttgatatcgaagctgttttctacgctctttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaa

SEQ ID NO: 71006 - DNA, 231 bp, Heterodera glycines
  Genomic contig location: Contig_ID=SeqID_43306; Location=758..988; Strand=-
  SCN-specific regions: Sequence locations=1-231
actacgccaaagcgggccgcaaattctacccaaaatgagcgtccgaagttggaactgtgacaacaaaagaattgggatgaatgagttcgttaaatgatcgatgatatatgctgccttttatttcaatgtttatagcgcaggacagatcagaaatttgtatttaataattatttcattagatcatttctggcgttttgacaccaaataaatttttcggtcctcggaaaaaat

SEQ ID NO: 71007 - DNA, 963 bp, Heterodera glycines
  Genomic contig location: Contig_ID=SeqID_43308; Location=200..1162; Strand=+
  SCN-specific regions: Sequence locations=1-4,26-416,446-963
  Gene Ontology: Cellular component=nucleosome; Biological process =establishment and/or maintenance of chromatin architecture
atggcatctcaacaaccacaacaaagcgtgacaaattactccttgcaatttcggattaatgcccaatatatgaatgaacagttcagagactccgtaaggtgttgtctgaatggtaagtgattgttcgttctgttctgagtggttttttcatttcttatcaaaacaaaaggttctcatgaggattctttgccttttcctcactttgcattcgctgaattcctcgctgattcggcagttttatcaggtcaaatccgaaaactaaatgggaaagtgccctcgctttaggcattcgtcgtgaacttcaatccgcggcatggatgcccaaaaacaatgacctttactccctcagtcaaactgtggatttggccgattttcatgccgagcattacccaattttaaggtcccgcaaacactcttttagatttatttaatgtttttacatttagtgcttttcgtgattttatgttggaggacgtgcgaaagtggctaatgcgtgtgacgggagtgagtcttgacgaccgattggcactcaccgggtcgcgttattcgtcgggcgactgtctccttcctcacgatgacaaactcgaggttttttccccttttttcacttcgtattcgcttttatatagggccgtgcgtttgcctttgtgctttaccttacccccggctgggaagaatcagacgggggacagctttgtctgttcgactccgacccggcgaaaaattacccgggcgaaatcgttaaacgaatccaaccgcgggagaacactttcagtctgttcccagtgcagcacaactcgtggcattctgtgtcagaggtgctcagtgaacagaaacagcgcctttcccttaacggatggttccattacgctccggggacggcgaatgttgcacagacagggccaaattgcgctgtggaagagccgatttgtcgggtggagccatcgatgaatatcacggcaa

SEQ ID NO: 71008 - DNA, 663 bp, Heterodera glycines
  Genomic contig location: Contig_ID=SeqID_43310; Location=5..667; Strand=-
  SCN-specific regions: Sequence locations=1-313,345-534,572-663
atgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggagggggggggggcgaaggcccaccacgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaatttttcgaaaatctgagtctttcgtttttatttatttgcaaaattaattcataaatattttttcagaaagggttctgaaacgcaccgaaattttatttacatgttagtttaggcactctgatgctttttctatcaataatggaggtgaataaa

SEQ ID NO: 71009 - DNA, 949 bp, Heterodera glycines
  Genomic contig location: Contig_ID=SeqID_9329; Location=1254..2202; Strand=+
  SCN-specific regions: Sequence locations=1-21,43-662,684-740,762-949
atggcttttccccccctccccttcttttttctgtttccgcttgccctcgtccctctccaaaggacagctgcggttcatccaccgctgttcaaccgaattgtccccaccagcgaacggacagtgaatctgactttgacgcgggattttggcgaggcaaaagcggtgaattttggctggaaaagcgaaattttagaggacattcgttttggaggattatccaaaaaatgaacggaaaaatttatttattaggaaataattatgcctttaattaggccgcatcaaaaaatgagcttaaggggaacgatgaaagcgcaaataattcaaatttgaccgcatcaccggtggaggcgaaaattcatcgactgaaagagctgagaaacgaaatgcgtgcattgacggcgatgatcaaagaagaacgacgacgaagtgggatggcgggggctcaaacgaaacttaggcgactcgaaaacattcaggcaaatccaaagacattcggcaccggcaccgatcaatcgcggagaaaatgcgcaccgaaatcagtgggacaattaaaaatgaaattgaaaagcataatttccccatttgtttttcgcaggcagacaatttcgaaaatggcgcaaaaaagtgctaagcaaaattcacttggttatgcaacgattggaccaattggagggcgaaatgcacaggacaaaggataatttgcaaaaagtgatgcacgacaacggccgggaggaagggggcaaatggggcgggggcagcaaaaagcggcgggtgagggaaagcattaaaattggaaaagagaaagccgacttagccaccgccttcgcattccgccgaatcattgtcagcagtgcgccgcgtgcaaatgaatcggcgcggcgaattgggcaatgtgtgccaaaaccacggggagtgcaagcccggtacaatgggatgagcaatgccacca

SEQ ID NO: 71010 - DNA, 196 bp, Heterodera glycines
  Genomic contig location: Contig_ID=SeqID_9329; Location=151..346; Strand=-
  SCN-specific regions: Sequence locations=1-72,94-196
tttaattacatattttaccagttgattaatatccattcgaaaagcttgctgatatcgtcgtcataaatccgaaaaacattaacagacaaaaaacctaaagtaatcatccggcggtgaagggcatcatttcagtgctttgaatgccttcggtttggcacaatgatcgaggccctccacgtagtcgatcatctcctgt

SEQ ID NO: 71011 - DNA, 429 bp, Heterodera glycines
  Genomic contig location: Contig_ID=SeqID_43313; Location=314..742; Strand=+
  SCN-specific regions: Sequence locations=1-127,150-429
atggataaatttgcaaaaaaaaaaaaggtcttcggaccggacccctccctttccccccccccccccgaaaatttttcctggctacgggcttgattgtatgcgaatttgagtcgaatttcgcattcttgaatgtcagttataatacaatttttagctttataatgaagtgtcggctctgtacgcgacctccgaccaaatgattgttggtgaggaacctgcgccggctcaagcaggcgctgctgcggaggatgccgccaacaaatcggcaaaacgcgcagcacttgccgctcagaaacgacagttggccctggatagggtatattcttagacgaacgttattatttggagatgttagaatggaaattttattaaagaaaaccccgaacaattattagacagccattatagtcctcatttttaagtagataa

SEQ ID NO: 71012 - DNA, 538 bp, Heterodera glycines
  Genomic contig location: Contig_ID=SeqID_43314; Location=401..938; Strand=+
  SCN-specific regions: Sequence locations=1-318,341-538
atgcatttctccacaattcgaagtgccacttttcctacctccggattgctttctttggaaatgttcgacgattatgacaaaatgctaagggcaatgagcgaggcaatcaaatggcttatccttcaccttccaaaaggtcgtttcgtttataatcaaaaatctttatatatatgtataagttttcagatgaatttatgtcgagaaataaaagatttaatctttttgctattgctgaagattctggagaaattctaaccgttttgaaacagttgtcgcaatttgaatataaattccgaaaagttttcaccctttttcactaaatgtcattttttaaagaaaaaattaaggcaataacccatttgaggaacaatcgtcaagattgtattaacgcacttcatgtacgaatttcggacaacttctcgcagattattgcctttttgcgcaactctttgtctgtcaaatcagaccgaaggaccggttggtttacttatacttactgaccctgacaaatggtttcactccctctattcatttttaa

SEQ ID NO: 71013 - DNA, 896 bp, Heterodera glycines
  Genomic contig location: Contig_ID=SeqID_43316; Location=166..1061; Strand=-
  SCN-specific regions: Sequence locations=1-223,245-398,420-433,477 -619,666-800,826-896
ccgcaagtccggtgaactgtgaggtgaatgatgggtcggtgttcagctgcgcggacggccgccaatgcttcccaattgcacggaaatgtgacggcaactacgactgtcgtgacctcagcgatgaaaaggattcatgcgcaacaaatcatacggtaggagatcggttcagagtacctttggtgtacggtgctatttcccctttggtattcagtatgaaaaatcctaaaaataattaattttaaaagaattgcgcggggaaatttaaaaatgaagaaaataaaaactttaaaaaagagaaaaatctaaatcctcaaaatcttaaataattatttctgcatctcctttaagcctttcttttcgtctccctattatccctttaaaatttattgtgtgttttgatgtgcttttagaagagtaataaatggccaatttgttaaaaataatttaaaaattataaatttatgtttttatttataggcttgttttccttaccaatttcgttgcgcggacagaacacaatgcattcaggtcggcctcattaaaattggacaatttaattggtttttttttcacatttcagaaggtctgggtgtgtgatggaacgccagattgtgtgagcaaaatttaaaaaaaaaataaaattaaaaatatatttatttaaaattcaggcagacaaatcggtcagtgcgcgaagttttggtataaaaatttaaattgatttgttcaaatgccaggacgaaccttcgacatgccaatttccagcatgccaaactggcgattttcaatgtaaaaattgtttgattatttaattaatttaaatttttacttttttcattcaggcaagaatcgccgatgtgttccgcataaattccgctgtgattattacgatgattgtg

SEQ ID NO: 71014 - DNA, 487 bp, Heterodera glycines
  Genomic contig location: Contig_ID=SeqID_43317; Location=547..1033; Strand=+
  SCN-specific regions: Sequence locations=1-66,107-153,272-283,350 -463,485-487
atgaaattttcaataattttattgctttccttggccttttgtgcgttaatcatcgatgcatgtgagaaaaaattaatataatgaattatttttaatattttaaatagatccatcgggaaatggtaaagatcttgaagctgacaacgaaaaaacggaagtgaaggaagagaagatggaaaaaagagaagcggaagtggaggaagggaagaaggaaaagaaagcagcagaagaggaggtagggaagaaggaaaagagaggaagtggaggcggaacatggggcaacggaggaagaggaaacggaggaggaggacacggaggaggaggacatggaggaggacacggaggaggaaatgacagcagcggcggaggtgatgattagaagccatagctaaaaagaagaagcataatatggaactaagaaaagaacgagcacacaatgcttttagtcgcttattttttgctgcatttaaaatgttaaattttaaaa

SEQ ID NO: 71015 - DNA, 255 bp, Heterodera glycines
  Genomic contig location: Contig_ID=SeqID_43320; Location=48..302; Strand=-
  SCN-specific regions: Sequence locations=1-52,74-255
atggacgaccaatcgcttgaccattctgctggtgatctgaaagcgcaatatcgccgtctgaagaaggaaagtgccgaacaggatgagcggattagccagctttatgaaaagaaattgaaacaggagaagcaattggcggaacaagatgagagattggctcggctgagaagcaactctgagtttcaggtggaggaaaaggggtcggaatgcacgaataatggagcaatgtgccaaaaatggtctcagtttatgtga

SEQ ID NO: 71016 - DNA, 451 bp, Heterodera glycines
  Genomic contig location: Contig_ID=SeqID_1260; Location=378..828; Strand=+
  SCN-specific regions: Sequence locations=1-404,426-451
atgaagcgtgcgagacaatcggaaaagttgggcgccttccctgagattgagttcgccgtcaacacaatgggcgtcacggtgtattgcccaaggcacctgcaaacgcctcggtttgtgccatgggaccagcccgggcggtgctcgagctgcagaagcggaactgttgagctggactacatcatccagcccgagggggtgaccatcttttcgaatcggctaaagacggacggcgagaactttgtgccatttgacgcaattggtaagcttctgcatgtgtttgccaaaaacctaacccttttcttaagtggattttgccgatcgtgctaaattccgcataagggcacgaaataaggtgttcactttgccgctgcgacacccggaggtccatgccgcaggcccgagcttggaagaagccgtaaaaggacagaaggaaatgacgcagatgccataa

SEQ ID NO: 71017 - DNA, 221 bp, Heterodera glycines
  Genomic contig location: Contig_ID=SeqID_1261; Location=2520..2740; Strand=-
  SCN-specific regions: Sequence locations=1-221
ccgcataagggcacgaaataaggtgttcactttgccgctgcgacacccggaggtccacgccacaggcccgagcttggaagaagccgtaaaagaacagaaggaaatgacgcagatgccataagcacttgtccatttttccattatttttgttcttgttctgatggattacccaagaataatcgaaagtgaactcgcttttcccatcccttcggggattattg

SEQ ID NO: 71018 - DNA, 733 bp, Heterodera glycines
  Genomic contig location: Contig_ID=SeqID_1262; Location=487..1219; Strand=+
  SCN-specific regions: Sequence locations=1-154,176-325,368-494,516-733
atggatgagctgaaaaaagaaaaattttcccctcaaaatggtgatgacgtcagcatcattggagacaacaacaacaacaacatcacccaaacactgcttgacctacaaccgggcccctcaaaaaggggacggaagcctcgcctggacaaaatccatgaggaaattgcttctgcagtgaagaaagccaaggccatggaaattgaaggtggttagctttttctgttaatttgctcaaattcgcaaaatttagtggatgaatcgcccaaaaaacaaccgaaaaatgtgtttgattacccttccatattttggaaattgggtcgcccaaaggtttttaacaaaattttgttaaaaattagcaaaatgtttagtatggtgtgttcacgttcatgtgcgatgagtgtcgtggcgaaaatttccggcagggaaagagcagtttcaaactcatcaatcagaatggcgagcaacagcagcgacttgtgttcgcccaatcgttttgccaagactgtgcaaagctgaactttgactgcaccgatctgatcatgaagcacaaaaagaaggatgaatcggcaacgacaacgatggcaaagagtttccgatggaccaaggatgcagaaaaatgaaccgagttggcacaccacatataaggacttttttgaaaattttatacttgttgatcaaatgacaaactttttctttgtaattctgccgagcaatacgccaggctttgttggaa

SEQ ID NO: 71019 - DNA, 730 bp, Heterodera glycines
  Genomic contig location: Contig_ID=SeqID_1263; Location=203..932; Strand=+
  SCN-specific regions: Sequence locations=1-270,293-325,356-494,516-730
atggatgagctgaaaaaagaaaaattttcccctcaaaatggtgatgacgtcagtatcattggagacaacagcaacaacagcatcacccaaacactgcttgacctacaaccgggcccctcaaaaaggggacggaagcctcgcctggacaaaatccatgaggaaatggcttctgcagtgaagaaagccaaggccatggaaattgaaggtggttagctttttctgttaatttgctcaaattcgcaaaatttagtggatgaatcgcccaaaaaacaaccgaaaaatgtgtttgactacccttccatattttggaaattgggtcgcccaaaggtttttaacaaaattttgttaaaaattggtaaaatgtttagtatggtgtgttcacgttcatgtgcgatgagtgtcgtggcgaaaatttccggcagggaaaaagcagtttcaaactcatcaatcagaatggcgagcaacagcagcgacttgtgttcgcccaatcgttttgccaagactgtgcaaagctgaactttgactgcaccgatctgatcatgaagcacaaaaagaaggatgagtcggcaacgacaacgatggcaaagagtttccgatggaccaaggatgaagaaaaatgaaccgagttggcacaccccatataaggacttttttgaaaaattatatttgttggtcaaatgacaaattttctttgtaattctgccgagcaatacgtcaggctttgttggaa

SEQ ID NO: 71020 - DNA, 546 bp, Heterodera glycines
  Genomic contig location: Contig_ID=SeqID_1263; Location=1550..2095; Strand=-
  SCN-specific regions: Sequence locations=1-347,375-546
atggccaataaacttattctgctgccgtacgagcactacaaggggctggttgcagcgagggagacaaagaatgacgacgccgacgacattgctgagcggacaaacttgggctttgtcaaacgacaggtgaccgctgcagtacagaagcggaagggaaacgtcagcgaacggaacgcaatgtacaaccagcacctgcgccggtacctgaagatgcgcaaggaacataaggagcggcccgtccgagtacagctcagcaacggcgctcaactgctaaataaaacagtggagacgggtgtgcaggtacggcctggtccggacgaaccgaaggacaagtccgtgatggttaccgacgaagatgaagatgaagaaattgaagtgccaaagtttttaaccccaacaagccagacgcagggaagcaatcgatcacccaggaccaataagaaagcagcaaaacagcaaaaattgatcgagaagaaggaccacctgttggccatcattatgtctgatccgcagagattcggcgcaaatgaaaatgtgtcacattaa

SEQ ID NO: 71021 - DNA, 1315 bp, Heterodera glycines
  Genomic contig location: Contig_ID=SeqID_1264; Location=3153..4467; Strand=+
  SCN-specific regions: Sequence locations=1-137,164-361,384-696,718 -766,801-1042,1087-1315
atggcccgcgctcacttggcggcgctcaaatggctggcgctcagttggccatgcacccctcccacacctatggggggctaccgtaatccggtgaaaaagtgatgtgtaactactgaggcttccaaagagaacggagcgagccaaaagaaaaagaagaaattcttcagaaaagacggacgtggcaaaaagaagaatttcttcgctgtgggagcgaatgtgatcgccagcttgggtgatgagccatggcgtgccggacgtgtgatcagccgaaaagaaggcacttacgacgttcaatttttggacggcacgactggagaattcccggcaaaaggtgtacaaccgtacaagccggatgaagatgaaaatttgaattttcttcttgacgggtttggtctgaagagagcctcatccgtggatctatcgggaagcacggcagcgatggccgacgagatcaaacgaaagatgatcttcgagaagcttccgactgtggacacaaggcataagaacgccgatctgaggatgcggatgatggacggaggcccggcacttttcaagggggagatgttagggttgggacccaattgtccggtgcccattttgaccctttgtttcatttgtatttcccttctcccttcgttaagtcacgcccacttttccgcccataaatacccgcgatgttgacccttccccatcattcttttgcttcttctccatttatttgttccctttgctcccaatcgatatttgaccccgttcgccctgtcccttctttttgaataaatatttattttattcctcttcggactttggggcgtaacacaaataccgttccctctacagtaggttctttctatgaactaactcacccttcttttttggcggtatactttcggaatgtaccgtatgcaaatggttgtttagtgcggtcagccgtctgaagcgcatttggcacccgaagaacacacagacatgcgtttctgcttttggcaaatggcaaacaaagacgtggttgagaagccaatcgatctgagcgcagaaaatcaataaataaaatattaaataaaaaatgtatattaatatttatatcagaattattaacgaaaaattttccaaaataagcaaatcactggtcaaaaataagctaatttttgatttaatataattcaaaaaaaaccagtgttaatacaagaatgtttttcatcaattttcaataagcttagcaattaataaggcatcgagaaggaagtcagaaattttgactctgcttgtaacaaattttacaaaaaaatgaccatttgtggggattttcaacaga

SEQ ID NO: 71022 - DNA, 797 bp, Heterodera glycines
  Genomic contig location: Contig_ID=SeqID_1264; Location=4542..5338; Strand=-
  SCN-specific regions: Sequence locations=1-57,79-192,214-519,563 -720,756-797
aaagtgtcggaacatcatcaagttttgagcggtcaatttacgaaagtgctgacaatgagtcggcatcatcatcatcatttgatcattgtggtcagaatgcgaatggagaaacagaagaatcggcaataatggacaaaatatcaaccaaaattgatcatttggacaatgattgggaggattttgctaattggaagaaaagcggtgggataaaagttgaaatggtcgaaaacaagcaaatagaaaacaaaagttgtaaagaacaaatttggatcaaagaagaagtttcggagtttgatcaaatggtggaaaatgatcagaatgccaaggaaaatgaaaaaataaaaagtgccaacgatgaaaatgaaaacggtgccaaagaaaacaaaaaatttaacagaaacaaaaaaattgttgtacaaaatattataagaaagtgtgaatgggctgaatgtgaattgaaatttgaaaatgacaacaaattgtatgatcacctcaaaacagtttagttttttaaaaaggaaatttaattaaaaaaaaattaattttaaacaattaaaattaagacacatattgacgaactaattgaaaaaaacaaagaaaaaatggatgataatgatcttccgaatttgaagaacactgatgacgaagaaaaatttgcttgtaaatggaaggactgcgatttgcctgcccggcggaggaacactcaaagaaaggttacacaaatttatttattttgaataattaatatatattttgccatgccaaatcgtaaaagcgttaattggtatgggaataaa

SEQ ID NO: 71023 - DNA, 2636 bp, Heterodera glycines
  Genomic contig location: Contig_ID=SeqID_9331; Location=57..2692; Strand=+
  SCN-specific regions: Sequence locations=1-51,76-627,650-1299,1360 -1444,1521-1671,1693-1798,1820-2005,2027-2060,2082-2636
atggttacaatggccactgacttttgcaacagattgccaactgaagggtacaattaaaaaattaaattttatttagccggggtgccaattttatgaaaaacgataacccaaacgctagcccattttgattagaccttacaaattttatggctttaaaattcaatttccgaaacatattggttggtgccttctctcaattcatatgcgcacatataattcgtggccaattttttgccaagcgatgaaaaagctgacaaatatggccaaatgatgctcccctcttacaattagcacaaaaattaactctaaagccgaccatgactggttaatgctttgaccttttttgtctgctcttagccggaaattttgttattaaacacaaaagtttatgttatgttaattctatgctttttaaatttttagtggtttttaggcccgttgttttttcgcgcataggtgatgagaaaagaaaccctaaattggctcgaattaggaaaaatttttcaaccaggccgccattacccaatcgcaaatgccgaacccgcaaatatcggttaaaccattcattatattaaattattatggaataattaccgctttttcactattttatgccaaaaatccgggcccattttttatttaatgccctacaaaatgccaattttagtgaaaatgtttcatctggatacttgcattgtgtgcagtttttgctttaccatcatatgcaaaagctggtgtggcgccttgagaacaaatggggcattatttctgatcaaaataatgacaaaaatttggaagcaaaaaatcatttattgcaaatttacacggagaaaaaaatgatcgcatgggaacaaatggtgaaaatctatgggaaagagttgaaggatctgacagaggtgaacgaactgattcggaggaaattcgaattttgtctgatcattgagggcgaaacgcgtgagtttttttttgatgagatttgtcacaaggaatagttttgtcttatgtgccatttatttttcggggtccggacaatccgtcagtggtcaatccgtcagtggacaatccgtcagtgaaggacaatccgtcagtaatggacaatccgtcagtaatggacaatccgtcagtaatggacaatccgtctcagcggataatccgtcagtggacaattcgtcagtaaatttttttttgagcaatcattaaaaatcttgcaaaaatgatcgttaaatttaataacgtaatttcttatagattcataacatttctagttactttataattcaattaattgaccatctcaagaaattatcatttaattcttttaaaatgattatttcataatttttataaaaattattaattcacatttttagcgacttaaattaattttcacatggttacaaataaatctgggtgttttaaaaataaatttgcttatggattagttactgacggattgtccactgacggattgtctacttactgacggattgtccactgacggactgaccactgacggattgtccgggagccttatttttctatgttatgtttttgtcgcattagtcttttttttttgaaaaattcgccatttttacattgaattttttattaatttctcctggctgtgactattggtgccgccggccgttcccttaaaatattcagtatttgacctaaaaaagctacaagtaattcctgaagaatattttttaacaatgcacataataattccaaattttcccgctgcgcctttcagcgccggcgacaaaccagtaataaattaaaattttatcacggcaattccacaagttgttcataaaagttaaaacagtcacagacatatatgagggcaaacaacttttaaaggattttaacagtttgaaaaaagtttagatattttttgatatttgggtagaagtaccaattttagtcatgttttttttttaatttatctttgtatagatattgttacaataagactatcagattcagaaagctataaaatcataaattaagaattgaaatgcaatgcaattggtgccgaaaatgcgcatttgttcctcaaaaatttccacaaaattgtgtttgagccagaatatgaacggaactggtcaaaaaaagcagaattaattggaacaaacattttcaattcgctgagaaaagaattgcggaagaacgaacaattgaagcagaacaaagggaatgaggaccaaaaagaaaaggccaaaattatggccaaaaattggaaattggccgaaacatcgatgcgtgtacgagtccaagtgttggtgaacacagcggagagaaagtgccgaacattaccgaaaaaaccgtttcgacagatccaaaaattgggaagaaatttatcgaaacgactcgaaaggtcatggagttcgaaaaatagggaaattaaccaaaatgaaagtggaggagataaatttgatgagttgacgttggaaagtgaaaattatacaaaaaatccttttcgaaatggagagagaaagtcaattaataggacgacacgaagggaaaatgaaaataccacgaaaaatccccttcgaaattttcaagaatttggtagaagcatttcaaaacgattggaacggtcttggagttttaaaaataatgaagagaat

SEQ ID NO: 71024 - DNA, 234 bp, Heterodera glycines
  Genomic contig location: Contig_ID=SeqID_9332; Location=343..576; Strand=+
  SCN-specific regions: Sequence locations=1-22,45-234
atggacaaaagctttgatgagtttttgttccaatgtgctggacaattcattgaggccgttgccgaggaacaattcagttataaattgtttgtcaatcttaacacaatgcaattggacaccgaaatggactttccgccatccatgaaagatgaaataatggtatcaaaaaatgttggaaaaaatgccaggggcaaatggttcatgatgcggtcgatatcctaaataaatttacta

SEQ ID NO: 71025 - DNA, 930 bp, Heterodera glycines
  Genomic contig location: Contig_ID=SeqID_9332; Location=909..1838; Strand=+
  SCN-specific regions: Sequence locations=1-37,59-232,272-318,363 -426,458-567,609-682,717-930
atgggcagtcagaggaagcactcggcggagaggaagctgtacaaggcacagacaatgcgccggaggagacgaaaacggacagacgacaacgaaatttttgggggacaaaaaacgttgggtgaattaatgagtgaggaacggcagctacgaaaaagcgaattcaccggtgagagtttagctcgatgaaatgaaaaagtgaatttaacgggccaaatttaatgaccatttaacgttaaaatttatttaaaaaattttaaacaattaaaataaacggatagcataagttttaacacatgagccttaatgggtattgtaaacataaattagaaaatgaaaaaattaaaaacatttatataaaataacacaaaaagccctaaaaaattattaatagcgccgccatggaaattttaatttataagtgagatttgttaataatttttattaaaaaggaagaaatgtagatattaatttattagatgattaaaaaaaacatttatagccctccagtcaaaaattttgaaaatctatttctgtaaacatgcagatttttaaattcctgtctcgaacataaaatttttttttgaaaataataaaataaaataatttatgttatacacaatggaatttagacacaattgttgcgatccgatgcttacaagaagaagacgaaaccagctcaagtgaacagcagcagacaaaaacattgggagaattatttgacgaagaccattttgaagcaccggaaattgtaatggaaaaaattgagcggaaaatggagaaaatcagacaaaaaattgcacaagaatcattgggaaaacggttaaaggattacgaaatgtttatccgcgctttttacatcgctttggcatttgaactgtttgagcgaatgcacggcgaggagggcgcaatgacaacaaattggcactttgt

SEQ ID NO: 71026 - DNA, 823 bp, Heterodera glycines
  Genomic contig location: Contig_ID=SeqID_9333; Location=144..966; Strand=+
  SCN-specific regions: Sequence locations=1-277,302-682,704-762,785-823
atgaagctgaacctggaccagttcactatgagctacgatggtacgttcccttcattagtgcttttgttcaagagtcttggtctcgcgttaaagaatgcgggtttttaaggagcctcctcggtacctaatctcagtctcgatgctaaatcttgaccggattcttgggaaatgaacaatcaaacagcaccaaaatcatcaactcattttaataaattagctaacgttgcaataaaaggatcggtcatttgctaaatgatccacctacaaattcatacaattcaaaaaatacaaaaacaaattaaactttcaaagaatattatatatatctaaaatttaacaattaaaggacagtgcgatttgaccaatgatttaaacgattgttttgttgcgtcggatggcattgactttgatgcccaagttgaaaaagtgtcgctatttggcaaggaaaccagtgaaatgagcacattagaaaaggcagcggaaagtctgttcaaaaagttgaaccgatggagctacaaatttgggcagagaggcaaacggcaccgaaatatactgaagcggtatttcagcggcaaaatgaaagacattttgggagtcattcccgaaatgatgactgacaaagtgtcaccatttgaggtgatttggtcgagtcaggacatttcaaccccatgaacattttacatttcataaatgatttcttagtcaagcattttattgcttaaatttgtatggcaatttacaaatatttaaaaaaagttttcgttttaaattttagaactcattcaaaaaattgaggcatatacacaattgaatatttatttaa

SEQ ID NO: 71027 - DNA, 504 bp, Heterodera glycines
  Genomic contig location: Contig_ID=SeqID_43322; Location=541..1044; Strand=+
  SCN-specific regions: Sequence locations=1-504
atgtctcgttttttgactcggtgtgtttacctgatcttaactcatataagccttaacttcaggttggaagcgcctggatatcattcaatcgttgattatccgatgtcattttcaacaatcaatgacaaaatagataataatatgtacttgaatttggatcaattcaaatctgacatttgtctggtttctgacaacgcaatgctttacaataacacaggaagtgtttattttttggcagcgcaaaaattgaaagttttggcaaaatattatttttccgagaagtatcttttgttcctcgtctattcgttgccctttggaaaagccttaactgaggagcaacttggaatacgcttacggaggaaagaggagcaaacgccgagacaactcaaagagaaaagtggcagggaaaggccgttgccttttctgaggcaaagcctggcctttataagggtgaaaataatgaaacttattttagtgacagtcaaaaaactgaggaaatactaa

SEQ ID NO: 71028 - DNA, 192 bp, Heterodera glycines
  Genomic contig location: Contig_ID=SeqID_43323; Location=518..709; Strand=-
  SCN-specific regions: Sequence locations=1-192
atgaatgataaaatcgactggctcggccttcgcggcctcgcatccttttcttggctttttctccaatcgccgggactcaacccaccagcatttcaatcactgggactcaacccaccatcattccaatcactgggactcaattctcctgcatttcaatcactggcactcaacccattttcatcagctcttctt

SEQ ID NO: 71029 - DNA, 819 bp, Heterodera glycines
  Genomic contig location: Contig_ID=SeqID_43325; Location=85..903; Strand=-
  SCN-specific regions: Sequence locations=1-507,529-659,686-768,811-819
acaaaaataaatcgattttttcaagtgtccgtttggggtactcaaacaattatggggagcaaaaatccaacgcagaattaaagtacaggctatagggaagctattccggaaggattcggtctccccataaatctgggcgcatcggttcgtggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagact

SEQ ID NO: 71030 - DNA, 832 bp, Heterodera glycines
  misc_feature (780)..(780): n is a, c, g, or t
  misc_feature (795)..(795): n is a, c, g, or t
  Genomic contig location: Contig_ID=SeqID_43326; Location=1..832; Strand=-
  SCN-specific regions: Sequence locations=1-193,217-359,381-832
taattaaatccattccttgcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaatttttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaaggatcggtctccccataaatctgngcgcatcggctcggngggactgccccgaaaacaaaaaaatcgattttttcaa

SEQ ID NO: 71031 - DNA, 522 bp, Heterodera glycines
  Genomic contig location: Contig_ID=SeqID_43327; Location=109..630; Strand=+
  SCN-specific regions: Sequence locations=1-69,100-253,279-488,510-522
atgggcgttagtcaaaaaaccatcaaattaaaaaaaaaatttttgctaaaactttgctcaacagcaaccaaatttttagttttttttttaaatattaatcttagcactaaatttcttttgttctccttcaaaatttttcaaatttttcgttaagttttaaaaatgttatgaccaaaaatcttcaaaaaatttttttttggtttatttggatgaagttatgaataatttctgtcaaaaagtttccatttgatggttttaatttaatttaatttttttttcgtacttttttccatattcttttagagtccgcctgctgagaataaggaacaggtcgaagaattgcagaaagccatcgaaaatactcgcgaatttcaagcgatgaaaaaggataagcaaattaaagagatcaaagaggataaggatgttcggcttgcttggtttggtccacaaatgtgggattttattacgaaaaaagaagaaggaacaacgagtgaagcagcagcacagaaaggagatttgtga

SEQ ID NO: 71032 - DNA, 469 bp, Heterodera glycines
  Genomic contig location: Contig_ID=SeqID_43328; Location=54..522; Strand=-
  SCN-specific regions: Sequence locations=1-469
gtttcaaatatcgtaagattgtttgatagggccagacaagagaaggcaactgttggtagcaagtttgcggtaaaaaaatgagaaaaaagagatagctattttttggtcaagaattttttttgtttgcgtttcaaatatcgtaagattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaagagaaggcaactgttggtaccaagtttgcggtaaaaaaatgagaaaaaa

SEQ ID NO: 71033 - DNA, 49 bp, Heterodera glycines; identical to SEQ ID NO: 51181
  Genomic contig location: Contig_ID=SeqID_43330; Location=362..410; Strand=-
  SCN-specific regions: Sequence locations=1-49

SEQ ID NO: 71034 - DNA, 774 bp, Heterodera glycines
  Genomic contig location: Contig_ID=SeqID_43331; Location=324..1097; Strand=-
  SCN-specific regions: Sequence locations=1-4,26-122,156-218,240 -404,443-579,707-774
atgcacctttctcctttttgtgcaacagttccatttttatttttcttcggtaagaaacggtgggagcgtactgtactcaattcttgaaataataaaaaagaagatctttgataatttcagagaaaaaaaaaataatatttttaattttatttattgtttagtcgttttttgttttatcatttttttaaaacggctttggtggttttcatgcccaaaaatcataaatcaccaagaattttctggagatttgaatattatactttaattaaatttaccttcaattccaattttgaattatctttgccacaaatatttcctctaatttctcaaatttactaggcattttttggcgatcctgatcataataatacacattttcatgacctttttaattaaattgtcacaattttattcattttaataacttaattaataaaattatggccccaatttttacaacttaccaaaccaaatttcgttctccaatcataaattgaacgtgaacttgcgcaaagtttctcgcatatttctttaaattggtcagcatattgtctcttatccccactctcaatgagttccttttttattttataaaatttttcacattttcagaaataaaaatgaaataatttaaatatattaaaaatttatgttcatttttatgcataaagaaattttaaatcattataaaataatcatataaataggaaatccgattgaatttgaattttatttttttgccaacataaatcaaaagtacaaaagtcaaataaa

SEQ ID NO: 71035 - DNA, 165 bp, Heterodera glycines
  Genomic contig location: Contig_ID=SeqID_43331; Location=14..178; Strand=+
  SCN-specific regions: Sequence locations=1-117,142-165
ggctggggtggctacggctatggctatccctacgggttttatggcaaacggcaagccggttttggtccatccggaaatgctggcacttttggtgacggtggagaaggaaatgccaacggaggaggagaaggaagaggagggccatcgtcaccaaacaatttttga

SEQ ID NO: 71036 - DNA, 3513 bp, Heterodera glycines
  Genomic contig location: Contig_ID=SeqID_9334; Location=1..3513; Strand=+
  SCN-specific regions: Sequence locations=1-123,145-308,330-533,557 -1830,1852-2605,2627-3513
  Gene Ontology: Mol. function=protein serine/threonine kinase activity; Cellular component=cytosol; Biological process=signal transduction
aaagagatcaaaattcttcaggtccgttacttttttatcggtggttaatgaaaattaaaaaaaaagaaaataatgtctccattttacaataattgttttcctaggaattgaaagggttacaacatgaaaatttggtgtcactgttgcgctgtgttgagaccagtacccacgtgtacttggtgatggaatattgcaaccacggggacttggccgagtatctgttcagcagacagtcgctcaacgaactcaccattcagcacttttttacacaaattgcgcgggcgttggaggctctgaatagaaaagcgattgtccacagagatttgaagtaaggcaattaaaatctgtattaatggggctatatttgcgctattcccattctttccttactgaaaatcgttcgcaggccccaaaacattttgttgtgcaatccgcgacatcccctcgtcccgctgccttctcagctggtcgtgaagttggccgacttcggcttcgcccgttctctacccgaagggataatggccggcactctctgcggctctccgatgtacatggcaccggaagtgatcatgtctcacaattacggagccaaggcagacctttggtctattggcaccatcatttaccagtgtctaaccggaaaggcgccatttgtggtatgttcagcagaaatatttggactaattagagaaaacgtgatgtacacatcgaattaaggcacaaacgccacaggcactaagaaattattacgaaagacacgcggagttgaagccaaacatcccggatttctgttcagccttgttgtccgatttactaatgagtcttttgaaaaagaatccattggatcggattgaattcagtaagtctgtgccttcctgtcactttcactcttaatcagctaatctttgcaatttatcagactctttcttcaatcatccgtttttcaccaccgaattgccaacttcgaatgtttcaccttcgcgtcatttggtgcgtcgcccatccgctgaagttcaagcccaacccacccaaaatcggcctaaattttccgggagtcccacacaaacgcaaaatgggcccaattgcaagtcaccacaacgatacgcaacttcgcaccaacgaattccttctgcggatggccacagacatttagtaagttggcctttcgttgatttctttttatgcggttggccttacgagaacatttgcttttactcattcattggcttttcagcctcagtccgtgcgaaatgcgcacgccccgggcgttttgcggcgccaagtgccgccaccctcccactcacgtgccccctcctttcccctggcgaggccgacttcgcttgaccggtcccaaaacgcagccgcgatgaatgaatcgactgacttcacttttcttccgcctctgcaagagacccgtcatcaatttaaccaaatccaacggacaaaagcgaattccccgcaaagccttcaacagtcgggcggttcttcgaccggttcattggaaaacccggtcaaacaagtgcaagttagctactgatgcattgaatttattgtttgaattgcatctcccaggttcacagcagcattcctcgccaaaaaccaaatatcgcaaaggctgtccctgtgccgaacaaacggcacgcttttgccaaaatggaagaaagacgaaatgcgtcaaacagaagtcagcagtcaatagagcgacagacgagtttagaggagcagcaacggctcgggaagggaacggatgtatttggggaagagaagaagctcaaagaaccgattgcattgattccttcggtggaagagattgaattgcctgaaagtgggaattgaaatttagagacaaaacctttttaaggcatgtttagcccgtttcattgtctatgaccagcaaaagacgagtggtgctgctgcttcacgttcctctcttccggtctctggccgattacgtcgcaatacgactgcaattgatgagccgtccacttcgaatgctccttctcaaacaacagacggaaatgacaaattcccaatgatggcaattccaaagtctgccaccttcgttatgacttcgattggaggccaacaacaaaaagaggcggagaagacggctaaggagttggacaacatccgatttcagaacacaacgccaccacccaccgtttccggattaaatgcgcacaatcagaagaaaatagaattcaaagtgatcaatgagacgaacgggacagaaaggcattccaatttttcaaattgtagttaatccgtttattttaagtgaaatggacgaagatgaagtcggaatggaagacccgatccaattgccgttcacggaagaatacatgggtaaaaaagcaacggcgtaaggtcaactcgtttttttcgtgtttcagaagaatctgatgttatttcgcaaatggccgaaagcacatgtgctggcgaaagggaaaagcgaattgaaagtgtcggcgatggtccgtcaccgtctatcaccgacaacagcgaaatgattatccaaaatgcagatacgaatgacaaggcgccgtccaccacagatcgttcccctgacaattttctattcgatgcacccgacccgccccccgaattggagcaggagacactcctcggggccggacacaaacaaaccctggctaaattgcgcttcgtgttggacctaattgaagcaattgcgagcgtagcggagaacaaaacgaatccgatggcaattgcgatggagggaaacaagcggaaatcggtgccctttcacggaattatcacactgacaaacctttactcgaacagcgccaacatcagtcggatgcctaccgccgggcggagcaattggtgctttatgtcagagctttgcatgtcctttcttccgcactcgtaatggcacaaaaacaaagtacaaacgaaaatgcaaaaatgtggccaactttcacaatttcttttagttaacgcgagcattttgcacccatcgtccgccgttcaaaatgtgttaaatcaactcaatgagaaataccactatgtataaatgatacatcacaaaatttgcaataattattctgccctagtgtttggcccggtcacaagagttggcttcgttgggaattcccggccaagacccccaggcgatggttgtttctgcggaacgcattatgtaccaacatgccatcgacttgtgccaatcggcggcgctcgacgaactgtttggaaacccgcatttatgtccaaaacggtaccaaactgcttatatgatgttgcacactcttctttacacagtcagtttttggatatttttcatttatcatattacgttaattttaaggtgcaaaatgagcaggacaaaactgttttgttaaagtacaaaaatgcagtggaaaaacgacttcgcattctcggtttcatattgggaaatattatactgataactaactattaaattgcttacaattagtttttctaagtcggaaaactttagagcgccaaggcctatgtgcatctgtgatcaat

SEQ ID NO: 71037 - DNA, 508 bp, Heterodera glycines
  Genomic contig location: Contig_ID=SeqID_43333; Location=464..971; Strand=-
  SCN-specific regions: Sequence locations=1-157,187-333,357-508
atgaatgtcgatcatttgcagcgcacctcacatcgcaaattggcagatcaaattgcggatgtaataagccgcgacagatcacgttccgccagccgggcgtccctcgaagggatcagtcgggaagttcggcacaaatttgcccattacacgccaaaaaagaaggagcaacaacaaacaagacaaaacgattcggttgacccagaggatgctcttctgatcctcgggcttgtcggtacacagaaggcttacagacgactaaaaggcactattcgtctgatcaatgccaaacttgatgtgtttccgccactcaaaaaagtaaaaacatattttagcattttttatattatttaaaaattccattgattattgttaggtgcttgacatcaaacgccgtatctgtgggccattgcaatacgcaccaattgagaccaatgtgggtgttggatttgtgtcactgatgttggggcagctttggaggcgcgtcttttgtctgccaaagacaatctga

SEQ ID NO: 71038 - DNA, 264 bp, Heterodera glycines
  Genomic contig location: Contig_ID=SeqID_43336; Location=245..508; Strand=-
  SCN-specific regions: Sequence locations=1-100,122-264
  Gene Ontology: Cellular component=nucleus; Biological process =neurogenesis
atgtccaaagaggccgacaattttaatagttttgacaaagcggacgcacttatggacgttcccgagtcgtcacgcaaaaagaaattagtaaaactcggcgcaaaagtattggagacgaggaaagaggcacgaaaagtgctacccgaggagcaatatgtgcagaatttggagaagttgattgtgcgcgattactttccggaattaccgaaaatgaaggtcaataaaagcgatgaaattggcaattcgaaatttaattgggtttga

SEQ ID NO: 71039 - DNA, 805 bp, Heterodera glycines
  Genomic contig location: Contig_ID=SeqID_43339; Location=514..1318; Strand=-
  SCN-specific regions: Sequence locations=1-9,40-805
atgcagttgtcgcaggcgcttcgcctcgtcaatgaacggacgcttgtcagcttcgtccaacagcttccactcgtggcccaactgtttggagatggtcgaattgtgcattttcggattgtccgccgccattcgctttcgcttcccgcgcgaccacaccataaaggcactgacaaatgggcacacttttcaatgattaattcaagtgaaataaaaaatcaattattttattgtaaaattcaagaaaaaaccaacaaaaattataaattttgttacttcatcggccttttcacgtgctcatccgcttcttcgctgcagcgatggcttacaacagcagcagttgctggtggtaagcaattcgcttaaaaaaccgtaatatggacattttctcccactgttaaatgtcgaacattccataaactccgcttccttgggtctttttttgacctcatctagaatagtatttggtggcaaaaaatcgcctaaaaggcactaaaattaaaaaaagatgaaaacggcaccaaaatggaaaaaatgcataaaaaactgaaaatagccaaaaggcaaaaattcttttggaaaagggaaaaattttaacatttaaaaaatgatacggaatgtttttttaatttgattaatattattgtttcataaaatgttcactttgagcattgtccggttctttgattactttttccattgccaaactgtacagttgtgccgcgactgatcgaagacaatggaatttgtttttgatgttgtgtaatgagtggtagcattaaaatgacaattaataatcttaaataaa

SEQ ID NO: 71040 - DNA, 346 bp, Heterodera glycines
  Genomic contig location: Contig_ID=SeqID_43339; Location=975..1320; Strand=+
  SCN-specific regions: Sequence locations=1-84,107-305,336-346
  Gene Ontology: Mol. function=transcription factor activity; Cellular component=cytoplasm; Biological process=cell fate specification
ccagcaactgctgctgttgtaagccatcgctgcagcgaagaagcggatgagcacgtgaaaaggccgatgaagtaacaaaatttataatttttgttggttttttcttgaattttacaataaaataattgattttttatttcacttgaattaatcattgaaaagtgtgcccatttgtcagtgcctttatggtgtggtcgcgcgggaagcgaaagcgaatggcggcggacaatccgaaaatgcacaattcgaccatctccaaacagttgggccacgagtggaagctgttggacgaagctgacaagcgtccgttcattgacgaggcgaagcgcctgcgacaactgcatat

SEQ ID NO: 71041 - DNA, 1019 bp, Heterodera glycines
  Genomic contig location: Contig_ID=SeqID_9335; Location=1186..2204; Strand=-
  SCN-specific regions: Sequence locations=1-567,590-646,668-1019
atgctcaagcggcgtcaacccgctccgcttaacccccagcgagttattcgcgaaaatcgaaaaacgccaaaaatggttttcaaattttgccaacgtgtacaggccaggcttttgcaggtaggcctgccaaataaacgccaagttttcccaaacactccaacttaaaatcctcccaccaagcgtttttcgctcccgcttcttcccgcaaagatacaggccggcaaaaacggacaaaaaaatttttgggccgtttcagcgccgctggcgctcagttggccaccggaccggaaaacccgtatttttcccagatgcgccgtcaaaagttggttaagtgatgtcacactcccgcgcccctcccggcgcccgttctcgagattttggttttagaaacgaaacccaacattattgtatatagagtagaaactagcgggtgcgtgaaccgtcggatatttagctgggaaaaagcgcttcgcgctttcggagcttcgctacctaggctgttacgggggaagaggtacaaccacgggtgggaaggtacaattgtgatcagaagagatacaactacggttttttcagggatttttaggccgcttcgcggcctcgaacgggcgattcgcgcccgttacaacggtgattagaagaggtaaaatggtgattagaagaggtacaacaatgattagaagaggtacaaaagtgatagaagaggtgtaaatttgatgaagaggtacaacagagattagaagaggtacaaacaatgattagaagaggtacaaaagtgatagaagaggtacaaatttgatgaagaggtacaacagagattagaagaggtacaaaagtgatagaagaggtacaaatttgatgaagaggtacaaatgtgatttaaagaggtgcaaaagtgatttaaagaggtacaaaagtgataaaagaggtacaaaagtgattagaagaggtacaacagtgattaaaatttgaacgaaagtgattagaagaggtacaatcatggtttaaaatgaaataaa

SEQ ID NO: 71042 - DNA, 253 bp, Heterodera glycines
  Genomic contig location: Contig_ID=SeqID_43342; Location=52..304; Strand=-
  SCN-specific regions: Sequence locations=1-107,134-217,239-253
atggagaaggcctgcaaaatttggagagattatatcgatgttagtgcgctaggttcgatgaaactttttaaaatataagcctaaactttttggcctgtttaaaaaggaattaaaaatttttaaaaattttattcatctcccttttgatagaaaaagcatcagagagccttatttaactttaaattaacatttggtgcgtttcagagcagtttctgaaaaaatatttatgaattaattttgctaaaaaaataaa

SEQ ID NO: 71043 - DNA, 665 bp, Heterodera glycines
  Genomic contig location: Contig_ID=SeqID_43342; Location=372..1036; Strand=-
  SCN-specific regions: Sequence locations=1-351,387-665
aaaaaaatatttatgaaacaaaaaaaatcgatttttttcaagtgtcgttttagggtactcaaacaattatggggagcaaaaatccacgcagaatttaaagtacaggctatagggaagctattcccgaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcagggggactgccccgaaaacccaaaaaaaaatttttttggataaaaattatttaaatgaactgactagataatatttaaaataggttattactcttcctttcagtatccctgcaaagtttggtgcgcttctgatcagtttctgaaaaaaaagttaagcctaaactttttggcctgtttaaaaaggaattaaaaattttattcatctccctttttgatagaaaaagcatcagagtgcctaaactaacctgtaaataaagttttgtgtgtttcagagcactttctgaaaaaatacttatgaattaattttgcaaaaaataaataattaatgaaaaagt

SEQ ID NO: 71044 - DNA, 174 bp, Heterodera glycines
  Genomic contig location: Contig_ID=SeqID_43348; Location=1..174; Strand=+
  SCN-specific regions: Sequence locations=1-153
aaaaatttttaaaatgagaattcatgcgagtttttctggaaataagcttaatagggcctagttaagctgtaaaaaaaatttgggggcgatttgaaagagaataaaaggacccaggttcgatgaagttttggtaagccaaaaaaaattccaaacatttaaaaaatctataaaaaa

SEQ ID NO: 71045 - DNA, 697 bp, Heterodera glycines
  misc_feature (603)..(603): n is a, c, g, or t
  misc_feature (610)..(610): n is a, c, g, or t
  Genomic contig location: Contig_ID=SeqID_43351; Location=1..697; Strand=-
  SCN-specific regions: Sequence locations=1-293,315-697
gtctgcccactcttgcctcgcccgtcctcctcgaccgccactcatttctgactcggctaattgtccaagaaatccacgccgacctcagacacgccggcgttgactggactctgactgagttccttagccgttattggatgcctcaagcacgacgaacaattcgcggcattcttcggggctgtccatcctgccggagaatgacggcacctccctttgcaaggcccactatgccccctctgccctcaatgcgcttcaaaccggccaatccctttgagtttgtcggtctcgattttgccgggcccaccccctctcggctaagcgacggatcactgaccaaggcgtatttggtcatcatcacttgcttcgtcacccgcgccgtgtacctcgaggcgaccaccgacttgtcggccccaagcttcattaatatcttacgacaattctttagccgtcgtggccgaccacggcgaatcctgagtgataatgccctaccttcgtccaaaccagcaaagccctcgacattctgacctgccccccgtccgaaaccgacgtcgtcacctttgccgcgcgccgaggcattcagtgggacttcattcccgcctacgnccatggnatggggtctttgtacgagcaattaataggcctcgtcaaatcgtgtatcaagaggacaattgggtcgacggattctcgactacgacga

SEQ ID NO: 71046 - DNA, 930 bp, Heterodera glycines
  Genomic contig location: Contig_ID=SeqID_9337; Location=4426..5355; Strand=-
  SCN-specific regions: Sequence locations=1-176,198-782,824-930
atgatcaactgcagaagtgaatttgtgcgtgttcaccttgaacgaattgattttgttaacgaatattttgacaattccctaaaattttctcaatgaaacgaataaataaatgttaatgaaaaataaatttttcgtaaggaaaagccatttccaaatgcaaaactagggatcgatatttaatgggaaaaatccaaaaataatttactaaatggaacaatacaaaaaatattgagaaaatgttttcatgggatctggatttacgtaatgataaaatatcaattttcaataaaaaaaagagtgaaatggggaagaattgaacctgagaaataacgcacaaaatccaagagactaaccactaagccatatgagcataaatttagcccctttctaaagtaatattaattaaattgaaaaaatttcctcgaacttttgtcaacattttgaccctgacccccatttttaccagtctattttaatacccggttggacccggacccatcgggtggggtaccgggtattggattttccaaaaaccgggtccgcgtagtgaaaaaaccgggtatcggggtctgggacccggtcgggtacccggacccggcctaccctaattaaaatcatgaatgatgtcaaaatttgtactgtgtattcgacacttggccaccatggcaacggaaaaatctctcgaacaaaaagacgaagcgttttttgagtgcaagatgatggctgagttttgaaaaattattatttaacattaccgtcgaaaaaattcaaaaataagagacaatttttttaatttcaaatttataaaaataaaattattttacttgattatcactgcttcagcgattgcgtttaaaacagaataaagaccaagtctactgcaatgatcatgcttattaatttcgcatccgttgtccatttacaaataaa

SEQ ID NO: 71047 - DNA, 769 bp, Heterodera glycines
  misc_feature (28)..(28): n is a, c, g, or t
  misc_feature (62)..(62): n is a, c, g, or t
  Genomic contig location: Contig_ID=SeqID_43359; Location=69..837; Strand=+
  SCN-specific regions: Sequence locations=1-384,406-769
atgagggcggagagacaaatgcaaatgnagcagcagcaggtggttgggcgtaattagttttnaaaacaaagccccctagactcaattagcgggtaatgattccaattagactaagtcggaacgggggtgttaatgatgtcggttttttgaagtgagattcaacacaaaccccttttcagtatcagcgattaaactgattattttaattgttttagctttgaaacaatattattatttttcttttttaccgtttagaaaaggtcccatttttccaaaattacggtcccgattaattctaattattaataatagcatttttaagggaggaaaagcggttgaaaatgaatcgtcacaatcagcaggaaaagaaaagatcactctgggaaagtaagtaatcctttcaaatttagcgttcaattcgattaacctttggtcggatttgaggctatttgaatgtgcggataaagcggatgaagcagatgaagcggatgaagttaatcgggcacttgaggaggtggaactcgactggcgggagaaggtggacgaaaagagacgccggaaaatggaaaaggacttccgcaggatggagaaggagcgtgcggagcagcagcggaaagcgggcgatgtgcagcctgaacagctgagcggggcggagaagcgcaagctgtacgggccacagtttgacgcggccaaattcagggctgacgtggaggcggaaaagccgtgcgacggggagccgctccaagttgcggagtattaccttttcagg

SEQ ID NO: 71048 - DNA, 181 bp, Heterodera glycines
  Genomic contig location: Contig_ID=SeqID_43361; Location=473..653; Strand=+
  SCN-specific regions: Sequence locations=1-26,51-181
atgctgatgaatggatttgagacgggtaaattttattttttttattaattgggcataattcccttaattgaggcttattgtccattaacggcgcagttttctgcacttatcctgacttgatttacacatccggatcagttggtttatgtaagaattttttgtgaaattttggtttttttaa

SEQ ID NO: 71049 - DNA, 1601 bp, Heterodera glycines
  Genomic contig location: Contig_ID=SeqID_9338; Location=3812..5412; Strand=-
  SCN-specific regions: Sequence locations=1-322,344-684,706-1064,1087 -1180,1214-1270,1292-1414,1437-1601
  Gene Ontology: Mol. function=protein binding; Cellular component =cytosol; Biological process=anti-apoptosis
gcacaggccgattttgcgttgaatttgctgcgtgaagtgtccacggacgaccgttcgtgcattgtttcgccgttttctgccgccgtcactttgtccatggtttacgcgggcgccaaggaaaagaccggcgaagaaatgggccaactgctggcaaatggtggaaagtttcgaaatttcataaactgaaaattatgtaaatcatttttagaatttcggttttttgtttaaatttgggtcttgaattcgaatttggccggaataaatggcagattcgttatcaaaaacttagaaaacccccagaaacattatcctcctacttttgaaaacaacaatttctcttcttttcagtgcctttgaaaaatgcctcacctaaagtaatgagggacaataatcatccccttccccttttaattaccctcccccaccaatcccccgtttttaatcccctccctattcctaattgccccctaggtgcgcccgagtcggaggtgcacaaatacttcggcgctttgctcaaatcgatcacaagtggaacgaacagcagcaacactttggagacggccaacaaagtgtacgtgaagaaaggcatcaaagtgaaggacgcgttcaaagagcaaattgagggaaattacggtggacagtttgagacggtggaatttgaggacggcaaagggacggcggaggtgggaaatgttttattggcgtaatgcgaaatcagtcccaaaaataggaaaatttcagctaaaaatgtcaaaaattgcttcatttttaagccattccattccgttagaataataactcttcataaaagtcaaattttggggtttttttttaaattctttttgaaataaattctgcgctacttcaaagtgcccgtttttgaaatttcttaaaaggcatacggacagtggtgaatccttttggtgcaaaatttttttgtttcattaaaagttgggaaacattatttttcgccttcagaaaatcaacaagttcgtgaaagaagcgactcataagaaaatccgcgatttggtcacgcccgacaattttgacgagaacactcggtaaaagtttttaaattttgtttctaaaattctgtggcaaatctaatcttattcaatggataacatacttttggcccgaaaacgtcgccggacaaaacatcgttccgcaaaaaaatatcaaaaaaaaaaaaagaaaaaaacgtaaaaaaaaatcataaagtttttgaattaggctgtcttcggccttctgcggcaatttcaaaagtccgaatatttatttttttttaaatgttatttgatggaaatagcaacaacaaaaaaattgtaaaagtttgaaaatagttatttatttttttgcagtttggtgctgatcaacgcgctttacttcaaaggcacatgggcggacaaattcgactcaaaattcaccaaaaaagcgaaatttcatgtggacgcgaaaaacttcaaagaggtggcggagacaaacacattttaaaatcctagcttcattttcattttgtccgtaaacgaccaattttttagctggaaatgatgcatttggaggcctatttcatttactacaagaacgctcaggtcgtttag

SEQ ID NO: 71050 - DNA, 128 bp, Heterodera glycines
  Genomic contig location: Contig_ID=SeqID_43363; Location=805..932; Strand=+
  SCN-specific regions: Sequence locations=1-79,101-128
tatggcacggaaagacttccggtttccgacatttttggggtcggaattccgacttccgaaatttttgatgaaaagtcggaaattttttaaatttttttttcaaaaaactagtaagtttgtacaatttc

SEQ ID NO: 71051 - DNA, 539 bp, Heterodera glycines
  misc_feature (5)..(5): n is a, c, g, or t
  Genomic contig location: Contig_ID=SeqID_43367; Location=78..616; Strand=+
  SCN-specific regions: Sequence locations=1-539
atgtntcatctggatacttgcattgtgtgcagtttttgctttaccatcatatgcaaaagctggtgtggcgtcttgagaacaaatggggcattatttctgatcaaaataatgacaaaaatttggaagcaaaaaataatttattgcaaatttacacggagaaaaaaatgatcgcatgggaacaaatggtgaaaatctatgggaaagagttgaaggatctgacagaggtgaacgaactgattcggaggaaattcgaattttgtctgatcattgagggcgaaacgcgtgagttttttttttttgatgagatttgtcacaaggaatagttttgtcttatgtgccatttatttttcggggtccggacaatccgtcagtggtcaatccgtcagtggacaatccgtcagtgaaggacaatccgtcagtaatggacaatccgtcagtaatggacaatcagtcagtaatggacaatccgtcagtggataattcatcagcaatttttttgagcaataacaaaaatctcgcgaaaatgattgttaaaatta

SEQ ID NO: 71052 - DNA, 219 bp, Heterodera glycines
  Genomic contig location: Contig_ID=SeqID_43367; Location=634..852; Strand=-
  SCN-specific regions: Sequence locations=1-120,186-219
taagtggacaatccgtcagtggacaatccagtccagtaactaattcataagcaatttttttaaacaccccagatttatttaaaaacatctgaaaattaatttaagtcgctaaaaatgttgattaataatttgtattcttttataaaattatgaaataatcattttttaaaaaataaagattaattgaagtataaagaactagaaatgttaagaatctat

SEQ ID NO: 71053 - DNA, 785 bp, Heterodera glycines
  Genomic contig location: Contig_ID=SeqID_43368; Location=552..1336; Strand=-
  SCN-specific regions: Sequence locations=1-123,146-180,203-218,240 -566,588-645,668-785
atgccaacattacggtcgaaagcattatcacttttctgtcgggctgccaagaatgcaaaacagggacaaaaaacgaacgacggatggccactctggtgagatcatatgcgcacaaaacacgggtatatattttattttattttttggcaaaatttatgcagagagggccaaaatcgaaagaaaaaaaaaattaaattataaagtcaaaatactgatttaaaataattgtggctatttttagcaaaattggcacttatttccaataccgtaataaagtttgggatgttcagagaattgactacgcacagttttatctgttcggcccggatgtgatcgaatgtcggcattgtgcctaccggcgatggaccaattcgccggggaaaccgaccaacgcgctgaggaagtcatttgaagaagtaccatatgaatgtgctgaaacgataccgtatagccatcctggagagagacggtgggcacagcaaaacggaggacgaagaaagtgaccaaaatgggggaatgattgacgacgatgacgacaatcaaagaataatgccaatgccatcggaaaaagaaagtgacgaaaatagggggaggaacggacgataatcaacgaataatgccatcggaggagggagtggagcacaaaacagcagaagaagcagcagcacaggcacggaatgatcagttcagatcagctaagtccctcaatatcacctgctgatatatttttgaaatgcgtatttttatgggggctttataattttttgttttgattttgtaataaa

SEQ ID NO: 71054 - DNA, 544 bp, Heterodera glycines
  Genomic contig location: Contig_ID=SeqID_43369; Location=414..957; Strand=-
  SCN-specific regions: Sequence locations=1-484,519-544
atgaagagaacggagacgattttgcgagtgttcaaaacgtttgccatggatggaaatgcattggaaggaggtgcagcaggtaaaacactgtttgtaataaatgcaaatggtaatccaatgggaaggaataccgtaactttgtaccgtaactttttccccgtccataaaagcgatgaatgtctaagaattttcgtacaattttttcccatttgtcaactttcttcaggactgaaaatggggagccgacgtcaaaagcgttcagccgtggctgccatcgctatcattgcgtttttgggattcattttcgtgtttgcccaattatcagcagccacaggctcttattaatgatgaaactttggagaaagaatttgttgacttttatttttttgattttccgttttatttaccttatattagtttttttcgtaattttagcataaacaaattgactcacgttcaaatagaatttgaaattttatgctcgaaatataaatattttactaaaaattttaaaatttgacacttttacccaggttcaaataaa

SEQ ID NO: 71055 - DNA, 535 bp, Heterodera glycines
  misc_feature (13)..(13): n is a, c, g, or t
  misc_feature (104)..(104): n is a, c, g, or t
  Genomic contig location: Contig_ID=SeqID_43371; Location=42..576; Strand=+
  SCN-specific regions: Sequence locations=1-428,452-460,482-535
atgagcttaaacntaattgagttattatattttattaccaaggttaattataattttttttctcaaaattaatgataacaattaaaaccaacaaaattcgaatntaatcgtagaatttttattcagcttttccccttaatttcatataatttttttactcattttttgtgtaatttcttttggcagaacattgaggaattggctatcgaggtgaaaaaaagcaaagacaaaattcgcaaatttttggacgaaaaattgcccaaaggagctacgctgatcgacgaaaagcaatatggggaaattaagaaaatgcgcaaggaattggcagacgcaattgacaaagtggcggaggaggagggaaaggacggaaacaccaaatcatcaaccgtaaatttaccatttccaaaaaacagtggcatttattggacaataaatgctcataatttttactaaaaggcaattccaaatttaaattttattcatcatttcatgtaatatttagtcggggaatttcaaagaatttcattgggtttca

SEQ ID NO: 71056 - DNA, 202 bp, Heterodera glycines
  Genomic contig location: Contig_ID=SeqID_9339; Location=482..683; Strand=-
  SCN-specific regions: Sequence locations=1-26,48-54,77-202
atggtggaagatcaacaacaagaagggatgaacaaatggaagagaatgggggaccaacaaaataaaaaggaaaatttcatgcattgtactgaacaatatgctgcgccggagctgattgaagttcaataatatttgtaaatgaataatttaatgttcattttaattccagaatttatctgatggcaaaaagatttatgatgag

SEQ ID NO: 71057 - DNA, 231 bp, Heterodera glycines
  Genomic contig location: Contig_ID=SeqID_9341; Location=630..860; Strand=+
  SCN-specific regions: Sequence locations=1-231
atgggacagaaaattgaaaaaaagccgctgtccctggacgagaaatcggtgctggacgaacagacgcaacttggcaatttgcgggaagaatttgatcagaaaaggaagaattttgaggagttgaccaaatctttgacgagtcaagacgaaaaggggcgaatcaatgaaatgaataagctctggaaaaatcttaaccagcagatcgttgacaggggcaatttgctgagcagt

SEQ ID NO: 71058 - DNA, 778 bp, Heterodera glycines
  Genomic contig location: Contig_ID=SeqID_43372; Location=549..1326; Strand=-
  SCN-specific regions: Sequence locations=1-370,392-400,422-622,658 -754,777-778
tcaattttacctgtcaggtcgaagtgaacccgggccaaattggcggccccggggcggctactgccgtttcaaagtgccaccgtaaaatgctggacaaggtggagattatgcacggcaaaaaattgccaattatggcgaaggcagttgtgccagaaaatcgcccggggccaggaattgcgcggaccctttaccaagcctggtaaacaaatcgcaaaaaagaatttttaaaaccgattaaactcaattagcacattcattagtctggacacacttatgttaacagggttcagatgaatttcaaggacagataaaagggcaaacaagacaatttaataaacatttttgtccattttcaagggcgtccttgaaatttaagggggccaaaaaagggtgaaacaatcttaaaacattattttcaaatttttcgatgacagctaaacagataacaaaaatgctcaagattcatctgttttcaaggacgtccttgccatctgagagcaactgaaaggagcaataattgttttaattttttttttgggtttttctcatatttttataaaaatttgttcattttcaaacacgtccttcccattcgaggggaccaaaaatggacgatgaaaagaatattttacaaaaaatttatttagaattttatttcgacaggaaaatgttcggcgacccaaacgcaatcattttgtatgtcaatcaacccgacctgttcccggtgtgccactttgagcagctccaatttgtgatgttccaagtggaaaagctggcc

SEQ ID NO: 71059 - DNA, 56 bp, Heterodera glycines; identical to SEQ ID NO: 52733
  Genomic contig location: Contig_ID=SeqID_43375; Location=749..804; Strand=+
  SCN-specific regions: Sequence locations=1-56

SEQ ID NO: 71060 - DNA, 108 bp, Heterodera glycines
  Genomic contig location: Contig_ID=SeqID_43378; Location=1..108; Strand=+
  SCN-specific regions: Sequence locations=1-108
gtataaaatttctcaaaaaaagagatagccatttttctgggatagagtataaatttaaaaattccctcaaaaataaaaggtctattgcgcaccgccctccctatcatg

SEQ ID NO: 71061 - DNA, 275 bp, Heterodera glycines
  Genomic contig location: Contig_ID=SeqID_43379; Location=356..630; Strand=-
  SCN-specific regions: Sequence locations=1-191,222-275
agaattcctccgctccgccttcgagctgtacaagcaagtggtggagttgaacgccaccgttttggattcggatggcaccacccaacacaacgtcacgctgaacgacatttgtttgaagccgttgtatccgcaaaatgtgcactgtgccgtaatgagtgtgttcaactattttcaagtttgccaaaaatgggaaaaaaattttttagatttttttaaaatttccatttttcaggacgacatttcaaaactggacttggaggatgacagcacattga

SEQ ID NO: 71062 - DNA, 2792 bp, Heterodera glycines
  Genomic contig location: Contig_ID=SeqID_9343; Location=289..3080; Strand=+
  SCN-specific regions: Sequence locations=1-59,88-91,113-462,487 -664,687-924,975-983,1019-1062,1084-1121,1146-1147,1171-1210,1235 -1248,1270-1404,1443-1574,1596-1872,1906-2425,2447-2603,2625-2792
atgacgatgatgatgctgcgggaggaggaaaagccaccccgaggaatggtcgaagaggcaaagtcaaagtttgaggaaaagcatctgcccaagaaaaagcctcccaacggcacccgccttatgaaagtgaggaaaaaccggggaccaaacagtaaatttttaatctatattataaatcacggcaaccgttttttaaatattagcttttctctcggcatgagtccaacgatagctcagttggctttagtgcgttaagccctccctgccccagctcctctgggcatgagtccatttgatcggaatggtggtaggaacggatcggcttcatccggtcatcccccgttgggtggcagttgcgtaacagataatccattcacattctttctgctcccacatgctgtgttgctgctgttacccatcccaaatcgcccaccgttgggttagcttttgtgtgcattccgtccccccccccccctccccccccccgcgtcccccgttcccttttttgtctcctccataactcgtttttgggtgcgtccgtccaccaaatccttccaggcgccgcttcatcttttgctgcttttcctgcctggtacaccaattagcgcattggacctctttgataagcaaaacaacaacaacaaacagacaaaaaacggaggaggaaaagcaaaagcaaaatgaaactcaatttgatcaatttgaacggaatgcgcagaggcggaccaagaaattaatgaggcaataaatgtaaattagccaattaaggggtcaatcgcatcgtcccctttggaatgagcggcgtttagtgccgccgaatcaaatgggcgatttttaatggtgcgcgattggatgatgttcacttttctgcttatactttgctgcttccgctgatcagttcagtgttttataatcactttcacctttctcttttaattataaaaagtgaaacaaattaaaagggaaataaaggcgaaaaacagaaaaatataaaataaaaactaaaataacttaatatgtcaatgattaatcatcaaaacattaacaaaatgaattgcccgctgtaaaattattcttcatttttaaaagcaaaatttgaaaaaaacaaaaacaaaatttggtataattaaaatatatttaattatcaattttgattttgtttcctttttgtgttaaattaattcgtctgtatttcatccgttttcccattggcttcttttcttctttctctcccatcactttttgttctcttcatcatcacccttttacctgctgatcatcacattctgttctcaacaaaagcattgtgggaatgaatggataaatgcgatcagtcgacccaaaagacaaaaagtggcgaaaggtgccacgaggggggggggggaggacggagtgatcagaagcaaaagtcaaagtcgggcggaagaagaagcagcaaacgaattgatcggaatttgctaccggtgaaagaaaatgggggcggatggactattttaagaagcattgggaccacagacagcagaagcaacacagcaaaggccaacacagctgccgacggatggccccgagaaatgggaaatattgggggaggggaaggaatgattcattggcagtgctttctgcgtacacccaatttttgctgactttcactgccgatcgatccatttttgtttttgaggatgaaaatggcacaaatttaggaaatgacacttttggcctaatcccccaaaagtgccaacatttacaaatgcattttcagaccttggcagtgcaacaagttctctttgccctcctccaccaaactgcgttgtactgcttgaacgtgtcctccccacaccgtttcttctcctcgcaccccagcaaaatgtaccgctccccgtcctcctcctcctccctctccttctctgccccaaacccgttcctgtcctctgctgaccagcagctgatcagtgaccgtacctttgacccgacccgcgtctaccgtaacgaaattgctggcggaaaaatgagcgaaacgtacgagtcgctggtgcgaaacattttccggcccgaacaaagtcgccaggagagctccgtctttctgccgccctcatttgcgccgccgagtgcgcatctcagccagcaacagtttggcaagcatcggcaaaacaccgtcaacgggcagcaatcgacgctgggcggagtgccgtcgccatcaacgaacggcagagaacggccgcgcatcagcgcagcggcgatgaagcgcatcgaggatcggttgggcgaggacgtgttggacgattcgcgtaagcggacggagggaacgggcgcggaggggaattcgaaaaacacgcgttttgctggcccttaactttttgaagactgtgaattgaatttcgccgaatcaggcttgggcattggcattttggcccattaattctcgaaagtaaaaatccattggcaaaatcaggcaaaatttagtgccgaaggcaatcacaaatttctgttcttttgggcagatgatgacgagctgtggaagtcgccgttggatgagatttacgccgagttgggcattgactcgtcctccgcctcttctccgttcgcgccggcgcccttccattccgcgctttcctccgcttacacttcgccctcctcctcagacgcgtcgcgacgtcgtcgccccgcgcccggcctcgtgtccgaatattccgtctacgtgcccaagtgttccgcggaatatgcccaattggccaactcgtcgcctccggcacaaccatcgtaccgcagctcaacattgggcgcgtatcgcgtaa

SEQ ID NO: 71063 - DNA, 443 bp, Heterodera glycines
  Genomic contig location: Contig_ID=SeqID_43383; Location=504..946; Strand=+
  SCN-specific regions: Sequence locations=1-133,171-307,348-369,442-443
atgaccatcatcaacactacggttttgtgccaatccaacaccaatccggcgtcccgtgaattgaaaatttttgtggacccacccggggtccattacactgtcagtgcggttgtgataacggtgaaccgtgatggcacaatgccaaatatgcccagacacattttccatggcacaaagacgtggacccaactggacggacgagaaatgttcattttggaaaagacaaaattggatggacgtcgaggagtcgtattcgaatatgggccagaaaatgcgactgaagaagaaatggtatgggttcttcggtatagaataattaaaataaaatttgaaagaaaaattgtaaaagcatcaaaatttatttactacagacaaagagatatagagagacatgcagagagacagagagagggaaatagagttatagcaaagagaaagaaata

SEQ ID NO: 71064 - DNA, 605 bp, Heterodera glycines; identical to SEQ ID NO: 43385
  Genomic contig location: Contig_ID=SeqID_43385; Location=1..605; Strand=+
  SCN-specific regions: Sequence locations=1-468,490-605
  Gene Ontology: Mol. function=hydrogen-exporting ATPase activity, phosphorylative mechanism; Cellular component=hydrogen-transporting ATPase V1 domain; Biological process=proton transport

SEQ ID NO: 71065 - DNA, 295 bp, Heterodera glycines
  Genomic contig location: Contig_ID=SeqID_9344; Location=43..337; Strand=-
  SCN-specific regions: Sequence locations=1-150,175-295
atgagccaaaaccgtgacgaaaactcgcagccacctgtactcgatggaccgtacccgctggcccaagagcgcaatgagtttgtggaagatgaagcaccggtgctgcttgagatgttggatcgtctgtcacaaggagtgggttttgttttgaattatttaaattttttaatttttccattttggcttatgctaattgttgattttgtttagggaatttgccaagccatgggcctgttttcgtttgcacttgccgactgtttggccacatttcatacatttgccatactgttcgact

SEQ ID NO: 71066 - DNA, 1926 bp, Heterodera glycines
  Genomic contig location: Contig_ID=SeqID_9344; Location=2900..4825; Strand=-
  SCN-specific regions: Sequence locations=1-333,372-514,537-546,577 -814,837-1344,1366-1926
gcaaatgcacaatcaaggcagccttaaacggcgaaaagggaattttattggatttttatgttgttgaaaaaggttcattcgaccttctcggattggcatggattcgagcttttgaacaagcatacagcaaaccagtggcaacgacattgaagtttgaccaaccgacgcacagtgttcagatcaaagggacggagtgcacgccgacacaactcaaagcagagttacaggctcagtttccaaatgttctttctgatagtttgggcttgtgtacgaaatttgaggcacaccttaagctaaagaaaattcaagcccagtcttttgcggctctcggcctgttccccttggtgttcaaagtgaagtggacgccgaattggacagaatgattgagttgggatttctgcaaaaagtcgactatagcaaatgggcagcaccaatcgtcgcggtcagaaaagccaatggcaaagtccggcagtgcttcgacttcagcaccggattaaacaacgcattggaaccgcaccaccacccacttccacgtcccgatgaactttttgccaaactcagtggtgccaaattcttctcacaaattgattttaaggatgcttatcttcaaatttgtgttgatgagcaatcacgtcagcttttgggcgtgaacacgcaccgaggcttgtaccaatgtcaagtttagcatttggcatcaaaagcgcacctgacattttccagtggatcatggatcaattggcggcaggaatttcaggagttttaggctatatggatgattttattattgcgtccaaaacaatcaccgaacattttcaacaaattttcaaattctttcagagaattcaacagtttggttttcacgttcaaatggaaaagtgcaagttcttggtgaaggaaatcaaatttttgggtcagattgtctcggctgatggaattcgtcccgatccatgcagaacgcttgccttacaacaaatgccgccaccacatgacatcaccactttgcgttcatttctctgcgcaataaactactacgggaagtacatcaaaaacattcaccaactccgtggaccgttggacgagttgttaaagaaagggattaagtgagattggaccgaaaaacaccgacaagcttttgaaaaggctaaacaaattttgttgtcattcacatcgttttcccgatggaaaggagaaagtttttcagcacgcggcccgcacattgacaaagacagaacaggcctactcgcaaattgaaaaagatcaaagcggcacaacaggaggatgagttgattaaggaagtaatcaaattcacacagaccaaatggcctaatcaaggggttaatgccgaaatgaagctgtatttttcaggcaggcacaacttttcattgatcacaggttgtctagtgttcaacggacgttctgtcatccccccgtcacttcgaagtcgcacactgaaggcgctgcacttggctcacccaggcatagttcgcataaaaatttagcacgatcgttcgtctattggccatcaatggacaccgacatcgaaacgattgttcgcgggtgtagccaatgtcaacaagcagccaaacaatcacccaaacagccactccaaccttggccaacaacgacttccgtgttcgaacgcattcacattgacctggttggtccatgcagggatggcaacatttacctggtggtcatcgacacattttcgaaatgaccaaaagtttttcttctccgtcacacatcgtcacgggccatcatttgatcacttcagtggttatttgataggtttggtagttccaaacacgattgtttcggacaatgtgccccaattcttttcacaaatttcaaaaatatttgttccaggaattcaatcaagcacattttttcacctccgtaccacccgcaatcaaacggagcagctga

SEQ ID NO: 71067 - DNA, 569 bp, Heterodera glycines
  Genomic contig location: Contig_ID=SeqID_9345; Location=89..657; Strand=-
  SCN-specific regions: Sequence locations=1-149,235-330,352-472,524-569
atgagaaccaagcctaaactttcattattaacaaaatgtgaacaaagattaaagatgctaaaagatactaaatttaagtgaattagttaaagtttttctgtaataattatatttgatgtctataagaaaatatgaaattcttcaataaaaaattaaatacgattaagaaaatttaaatttaaattcattacataaaaataaaataaatcaatattaaaacaataaataatattatcatgcagaggctttgagtctattagagatcggtattttgaaaaaagcctggacctggacctggattccatgttgggtctggacctggatttcctggacaaaaatccaggaaaatccaggtccaggaaaaatccaggctcttcgagacctggatccaggcctggacctggattttttgaaactcatcttaaaaatcaaaaaaaggtttgaaaaaattaattaattgcttagaaacacctaaaaatatctaattaataataataataatgtatttttaaatttatttaatctgtttttgaaaacttgaaaaaacatcggtcacttgaaaaaataaa

SEQ ID NO: 71068 - DNA, 80 bp, Heterodera glycines
  Genomic contig location: Contig_ID=SeqID_43394; Location=698..777; Strand=+
  SCN-specific regions: Sequence locations=69-80
gtcctgcccataatatctgtggcatggaataaattttggaactgcgctgcctaacggcggtgcttaaagtgccctaaaaa

SEQ ID NO: 71069 - DNA, 490 bp, Heterodera glycines
  Genomic contig location: Contig_ID=SeqID_43397; Location=517..1006; Strand=-
  SCN-specific regions: Sequence locations=1-151,173-187,210-413,437-490
atgagcaacggatctgaagaagatgaacataatgatgacattatgccaaatgatgcgctacgaaaccgtcaaaaatatggaaagaaacgtgcgaattttggtatggagacaaaagagtcaacatgtgtctacgaatattttatttgatttttaatgctaatgttgaaaattaagcaatataattaggtttttaattttaaatattataaccttttaggcagagaattatcagacgaagaaaaaataaaaattgtgaaaaagtttatgctaattagagaacgcattgacaatggaaatttctcgaaaaaaataacagcagaacaaattgtaaacaaattaggagtcacaatgcatcaaataaaacattggaaatttaaatatggactaagtaaatcacaaatacctaattaatgttttttggaatattttaaaatttaggcaaaaaaccaaaaaatttgactgatgaacagcgtaaaaaaatcctaataaa

SEQ ID NO: 71070 - DNA, 583 bp, Heterodera glycines
  Genomic contig location: Contig_ID=SeqID_43398; Location=363..945; Strand=+
  SCN-specific regions: Sequence locations=1-583
atgccggcggaaacagccgctgcaaacaatcattttgtgctaatggggcagcccaagggcgaagggagcccctttctggtgccaaacccaatgtacacgctcaacttgaagcaacaacacttcggcggagtgcctttgcccgtccatcaccagcaccaaatgagcttatctgttggatctgcggaggtgtgcccattctgactaattagtgcactaacccccactctcattgtcagtccgccgctgatcaccaccagtgccgtccaagacaacagtcgttgtactgctccaactcctcgcgacagtccgagcctccaccccagcaaagtgcagcagaacaacagcaacaacaacaacacctttacgctgcccaacaacagcaaatgcgcacttctccgatggaagtgaaaagccaattgttggcacaattggccaacgaattgggaagcccaacggagcaacgcaattaggggaaatacagcagaaacagtcgaaaacaatcactgcttttgttgtttcacttcaattattggcttcgcccatcaaattaccttcaaattaatgactcatcaaaattaaaaga

SEQ ID NO: 71071 - DNA, 122 bp, Heterodera glycines
  Genomic contig location: Contig_ID=SeqID_43398; Location=1138..1259; Strand=-
  SCN-specific regions: Sequence locations=1-122
cctcaacagcattcggcggtttgttctgtgtgtgcaactcgtttttctcatattttgggctgtgagaggaaattgggggaggcatttgataaggaaatgatagtacaaagcacagcgacagg

SEQ ID NO: 71072 - DNA, 282 bp, Heterodera glycines
  Genomic contig location: Contig_ID=SeqID_43399; Location=7..288; Strand=-
  SCN-specific regions: Sequence locations=1-282
taacttctgctaaactcaacagtggtggttttttgagtaaggcacctgatgcttacgttgaaatcattgttgactcgaaggaggaccaagcgaagaaaacgagtgttaagaagaaaacgaattccccgcattgggacgagtcattcactctgaatgtcactgagaattcggtcattgagttcaaaattttctgcaaggccaaagtgttcgatgattctttgctggcttctaaatcggttaagatgtcgaattggttgcgaaaggagtccaacaacggaaaat

SEQ ID NO: 71073 - DNA, 484 bp, Heterodera glycines
  Genomic contig location: Contig_ID=SeqID_43404; Location=321..804; Strand=+
  SCN-specific regions: Sequence locations=1-484
aaattgttggagttttaccgcaaagagcgcgacatgttcacagagggactggagaaggcttccgtcaacgtggaggagttcaaatttccgaccgaaaatgttgaacaaatttttgacggacttttcgcattggaaatcaccggcaaacaaatgaaggccaattacgaaactacgaaggaggcgcagcgagagcatcagaagcaatccaatgccgaagcaatgcgcgcacaaaatttggtcaaggcaaagccaacaaaatgccaaagtggtgggttgacgagagtctcgaagcccgggtttttagtgtgcccgatgccgttccacccggaataaaagccgagaatttttgaattttaattgctttcatcatttagcgtccaaccaaaaagcgattcagtgctatttggacgaaatgactgagaaaggccaacaacagctgggccagggttggaaagcggacggaagtgccgagtgggtggataaa

SEQ ID NO: 71074 - DNA, 923 bp, Heterodera glycines
  Genomic contig location: Contig_ID=SeqID_43406; Location=51..973; Strand=+
  SCN-specific regions: Sequence locations=1-536,560-923
  Gene Ontology: Cellular component=nucleus; Biological process =embryogenesis and morphogenesis
gggctattgatgtgattgttgtggaacaacctgacggctcattggcctccactccatttcatgttcggttcggaaagtacggcgtgttcaactacgagaacaaagtcaatatttatagactaaaaaaaacatatacttacgcatttttcagtacgtcgacattgaaatcaacggggaagagattgacctgaaaatgaaattgggagagaacggagtcgcctttttcttggcaaatgacgaagagggaattggcgagacaaaaaacgcggagggaaaggtaaattgaaaaacttattttaaattggctaatgctttcgagaattaaattgctttttttggggagggggagggggtgaaaatggaaattcgaattttggcatgtttagaaaaagcaaactgttagtattttaagccataaaatcatcttttaggagtttttgagagaatcgcaaaacaaaaagtggagcgaagacacacaacagaacaatcggccgtcagcaattgacctggaaaaccaacggaaatgctcttttgcgagcagtagcagcagcaccagcagttgcacttcccaaccgcagcacaatgaatgcccaccaacggcgacgacaacagccgaaagaaagtgcgctttaaaacaatggaaaatggattaagttcacaaaagtaaaaacagcttataagaagcgtccggcggtgccggcgatttctgccggaatttctatggcttcagaatttgcaggcaatccgacgccgccaaagcggtcaaaaatgttcaatccgtcctttctcaaccacaaggcgtccgtccaacagaaccgtcagcgactgcctttttcgtcgtccatttattcgtgccgaaggaatcgctctttgcccgatttggccaatttgttgtcgccttcgtcgaacatctacgactctga

SEQ ID NO: 71075 - DNA, 477 bp, Heterodera glycines
  Genomic contig location: Contig_ID=SeqID_43407; Location=816..1292; Strand=+
  SCN-specific regions: Sequence locations=1-78,101-477
atgcccgtaaaatttgatcaacgcctcctattcccactctgtgaaaagtgcgccaaacacatcactgcaaaatatcccaatggcctcaaggacaacatctactcctgcccacactacaacccaaatgaccgcgccttcgtgtccacttgcacccatcttgagttaaacgcagcattggaggccggctacacagtccgcaaagtcttccacgtcctccaatacgaccaatggagtaacaatgtcttcaagtcttacgtgagcgaaatgatggccataaaaatccacgcaaccgggttcccgtcgtggtgtgagagcgaagaggagaagagtgaatacattgaggagtgctggatgaaatttgcaattaaactcgacaaagaaaagatgaagtcggagcctgggaagcggtacatcgccaaactttgcctcaactcactctggggccgcttctccatgaggaatcttctctccaaggcg

SEQ ID NO: 71076 - DNA, 648 bp, Heterodera glycines
  Genomic contig location: Contig_ID=SeqID_43411; Location=199..846; Strand=-
  SCN-specific regions: Sequence locations=1-221,251-648
atggtttaattttattatttttggcactttagaatttggacggcaattctttgttaatatgaccgttaaactgggaaagccattttaattaaagtattcaaattttgtttcattttgtagaattctctgctctgtgagaaattgaatgccgcagcagccacgatggctgacatttatggtgcactgcttctgcatgcgattttcgatggcagcaaagtgtgttatattgaaaaaaataattttttattttcagttttgaaaaacagtattaggcgcaggtgttccatattcgaacccaaagtcagcgaggggtggtcagccatcacatttattaatgggattaaccctcgaaatacgaccttttttttattacttttcgcaaatctatgttcgtgctgtgttttgttcaaaaaaatcacgagtatggttaggcggcgccggataaatttttgataatttagccccaattatttgctaacttgtccagaaaatgaccaaaatgcgctgcatgtttttaatcaaaattgtcataaaactttcttgggagcggggtacgtagtacgtatctatcccgcttataaaatcagcatttggccgataaaaaattataatttgcggtaattagaattttgaattattccaaataaa

SEQ ID NO: 71077 - DNA, 928 bp, Heterodera glycines
  misc_feature (335)..(335): n is a, c, g, or t
  misc_feature (367)..(367): n is a, c, g, or t
  misc_feature (421)..(421): n is a, c, g, or t
  Genomic contig location: Contig_ID=SeqID_9348; Location=182..1109; Strand=-
  SCN-specific regions: Sequence locations=1-130,167-302,324-928
gttcttgccatggcaatcgctaggcagttccgctactcaatttatcttctgttagttttggttcgtttttctctccatcaaagtgccgaattgggtgagtcgattggcatttcccccccccccccccctccaaccattttaattgttgctttttctgaagaggacctccaacgcctttgccccgacttaaaaggcgctttctgttcccattgtgaccacaaaagtgttgagcaaatttgtccaatcgaatgcaacttttgctcaacttttcgctcaaacgaaacgccaaaattcttcggaaatgccgcagaaaattgaagtcatttctttctttnttgtcccattttcaaattcaaatttttcttcnagttgagctgaaaaggcaatgcgccaccattcgattggccttttgcaacgttgntaaggtgagaagcgcaaaagaaaagcgccaattcaaaagaaccaaaattaaataaaattagaaatgaaaatagtacacaaaaatgagagggttcgaaagaaatgagaaacgaagagatagtccaagggttttctctgggttgacccattgattgcgttatgcttttttgatcacttcgatcaacgaattgtgcgtggaagaatgtttggactgcgaagcgggcctaagagacgaagtgggcccaaacagcagcgaaatgccggacagataagccaattcagcagaaagaagtggtgccattggtacagacctggcaacagtcagcgggggatggactcgcaattggcgacgatggcacaaattcagcgggagaagctgccgaactgagcgagtctgaggccgaaggaagagaggtgccagcggaagtgccaattgaaatggacagtttggcacttttttgacgataaaacacgaacaaccaaaagcatttgtttattggattgacaa

SEQ ID NO: 71078 - DNA, 2223 bp, Heterodera glycines
  Genomic contig location: Contig_ID=SeqID_9349; Location=383..2605; Strand=-
  SCN-specific regions: Sequence locations=1-387,414-675,697-765,789 -875,897-938,960-977,999-1034,1056-1090,1113-1161,1184-1209,1233 -1235,1282-1514,1536-1562,1585-1694,1716-2223
atgaccagcaagaacaactcgccacgaaatggcagccaatgccacgggtgccaacagcagacgaatgtgaacggcacgaaatgcgacaacaaacgcattttggtggtccaaacgacgggcgacgcgaacggaggcaatgccaacggcggaggagtggcgacggtgctgacaaacacaacggcaatgccaaccacggcagcggcaaaggagcaaccgcaaccaaaggaacaaacggagcaacaaatggcacagtcgggtgagtgatggatggcacagactgataatgccaaatggaaatccaaaggtcattcgtcgaagaagagcagcacacattccaatttgcagcagcagcagccgacgggcgacacggcgacattttcaaaatttgccaatttttcgttggccaaacgtttcctgcaacaaaaattggcggacggagaaagcaaaacttctccagtcgaaaagtcttgtgaaggtaacgacactttctcaagattatttttgaaccatagaagcatcactttgaaggagagaatatgacggaaactgtcacttcacaagactcaattcccttctctcccgtcggcatttgcccaatggcgccaataaaagcggcggataaaagggcatggaccaatgccataaatgtgggccaaattgaggggacggagggcaattgcagtcgcaaacagtcggagatggccaaacgaagttcagtctcttcgacactgaccaacagccaatgcgacgcgtttctctgatcagacaaagcaaaggaaaccaaagctgtgatcactggtctcatcaatcgttctaattgctcatctccgtcgggtcgtgatgaattggaaattcaattatttttttgccgaattatttggattttttaggcttttccatccaaattgttcttaagagttgtttagtgcgaattgtcaaagaaaatactttttgttttggcatttgtccccctttccttctcatctttcattttattaccactggcatatcattttcatttaacatgaattaaattttgttaaatttaaaattcctttagtcccctcgccaataatccatcgcccattccaatttttctttctttcccttacaattccatcccaacgaatcgatcgaatgggcacgtcagcagtgactgtgctgacaaatgagaaagaataaaaataataatgctcgtttatataacgcattaataatattttttatatttagtgtaattaattaattgcctaattattaattaatttataattgattgatcattaaaccccgtttctttccaaaggcaatgattcggcgacggtctgtcgtcccaaatgtttcctccccctccttttgctcccctttaattgccgtcactttctccgctcttttccttttggtgaggttaaacagcgcccggggggactttggaaatgaagcgacggaaagtgaagcgaatgggcaaagagagagtgggcaattcccacaggaggacggcatttttatgctcagagacggcactttcgattcttttctttcccaaaacccaacggtgctggtcgagttttacgcgccatggtcagcagctgtcttaaatgatcatttggcaaagggtcacttgctaattgaaggtgtggccactgcaaacaattgacccccgaatatgcaaaggcagccgcccaattggccgattcagtgccatttgccaaagtggacgcgaccgtggagacaaaagtgggccacagcaggaaaacccctgcatattaagtgcccaaattaattttagcttgctgagcgttttaaaatccaaggctatccgacgattaaactgtggaaggatggacagacggaaccgacggactttgacggggagagagacgccgaaggtgtaagaggggggggggggggaggaattggccaaatgacaaagaaatattgaataaggaaaatggctgactggattagctgaataatttgcaggaattgtgcgatggataaagctgaagactgaccccaattacaaaccaccgccggaagaagtggtcgcactcactcgcgaaacattcgatgaatttgtcggcgacaaaccgctcgttctcgtcgagttttacgccccatggtggcacaaaatccaagttcccaaaattaataattgcttaaaggtgcggccattgcaagcaattggcacccgaatacgaagaagcagcaaaacgtttgaag

SEQ ID NO: 71079 - DNA, 1126 bp, Heterodera glycines
  misc_feature (963)..(964): n is a, c, g, or t
  Genomic contig location: Contig_ID=SeqID_43412; Location=208..1333; Strand=+
  SCN-specific regions: Sequence locations=1-164,187-406,429-1126
gttcaaaattgtgaaccatgtcaattggctgcaaaggcaccgatcaaaaccgatctccattcatggccaaaaccaactggcccgtggcaacgaattcacatcgactttgctgggccattcttcgcaaaacatttttaattgtcgttgattcattttccaaatacccggaggtatttgagatggccaattcaacagcatcggccacaatcgaaaaattgcgttatttatttacgcgccatggcatcccagaaacaattgtttctgacaatggcacgcaattttccagttcggaattcgccaaatttgttgcagccaacggcatcacacacttattttcggccccatataatccaatgtcaaatggacaagtggagagatttgtcgacacatttaagagagcattcagaaaattaaaaggggaggggaagccgaacaaggagatcattgacatttttctgatcacctatcggacgacaccaaatgattcacttccggatttgaagtgccctgctgaactgctactcggtcgaaggccaaggacaacgattgatctccttcggccaccgccacaccaaccatttgaaattgatttggagatggaaaggcaattcaacaagaaatttggcaccaaaaatcgaagatttattttgaatgagaaagtcttcgctcgccatcgctcctcgcaacattggaagacaggagtgatcagcggcacatctggagtgatttttgaagtcaaatttcacgacggatcattcggccgttttcacgccaatcaactgcgctacaggaaaacagccgacaattttgatcagtccttggccatattaaatgaggcatttgagttgccatttcctccggccctgcccaatcaaccacccgacgcagaaaatgccaatttagggcccaatcaattgtaaaacgaggtggcagaacccattcagggacaatttggctgctccnnattgaggacgtcccaaattcaacgacgctatcctcaacgccaacgtcgtaaaccgaaccgcttttcaccggggcatgaactgatcagcctaaaggggaggggtcgggcaggcacattttccccccgattattatttccctttctcatttgcatcactggttt

SEQ ID NO: 71080 - DNA, 139 bp, Heterodera glycines
  Genomic contig location: Contig_ID=SeqID_43414; Location=28..166; Strand=-
  SCN-specific regions: Sequence locations=1-139
gctgaagctccatccgaaggatttctcacttattttggacgacgaatatttggtggccgtcgctgtccatcgctacagtagtgcaactccacaggaattgacatttactcgagaaattatacgccggacgacggctatt

SEQ ID NO: 71081 - DNA, 261 bp, Heterodera glycines
  Genomic contig location: Contig_ID=SeqID_43415; Location=259..519; Strand=+
  SCN-specific regions: Sequence locations=1-48,76-124,154-156,178 -223,245-261
atggaaaatgcggacgaaaagccgccgccggtgaccagcagcggcggcaccaatgccgccgccgccaccgctgcgttagcaatgcaaaaaattgtccaacaacacgcagcaaccatcgcgaaccaagtgcagcaacagcagcagcaacaaacaggcacagaatacaaacaaacaaatgcatattttgggagacaaattatggaaaaatatcatgtgtacttgccggaaaaatgggtacttccgtgttttttgctggtactt

SEQ ID NO: 71082 - DNA, 153 bp, Heterodera glycines
  Genomic contig location: Contig_ID=SeqID_43415; Location=1..153; Strand=+
  SCN-specific regions: Sequence locations=1-153
atttaattaaaaagagccccgagcttttcttaatttgtcattttgtttatagataataagtattattatgcgttcctctttttttatatacacaaattgtgcgttccttttcaatgtaaaaaaaactaatttttctgcccatgggcaaaaaaa

SEQ ID NO: 71083 - DNA, 710 bp, Heterodera glycines
  Genomic contig location: Contig_ID=SeqID_43416; Location=111..820; Strand=-
  SCN-specific regions: Sequence locations=1-17,40-258,280-710
atggaaaaggaacagcaaaagcacacagcggagagacaacagccgaatatgcaggggaggtgagaaacaaaaaaagcaagggaataatgcaaaacgcagcagaatgattccattcaatccgattaacttttggcaaaaaagaagtgccaacaatgttttagggtcggattaatcagtggagggtcggaaaacaggaaataccgacattttggtaacaggtggtttgtcgtcccctgccctattttcacaaaatgttgttttaaaaagccacgaaaacactcccgggagttttctgggtcgctgatcatgaatataacactcatttcggtcaatttcaaacctcggaaaggaactcgagaaaaagcatttcatttatgtaaaacggtttgacttttaaaattggatttgaaaaagttgactcttcgacttctgtttgaattcggcaacgatgttcgattcgtgatcagcgacattttcatgactttaaaaaaagggggagtgggcaaacaaatatatcgaatttttaccattcgtttaacagtttcgaagtgttggatagtggcaaggcattttcgccgtctatgacgccaaatccgaagaattgtcgcacgtccgttgcccaaattcgtcacaaagcaatggcacaaattcaagtggagccggcggaggtgccaatgccatcgtgccaaattaaaatgatggacaaaagg

SEQ ID NO: 71084 - DNA, 962 bp, Heterodera glycines
  Genomic contig location: Contig_ID=SeqID_43417; Location=107..1068; Strand=-
  SCN-specific regions: Sequence locations=1-302,338-352,375-402,472 -490,528-852,875-962
atgtttggcccaacagccacaacatggacaaattcggccgcagcgttgggctccaattcgtcctcccacgcctgggggtgtgaaaaaaaaatcaattttattcttttgatttacatttagtggcgctgagggaccctcgccgaaagcgaaatcggcaaatgcttcatctcattccggaggaaaatgagccgccaatgcgccgcaacaaccaagatcctccacagccgccacctccgggagttggagcataattttgagaattagcggatttatggtcttgtgatctgaattatgttttgttgaaatttaatattttgtaatattttcattttttattctgagtttagtgagtgttttaattggaaaatctttaaatatcttaatatatcaaaatcaataattattttgttttcatttagatcatttatttttgtttaaaaatggagggaaaatcctttttgaaaaccccaaaagaaaaacgacaattgagaaataaaaaaaattatttcagtaataaaaaaaatattccaaatgatagttattatacggaattagcaaacacccaaaaagaaaacaagaaatttggcatcaaagaaaatgttataagatttatatttaaaaattccgaagaaaattcaaaagaaaatttcaaaaaaattattgaatatttaacagataaagcaatggaaaaaaatgaaaagggttgggtaatagaaaaaatttcgtatgatttatattgtgaagctctgagtgatccgctaataattccgcctagggatttggtacaaaataacgcagatgtagttttggaatctttttaccacatacaacagagttttagtgaaattgatttattgaatgaggaaatctctttgattataactacgtatgctgccccaaatggatctggtattaagaaaaattcagtataaatcatttttaattttagggcaattaataaa

SEQ ID NO: 71085 - DNA, 958 bp, Heterodera glycines; identical to SEQ ID NO: 43418
  Genomic contig location: Contig_ID=SeqID_43418; Location=1..958; Strand=+
  SCN-specific regions: Sequence locations=1-203,229-670,692-805,827-958
  Gene Ontology: Mol. function=inositol-145-trisphosphate 5-phosphatase activity; Cellular component=actin cortical patch (sensu Saccharomyces); Biological process=endocytosis

SEQ ID NO: 71086 - DNA, 1210 bp, Heterodera glycines
  Genomic contig location: Contig_ID=SeqID_43419; Location=1..1210; Strand=-
  SCN-specific regions: Sequence locations=1-2,34-45,67-116,152-155,181- 216,238-248,295-308,342-600,633-638,722-722,752-803,926-928,956 -963,1039-1110,1177-1210
agtgtctgccttatcaactttcgatggtactgtatctgactaccatggtgatgacgggtaacggaggataagggttcgactccggagaaggggcctgagaaatggccactacgtctaaggatggcagcaggcgcgcaaattacccactctcaacgcgaggaggtagtgacgagaaataacgagaccgatctcttatgaggccggtcatcggaatgggtacaatttaaaccctttaacgagtatctatgagagggcaagtctggtgccagcagccgcggtaattccagctctcaaaatgcatagaattattgctgcggttaaaaagctcgtagttggatctgtgctagccgtccggtgcacactttgtgtgttactggtttggttggcttttctgccggtctttccccggcgttggcctttaccggtcggcgtcggtgggctggcgagtttactttgaacaaatcagagtgcttcaaacaggcgtttcgcttgaatgttcgtgcatggaataatagaagaggatttcggtccgattttattggttttgctgaccgagataatggttaacagagacaaacggggccattcgtattgctacgtgagaggtgaaattcttggaccgtagcaagacggactacagcgaaagcatttggcaagaatgtcttcattaatcaagaacgaaagtcagaggttcgaaggcgatcagataccgccctagttctgaccgtaaacgatgccaactagcgatccgccggcggatttattcgccctggtggggagcttcccggaaacgaaagtcttccggttccgggggaagtatggttgcaaagctgaaacttaaaggaattgacggaagggcaccaccaggagtggagcctgcggcttaatttgactcaacacggggaaactcacccggcccggacaccgtaaggattgacagattgatagctttttcatgattcggtggatggtggtgcatggccgttcttagttcgtggagcgatttgtctggtttattccgataacgagcgagactctagcctactaaatagttggctcattgcttctgtgggcacaacttcttagagggattttcggtgttcagccgcacgaaattgagcaataacaggtctgtgatgcccttagatgtccggggctgcacgcgcgctacactgggaaaatcagcgtgcttgtccttccccgaaagggg

SEQ ID NO: 71087 - DNA, 1194 bp, Heterodera glycines
  Genomic contig location: Contig_ID=SeqID_43419; Location=1..1194; Strand=+
  SCN-specific regions: Sequence locations=1-34,101-172,248-255,283 -285,408-459,489-489,573-578,611-869,903-916,963-973,995-1030,1056 -1059,1095-1144,1166-1194
cccctttcggggaaggacaagcacgctgattttcccagtgtagcgcgcgtgcagccccggacatctaagggcatcacagacctgttattgctcaatttcgtgcggctgaacaccgaaaatccctctaagaagttgtgcccacagaagcaatgagccaactatttagtaggctagagtctcgctcgttatcggaataaaccagacaaatcgctccacgaactaagaacggccatgcaccaccatccaccgaatcatgaaaaagctatcaatctgtcaatccttacggtgtccgggccgggtgagtttccccgtgttgagtcaaattaagccgcaggctccactcctggtggtgcccttccgtcaattcctttaagtttcagctttgcaaccatacttcccccggaaccggaagactttcgtttccgggaagctccccaccagggcgaataaatccgccggcggatcgctagttggcatcgtttacggtcagaactagggcggtatctgatcgccttcgaacctctgactttcgttcttgattaatgaagacattcttgccaaatgctttcgctgtagtccgtcttgctacggtccaagaatttcacctctcacgtagcaatacgaatggccccgtttgtctctgttaaccattatctcggtcagcaaaaccaataaaatcggaccgaaatcctcttctattattccatgcacgaacattcaagcgaaacgcctgtttgaagcactctgatttgttcaaagtaaactcgccagcccaccgacgccgaccggtaaaggccaacgccggggaaagaccggcagaaaagccaaccaaaccagtaacacacaaagtgtgcaccggacggctagcacagatccaactacgagctttttaaccgcagcaataattctatgcattttgagagctggaattaccgcggctgctggcaccagacttgccctctcatagatactcgttaaagggtttaaattgtacccattccgatgaccggcctcataagagatcggtctcgttatttctcgtcactacctcctcgcgttgagagtgggtaatttgcgcgcctgctgccatccttagacgtagtggccatttctcaggccccttctccggagtcgaacccttatcctccgttacccgtcatcaccatggtagtcagatacagtaccatcgaaagt

SEQ ID NO: 71088 - DNA, 1005 bp, Heterodera glycines
  Genomic contig location: Contig_ID=SeqID_43421; Location=60..1064; Strand=-
  SCN-specific regions: Sequence locations=1-1005
atggagattttgttggaagtaattttgggcagttctgacgaagaaatgacagaagttttggaggtttattctgaacaatatggtggaaatttgtcggaggatattcaaaaaattggggagaaggcccaagggaaaaactcaaaaggaaaaaatgacactgaggaggcaaaagctgtccgagaaattttgggtgatcggcttcaaaacttgaagaatagagcggcaattaaagtaagtacaagtatttttggaaaagcatggcgttttgcccaaaacttattaacaaaaatgcatcaaaaccgtaaaacacaccgcctaaaaatgaccctaaatttaaatatttttaggttttagcttattttttctgagctccagtggcttaaaatgcacgaaaaccaagttttttgggggattgttaagctattttcgagttattagagcatatgccaaatcccggcggggccccggtccaatccgggctcgaaaacaaacccacgaattgttgggtaatacattaagtggtacccacgtggttttggcaattatttaccttatgagttggctgtcgtaaacattcaatataaaattcattcgaaaaatttaaacactaatacaaccgtttgatttctaaattcgttttgtatataaaataagtaatgattagggttcgaaaaaatatgcacataaaattgcaaaatatgcgtataaaaatatgcaccagaagtaaagcgatgtatttgtgacgccccccccccccaatgtctacataaaaataaaggatatttccaatagtaatttttgaaggatacgatcaaagaactcggaacaatttgcgggcattggaagacgttaaacaattcttcaaatgagcgcgatgagcatttggagaccgacgaggatatagaaaacatgtacgggcttgccaagaagattttggtgaatttcgagcccgacacagcggacagtgcggaagttgcctccgtttggtctgaaagtgttccgtga

SEQ ID NO: 71089 - DNA, 609 bp, Heterodera glycines
  Genomic contig location: Contig_ID=SeqID_1266; Location=1289..1897; Strand=+
  SCN-specific regions: Sequence locations=1-175,197-285,307-609
atgcttaaaggatgtctgtacgttatcttagtgctgattgctgttagtttgattcggttgggcaaatgtttgaggtgatttaagccttttggcccttaatttctcctgaaaacttagaaaattcaacataactctgcctaaaagacatatttctgttcgcaaaataaacagaaatgtgaaaaaagatttgttctttcttatttacatagtttgttttatctgtttatttttggtagttgttgagattttgttcgtttttatcaagtgtctctattttaaattaacacccctttttcgggaaaaaattcataaaatttttttccgtcgtcatttcgccttctcctttttagaatcttaatattttcagaattgctacgtacagttaaaaattcagctcgatcggttcatgggaagtggtcaaactcccaaaaaacagggtgtctttattttaaattaacacagtgtacaaaatcagaaatctaaaccctctcgttgttttatcatctgttgagaagcagtccttctcttatcacttatcatttccatctccttagaattgttttccgtcaattccctgtttatgtccgtcttttttactatcttgaaaaa

SEQ ID NO: 71090 - DNA, 3592 bp, Heterodera glycines
  misc_feature (3548)..(3548): n is a, c, g, or t
  Genomic contig location: Contig_ID=SeqID_1266; Location=2432..6023; Strand=+
  SCN-specific regions: Sequence locations=1-308,330-483,505-563,586 -948,970-1004,1026-1217,1240-1299,1321-1374,1402-1496,1518-1548,1570 -2794,2816-2884,2906-3035,3058-3108,3130-3411,3434-3527,3557-3592
  Gene Ontology: Cellular component=mitochondrion; Biological process =embryogenesis and morphogenesis
gtcttcaggtatttccgtcgttgagcccaatgttcccgtccgtgtggtcgtttttggtctctttttggaccgtatcgctttggttgcctttacaacggataactgcttgaactccggtcttttttcaaaaatttctgtcaatgagctaacaacatggtttttttgtatttagttttcaacatttcgcacaatgaatttttgtctcattcggagaaaatgatcgaaatgagtgcccaattcaaagagttggcgcaacatttaacaattttgaaaaaataattgaaacaacagagacgaagacgcgtaccgaatgtgtttgttggagaaaatagacgaactcggcgaaggcgaggaagaccttattttggtgggtgtttcaccctttttgagttttttcagagttttttcttggcctgaggggctgtattcaaaaattcggtttttatggagtatggttttcgtatgttagaaatggtttcttcatctcctccccttccatttcctagattgacgaaatgcgcacttggatccgtgccacttcggaccccccggtgcattacatgcctgaggaaattcaggtagttttgttcttgtcattgtttttgcagctttttcaaaatttcagcttctgttcatcgtatgccatttttcttttttttggttttcatttgccaattctttcccttcagttcactttgtttcttctgtccgctttgttctccggtctaaacctcggccttatggctttgtccccccaggagctcactctcatcctaaattctcggtgatttttcccccaaaatgatattttattttccccattatccatccgaccgtttgctttaaggctctgaacgcgaacgaaaatatgccaaggtgattttgcctgtccgcaaagcggggaacatgctgctgtgtacgatactcatcgtaatgcacacaattcgattcttatttgatgcccttctcattgtaagatgaatgtcatcgtcaactcggccatctccattctgatggaggacctcacttccggcatcgtcgcctttgtactcgcctcattgggaattgtcgtttttggtgaaattgtgccccaaagtgtgtgcattaagtgagaaggggaaatgttgtaaattactttggcacgtaaattttgttaattttagaaagggtcttcaagttggtgccaaaactatttggctgactcggtattcattgagtttttcaattaattttttccataattagacaatttgtataagtttcttcatgttgatcacacttccactcgcttggcccatcggaaagcttttggattgtattttgggcgaagatttggttggcatggatcacgaaaagttgttggaaatgctgcgaatggcacaccaacacagcgaacaccacgaagaactcgcggaagatttgaaaattgctgttggagcgatggaaattgcggagaaaattgtgcgcgaagtgatgacaccaattgaggtgtggttaattggacaaaaagccaacagtctgttgaatgtgtaatgatttggtccgtaggatgtgttcatgctttccgacgaggccgtgttggactcggattgtgtggcggacgtagttcggcgaggctacagtcgtatccccgtgttcacgaacaacgaccgtaaccaaatcaccgggtgattctttgacccaaataattctaaatttctatggtttattgtcttcatggctttattcggtttcagtttgcttttcatcaaagatttggcccttttaaagcccaacgaacgactgaccgtttccaccatttgcgacttttatgcacgcactttgcgtttcgtcaccgacgacacaccgttgcaaacgatgctcgaggagttcaaggaggtcgaaacgctaaactgactcaaaatggagctaatattcaccattcccagggtgaatatcacttggccattgttttgtcggagaatcacaatcgcgtggtgggcatcatcacattggaggacattgtggaggaaattctgcagtcggaaattgtcgacgaaagtgacgttgtgtacgacaacaaataccgcaccaagcgcctcaccaaatggcttacggtaattaatgatggactaataactacaaaaaactaattacatttaatgacttccagaagggaaagctccgacggattaccgattctgaggacagagagggagacaaatgcaaatggttgtccgagtcactggccaaagtcactgcgcaatggctgagtgccatgcgaccggcactttttggggacaaagctatggacacgaaggctctccatttgctcatccgtctgaatgcgcgcaaagtgggattttggaatcttaaataaattcaaatttctacttttaaaaataccaactttgcagataaaagtaggccaacgctgctcaaaattggacagtgaactgaatttggcaccccaagagcctaaatacctttacaggtaaatacaaaagtacctttttctaagttccatttaatttaaagagctggtcgaccttctgaccattttattcttctcatcgaaggaaatgctgtcgcccatttcccgaaggttcactttcgatttcgtctggtaaattataccctttcagaatcagatgaaatttgacgttggagcatgggaatgtttcggtactgaaattctcgaccaaatggaggcacagatggttaacaattatcagatggacaaaaacatcgggaaaatgcaccaccaaaagacagtggccacaaatggactgttagtccatcgacacagtgcgttcaaaaattcatttttaattttgtccgtttcgacaaatgagtcaggtgcattcgttgaactgagtgagggcattgagtttatttctgactttgacctgctggtgaggaaagattgccgcttcatcgaactcactccctcgtcctatgccaccgcttctcgactttcgactttgcttcgcgctattaggtggggaaagcaattagtaaatactatctaaagcatttttcgctttctatctatgaccatgttttaaaaaatgttttttgcagagatctacgtaaaacggatgggtctcggtttgagcggcgccgaaaactgacaaagcaagactcagtaaagactttggatttggtgaccgaggtagaaacggctcatcataattaattggtggtcattggcatagagtaacgagcgattgctttttggaacgtatataatatttgtgaagcctctcgttacctctactgatcatcagcagataaattaattttccgatccgttcaaacagggctctccgagggtgcagaagcaaaagcgatgcatctcaaccgtcgaaatgccactgctgaagagattaatatagtcatcggcagaaatgacatcggaagaatatttgcaaaataacattttgttattaccatccacttttctttcattgccaacataaaaatgtttatatcattttcaggctctattgcatttaggcgtccaatcaaattttatgcatcagcagattaattattattttttttanattttattcttcgtgtaaaacatattagggcaaatgttaatcgg

SEQ ID NO: 71091 - DNA, 621 bp, Heterodera glycines
  Genomic contig location: Contig_ID=SeqID_1269; Location=862..1482; Strand=+
  SCN-specific regions: Sequence locations=1-62,84-99,121-129,163 -420,442-621
atgcaaaaactgtcctgtcttggagactttaacacacaacaacaaaaccagcagcacaacaatgcttctgtttcgtctctgatgtacaacagtaactaccaccaacagcagcaacatcagaactcgagcggcgccagcagtggcgtgtgttcgcccgcgtcgccgtttccgcctgccggaaggacgccgatgcaatcgcaacaacaacagttgcgaatgaacccgcagcaacaaagcaacgggggcaatgagttcactccgttggtccgaatgggcagcggaaacggtgctgttggacaacatccgtactcctttcggcaacaacatggtggtgggggtacagcggcagcagcgacaaatgcgatggttgcagcatcgtccccaatgatggccgaaaatcaccaccattctcaattggttattaaatgcacatctccgtgttacttactggtttaccataaaataatttaagcaaaaacaattgccgtcacctgcctactcagtccatgggatgaacaacagcaacatgaacaaccatgccaattcggtgatgtcctccaacccaggctcgatcatttccgcgttgcccgagtcgccgctgtccactcattccgtcaataa

SEQ ID NO: 71092 - DNA, 1386 bp, Heterodera glycines
  Genomic contig location: Contig_ID=SeqID_1270; Location=225..1610; Strand=+
  SCN-specific regions: Sequence locations=1-130,152-496,518-691,714 -752,774-886,908-979,1001-1386
atgacggcgacaaattcatcaacagcgcgagtggccggcgccagcacttcagcaccgggcgggtcgtctgctgacactttagccagcacaattgcgtaagggcatgttaaatgaatgactgcgtgtgtaataattgttttgtttattaatgcttttaaatcgatcctttgtttaggtctgtggcttccggaggtggcagttttgaatttgagaaggccattggcacttcgccccttccgtcgtctctgccaaccgccggcgattcctccgccgctttattgacaccgactgttggccctgctgttggtccgagtacttctgcccaaccgcaacagttgacctcttcgcccggtgtgaagagacgaaagaaccaacaaataacgcagacggtcacagccattgtaaatgcattggaacagccgccgattgccgtggagcagcagcagtctcttcccgcttatggcggcggtgcgttgtcccatcctttacaacagcaaacatcacttggcatgcaacagcacgaacaaatggttagttgcacatggatgatgatgattaatgtcaacaagcaacaccattgctgcttcgggagggctaaattcaagggcgtagccaaacccttggcttcgggggggattaaaaaaatccgtttttagaagtgtttttttcttttgttagaaatcccgaattaggaggtgtatttacaggaatttataaccgttttttcgcaaaaaaatgactattttcataataaataattttagaaaataaaagttttttcaagactgtcccatcacaatgtcggatccatgtgcaaaacccgccccaaacgcacggcgattttccgcccacaggcaccaaaatccaagtggtgcacatgcaaccgccagcagccgccatttcacaccatcttcaacagcaaatgtccgacaatctttctcctcaacaacaggttttttgccatttgaactgcttgagtttcgactttccttcccccagatttccgtcgctcgaccgatttcaacgcgtctttcgacattacaacctgaccacaatttgaattcgtcctcctcttctgctctgtgcgattaccatgtggccaatgccaacaacaacgactccattaatggtgttcaccaaattgggccaccatcaattgccgaactgtcgtcctctgccgaaatgagccatcactccacgccgagagttgctgctgcaccgccttactcgccatatcatcaccaacagcaagtcgctgccgcgtttgtttctcctgcgccacaaaatcaacaccatttttatggaagcacaatgccgcaacagttgtcaccatcatcagcatacaaatataataatcaacagcagttgcaacaccattcttatcat

SEQ ID NO: 71093 - DNA, 677 bp, Heterodera glycines
  Genomic contig location: Contig_ID=SeqID_9350; Location=666..1342; Strand=+
  SCN-specific regions: Sequence locations=1-188,210-403,445-537,559-677
atgcaaccaaatttccattttctaattgttctgattttattcggtgtttccatttgtacggcttcatcttacacttggaaatcagagcctaatttggccaacaatgtacaaacgtttgccaaatttatggatgatctttatgtggaatacaagaagactgtaaaaatgggtcagttcaatgcaaaatgtaaaataaaaaatatattttagtgaaatttaccagcaaaaaattattatttttttggatttggtttttttagatgtaaatacactttcagacacaattctaagaaatccgtcaacgatattattgactaattactcagacaagcagaaaaggacagtgttcaatttgacatttgtaaaatgtgtggcggaaattgcctatttccgagtgattaacaaaaatgcaaattcgaatttttcatatcaaaaatttaaaatagtgcctggattagatgctaaagatgaatttgttggttttttgcattttgaccaaacacttggccaacaaattgctgaaaaattcaaagacgaaattttttctgagaaaaaacaaattcccgaagaagttgtgaaccaaattctgcagttggccttctcatttgccgcccgagtcattctcagcatagtgtaaaacattgaaaaaccttgaattaatttaaattatctaaata

SEQ ID NO: 71094 - DNA, 824 bp, Heterodera glycines
  Genomic contig location: Contig_ID=SeqID_9351; Location=133..956; Strand=-
  SCN-specific regions: Sequence locations=1-455,477-824
atgaaattatatagcaagcgtattggttctaaaacagttatgacaactgattgctccgaaaatccgaattattgctacaaatggacatctgcaggagtcaaaaaagatgacggtcaacgctttgtatgtgctggttgccggaaaatcaaggaccggaaagatgttccaagcgacagaaaattaccaaccagaaaagtgcttgaaaatggatcatgggccagcgatggtgcaaagtaccctcacttttgcgaaccgattcgaaaaacagaagttcttggagttgaggtgtaaataatatgtagagaatgatttgacttgaattttaggaacgacggaaagtgcaagcagaactggcacttgggtccagagaaaacattgcatcggcgaaagtgcgcattgaatgcatagtggaagaaaattacaaacttttacctactcaggaaaaagcggaaatcagggacagcgcttgtggtaatgcagtggcaacaaagaaggtaggaactcattttaagtccatttaatttttaataatatgctcgtttaaatctcaataggcgttgtactatgcccaatcaaagaggacgatgaaaatccggacattacaggaacttcagcaagaaataagcaagcctctatggctgacttatcgtggaagaattgcacacgaggaaagcgatcacttccaagaactttttttgctagagtgtacggacgtgatggcactcttttcttcgccccgtcagttggcgctttttaaacgaacggaaacgattgtttgtgatggcactttcaaaatggcaccgcgaggcatttatcaagtttaa

SEQ ID NO: 71095 - DNA, 1609 bp, Heterodera glycines
  Genomic contig location: Contig_ID=SeqID_9351; Location=2260..3868; Strand=+
  SCN-specific regions: Sequence locations=1-12,34-163,186-194,218 -253,275-339,384-463,485-528,551-1052,1074-1082,1104-1157,1189 -1389,1411-1609
atgaacacaaaatcccaagagaaaccacctgctgaaatctacacatttctccatgatcattttgtctcattggcatcaaaacaacaatcatcatcaacatggatatggaggtattatggcgttactcaaaaacaatcaaaatgggttactcaaaaacccattcaaaataaaaatatttatattaactgatcggaagcaatcaaagttttaatatttgatttcattcgatagtgctaaattttctctattagcctttaaaatttaaaaaaattttgttgactttcaaaaaagttgtggtcagaaggacgcaaaaaacaatgtttttcaaacacattggtcaaaaaatttttttaaacttaacaaaaattttttgaaattatttaggctaacagaaaaaattaaggcaatcggaaaataaaaatcaaaaatttggttgtttcttaacaaaattatagtcaactatttttatttggatggtttttgagtaacgcccaatttggaggtttatgagaatgacctattaaatacagacacggacacggtggatatgaattgtcggaacaataaaagccacggcttctctaggccaaaattctcataaattttcttaattattttacagtgaaaaaaaagcgcgaaataaactgtgcatttgtcaattttggacgagtgttggcaaaacgtttgaaatttgttcatgaaaagtttaacacatttgctgatggtaaagaaaaagaatgtggtggcagagaccctcacacaacaaattattatgattataagcatcatcatgctttcatcagtgataacaatacaccggcggaagggtaattaatagggacgcgacttttagtgacgaaaaagtgccaaaatagttgactaaaatagttacgaaaaagtgccaaaatagttgactaaaatagttacgaaaaagtgccaaaaaagtgacaaaatagtgaaaaaagtccgcaatagtgacataatttttagccaaaaattgagcaaaaaataatttttattcactgattgcagttgcaagtgagctacatttcctttataaaattctcttagcaaatattcacattttttaaattaaaaattttgtcaagaaaaaaaaatttggtggaagaatttttgaaaaaattttccaattcttagtggtgtatttttaaaaaattgttttgtcgattcttaggggtgtatttttttgaaatttttttagatcgattcttaggggtatattttttgattttattgcatttttgttaacaaattttccaaaaaatgtagaaatagtgaaaaatagtgacaaaacgccaaaaaagtgaattttcatttaagtgacgaaacgccaaaatagtgatttctctagtgacgaaaaatgacgtccaaattaaaaaattttaatgcataaatgcgttttttgagcacctttcttcaaatcaatcgagcaaaaaaaagtttttccactagaaatcgcgtccctagtaattaaattgataattaattaatttgcagacaaggattagggttcatatcttttggcccggaccaggccgttttcgcgtgggcccagtttttgaactgtaatttttttattgtcaactaa

SEQ ID NO: 71096 - DNA, 611 bp, Heterodera glycines
  Genomic contig location: Contig_ID=SeqID_9352; Location=792..1402; Strand=+
  SCN-specific regions: Sequence locations=1-84,124-226,248-307,330 -394,416-611
atgctaatgtttgaagagccgttgtggaactatggccaagtaattggaattgatgccaacgaagcacagggtaaagaattgaacataattaaaactttaattaataaaattcattaattaattccagatgttgtgaaattctgtgaagaccttcagcagaatgttgtcagtgcagcactgaattcacccatacgaaaagctatgacagttatgaaacttacagaattggaggaatttcaatatttgaactccattatcaatagcttaagagatgaggaaaatatggatgaattgaacatttttgctgaaaattatgacaaaaaattaatgattgacaagcaacaatcattaaaggaactgttggcaattttaatgaaaatctacgcggactatagcaatgccagcaaaagagaaataagcaaaaatgccattcggttgacacattctggaaacgaaattttacgatttggacaaattttatatgaaacgttagagaatttggaaaatttgccggaagaccgcgtgaaatatgatgaaaatgaacaattgctaaccattccattattatttgtcaatcatttgcttgagcgactcaatgaattcattgaaag

SEQ ID NO: 71097 - DNA, 376 bp, Heterodera glycines
  Genomic contig location: Contig_ID=SeqID_43424; Location=82..457; Strand=-
  SCN-specific regions: Sequence locations=1-81,107-145,168-193,215-376
atgataattcgctctccgccattgacacgacaaagagcgttgaatttgcgaacctttgcgcaaaaccaaaacgcagcggttgaagagcagcagcaacaacaacaggttgaaggagttcatggtgaaaatgaaccattggttaacgctccgatctcgccaggacttaaccgaaatttgagtttgtcggcggaggaaaacgaacaccattttagtgaaatggaagcagcagcagcaaatgacgatgaaattcggcggcgccttctgcatgtgtccatccaatcgaatttgccgccgcgagcaaacggtggtggtaacaatggtgccgaacagcagcaaattcgcaatgcaaatgttggtcacgaggactttgttgaag

SEQ ID NO: 71098 - DNA, 282 bp, Heterodera glycines
  Genomic contig location: Contig_ID=SeqID_43426; Location=139..420; Strand=-
  SCN-specific regions: Sequence locations=1-87,170-282
atggccaaattggccgagggattggaaattggcgagcagttcagcagagagtggggacggacggattatgagggagggaaaggtgggaaaaatttaaatatttaaatttgaattgacattttgtaattttaaataattaaagatgaagaagacgaagaagacgacgaagcggacaacacgtcaacgacggattcgatgaacacaattgttgaatttggcatttgcgaaccatcggaaaatgggcaaaatcaatggcaaagcgaaacgatggagaaacgaaag

SEQ ID NO: 71099 - DNA, 582 bp, Heterodera glycines
  Genomic contig location: Contig_ID=SeqID_43428; Location=73..654; Strand=+
  SCN-specific regions: Sequence locations=1-49,88-406,428-582
atgaacaaaggcaaaagcatcgttatggctgactccaaaaaggaaggtgaaaatattgttaattaattattaaaattatatttttaactgaaggcacaacgacagtgaaaattccgcaccgttatggagcagtgtcggggatgagtggccaaaatgccagtccaaaagcctctcaaattggcagtccaaaaaacagtccaaagggcactcaaattggcagtccaagatccattagcagtcctaaatcaacacaaattggaagcccaaaaggcattcaaattggcagtccacgaaaagaaaagaccaaattatcttcagctgttggctcttctgatttcaatgttatcgacgaatgtaagaagtcataattgaagacaattccaacattttaattaataatttagcaaaagaagcgaaaaaaccaagccaattcaaaccgagtccgtccagaagccaaaataaacgcgaacagcagcgactcaatgttactattggagaagcgggaagaggtaattaatgaaataattattaattgttctttgttatggcctaacgacatatttgggaacgtttatttaaaaa

SEQ ID NO: 71100 - DNA, 1021 bp, Heterodera glycines
  Genomic contig location: Contig_ID=SeqID_43430; Location=29..1049; Strand=+
  SCN-specific regions: Sequence locations=1-18,40-106,129-464,488 -808,831-931,953-1021
  Gene Ontology: Biological process=cell growth and/or maintenance
atgccaagtgcatttgaaagaatgccaaggaaaaggaaagagtgccaaggaaaaggaaagagtgccaagggcgaggaaagagtggagtgcctgagagagagatatcaaatgggaaagaaagtaaaaaagagtgattgcaagggatggacattaacttttaatggacccgcctgcctcatttgccgcttttctctaaaaatgattcccttttgtacagtgtgccaacacagaagataaaatctattctgaatgggactgtccccaggcgttggctgtgcataattatgccattcaacaggaggacgaattgagcctaagcaaaggcgacgtggtgaacattttgcggaaaatgaccgacggatggttttacggtgaacgaacgcgcgacgcacaaatgggatggtttccctcttcgtatgttcagcaggtcgcactttttaattcaaatccattaaaattcatcgtttttttaatttaaattttaaaaggtccaaggccagcaaagagttttgcttttaaggtgctgaacgaccacaacaaggccaacagtttcagacagaagctgagcctcgtccagcagcgttcctccgccggcgatgcgaatgtgttcagacgcggctcctccctgcaggcgatagcccacgacggaggcgagctgtccttctcccatcctccgcaccaacgcgaccacccgccgtcgatgagtcggttgagacgcatgagcagtcccttcggcgtgctttcccgtgacgcataaatggcgcattggcaacggagttatcccattctttgacggcgtcgttaatcatttcccccttccccttcccttcatcagatgccccttttaaatatgcttttctcagtttctcataatgttcccgttcccattgtttctttgtaaatattattctaaaatacaaatgctcacttcattttatttacaattcgtttttgtatcgactcatttttttatattttctgtaggagtgccgaagaagttagatagtttatttattcaaaa

SEQ ID NO: 71101 - DNA, 965 bp, Heterodera glycines
  Genomic contig location: Contig_ID=SeqID_43431; Location=13..977; Strand=-
  SCN-specific regions: Sequence locations=1-696,718-750,786-965
atggccgaaaggcacacggcacacgcgtacaaagcagccaatttgagctgctcagtcgagtcacgcgtcccattcactgttttttggcttttcgagggaaaaaccatcggagggcccctcttttatgagtaagaaagtggcaaaaagccgccacagtcggcataataccggcgaaatgttgccattttgcgaacagttccaccgacacttccctttggacaattgacgcggttacgccaaagcaccgcggattgtacacgtgccaagtgaggaacgaatgacagcagattatgtccgtttgatagtttaattttattttcaggtggtcagtccccagggcaatcactcggctcttacctttttggattctcgaggtgattgattttgccgattgcttaacaccggtcattaaactccgttcagagcctccgccgcacattgtcgcaattcgcaacgaatccgtggccatccacggcaccgcttttctccactgccgcacccaaagcattgagcaagcgaaaatcacttggctgcacaaccaaagcaaagccgtgggcaattcggccaaagctgtgctttttttgcttttgtttttcattgcttttgtaaaaggcgcggggatactgtatctttcgattggacttctgtaattcgatgagcataatttaaaacgcagcaattaatacgattgctcgctttttaagaaaatatttttgagcccagtcaatccaagaatccttaatcacattcttccttaaacatttccctttttaattggttttgaatggccatctcattaacttccttttggcattcgcccgtttcagtacactttcggtaacaacggcactttgcgcatttttgacacttccatcgacgattcgggcgagtacaaaagccaagctcgaacatcgggaggcctatcggaagctgtaggaaagctgaacgttctgcaggccccgcgg

SEQ ID NO: 71102 - DNA, 1348 bp, Heterodera glycines
  Genomic contig location: Contig_ID=SeqID_9353; Location=71..1418; Strand=+
  SCN-specific regions: Sequence locations=1-100,122-130,152-343,367 -417,439-1027,1049-1244,1266-1348
catgtcactacaacaccatatcatcagcagtctaatggaatggctgaaggggctatgcgaatcatggcaaatattatttctcaaatggtaaatgaaaaagggaataattgggatgaaattctgccgcacgctattttttcatacaatatttcaatacattcagctaccaaattttcgccattttttatcattaatttacgacagccaaaattgccaactgatcggttacttaaactcccatcccccgatgagcttgtgtccgatatttcggtctatacaagaattcagactgaaaaagcagctaaagcgtgggaaattgtgcgaaatgaaattctaaaagcgcaggaaaggaacaaagaagagaatgatcaaataaggaaagcacatgaaagagaatttgaaatcggtgatttagtgttggttaaaaaagaagttttgggccataaatttgatcaacgttggttgggaccaatgcgttgtgtgggagttgaaaaggagaaaaaaaatgttgttttacagtcaattgatggaagcgctaaattaagaaaagtacatcaagaaaaagtgaaacattttaatggaccagcaattcttcctctaaggcagtcagacgaaccattaaattgggaaaagtacgtagatgatccgaatttagaacaggaagaaatcgaaggtgaaagttgcgaaagtgactgtgaggaaacgcaagaaaatgaaaatgcgcagtcaaaaaacaaaatgggattaaaagtttaaaaatatggctttgagagttctgacgatgagaatgattggagtattgttgcgtttgtaagagaaaaccaaaattctgaggatgatgaaggcccggaagttataatggacagaaacccccgaaatcgaaataatgccaattttcacaatactcgaagtccttattgagggttcatttactgaagtatacaccggatggagagaccccgtaacaatctcattaatctcaagcatatctgaaaacctagtaagggaaaattgggaaatttatgttaatggaaatggctcaagatttgttatggcatggatttttggcgaaagtttcgaaattttcattgtcaacgaatttgatcaaataatgttgggaattgatgcgcaaatgttgttgggtgaaagatggcgaataaaaactgaaaatgaaattgagacatattgggaaatctacttcgatgaaaatgggcacgaatttgaaattcccagaattcctgaaatccttttttcagaaaaggaaaatttggaaattgggtatgggccaaactttgtaactctccgagattcagaaggaatgataagtgatcaggatgatttagaggaa

SEQ ID NO: 71103 - DNA, 922 bp, Heterodera glycines
  Genomic contig location: Contig_ID=SeqID_9354; Location=1096..2017; Strand=+
  SCN-specific regions: Sequence locations=1-2,25-112,135-240,262 -707,729-922
atgccaaaagaaggacaaagtgcccgaaaacgattgcgagagggatcgccaaacaaaggcgaattgtttacgaacaatcgttgggatgagaagatgcgcgagatcgaagaagtgaacaaaaactcaaaagaagtgcgtaatgccttgaatagacttttgacgatgcgtcaaaaaatctttgaaatacaggacgaagcccaagtggcgacgaaggaattgcaaaaagtgttaagaaaaatggagggaaaggaaaaaagtggaaatgaactggaggatgaagttgggttgccgggaaatttgcgtgaagctcggtgctttaaatgcggacgttctggacattttgctcgtgaatgccgtgatggtggagacgggaaccgtggaagcagagtttggcgcaattggggcgacgctcgaggtcgaacgggacgtggaacgtggcgaaatagcgaccagaaccaagccgatgagggcccatccacttcgacgtcatcagctcacttgacggacttcggcacgttcttcaattacatcggaggaaaccaataaacgcaaagtgattggacattttcatttgatcggacattttcattaattaatgctaaattatattactctttaactttcattacttctctatttttgaattgtatcagtcaggaccgatgacggtctattcggagggggccgatgatatacttaatttcttatttctctttttctctctcttatcctctgatcattgttcgcccatcaatgtcatcccgggggcggaccttcttttcactaatcgagaccctttataagtgttcatccgcctcttctctctctcagtcttgcccggggctcccgcccatcagtctctgtccccgagaccgaatcgggttgggggttgcccattgtatcctgaacattggacaccaga

SEQ ID NO: 71104 - DNA, 699 bp, Heterodera glycines
  Genomic contig location: Contig_ID=SeqID_43434; Location=148..846; Strand=-
  SCN-specific regions: Sequence locations=1-699
tttggtgcgtttcagagcaatttctgaaaaaatatttatgaaataaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaaggtaaaaataaagtagaggtatatcgaagctattcccgaaggattcggtctccccataaatctggcgcatcggttcagggtactgccccgaaatc

SEQ ID NO: 71105 - DNA, 226 bp, Heterodera glycines
  Genomic contig location: Contig_ID=SeqID_43436; Location=482..707; Strand=+
  SCN-specific regions: Sequence locations=1-226
atggtgattagaagaggtacaatggtgattagaagaggtacaatggtgattagaagaggtacaatggtgattagaagaggtacaatggtgattagaagaggtacaactgtgattagaagaggtacaacagtgattagaagaggtacaatggtgattagaagaggtacaatggtgattagaagaggtacaatggtgattagaagaggtacaatggtgattagaagag

SEQ ID NO: 71106 - DNA, 788 bp, Heterodera glycines
  Genomic contig location: Contig_ID=SeqID_43440; Location=1..788; Strand=-
  SCN-specific regions: Sequence locations=1-745,767-788
tccgcaatggcacttttgccaatggctctttttctcatattgtcctcccaaaatgccaattctgttgatcaccaacggagtcaccgaatgggcaggcaaagatctttcaacgaaggttcgacaagaaaaccacgaaaaatttgaaaattattagcggaattatatttaaaattgattatctcataaatactccaagttcagatctccaaatcaacgtccacccgcccgaattgagcgtccgcgaggggcgcgaagcatcgtttgaatgccgcgcacggacaacggacaacagtttttacccggaagtgaatttagactctcgaaaacccataaaataccaaattcgagatttaattaattaattttgtgcaggtgaggtggacacgggtgggcggacgattgcccgacggagtgcgcgaggggggcgggagactgaccattccgcaagcgcagctgcagcacgcgggacagtacgcatgcgtggccatgcacaacggacggacagtggaggcacacgcgacgcttcacgtccaatcatgtgggagacacgagggaggaggacatttgaaactaagaaaatggggacacattcggcttaagatgggccccaagagttgcaaggggacaccaacgcagtcgcagccggttgcatggcggacgagcgcgcgtgtggcagcaacgaatgtgtgaagttggactacgtttgtgacggggagccggactgtcgggacagatcggacgaattggagggaaaagggaaaggggcgaagcagaagcaatgatcggaa

SEQ ID NO: 71107 - DNA, 503 bp, Heterodera glycines
  Genomic contig location: Contig_ID=SeqID_9357; Location=511..1013; Strand=-
  SCN-specific regions: Sequence locations=1-503
atggcacttagaaagtttttaaaccaaaagaagaatcaacaagtgtgcttcaacgacgaggtcgaacggcatgagtttgagcaggagcttagtttagacataatcggcgaattcatcaaagtgccatttaaagatccgagaaaaggctacagtttgagcatccgatcagcctcttttttgggcgtttatgatttggtggaggtgaaaatgagtaaataaaagagatgagccaaagttttttgaatgtttagcgtattattgcggaggatgccaattgtgtgaatgtgccaaacaaacacggctggactgcgctgatgtacgcggcgcaaggcggcaacgtcgacatttgtcaacttttgctgcaacacggggcgcgattggatgtgaaaaatgggcagggacaagatgcttacgaattggcaaagaattggggccacaaaagggtgatggatctgatcaaagcgaaaacgtatctgagacagtccaacaacggtaaaaagtga

SEQ ID NO: 71108 - DNA, 170 bp, Heterodera glycines
  Genomic contig location: Contig_ID=SeqID_9357; Location=37..206; Strand=+
  SCN-specific regions: Sequence locations=1-170
  Gene Ontology: Mol. function=monooxygenase activity; Biological process=oxygen and reactive oxygen species metabolism
agttgcaatacgtggattacatggacgagttggccaagttggtcggctgcaagccgaaattagtcggacgcattttcactgatccatgcctggccaaagttctcctcttcaacggcctcgtgccgtaccaattccgattggatgggccccaccgatgggaaggggcgcga

SEQ ID NO: 71109 - DNA, 553 bp, Heterodera glycines
  Genomic contig location: Contig_ID=SeqID_9359; Location=534..1086; Strand=-
  SCN-specific regions: Sequence locations=1-370,402-529
atgggaagaggtggaaagagcgttagacgaattgattgagcaacgccgccagcggggcgtactgcccgaggtaaccgaatgggtaccgcccgctggcggagggaggaggagagggaggaggtggaggggaagtcgacaacttcgtggaagtgctctgttggtttgtcgtgggagattggacggggcagtctcaccggatacatcatccgcagttctttcgttgacccggtaaaattttcgattagatattctccctattttaaacctagttttacaaaaatgcaaagccaggagaggaaggagaccactttagtggcctagtgggtggacctattaaattttgttaaattcagaaaattggctgatgtggtttgtcccccacaaaaattttgatttcaaaatttaaaaaaatcacaggtcaacggaaagctgaccaaacatggccaccggcggataaacaaattgatcgaacgcaagaaacaatggacgcaaaattcatgatcaggctttttcaaaccaaaattcattgtaaaaattttttaaaaataataaa

SEQ ID NO: 71110 - DNA, 314 bp, Heterodera glycines
  Genomic contig location: Contig_ID=SeqID_43445; Location=496..809; Strand=-
  SCN-specific regions: Sequence locations=1-314
atgacagaaggaaaggcgtattatcgcgacgatgaaggggattacgactacgggctgaaggacgatgagtcggactccgaatgttcgattggctatcgtcctaccattgtcagctcaaataacccaatttctttgcttaatctccgacttaaggtgattatggggctgaagcggagcggtaaaacgtcgatcaggaaggtttgtcaatccaaatttttaaatttttcttattttgtctttttaggtggtcttccaaaaaatgagtccgaatgagacgctttttgtggaaagcactgctcgggtgaccaatgaat

SEQ ID NO: 71111 - DNA, 568 bp, Heterodera glycines
  Genomic contig location: Contig_ID=SeqID_43448; Location=148..715; Strand=-
  SCN-specific regions: Sequence locations=1-156,179-206,230-568
gtattgcagatttgggaaactcttttcgagaaactcgaaaattcaaaaatgccattgacgaattgccaataaaatcagcgcaagggaatgcttcaaagggggaaagtttttctggacaaagtaacgaagataaaggtaaaaaaagtacagaaagcatgaaattctgttttatttatttttggcgtaatcgtcgcagcaggacacgcaattaatttatattaaactttttctaagtgcttatgttttacatggattagtggctaagctttcagttcatcttcatttttgccttttcattttttgaattattatttaattactaacgcataactcaactttgcacctttggttttcaaaattatatcaacaaaaaattatacttttatgaactttcttatttcattaaaaaaaagcttcgctttgaacttttaattttgtaatttctttttttctgtcagaaaattttttttagtaaaaattaaaatcacaaattccgttggcaacaaagacgtgcaattaggacgaagcagaagcacaagtataattggaagatttgccaaggaaaatt

SEQ ID NO: 71112 - DNA, 828 bp, Heterodera glycines
  Genomic contig location: Contig_ID=SeqID_9361; Location=2159..2986; Strand=+
  SCN-specific regions: Sequence locations=1-61,101-154,176-184,223 -534,565-630,735-799,821-828
atggacaaatggggaagaattaatttttatgtgtttgtggtcacattagttgtaagtttagaaattttttattttggaataaatttttttttattttttacgctcgaaaaaaagttttttttattgaatttgtacgattgatgctcaaaaaattttgcttttgaataattttaaaagaaaactgaattttttctaataatttttagttttataaaattttatggctgcggccattggcatcgcaggcccataaattctttgttttttttaaatatgcccaacaattccaaaattagagatgcttacatatctcgaactaagagagcagaatttacacgaatattcgtggcttttcagctgatgatgagtgatgagatgatgctctcggtgggcttcttccatttgccatggatttggtcgcccgcttttccccgcggggcgccggaggcggaagagagtgacgacccggcggttggcacaatttctgcgctttctctctcgctctttttttcttattgacctttaatgaacacactctctctctctctctcgctccctccctctgtccctgagctttttgtatatatccactctcttgttccatgtttttctcggcctctttcacacttgctctctctctctctctctctctcatttctctctctctctctcatttctttctctctctctctcttatctctctctcactctctctcatttctctctttcctctcaaattgcattttcgtgtatactttttttcgctcctttctcttatgctctctttcttcatattagaaaacgaagaaaaacaacgaaatgagcaga

SEQ ID NO: 71113 - DNA, 142 bp, Heterodera glycines
  Genomic contig location: Contig_ID=SeqID_43455; Location=1..142; Strand=-
  SCN-specific regions: Sequence locations=1-109,135-142
ctttctcaataatgaggtaccatttcctgtgaatatccggttattaatgactttgtttatcttaatcagcgtgcagcgtgaattttgtcatgtgacattaagctatgccaaatttagtaattctgttgacaaagacggaaat

SEQ ID NO: 71114 - DNA, 396 bp, Heterodera glycines
  Genomic contig location: Contig_ID=SeqID_43457; Location=92..487; Strand=-
  SCN-specific regions: Sequence locations=1-276,298-331,371-396
atgccaccacagtacaaatggatggaatttaatgcatcgttggctcatccatcagacccagtcgtatttctggtaattttttcttttttcctttctctcttattttttattattatgtttaaggacattgaaagtgactcggcttcttgcggtaattttttgtttaattaatttcgaaaaaatgagtcgtggccagttcggcgcttaaaataaaatactaaatttttttggaaaaaagtataaaatttcaggacgtataattattgacctcatggttgctgctgtgccacagacgacggaaaatttcaaacaattgtgtgcaggagcattgtaatattttattaaaattttataaattaaatattatattcgaaattttcatgctattagaataaa

SEQ ID NO: 71115 - DNA, 119 bp, Heterodera glycines
  Genomic contig location: Contig_ID=SeqID_43458; Location=400..518; Strand=+
  SCN-specific regions: Sequence locations=1-119
tgtccgtttggggtactcaaacaattatggggagcaaaaatccaacgcagaattaaagtcagactatagggaagctatttccgaaggattcggtctccccataaatctgggcgcatcgg

SEQ ID NO: 71116 - DNA, 678 bp, Heterodera glycines
  Genomic contig location: Contig_ID=SeqID_43459; Location=1..678; Strand=-
  SCN-specific regions: Sequence locations=1-508,530-678
aacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcggggggactgccccgaaaacccaaaaaaaaattttttggataaaaattatttaaatgaactgactagataatatttaaaatatgttatttctcttcctttcagtatccctgcaaagtttggtgcgcttctgatcagtttctgaaaaaaaagttaagcctaaactttttggcctgtttaaaaaggaattaaaaattttaaaa

SEQ ID NO: 71117 - DNA, 1207 bp, Heterodera glycines
  Genomic contig location: Contig_ID=SeqID_9364; Location=48..1254; Strand=+
  SCN-specific regions: Sequence locations=1-138,160-163,185-394,417 -553,576-678,700-842,948-1207
atggcatttccttgccatggacgcatttccgatcaaagagaagggacattttcgatggacattgagaaattgtcggaatttgcgcgagaggaagtgaacagcaggcgattaagcaaacacttttacacaaaaggattgccatggaaaatttgggcacaaataaggacgaagaaaaacagcactgaaaaatatctgggcgttttcctatggtgcattgctcaaataattggtggaacaaaccaatttaaatttgaaatattttactttatgattaagatgaaaattggagttgcaaatgttcgtcaactcttcgaattgtttcacaaaagagcggaacggaagatgtaacgagaaaatatgaccatattttaaacaacaaagtgaacagatggggatttccatttttcattacttttacggtcagtggcagtaaaaatattccttttcttcgcttaataaaattgcgaaattaagcaattgatggacctggacaaaggaatttacgacaaaaatgaggacaaagtgacattggccgttaatattaaagtggaagaagaaaaagggacaaaaaatgcctgaagaaataagcgctcattcacccacccactcattttctgttgataatatataaatatcgaattaaacagtttcactgatccaagacaattaattcatgggttctttctttggtttgttgggaaacaaaagcaaaggcctcacttttacactttcgcttaattaatattagggttggaaatgtcggggtcagcaaggtcggggtcggggttgaccaaattgttaggtttttcaatttttctccttataccatatagtcaaaaatctttatattattttagcataaaattttttattattcataataataattttatgtgtttttttatttctttttatcataaatatttttgtataaaataattaaatatgtataggcatttttatggccaatttccagtgaaaaactgtaaaaaatagtcaaattttcaaattttccagcagaccattgacaattcaacggttgggcaagataaagaacattggtcgcaaattttctcaagctctgccggattttctttattttattttatttttcatttgcattacccatcgacaggatggggattcgaaaatttcatttcctttgcggtgaatgccaattcaaataaatgagcaattgacattcaca

SEQ ID NO: 71118 - DNA, 1277 bp, Heterodera glycines
  Genomic contig location: Contig_ID=SeqID_43463; Location=9..1285; Strand=+
  SCN-specific regions: Sequence locations=1-1075,1097-1179,1202-1277
atggcaacagctaaattaaaatattgggttctgcagaatgaggcacaaatggaaccgtattgtgagcggagtgtcgcggcacaacagaagttgggctattcaacaaaagattctgaagagatggtggcgattccaatggcattccgtgccaatttgaagatggcggcgattcaaatggcattccgtgccaatttgaagatggcggcgattcaaatggcattccgtgccaatttgatgggtgtgcaccgtattggaagggatttggcactcgcggtatgtttagttggaggagtggcttttgcgcatgcattaaaaggcgagtgagcgaattgggccgattgtgaactgccgacgcatttgtttggtacatttcgttgaatggcatttgttgccgcgggggcggtgggcccataatttgccctgtgaaatatgcaacattagctgttttttgatttattcaataattcaaaattgcgtaaatgaagccaaatgacggattactgtcagtttgtacggtagggacgggttccatttgcgaattcattgaaaatgcaaagtcgtccatttggccaacagtggaagtcggtagtggcggaaacatctgagagagggaatgccaatgcctagtaatcatcgcgaatggcacttccttaaggcgttttaccccgctgatttggttggattgactggccgaaatttggtgaccagcagcagccgcggaattgtcggcatggccttggccaattccgagagccatcggaaggagtacatcatcgaaagtttggccagccatttggtcggaggaggacccaaatggtagcgacgagtggtacggaagctgatcactgtgctgctgccaatggtccgacgaaatgaacgcttcggtctgttgctgaaacagttggtcaggccacagcatttgttctgaatgaatgcgaatggcacttcatcaataggcctaagcctttttttgtcagtctgaaaagctcaaaaaccgtaccaaatgaaagtgtttcaaaaccttttggcctatattttaacatttttttccgcatatcgcatgatttccaagaataattaatgaatttggtgcttctaagtaaagttacgataaaatttgtcaaattgactttttaactaaatttcattgcgtttaccccaatttcaaaatttaaatgcattaattttaaattttattttagcctccactcacccctcgttttgccttcgttcgccgtcgttcgttgttcgtctttgcctatttgcagatcgaatag

SEQ ID NO: 71119 - DNA, 952 bp, Heterodera glycines
  Genomic contig location: Contig_ID=SeqID_43464; Location=65..1016; Strand=-
  SCN-specific regions: Sequence locations=1-141,192-256,297-344,366 -417,443-522,555-652,674-861,915-952
atgaaaccaaaaaaatcatggacttatgcggctgtggcacatactggtgccggccaaataagggctatcgtggattcggctgttgcccgagtgactacgaattcgtctgttgccatgttggcaatgtaatgggaaaatgacaaaataaataaaattatattacaagaattttttaaattatttttttatttcatttagcaaacaattcaaatgtcaacagtgacgacagtgacgccggttggacatagcttttatcaaaaatatattaaatatgttaaatgaaaatctttaaattggttgagtttcaaaaaatttattaatggtcaaaaaattagtccttgagtattttgttaatttatatttttgtaggaattgaccaccacaacggtaacaacccttaaatttttcagaaaaattcttttttatatttcttagactttgccaacgacgccaaatcttggcaaaattgagaacgatcctccgcttttttgcgcgttgaaaaaaacctgcaatccgtcgtacttttttattattaattaaacaaaaattttaatcaaaacttttaaccagcaataatatgacgggctcggcgaaatttggccggcgtttcaacgcacataaaaaaaaatgtgccgcattgatcaaacggcagcagtcggcaccatcgacggagcttaaatcggaattgcgtcaggcgttcatggacgacatcatggaaggatcctttttgatggattacattcgtgatcattgatcagtgctagattccggcctcctcccttccaaaaagccacaaaatataattgctttaacctccccccccccccccccccaaaaaaaaagcccaccaaatttaattcctttttttaattaaactttatttattatttatcaattttctttttgtaaattatctgaatattttcctattacgcattattatgctaataaa

SEQ ID NO: 71120 - DNA, 1050 bp, Heterodera glycines
  Genomic contig location: Contig_ID=SeqID_43465; Location=139..1188; Strand=-
  SCN-specific regions: Sequence locations=1-163,186-299,321-422,444 -505,527-697,720-898,920-1050
  Gene Ontology: Mol. function=RNA helicase activity; Cellular component=bud neck; Biological process=mRNA splicing
atgtcaccaactcgcgaactcgctcttcaaacatggaaagaggctaataaatttgctcgtaacctcggccttcacgtggtttgtgtatacggtggagtcggtatttccgagcaaattgcagagctgaagaagggagccgaagtaattgtgtgtacacccggtagaatgattgacatgttagccgcaaacaatggtttctaaacgcaaatgaccattccttattttattattgttcaggaaaagtaacaaatcttcggcgagtcacttatttggtcatggacgaggccgaccgaatgttcgacatgggttttgagccacaagtgatgaaaattgtcaataacattcgtccggatcgacaaactgtgcttttttctgccacatttcccaaacaaatggaagcattggcgcgaaaagtgttggagaggccggtggaaattcaggtggatatatttttacaatctccattagcattaacggcataaataagtgactaattagttagtaatttatgatattttcagtgaattttggaaataaccattcaatacttcaaaatatttaaagaatcttattgtttagtcttttaacatgacattttaaggttggcggacgaagtgtcgtttgcaaggaagttgaacaacacgcttttgtgcttgaagagcaccaaaagtttcttaaactgttggaattgcttggccaatattgggagcatgggaatgtgttggttttcgtggaaaagcaagaaaaagccgatgatttggtgtcccaactgatgggcgccgggtacaactgcgccccattgcacggcggcattgaccaggacgaccgcgactttaccattttggacttcaaaacgggacgtttgaagctaatggtattattgcttcgtcaaaataagtttcaccatttttcaaaattaaggtggccacttctgtggctgcgcgtgggttggatgtcaagaaactgattctagtggttaattatgatgcgcccaaccattacgaagactatgtgcaccgcgttggtcgaactggaagagcgggcaataaa

SEQ ID NO: 71121 - DNA, 739 bp, Heterodera glycines
  Genomic contig location: Contig_ID=SeqID_43466; Location=283..1021; Strand=+
  SCN-specific regions: Sequence locations=1-65,112-193,215-349,384 -436,458-478,501-563,601-714,737-739
atgtgtgtaggttgttatcttgcgatttcaacaatggagaaagtatgtgtttgtatagcaggtacttttttaaattaaatatttatttattttaattatttttttttttttgctaaatgtttcttttttttaatttgcccttttgagtgaataaaaaacccttttttgtccatattttcgaagttgacttaaaaatgctttcaattttaaattcacagttattaaaaactttgtataaacagcaaaatttttatctttttcttactaaaatcttctcatactttctaaattttttgaaaatttggctaataaattaaaaggattaaattgaaaaaagaggtcgccaaagaaattaatattaatttttttaatataaattatttgagttaataaagccttttgtttgctcattcttaaaaatcttgcgaattattctattttgttttacttcttttttagtacgcgtatttcttcttcgctgtccctttttcgttcttttaatcggagtgctttttcaatgctttttggaaggaatcgcgttacaatgattgaggcaaacgaccaaaaataaaaataaataaaataattaattaattaattcaaattcaaatttcagtcatctcagttccatttgaacgcgcctgctcgactacattttgacttctcaattacggtgcatatttgctcgaaaatattaaatttcatagtttataatcctgctgatcctgtctgagctcga

SEQ ID NO: 71122 - DNA, 622 bp, Heterodera glycines
  Genomic contig location: Contig_ID=SeqID_43468; Location=1..622; Strand=-
  SCN-specific regions: Sequence locations=1-306,328-471,493-622
atctccctttttgatagaaaaagcatcagagtgctaaaattaagttgtaaataaaatttggtgcgctttagagcactttctgaaaaaaatatttatgaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaataaatcgattttttcaagtgtccgtttggggtactcaaacatttatggggagcaaaaatccaacgcagaaattaaagtacaggctatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacaggctatagggaagctattccggaaggattcggtctccccataaatctgggcgcatcggttcggttgaagagccccgaaaacaaaaataaatcgattttttcaagtgt

SEQ ID NO: 71123 - DNA, 851 bp, Heterodera glycines
  Genomic contig location: Contig_ID=SeqID_43470; Location=26..876; Strand=-
  SCN-specific regions: Sequence locations=1-65,90-226,248-286,424 -502,557-693,742-851
atgtgttgtgatcaccggaggagcatctgggcttgtaagaaaaagcaaaattcaaattgactgctattaaaattttgaattttcaaaaatttgcacgtttaaggggcttcggatgagcgaaatttttgccgatccgtccggtttgggggcaagagttgccataattgatcgaaatttggtgattaacggcattttttaaatgtacttttttatccatttatcatttaaggacgaagctgagaaggtagcagaaacaatttgtggaaagggcggaattgcaaaagcgtatataaaaatttatttaaatatatataatttaattctaaaaaaatcaggggtttactataaaatttagaattaaaaaaataatgataaattttttatttaatttatacatgaaataatgaattaaattttaaaaaacagttggtgctgtgacattgtgaatgccgaggaattacgacagtgtgccaataaaattcgacaacattttggtataatgaaaaattttaaaatttcatttttaaattaaaaaaaaataaattattttttttatcgttttaaggcaatgttgacattgttattgcgaatgctgccattttgttttttgagctgacccaaaatttgaaagacgatcagatcagaaaggcgttggatgtgaatgttcttggcacaattaatgtaaaaattctgattttaaatttagaaattttaattaggaataattaatttaaaatttttcagacaattcgctcctttttgcctgccatggaagctgcgggccatggtcataaggttgcaatttcttccattgccagctattttggcgaaacaatgggaatggcatattg

SEQ ID NO: 71124 - DNA, 443 bp, Heterodera glycines
  Genomic contig location: Contig_ID=SeqID_43472; Location=387..829; Strand=-
  SCN-specific regions: Sequence locations=1-24,52-54,163-226,256 -256,340-345,378-443
atgcaccaccatccaccgaatcatgaaaaagctatcaatctgtcaatccttacggtgtccgggccgggtgagtttccccgtgttgagtcaaattaagccgcaggctccactcctggtggtgcccttccgtcaattccttaagtttcagctttgcaccatacttcccccggaaccggaagactttcgtttccgggaagctccccaccagggcgaataaatccgccggcggatcgctagttggcatcgtttacggtcagaactagggcggtatctgatcgccttcgaacctctgactttcgttcttgattaatgaagacattcttgccaaatgctttcgctgtagtccgtcttgctacggtccaagaatttcacctctcacgtagcaatacgaatggccccgtttgtctctgttaaccattatctcggtcagcaaaaccaataaa

SEQ ID NO: 71125 - DNA, 450 bp, Heterodera glycines
  Genomic contig location: Contig_ID=SeqID_43472; Location=825..1274; Strand=+
  SCN-specific regions: Sequence locations=65-136,204-339,375-450
tgcatggccgttcttagttcgtggagcgatttgtctggtttattccgataacgagcgagactctagcctactaaatagttggctcattgcttctgtgggcacaacttcttagagggattttcggtgttcagccgcacgaaattgagcaataacaggtctgtgatgcccttagatgtccggggctgcacgcgcgctacactggcaaaatcagcgtgcttgtccttccccgaaaggggttggtaaaccggtgaaaatttgccgtgattgggatcggacattgcaattattgtccgtgaacgaggaattccttgtaggggcgagtcatcaactcgctctgaatacgtccctgccctttgtacacaccgcccgtcgctgcccgggactgagccatttcgagaaattcggggacggttagtgttccggcttcggtcggtatgcagactggaaccg

SEQ ID NO: 71126 - DNA, 831 bp, Heterodera glycines
  Genomic contig location: Contig_ID=SeqID_43475; Location=6..836; Strand=+
  SCN-specific regions: Sequence locations=1-831
atgagcgctaaaattatcagagtgccgaaaatcgcatgtgatctaagcctagcaaaaatggtgtaagtaaaaatcgtgaattacgctcaaaaagtttctcaaacaattttaacgcttccaattccttctacaatcgcctttatacatcccattatgaacgctaaaattatcagagtgccgaaaatcgcatgtgatctaagcctagaaaaaaatggtctaagtaaaaatcgtaattacgctcaaaaagcttctcaaacaattttaacgcttccaattcttccttctacaatcgcctttatacatcccattatgagcgctaaaattatcagagtgccgaaaatcgcatgtgatctaagcctagcaaaaaatggtttaagtaaaaatcgtaattacgctcaaaaagcttctcaaacaattttaacgcatccaattccttctacaatcgcctttatacatcccattatgagcgctaaaattatcagagtgccgaaaatcgcatgtgatctaagcctagcaaaaaatggtctaagtaaaaatcgtaattacgctcaaaaagcttctcaaacaattttagcgcatccaattccttctacaatcgcctttatacatcccattatgaacgctaaaattatcagagtgccgaaaatcgcatgtgatctaagcctagcaaaaaatggtgtaagtaaaaatcgtaattacgctcaaaaagcttctcaaacaattttaacgcttccaattccttctacaatcgcctttatacatcccattatgaacgctaaaattatcagagtgccgaaaatcgcatgtgatctaagcctagcaaaaaatggt

SEQ ID NO: 71127 - DNA, 599 bp, Heterodera glycines
  Genomic contig location: Contig_ID=SeqID_43477; Location=274..872; Strand=-
  SCN-specific regions: Sequence locations=1-43,65-207,230-252,274 -445,467-599
atgccaaaaaaggcatttaaggtggcaagacgtttcgtcactgaaataaatttttttttaaaatgccaaatttccagggctttccagggtcgctgattacgaatccggcatccatttcgacctatatcgaacccggactcgaaatcgaacaaaaagtcgaaaattcaaaaaatttcagaattcacttttatgttcgaatctgtgcagaatgattattttctaatgttgcaatggtttctatttaattttgctgttttaatctattttagaacataaaagtgaattctgaaatttttcgactttttgttcgattttgagtccgggttcgatataggtcgaaatggatgccggattcgtaatcagcgaccctggaaagctctggaaatttggcatttttaaaaaaatttatttcagtgacgaaacgtcaggtagccggcatttacggcacaaaaaccccgaaaaaggcaaaaaaaaaaggacataaaagtcaacgtaggagcttcaaatgaagtgtaaaatgcgtttttttatgcttatatatcgaaactattgcgcagaaaaaaggcatattatgcctcaaaagtctctctatcaataaa

SEQ ID NO: 71128 - DNA, 262 bp, Heterodera glycines
  Genomic contig location: Contig_ID=SeqID_43479; Location=589..850; Strand=-
  SCN-specific regions: Sequence locations=1-262
atgtttgtcatctttgaatttgcccgctgctttggatgacgtgacaaaacaggagcagtgtcccgagtctattcgcgaaaagtcggccaaggtgaaaaacaacggcggaatctctgcaatgtcagcgaagataaacgaacttccatcgctttataagagaaacgatgagattttgaatgaggtagaagccgtgctaaaacaaatgccatctccccattcattgtcagacttcacgacttatcaaagaggaaaaggaaaatga

SEQ ID NO: 71129 - DNA, 675 bp, Heterodera glycines
  Genomic contig location: Contig_ID=SeqID_9368; Location=676..1350; Strand=-
  SCN-specific regions: Sequence locations=1-46,87-387,409-521,543-675
atgaaaaaaagttatattcaaaaaattgacaaaagtatcaatgaccttaatatttaaatttaattattattttaatttttttttttctaaatcataaatcataattagcttagacttagtcaaattaatcaatcttggtattagaagaaagctctagctctacgaatcctctaatatataataatgtttttaaaatctagcaaaaatttacaaaaaaatgtaacaaaaaaattaggaaaaattatattctgaaaaaaagttaccaatgaattaaatttgtcatattttatggacatataataattaaatttaactattactgtcattgatacttttgtcacttcgtcctagcaccgtttgcttcattagtcactgtccgtttgcagttccaaaaatattttttcagtgctccgttcggccgatggcacaaatgccatgaagggtttgtgcaaattgttcgaccagcaaacaattgtcgaactgttccgacttcttcacattgacccgaaccttttgggctgtcctcttcctccccaaatgcgaattgtgctaatcgaagcgaaaagtgaagaaaaaaatggcagcagcagcagcaattcggagacggaaaaagaaaatggaaaagcaaaaaacggcacttttgatgaaatggcacaaaaaatggtggacaattag

SEQ ID NO: 71130 - DNA, 430 bp, Heterodera glycines
  Genomic contig location: Contig_ID=SeqID_9370; Location=267..696; Strand=-
  SCN-specific regions: Sequence locations=1-430
atgccaacgcccacacaccaacatgtggcactcggaggatggaagcgcgagcgtgttcggctccgttcccaacagaacctgaaccgtctgttcgtccgtccggcgctgtccaaagaacaactcaaagaggaatacgaagcgcgtctccgaaaacgtcaacaaaacccagctccaccggcacctccaacccagctcccaaaaacgacgaatgaccagactcccattgttgcaccaaaccagaaggaggccagcgaagacatgtccaaaccgccggaagtttttgaccaaacaatcatcgtttgttatgaagcattaaaatcattgccaccaaccgacaaaatttctcaccaaattcaatcactcaaagaacaataccctcatcttttcaataaatagttctttcagacctccaaacatttcctcaaataaa

SEQ ID NO: 71131 - DNA, 297 bp, Heterodera glycines
  Genomic contig location: Contig_ID=SeqID_9370; Location=400..696; Strand=-
  SCN-specific regions: Sequence locations=1-297
atgccaacgcccacacaccaacatgtggcactcggaggatggaagcgcgagcgtgttcggctccgttcccaacagaacctgaaccgtctgttcgtccgtccggcgctgtccaaagaacaactcaaagaggaatacgaagcgcgtctccgaaaacgtcaacaaaacccagctccaccggcacctccaacccagctcccaaaaacgacgaatgaccagactcccattgttgcaccaaaccagaaggaggccagcgaagacatgtccaaaccgccggaagtttttgaccaaacaatcatc

SEQ ID NO: 71132 - DNA, 710 bp, Heterodera glycines
  Genomic contig location: Contig_ID=SeqID_43483; Location=112..821; Strand=-
  SCN-specific regions: Sequence locations=1-54,76-111,153-186,208-710
atggaggagaacattgaaaaatttatcactaaaagattattggaagacattgagaaaatgaaggaaaatgcccgggaaatgatggaaaacagtgaaacattgaaggaaacctgtgaaaaactgaaggaaaatggtgaaagattagaggaaccaaaaaattggaggaacggtgaaagattggatgaaaatggtgaaagattggatgaaaagggtgaaagattggatgaaaagggtgaaagattggtggaaaatgccaaaaattggaggaagacggtgaaagattaatggaaaatgccaacaaaatagaggaaaacggtgaaagattgatagaaaacagtaagaaattgttggaaattgatgaaaaattggaagaaaacggtaaaaaattgaaggaaaacgatgaaaacaataatgaacgcaaaaaaaaatgggaagaactcaaaaagtggagggaaatcgctggctgtgagaaatagctgggctttttcctattgtacgacgctccaaaagatggtaaatgaaaattaattgggcaattaaaagtgctaattaactgattaattggtttgaagactccaatttgggctgcatttgttcggcaactcttcgctttgtctcacaaaagagcgatgtgcgcgatttccagcacaaattcgacgacgtaacgatgaaaccgggcaactaactgctggggaatccccgaatttgcg

SEQ ID NO: 71133 - DNA, 366 bp, Heterodera glycines
  Genomic contig location: Contig_ID=SeqID_43485; Location=81..446; Strand=-
  SCN-specific regions: Sequence locations=1-226,248-366
atggaacattaccaacaaaaacgtccttcgaattctccattcgttgatattcttcccaaaaaaccccgccaagacttagtcatcaatcaaattttgggtgttgtccaacaaggaggaggagatacatcaccttcaaaagaagctccaaaggattatgtgcagaaattgggtagctctgttgaacatgtcgcccaattccactacaccaaaatgaaatctcgcttcagtatttcggatgttcctttttaccccgaaaggcttttggctggaattattccccattgtattgatagtgctacaaaggccagccggggacgggggaatcgagccactcccccttggatgtttgataaccagtcttctttg

SEQ ID NO: 71134 - DNA, 343 bp, Heterodera glycines
  Genomic contig location: Contig_ID=SeqID_43486; Location=542..884; Strand=+
  SCN-specific regions: Sequence locations=1-343
atggaacggccgctaccactgcctcagttgattgaccacggcggtgccctttttcacacttcggccattgataaaagcattatcggagaaaagaaaacgcagcggatttacccgattttagacgaccttttttacacaaacacaaatgagatggacaacgagaagtcgaattcggcactcgcacagacaatgagttgctcttcgaccactgccagtgactcccattcttcagaaaacagcacttcttttatcgcttcttcaattggccttgagattgcgccttctccttccaatcccttctcgtcgtattgcgagcctttcgatggctatttaaaatttgatg

SEQ ID NO: 71135 - DNA, 1606 bp, Heterodera glycines
  misc_feature (11)..(11): n is a, c, g, or t
  Genomic contig location: Contig_ID=SeqID_43489; Location=77..1682; Strand=+
  SCN-specific regions: Sequence locations=1-81,110-133,157-640,686 -686,883-883,915-917,941-1006,1029-1088,1110-1171,1194-1552,1576-1606
atgctttcaanacgcaacggaagctctgttcaatgcggaccgtcgaccaaaaaatgggatttccgttcaatcgggtaagcgttaataaaatatttaaagaaaatattaagagacaacgtaatcgttttctaccaattaaaaaataaataaattttaggaacaattttactgaagaaatggaaaattataaattgctggattatcaaacgactacttgccaaaaatttggatttacgaagaacattacggaatttcgtgtcaacccggacgggggacgccctgatgaagcaatgagggaagcgatcgacgacatgataaaggtggcttttaagactacggaagaaaaaatgaagcgaaaagtgcggatgtttggagtggcaattacgggtgccgggcttgctttcccggtatgggtaccgtacagggcgtacccgcagaacaatgcggatgttatcatgcaggagattaataagctggggcagagcggggacggggatgaaaataagaaaatgcttttattatcggaaccagttactatgaaaattacttgcgtgaccatgcccagtggagaggggccgaggaatgtccacaaatttgactttggattgaaggaacaccagcggatagggtaagtgtttttaataaaataaaattaaaatagaaaaaaactaaaataaaaaaaaatcaataaataaatttaaaataattatttctaaaaaatttaatgaagcaaaaaaaaatttttttttaaagaaaaaaatgaaaaaataataatttaatgaaacaaaaaaaaacacagaataaaattaaaaataaagaaagtaaaaaataaatttaaaataattattttaaaaaattttaatgaaacaaaaaaaaaaaaaacttaaaatatttatttttaaataatttaattaggcaaaaaaaaaaaaaaaaaaaaaaagtaaattttaggattgtgaatactgataaattttgccttttttacgcactggcgtcgtcgatgaattatttaattatggataaatattcgtttattcgttttatgaagaacttagcaagacaaaaggaagcggctgttgaacttttacggaattgtggaattgatattaacgaatatagctatggtgtggagcaattgccgaatgttcagaaatattgggtgggttaaatgaaaaaatgcaaaattaataaatttttcaggatgagatttaccccggaaagtaccgggttgttgcgtttgagaagtctgcagatccgcggaaatcgatccgtgttttgtggaagggccctatgggacgtgaaaatgtagtgccgatatttttggagaacggacattgggatggtctgaagaattatgtctgctttttcaaccgggggaggaagttctgcgttgaatgtgaatgcttttacgatcaggatgtttatcatacgatggattgccgggcgagatgttattactgcaatagagttggaggaatgccgtgtcaaaaggagagtggagtgaagattgaatgcccgaagtgccaccgttacttttataattgggagtgttacaactatcatcagggacatcagacttgcaaattatggaggcgttgcgtgatct

SEQ ID NO: 71136 - DNA, 72 bp, Heterodera glycines
  Genomic contig location: Contig_ID=SeqID_43490; Location=1..72; Strand=-
  SCN-specific regions: Sequence locations=1-23,46-72
aatcgaacgctaacggacgacctaatgggaaaaaatccccgaaggagagaatttaattaaatccattccttc

SEQ ID NO: 71137 - DNA, 735 bp, Heterodera glycines
  Genomic contig location: Contig_ID=SeqID_9371; Location=219..953; Strand=-
  SCN-specific regions: Sequence locations=1-99,122-193,215-359,383 -607,629-735
atgcggcagagcagtgccacgccttacataaatgtgcaactgctgcagacactgaacatcctttttgagaacatcagaaacgaaacatcactttgtaagttatttatttattttaaaaattcctttcctaaaaaaacaattttagattttcttctgagcaataacacagtgaatgtaaggcatttgttaatgttttgtcaaaattcataatgaaatgttatcttatttcagctgataatcacacatacttttgattttgcaaacgaagaaataattgcttatttcatttcctttctgaaaacgctgtcttttaagctgaatcccaaaacggtgaactttttcttcaatgaggtgagttgtttattttattattttttaaattcattccattatttgcaaattgggtaattgtgaagctggtgcccccccccttttggaataaaaaatttttcttctaataagccatgaaaacacgttttatggggttttgagggtcgctgatcacgaatatgacattcttttcgaccaattccaaatcccgggcccgagttcgaacaaaaagtcgaaaattcaaaaattacgatttccatttttagtctaagaatggtttaaatgaccttttactgaagcactgatgatattcagaccattttcgtgtatttaaaccagggctcggatctgttcttatttataagaaatgttctgatttggagggtccaaatcttacaaaataaa

SEQ ID NO: 71138 - DNA, 150 bp, Heterodera glycines
  Genomic contig location: Contig_ID=SeqID_9371; Location=4986..5135; Strand=-
  SCN-specific regions: Sequence locations=1-150
caagaatcgcccaaaaatgatcaaaacgaagcgatgtcgaataagttagaggacatcaattctctgatgacgagactaacccttcacaaccgttctttagccaaattattcgcattgaaccaaactggttctcttttttagcatttcact

SEQ ID NO: 71139 - DNA, 358 bp, Heterodera glycines
  Genomic contig location: Contig_ID=SeqID_43493; Location=489..846; Strand=-
  SCN-specific regions: Sequence locations=1-358
atgggtgccgttgtctgtctcgcctcctttttggcgctgttctccgttttcccacagaatctcttcgggtattcttgcaaatcgttgtcgggaaaggaggtcgattggtcagttcgactgattggttagatttcttttgcttcccttgccattttacaggtttgtcgcttacaaattgcccgatttggggtccgatggcgacggcaccgcctttctttattcggacgcgaacaccgccgcttggcgcctttccgacaaaaatgtggaggacaaaagttcagcaattggactgaccgtctcgcaactgttcacagcaaagaaaaaaaaggcaagcagaactgtctcaactgccttctga

SEQ ID NO: 71140 - DNA, 410 bp, Heterodera glycines
  Genomic contig location: Contig_ID=SeqID_43501; Location=353..762; Strand=+
  SCN-specific regions: Sequence locations=1-164,234-242,265-289,311-410
atgccaaattaccattcgaatattttgacagttcgtcggtcacgcaacgaagcgttgccgcctttgccttcttatgaagacgcgaccaaacttcccgcgctgatcccagcggcacaagaaaatacggacgaacagagacacgggattgaggagagagcaggaagagagacagaggaacagagacaaaggaacggagagagagcaggaagagagacaggggaacagagacagaggaacgaagagagagcaggaagagaggcagaggaacagacagggggagaagacgaagcagtaacagaagcagcagcaggacaggcggaggaaggagccatcggccgaccaatcccccgttaattttgatccccctccccatttgacacttatactttactttaaaagggtcagccgaa

SEQ ID NO: 71141 - DNA, 578 bp, Heterodera glycines
  Genomic contig location: Contig_ID=SeqID_9372; Location=776..1353; Strand=+
  SCN-specific regions: Sequence locations=1-16,38-53,77-206,436 -475,497-523,545-578
atgagtctgattgtattgcaacagcagcagcgcaaaaaatcgctgtgcgtcgtcccccggggcgcgggcggcggcgattatacgacaagcagtgagacagagagagagaaaaatgatcagagagcaaaatggaaaaatgaaaattaacaaaactttaaatatgtacatagtttattaatgagaatccaagttggcataaactattcaaaaatagttaattagaaaatcaaaaaaatttattttaatttttttaattaaaatcgttaaagtaaatctaaaaatatttaatttctcattttttaatttaaatgattaaaataaataaacttaatttttcgattttttctgaatcattttttctaaacacaaatttcaattaaaattaacatttttttaaaccaattttatcaatatatattttttttcaaaattttagtcgccaaagcggctgtcctttcatcgccaatgtttcaacaaacaaaacagcagcaacaagccggcgcttctggcgcaaatgccacggcacaacagcaacaacaacagctgagaccaagtacaaaaagctaatttaaacatga

SEQ ID NO: 71142 - DNA, 371 bp, Heterodera glycines
  Genomic contig location: Contig_ID=SeqID_9373; Location=998..1368; Strand=-
  SCN-specific regions: Sequence locations=1-181,203-371
atgtacaaacagttggtaaatgtggagcaacaaggagatccaatggaaaaggagcagaaaaaagtcgaattggcaccaacggtcgcggaaataggcattttgatgcttaaaaaacaaaacaggaaaattaaaatggtaaaaaaaatggtgcaaaatggtaatgccaaaaatcgaagggcacttaaattttttaaaaatatatccaattacgaattgttttcaaaaaatagtaaatttttatagagggatacatttaattatgctgattaattttagtattaacaaaggtaaaagcaaaagaaaatgatcaaattaaaaaatggaaattatattaaaaaactaattaaaaagacagtgtttttaaaaataaa

SEQ ID NO: 71143 - DNA, 3994 bp, Heterodera glycines
  Genomic contig location: Contig_ID=SeqID_9373; Location=156..4149; Strand=+
  SCN-specific regions: Sequence locations=1-411,433-497,520-568,596 -826,857-1011,1033-1307,1337-1337,1359-1442,1474-1501,1527-1560,1582 -1740,1762-1769,1810-1953,1975-2010,2033-2041,2099-2254,2336 -2390,2413-2468,2490-2669,...
  SCN-specific regions: Sequence locations=...2691-2826,2848-3235,3257 -3427,3449-3771,3793-3823,3892-3952
  Gene Ontology: Mol. function=voltage-gated sodium channel activity; Cellular component=integral to plasma membrane; Biological process =adult locomotory behavior
gtctcaattgggagactattagccaatttctctatttttaatgtcagcagattgccgaccttttggccaccacgtcacttggaagcaccaagaaattgccgaaagcaagtgagttttttggcacagagaaagtgaatttggtacaaaaaaagaataaggcacaaaattgaatttgaaaaaacaagtcataaaataatgactatggcataaaacagggatttggcatggcacaaagcaacgaattttgcacataatcgctgttgaagtgtgtgacttagagcagaaaattcaacccaaagtttcggtgttttgcacagaataaaggaggaaggttccaatctctgagaattttgcttattttatagtttttgaaagggtcgaagagggaattttttaaattaagatagtctgtttttgtattttttgaaaaaatcagggtattttgacagaaatcctctaaaattgtaaaatttttacacataactcaataggatgtgtattaattaaagaaaattaattgctgatttaatgaccgattttcaatgtttgtgatcggaattctttcgcctaattatgtatataataatatttttgttcacttagccattctcgatcggcccttggctgatcgagtgctgaaaatggtgtgcttattgtcgctgatcagcgtttgcatgcacaccccgcgcaccctgcagctgatcccgcacttcacctgggtactgcttgtgcttgacgccaatgtggtggccattttcacgtgggaagtggtgctaaaggccaacaacatgggctacttcaggatgattaactatgccgtttagtctaattttttattttattttatttttaaaaacactgtctttttaattagttttttaatataatttccattttttaatttgatcattttcttttgcttttacctttgttaatactaaaattaatcagcataattaaatgtatccctctataaaaatttactattttttgaaaacaattcgtaattggatatatttttaaaaaatttaagtgcccttcgatttttggcattaccattttgcaccattttttttaccattttaattttcctgttttgttttttaagcatcaaaatgcctatttccgcgaccgttggtgccaattcgacttttttctgctccttttccattggatctccttgttgctccacatttaccaactgtttgtacattccgagctgttcgcccaatttgggctcgtctattacgattggttgggcgtgattcgatgtgttcgtccattggtgcgttatgaaatgcctaatgaaaacccaaaagtgggaaaaatgccattattaaaatttagaaaataattaatgtgtcgaaaaataagggtcaaatcagtctatttttaaaaaatgtactttcacaaaaaaaattatcaatgtcaaaaaaatgttcatatttattttttattatttttgaaatttttgagttaaaacttgttgacaaatttcattaaaattttcaaaatttttcccccggcgcctattggcaccgccgggttccatcgcttgaatttttcattttaccaaataaatctacattatttttttgtcaaattcattattaataataatcagcctaatgacttggctgatcaacaagatctttccactctttcttccaggtgattatccgactgatcagactgatgctgacattccaagtgccgcggcagcgaatacaacagctgttgaagtaataaattttgccaaaaacggacacatttaattaaaaataattttttgaaattattttttatttacatttggttttaattaaacagacgatcgagcactcaagtgcaaaatgtgaccgtgttctttttgttttttatggcattgtacgccatcatgggcattcagctgttcggccgaatggattaccattgtgtgatgcccggtgagtttaacaaatgtgcagaaattttatattcaaatgccagaatgattcatttaatgagatttaaaaactgagaaattaaaaaataattgtggatttattttctttttatataatttttattttaaaatgttattttaaacaaaaaaatagtttgtctttaaattcagggaccgacccgaagaatgtgaccattaacgatttggccattccggacacaatgtgttcaaaagaaggccaaggcggttacgagtgtcctgacaacatggaatgcatgaaggtgggaaagtttgtagttaaatcttaacatttatatttacaattttttttaaatgaaaaaactaattatttaaataaatattttatataaatttacaattataaaattagattattctaaccttttgtctcatataaaatatttgttcagctagttctgagtgccaaaagtgaaggcttttacggcatgtttgaccatttcggtaagttttagaatgaaaatattttctaaaaataattttccattaaattcgttttatttctgtaaggcgccagtgtgtttactgtgtatttggctgcctcagaagagggttgggtgtatgtgatgtacgactgtttggactcgctcccgtcacatttggcatttttttattttgtcactctgatttttttcttggcttggcttgtcaaggtgtgataaaaatttaaattttacgaatttcatacacatttagaatgtgtttattgctgtgattacggaaacatttgctgaaatacgggtacagttcagtgaaagttggaaaaaggaggaaatgacgacaattgaggacgattttagtcaagtgattgattaattgatatttattaagccaggagataattaattaatttctaagaaaattgagtcaactgatgacgggtggaggctgatcagactggacacggaggacaagctgaatccacgcataaagcaattccaaacggtaaaaaatggtttagttttaaaatattctgttaggtctaattaagggattatttaatgtgctgaaaaattaaattatgaattgaatagctatcatcaatttttcagattcttcgttcaactggtttccaatgtgccatcatttcgttggtgttggctaatgctgcgataaatgcttcgtttgtttatcggcacgacgaaacggatgcgaaacggcgcaatttgtattatttgattgaagtgagaaatggctggttgagaatttacttaaacaacttcctttgttcttttaagtgtgactttttcattgtttttgggaaagaaaagcttaccaataagccacgttcggaagaatttcgagcaaaatttatgatgcttaaatccgaaacttgcatttgctttgctaaattttatatgttttaccaaaactgataagttcaaaaaatttatttattaaggtgtggaatttagaaaactaaaaagcacataaatttgttagtaaggccatttatgtttttatttgtgggcagttgaatcccttttcgtctctccgcttttcatttttttttcgtctgtatgaattcagcttgaatatggatggcttgcccttacactgattatcggggagatatattttggattttggcgtttatgaatcattgtttcccaattacgcatttttattcgattttattttttatttttagtgtgttttcactgttttattcgatgtcgaatgtttggtcaaattgttttgttacgggcgccaattttttaagcgaaatatcttcaagttcgaattaattttggccattggtggcacttttaacattcaacggcatttgtacaaccaaaattacttcacttattttcaaggcaagtcaatggaaagctgtaaaattattattattcataaaaatatgttttttattttaaaagaatttaattaattttatatttttagtttttcgtctcttccgtctaatcaaagcatcgccaatgctcgaagattttgtgtacaaagtaaaatataaatgaataaaattaaatataatatattttattt

SEQ ID NO: 71144 - DNA, 770 bp, Heterodera glycines
  misc_feature (16)..(16): n is a, c, g, or t
  misc_feature (90)..(91): n is a, c, g, or t
  Genomic contig location: Contig_ID=SeqID_43502; Location=566..1335; Strand=-
  SCN-specific regions: Sequence locations=1-201,247-299,323-371,393 -416,442-548,570-572,594-770
atgtattttatttttntaatgtttttcacactttcccgacttttctggcccggtaagtcccggtctgggtttttgtcaaaattcccggcnncgctcagttctagtaaaaatacatcaatatattcgaaaaattttatgatcttcaaaaattaatagtttatatggagaataatttcacaataatataatatatcttgttggaataaaaaatctttaaatatttaaagtgttttattaaataattttcttttcagtcaatttttggccccatttgaaagcaggtgtatcccctaacaaattaaaatgtttcatttattttattaattgttatgccaagattaaattgaattttttcaaactgctcttcttgactgattattatgcattgatattaagtaatcgaatcgatttttccctttttatttaattattttttaaattgtgttagagaaggaagtaattattgattaggtgtatgaccccacgccacttcgccatcttcaccctcccattcccctcattcagttgttattgtgcccaccaattttgacctcccaatttattttctctgcatttatttattattttattttcttcggcaaataaacttatttaatttgttatcttcggacataacaacaataatatttatttttttgttttcagctaaaaagtattgcatcgatggattggttaatgaatgtttgcaaattccaattcctcagctgtccaatgctttcttggcctctacccagtgcccgactgtttga

SEQ ID NO: 71145 - DNA, 776 bp, Heterodera glycines
  Genomic contig location: Contig_ID=SeqID_43504; Location=56..831; Strand=+
  SCN-specific regions: Sequence locations=1-136,158-413,435-668,690-776
atgccttgtggtgaaaacaatatttcacatttcactccataccatggtgagttcggcacggatcgagaccgggataagaccattggaaagagcagctcgagctctacaagaacgtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaaataataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataacattgtgagttcggcacggatcgagaccgggataagaccattggaaagagcagctcgagctctacaagaacgtatggaaagaaaaaatagttatttctgggactttttcagaaatcagaattaattctccaatgtggcccaaattttaggcccccagccacagccccttgcttctcccagttttaagtcttggatttgtcaa

SEQ ID NO: 71146 - DNA, 779 bp, Heterodera glycines
  Genomic contig location: Contig_ID=SeqID_43507; Location=41..819; Strand=+
  SCN-specific regions: Sequence locations=1-90,235-248,279-375,435 -468,490-493,515-570,594-779
atggatgcggaaaaacagcagataaatgcgggtgaaacggactttggaaaaatggcatacagtgaaggaaaccggcgcacgaaggtagggaatttaaagaaaatattaattaaataataatttaattcagtttttaaaagagatatttccgttttcatttaattaataaatttgtttttgaattttgcgtagaaataatgaaaaaaaatatttataaatttatttaaaaataatgtaaactctgccacttttttttaactttttaattaatttttattgtaagacaaaaaatattaacaaaacatgcaaaaaaataaaagaaaaaaaaccaacagaaaagttgcaagtaagaaaatcgtatgcttttgtcaaaagaaaaaaaaattcattttttgaaataaataaattatttaaaaatacaaaaaaatatatatggaagatacttaagaaaagttattagagctatagaaactttaaagaaagaacaaagataaagagaaaaaatatatagaaggttattctccgtttttccatgtttgatatttccataaaatataccgtattccttgaaatacatccctccccctgaaataaagccacccttttgagggagttgaaaaataaagagccaggagacttaatttcaatgaacacggtacttccaactacaggagaagcatgctttcattgagctcagctcacttgtaccattgccaccgccaatacgtgatcagctcgacaaaacggccacccttcgctcgacaatagcatttttgtaa

SEQ ID NO: 71147 - DNA, 990 bp, Heterodera glycines
  Genomic contig location: Contig_ID=SeqID_9374; Location=154..1143; Strand=-
  SCN-specific regions: Sequence locations=1-14,36-57,85-657,679-990
  Gene Ontology: Mol. function=chaperone activity; Cellular component =nucleolus; Biological process=nucleocytoplasmic transport
atgaaactattctcaatgtttcttctcctgactttggcattcgccgcttttgctgagagaagcagcagtagcagtagcagcagcgaatcgtccgaatcatcggaggaatgttcttcagaagaaggcaatcccggcacagaaccggagacgacaacagttgttgattcggacgaaaattgcaacgcgacatcagatagtccaaatgacgagtcatcgcctgtgccatcgtcggacagtccaaatgatgagtcatcgtctgtgccatcgtcggacagtccaaatgatgagtcatctcctgtgccatcgtcggacagtccaaatgatgagtcatcgcctgtgccatcgtcggacagtccaaatgatgagtcatcgtctgtgccatcgtcagacagtccaaatgacgagtcatcgtctgtgccatcgtcggacagtccaaatgatgagtcatcgcctgtgccatcgtcagacagtccaaatgacgagtcatcgtctgtgccatcgtcggacagtccaaatgatgagtcatcgcctgtgccatcgaccgccgacccttcctccccccaatacactctgccggtgactgaagaagacaaaaacgcagctgtccaatgccacaacaaattccgttccgaattggccctcggcaattctttcaacaaaacggggggcaacaaaatgccatcggcgagcaacatgcacaagatggagtgggacgacaatttggccaaatttgccgcggaatgggccaacaaatgctcaatttcgcactcgtggaacggctgggcgggcgagaatttggccatgaatggcggaacattcacgaacagttcgcaattgactaattaataccactaaatgcctgattgactttaagaggatgcttttgagtacgcttgcggtcgctggtggggcgaattggcggcgctcggcttccccaaggatttgattctgaccggggaaaacttcggaggcatcggccattggactcaa

SEQ ID NO: 71148 - DNA, 580 bp, Heterodera glycines
  Genomic contig location: Contig_ID=SeqID_9375; Location=3..582; Strand=+
  SCN-specific regions: Sequence locations=1-383,411-428,450-468,490 -492,514-580
atggcacaggcgatgactcatcatttggactgtcggaggatggcacagacgatgactcgtcatttggactgtttgacgatggcacagacgatgaatcatcatttggactgtccgacgatggcacaggcgatgactcatcatttggactgtccgacgatggcacaggagatgactcgtcatttggactgtccgacgatggcacagatggcacaggagatgactcgtcatttggactgtccgacgatggcacaggagatgactcatcatttggactatctgatgtcgcgttgcaattttcgtccgaatcaacaacagttgtcgtctccggttctgtaccgggattgccttcttctgaagaacattcctccgatgattcggacgattcgctgctgctactgctgctgctctcagcaaaagcggcgaatgccaaagtcaggagaagaaacattgagaatagtttcatttttgataattataaattaaaattaagcttttaattttatgatttttctgtgttatgcgttcgctttataaaggctttttcctccgctttttgtcaaaattttcaaaagctgagcaa

SEQ ID NO: 71149 - DNA, 456 bp, Heterodera glycines
  Genomic contig location: Contig_ID=SeqID_9375; Location=10..465; Strand=-
  SCN-specific regions: Sequence locations=1-14,36-53,81-456
  Gene Ontology: Mol. function=chaperone activity; Cellular component =nucleolus; Biological process=nucleocytoplasmic transport
atgaaactattctcaatgtttcttctcctgactttggcattcgccgcttttgctgagagcagcagcagtagcagcagcgaatcgtccgaatcatcggaggaatgttcttcagaagaaggcaatcccggtacagaaccggagacgacaactgttgttgattcggacgaaaattgcaacgcgacatcagatagtccaaatgatgagtcatctcctgtgccatcgtcggacagtccaaatgacgagtcatctcctgtgccatctgtgccatcgtcggacagtccaaatgacgagtcatctcctgtgccatcgtcggacagtccaaatgatgagtcatcgcctgtgccatcgtcggacagtccaaatgatgattcatcgtctgtgccatcgtcaaacagtccaaatgacgagtcatcgtctgtgccatcctccgacagtccaaatgatgagtcatcgcct

SEQ ID NO: 71150 - DNA, 373 bp, Heterodera glycines
  Genomic contig location: Contig_ID=SeqID_43514; Location=2..374; Strand=-
  SCN-specific regions: Sequence locations=1-373
tatacatcccattatgaacgctaaaattatcagagtgccgaaaatcgcatgtgatctacgcctagaaaaaaatggtgtaagtaaaaatcgtaactacgctcaaaaagcttctcaaccaattttagcgcatccaattccttctacaatcgcctttatacatcccattatgagcgctaaaattatcagagtgccgaaaatcgcatgtgatctaagcctagaaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaa

SEQ ID NO: 71151 - DNA, 439 bp, Heterodera glycines
  Genomic contig location: Contig_ID=SeqID_43514; Location=479..917; Strand=-
  SCN-specific regions: Sequence locations=1-32,54-439
aaaatggtctaagtaaaaatcgtaattacgctcaaaaagcttctcaatcaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaattttaacgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagctcctcaaacaattttagcgcttccaattccttctacaatcgcctttatacatcccattatgaacgctaaaattatcagagtgccgaaaatcgc

SEQ ID NO: 71152 - DNA, 659 bp, Heterodera glycines
  Genomic contig location: Contig_ID=SeqID_43515; Location=169..827; Strand=-
  SCN-specific regions: Sequence locations=1-659
gttttcggggcagtccccccgaaccgatgcgcccagatttatggggagaccgaatctttccggaatagcttccctatagcctgtactttaattgtgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttttt

SEQ ID NO: 71153 - DNA, 166 bp, Heterodera glycines
  Genomic contig location: Contig_ID=SeqID_43516; Location=618..783; Strand=+
  SCN-specific regions: Sequence locations=1-63,129-166
atgacattgatgccaacggcagaaacaacgacagcgaatttgggcactccaacggaacaaaatcagccgcaggagcagcagcaaaaggcagggacagcagcggggacaacgacgacagctgcagcaactgacgctgcttctgctgcggttgtaatggaagaacaga

SEQ ID NO: 71154 - DNA, 308 bp, Heterodera glycines
  Genomic contig location: Contig_ID=SeqID_43516; Location=18..325; Strand=+
  SCN-specific regions: Sequence locations=1-97,119-308
cagtgcagcaacaaaaccctcagcagaaagacacaccggcggcactttctgttaggtctcaactgccaattaagccaggcccaaagccgaaaaaaccacaaatggaaaagaaacagcgaaaggaaaagccgccaccacccccccccaaacagaaggacttgaaaattacgtgcagtccctgcggagagattggccacatgaaaacgaaccgtcactgtcccctctacggaaaagaggaggatttggcatccaaaacagtcggcgagatttgccaggcaataatattgctggttgacatcaatgtgtaa

SEQ ID NO: 71155 - DNA, 595 bp, Heterodera glycines
  misc_feature (571)..(571): n is a, c, g, or t
  Genomic contig location: Contig_ID=SeqID_43517; Location=231..825; Strand=+
  SCN-specific regions: Sequence locations=1-49,71-240,262-595
atgaatttttttttttgcatatacaatcttgttaattactggtattttaaactgtattatattccttgtgctaatggccaaacgaacgcacaaccaaaaaaaccattcgcagttgtctctgtgtgtcggcaccgctcgcacaaatggccgccaccgccgcagcaaaaaaccgccaacaaagggcggccacgaaaggacgccgccaccgacgccccaaacattggccgaccaaacggacgacagcaaagcgacaaaacagacgaaaaagcgatggacaatgaacgaatgccgaaggctgaaggtttgttgtgggagaagtgaaacgcccgcaaaagaggagggagctgccaaaaagcttttaaaatacaaaaaaatgggttttactattgcctacttaacaatcaatttgattgtgttttttcagcttgctctcaaaatctgcaacccatcgaccgactcggaatgggaggccatcagcaggtcagcagaaccaaatttcataaaatagggatcgcatttgtaatatcaatggaatttctaagaattggtaatttaaaaatgaatgccgtanatgtttatggagaatcaaaagaat

SEQ ID NO: 71156 - DNA, 323 bp, Heterodera glycines
  Genomic contig location: Contig_ID=SeqID_43518; Location=115..437; Strand=+
  SCN-specific regions: Sequence locations=1-323
atgtctgacaaatcgttgtatctcaacgcgcaattcaacgtggactcgaacgtggcgttgcctgtggctgacaatacgaacccggctgggcctgccaatccgaatccggctgggcctgccaatccgaatccggctgggcctgccaatccgaatccggctgggcctgccaatccgaatccggctgggcctgccaatccgaatccggctgggcctgccaatccgaatccggctggggctctcaatctgaacggtgccgcgttcgatgatacgctgagcctttatggggaagaacgccttgatcgccattaggcgagtccccgtga

SEQ ID NO: 71157 - DNA, 93 bp, Heterodera glycines
  Genomic contig location: Contig_ID=SeqID_43518; Location=776..868; Strand=+
  SCN-specific regions: Sequence locations=1-93
atggacgtatgggcggacattgcgaaagcggattttatggatgaacgattttcgagggttattacggctaataaggcgtacaacctcttccag

SEQ ID NO: 71158 - DNA, 93 bp, Heterodera glycines
  Genomic contig location: Contig_ID=SeqID_43519; Location=275..367; Strand=+
  SCN-specific regions: Sequence locations=1-54,79-93
atggcgagcgacggacagaacgacaacggatgcaaaatgatccaagctgatcagcaaaacaacaacaaaataacagtaacacaaaatgtgatg

SEQ ID NO: 71159 - DNA, 468 bp, Heterodera glycines
  Genomic contig location: Contig_ID=SeqID_1271; Location=453..920; Strand=-
  SCN-specific regions: Sequence locations=1-81,108-130,152-468
atgtcaaagaaaaatttccaagaaacttcaaaagaaattcgccgctcgaaaaatacaaaaaattatttcaagaacagttctaatttgggaaaatgttttgaagaagtggaaagtcacacaaacgaaaataaaaaatttgggataaaagaacatgtgactactttctattttaagtgcccagaaaacgaagaccccgaacaaatgtttaaaaaaatcctgaaaaaattaatgacggatgcgatgaaccgtgaagctgagccgggctggaaaattgagaaaatttcagtcgatctgtattgcagtgccctgtcggacccagtgatcatccctgcccgccccttccaacattcgaacccagacattgttttcaatgagttcatgcacagacagcaatcatttggggaagtgaatttgttagaccagagaatttcgataattattgccacttattcctttcctgttaaataa

SEQ ID NO: 71160 - DNA, 6635 bp, Heterodera glycines
  misc_feature (6565)..(6565): n is a, c, g, or t
  misc_feature (6584)..(6584): n is a, c, g, or t
  Genomic contig location: Contig_ID=SeqID_1272; Location=1..6635; Strand=-
  SCN-specific regions: Sequence locations=1-70,92-784,806-1151,1173 -2631,2653-2947,2969-3026,3048-3171,3193-3220,3274-4096,4119 -5024,5046-5083,5105-5250,5286-5448,5472-5509,5531-5693,5715 -6146,6168-6527,6549-6635
ccccaaattcccccccccccgccaaattccaccccaaatttggccccatcccctccgccttttcctaccctttctttctgcttttcaaattccggcccaaatttggtcccaagatccccccaccctccctttcatctgacccccctaccgcgattccctccccgcatatttcgatcagataagattattcacattttcgtttgttgcgaaatttttgtgcggggcgcaccaaaaatggtgccatccacgcatcaaggtcaaaatagtttttatgttcgcgacctgtcaatcaaattctttgggcgagaaaacttaaaacgctgcggagatgcaaaaataattgcggccactttaccgcagtttttatgttcgtgacctgtcaatcaaattctttgggctagaaaatttaaagcgcggcggagatgcaaaaataattgcgtcacacaaaccgcagtttttatacacgggaactgtcaatcatataaatgaagggaaggccgaagcgacttcatttcaattccatttcgcttaaggcggggggtcgggggccattcttgcccctcggggcgcttgcccccaaatattcaaattttccatcgatcatctggatctgtcaccgcagcacggcagaacggcatggtagtgggaggagtcagcagcggcaccatccccaagttctcttctcatcatttgccactttcgcccacttttttaatttgtcagcagcggagacgcatcccaaattcacttttcaccagttgccattttcatccactttcatcatgccttttattgcccccggcactttcgcgttcctttcaaaagactatggggaattttcgactgggcattttgacccaaacagagcatacgacccaaattcactcggacaactttcgtaatggcattcattttttccaatcttgatttttttctttgtaggaaatggagaaaagattttctggatgccgatacggatccaagcaaccaagtcctccttccacaccccgttcaccatcgcgcagcttcccaatcccggtcatcgttggtagtttaaatttcagtttttttttggattttgcaaatattccgtttgcaggaaatcgtccacaggatgaaaattgtttggttttccacaaatatcttgtctgattttttccattttagggcggcagatgttccccgatgacgatgggtacgaatcggaagatgatgaaattctcttgccacctccgccgatccccccgcaacttggccaccctccgccaaatgtgccggtaatttcggtctcgcttttcgttgctttttctaaatttccgagtgcttttttcaggctgttcgtgttcagccaatgcatgttgggcagcagcggctgccgctgagagacttgccacaattcgaggaccatccgcaaaatgtgccggtaattttgagtcgattttcgctgcgttttctcaaatttctgcgtgctttttttcaggctgttcgggtccaaccgatgcaacaaccattgccgctgagagacctgccacaaattttccaccctccaccaaatgtgccggtaattttgggtctttctttcgattgctttttctcaatttccgagtgtatttttcaggcaattcgtgttcaaccaatgcagcaacccgtaccaatgggagccgtgccacaattccctaaccctccaccaaatgtgccggtaattttgggtctttctttcgattgctttttctcaatttccgagtgtatttttcaggcaattcgtgttcaaccaatgcagcaacccgtaccaatgggagccgtgccacaattccctaaccctccgccaaatgcgccggtaatcttgagtctcgttttcggttgctttttcaaaatcccgagtgcattgtttttcaggaaattggtgtgggaccaattcatgatgggcaacaaccgatgccgctgagagttttgccgcaaattgcgcatcggccactaaatttaccggtaatttgggctcgcttttcgttgctttttctcaaatttccgagtgcttttttcaggccgttcgtgtccaaccagtgcaacaaccgataccactgagagacgtgccgctatttgtcaacccaccaccaaatgtgccggtaattttggctcgcttttgttactttttttcaagatcctgaatgcattttttaggtaattcgtgtccaaccgatgcctcaaccgttgccgctgagagacatgccgcaaattcaccatccaccgcgaaatgtgacttcaatttggatcaaattgtgtttgctttttctcagtctctgggtgtttcttcagggaattcatgttcgacaaattcaacgtgaatacgccgtaccgcaatttgcccatccgccgccaaacgtgccgtatcatccaccagaaaacgttccggtaatgttgggtcttgtttttcgtgcgtttctcatattttcggatgcatattcaggcaatccaaccatggcaacgaccgcggcagctgagagacgtgccactattcgaccacccgctgccaaacggaccggtaatttcagaccctgtcttttacctagcaccgaaacatcttttcttaagcaaatacatcccaaccccccgagagtgttggaagtgatccgacggctgggtgagtggagaggaagaccaagggacccaagacgtccgcctcaatgaatgaatggaatttttgattttgataaaatttgttgttttttaattttttgaattgataagggttaaatcccgttacctaaattgtttgaaaatcataaaattttaagaaattagatgctaaacctaacctttgacaaagattatgaaaaaatgaaaagaaatgacgaaatttttggaatgttccttctttttattatatatggattttttttcatgtgcattattttggtgctagtaagatattgtcgaatgaattaattggttttttctcttcattttaaaacatttcacgtccccatgccctgcccgcttcccgcggaattgatcaaggaaataattgatgctcttccccctccaaaaacacatcggcttttgcgcgtaaattttgttttggcatactttgttaaatgtcggttttattccatgatgagaagattgtttcgcccagatcatatatcaataccaatggcccgaagaaccggaatttatttctttttcgatgttagtactccccccatttattttccactctaccaataataacatttaaataaaattataattttttatttcttatttgattaatttcgatcaatattttttgataattaaacaaattgtatttttcaaaaaagacctttctcacagtaacaactcatcggctttttttttactcccttcataaaatgtctcgcttttgtcctatcacccaaatcaatgaatcgggccggcttaacacaccaaaggggaaaattagtgagtttcaaatcccgtaaattccgcataaatttagaaacttttacttgtgtttaggtcttttttatgctttggaaattgctcgaagctaccaacttataggcgaaggtataacggaaaaaacttttcgttatctcatgaaaacggaaaagaaacaaagggaattggccatcgaattaatggaaaaggcaggaattagcacagatgacaaaacttttggtatccaacaccttgaggccgtacaaaaatactgggacagggaatacccggacaactttcgcatcgtcgcttttgaaatggtaattattcgcataaaaaaatatcccgttacatatttttagaagacccgacttaagccaattttcaagggggaaggtgttcgaagaaatgaaatcaacgtgataagagagggggaccactgggatgggttaaaatcggtgtcctggtttttctgcgttcgcaacttttgcgcggcttgcgaagtgaattatcaaacaaaggaacggcacagaatagaatgtaaagaaagatgtaagaagtgctgccggatggggttcggctttccatgcgcggatgtctgtgaatagatttactgcggcgaatgtaatcgcaagttctacaacccggaatgttttgaagcgcacaagaagggagcttgtaatgagtacaaaaaatgtgaaaaatgtggagaagtctaccaaacacgttcgaaacacgtctgcggggaaaagttttgtagactttgcaaagttttccacccaggacggcaatgtttcatcaaaaaaattcaagtgcggccgcagaaagcatatagaattgtggcatacgacctggagacgactgtagaggggggagaacatcggcctaatcttgttagtgtggcactaacatgcagcatttgtgcgggagaagagcggaaatgtgaaatttgtgaaggacccaagaaaatcacatggtcagtagcggatggttttgagccaatgagcgagtttatcgtttggataatgggttttcaacgatttgaaacgattgctttcgcgcattatgctgggaggttcgattcacactttgtcttgtccgagctaacaaagaaggaaattgcgacggagttgatgatggctgatttgaaaatttatcaaataaaggcgggaagagtgtactttcgggatttttggatgcttagtcagaataaattggcggaccttccaaaaaccttggggttaaaaactgcagctaaattgtattttccacacaaatacaataagaatgagaattttgggaagagattacccaacctgccttctttgggagactactgcccggacaatatgaaggaggaagaagccgtaaaattggaagcatggcacaatgagaattttcaaacggaatttgaactaggtagggaaaataacatttttttctttgaaaataaaatttaaggggaacaactcaagacgtattgcgaaaacgatgttgaaattttgatggaatcaattttgaagtttcggcagttatttttggggataacaggagatttggatgtgatgaaggacagcgtgacaatcgctggtgttgtgataaagatatttagggcaaaatttttgaaggacaggcatattccgatcatgcctgagggagggtatgagaaagctgagaatcagagcaaaattgcagtgaaatatttcgaatggctggcccaaaaaaagggagtaaaagtgcggcatgcgtgtaacggaggagaagtggaatttggtgggctgaaggtggactgtgtgattggggcagagaaaaaaataattgagtttcaggtaaaagaaaaaatattttctttttaaacaatacttaaggggtgtgcatttcacgggtgtccgagatgttttttaccttggactatagcgccaaacggacggacaatggaagagaatcaaagtagaaccgaaattcgcatggaaattttgagggaaaagtgcaaaaatttttcaatcggagaagtttgggtagaataaaacatttagaaatatttattaattgttagttttaggagtgtgatgtcagagaggaattgaagaaaaataaggagatgaaaaagttctttgaaagtgtgccggacaagggaccgatcaatccgagggatgcttatgccgggggaagaacgatgccattttgtttgtacgcaaaggctacggaagaaattgagatatcaatgttcgacatcattagtttgtacccctttgttaattatggtaaaaatctgcttaatttttgttagtttcctttcgcttaagacaccccataccccgttggagtcccgaaaattgtagtgagcaggaattttaatgtgaattggacagcacccgacgacgtaccctatgatggacttttgaaagtaaaagtgatcccaccgaaaaatcttttgtaccccctcctccctgtgcacatcgatgaaatgctcctcttccctaattgttggtcttgtgcgagaagggccaagaatgaatttgtgatgacaaaagatgtgaaaaaatgtaaccatcgtcccacgcaaagagcatttttggggacattcacatcaattgagttgcggaaggctttagagctaggatatagaattgtgggattctatcgagcgtatcattttgaacagtttgacagtcaactgttcaaaggatatgtccggatgtttttgaagataaaggtggaagcgtcggggtggccggcggaggtgaaaagtgaagatgaaaaaagagcattcatcgaaatgtacaaggcaaagtatgacatcggtttggattatgataagattgggtttaatcccggactaagaatgattgcaaaattggtgagaaattataaaaaatctctaaaaaatgttcgaatttaagggattaaacagtttgtggggaaaattttcgatgcgcaacaccctttcaagtacggaaattgtgggcagcatggaacgttggatggaattggggagagacaatacaatttgagttgggcgcccagtaaaaataagcgaagagttaatcagagtcgtgtaccggaaaaaggaggagttcatcagggagcataaagtgtcgaaatattgttttgtcattgtggaccacgagtgctgcgaggctanagctgtacgagtacatggnagcagtctacaggaaaggaggggtgtaaactgctctattgtgacacaggtg

SEQ ID NO: 71161 - DNA, 5976 bp, Heterodera glycines
  Genomic contig location: Contig_ID=SeqID_1272; Location=7093..13068; Strand=+
  SCN-specific regions: Sequence locations=1-232,254-425,453-517,539 -663,685-1640,1679-2312,2335-2340,2363-2868,2892-2987,3009-3149,3171 -3696,3720-3808,3838-3948,3989-4393,4415-4416,4438-4947,4990 -5090,5120-5171,5215-5414,...
  SCN-specific regions: Sequence locations=...5437-5499,5521-5774,5811 -5976
atgaccgagagaacatggccaacgagtacaaacaataatgtggagaagcagatgacaaagtcgcgcaattgcaggcgcagctcaatgcggccgagcattgtaagttgacagaaatatttttaattgagaagaatttttttaattttttcaactatcaaaggtcgggacctagcagtaaaacgggaagcggaagagcacttgatgaaaatggaggaggtggtaaagtttttactttaaaagttgctcatttcctgggccaagaatattatattgtaagggcttaagccggcttgctcattatgaaatttttacaagtaacaaaaaaacatttcttatcaaaattcgaaaagtaatcaatatttaaaagtccctgatcagtccgcattgatcactgtttatgctatcaaatccagcttccaaatatgttttattttattttaattttatttattcatagagagagggacgcaatgaaacggaatcggtcagccgaattgcattcaaaggcgccggcggagagcgggcggaagcggagcggccaacctatttccacatttttcgcggcgaggtccaattggcgacggagactgtggcacgggcggactacgaaccgaagggccgcggtgatcgcttcccggacaagaagcacgtggaagcgggtgagtgttgtgtgtttgttttgtgcaattgctaatagccgggacagagtccgcgactgaactgggcggtagcgattaaatttcccaaatatttttatgaccgagcgaggcctgagggtctgggattaaattcctgaaaatttggagccggaacaacataacatttcttgaaatatgttgtcgtgattgagctttggactgactgggacgaacagcaattcaaattagcaaataaaaaatataggattgaattttttagacgtaggcctggcctgagcgaggtccgggcttaaattcaccgaaaaaatttgctaaaattgttataggaaccaattctaaaatttagttgattctcagaaatgactaagtactaccgtatctagtttttaaaaatatagtgtactcctgcattttgcgctcatgatgggatcggacctaccaaattcccggcagattccgtttccatctgggatattcatgaaattcaaggagagtcggtcttgacactcactcaagaacaggataagatgtttagagctgttgcgtcgcgatggaacaattcgtgctgaagggacagttaaccgaagcgactatgccaatgatggaaagcggggggaagggcacgagatcagctgggtcaatggccgcgaagcgtcggcaccgctgtttggtaaagcagctaatattcgaaaataaaactcccatgctgtgtatatatcattaatgttcattagtgagctaatgatcgaaattcggcttttatattgctcatttctcgggtcaataatttttctagattatgggttaattagttgatttgatcacctttaattgcccccctttcagccggacctagatccaattcagcaccatgccgacaacattcatcgtgctgaatttgtcgcgcacgaaagtgggaagcgcaaagtgccgacggaggagggtgctgagcatactccggcgaagagatttatggcaataatttaaataattgtggcaaaaattgtgaaaatacaaaaaggcaaattaaggccacggccacaactaaaaacgccctgaatcaccagcaccaacgccggagccaatccaagctttattgtcccaacgtttgatctacacgatcgcgtatattaatggacgcgtgtgctttgtcttggtggacaccggtagaaacaataattattttttgatttttgttgttcaaggcttcgttggctctctgttgagcgacgaattctacctgggagtcaattatacgccgcgctttggtgcgacattcgacgcgaatgtcgtacgaatttttttttaatcatttttgggacgacgcgcgcgttgtcgggtcggtaagttattggattttaaaaatccaatggcattggacactgaaaatttgtgatggtgatttaaggtttggaacggattttttttcttcattttggtgtcaacgtttgttacgataacaggctgcttcgttttggagaggatcaatttccatttttgttggtaataaccccaattgcgcattgcttgaatgatgataattggagattttttagcaaactcaggcaatggccgctcttggccaagcacatggagaccccaatgtacaacaagcataaagacgtaaaaaaatcataattgtaatttcaatgaaatttttgcagattgtattttgctttttctgctacaattaccatcaatatttgatcattcagtaaaataaagattttttcgtaagtttttgttgcaaaagcaaatacatataacgaaaaaatattaatacgttttagcattcggttttccatattcatcaattgtgcccaaatcggtcggttgccaacgcaataaaatgccaaatatttctttgaattcgtagtcaatattttggtaccactgcgcactttcaccgcttttcaagtccaattggagtccgcgcatctcttgcacgcggcccttgttgaaagaatgccaaatttgagaatttggacccgcaggctatttttgacgaatccgaattttaggaatggaccaaatttttggatcgagaatttcggctttattttttcttttttacatttcgagtattgatttcgggtttatgatttcgctgtccatttgaaaacttaaaaccaacaccataagaaatatttataaaaattatagcttgatattctcatttagaattaaaaaaaacgatatgcctgcatactatttattattattttttttaatctcagaattttaaaagtatttttttggttctggtcggttttatgcgtctcatgccatattatgcgtcccatcacatattatgtgtcccaagaatgatcattcttagtttcttagtttatatccttttttcttacttggtcaatacctatattttggtatcaatcgatagcttaatgactatagaagcttttgtataaatttattttttaactaaaggcaataaaaaaaaattatactcggaaaagttgaattcatatattctcattgtaattttcctttttaatgcctgttattattttttcttgcattataaaatcccgagactttcgtcttcgattgataccaagaatttaggtattgaccaagtaacaaaaaagttatggcctggcctaagaaactaaggattaagatcatcttcttttattacggtccctaatcggattttgtctagacttttttttgagaatgcactcggaccagcagaagaaatccaaaaaaattttagttggttcgtttccttaatccatatatccacataatatggatcagaagaaactctgctgatccgtcctgatcagagttcagaaaaatgtgtaaattttccgagtccaattttaaatgtcatcatttttcaattttattgactcactcgccactcaatgtgaccgttatattatggaaaacagctgaagtgtagtaattaatgggtcccagcagtgtcggctttttgacaccacgggaaaagtgaacggcgaaacgccactcataccgtacccatcaacggatgctttgatttggatactgtaaaccataaaaatattattttaaccaaaatcatgttcggattcggacccgtaatggttaattaaataaattcttttcaatcagaatgcgtacccctattttttccaattatgtaaatataaaatataatctattttattatgaacaaatatgttatacatatttatggtatgctctcccaattttatccaataaatccgtatttataaaagtttcatttaatattcatctatttttggatttttgcaccttactaattcatcctaattatttaaagttttgaatttttccaatttatgtgccttcaaaaactgatttttgattgagtacaatccgtaattaacgacctaaaatcatgaaaatcgttaatcaaaacacagttacattcatcaacttatggatattaattaaatttctacgatattttgcgtgacatcaatcataattatggattgtccttaatcgaaatcaattgtgcccattcattctgggaattgcaacccaacaaaaacgtaattatgtaaaaattaattaaaattcaagatttcccgacttacgtgcccttaaaagctgttcggcgcctttctccccaaaaacatttggacaattgaaaaatctcttcgtaatcaattttcacatttgccgtacagtttttgcttaccccagtgaaacatccgtcaaaaagtgcgagagtgccgaaaatgggaacaaaaatttggcacaaaaaatattcattaattacggcgttttttcggaggatcttctttagggtttttgtccgggtcattttcataaaaataaacctaagaatttcaaaaaattagcagaggcatttttatattttttacaaatgcaattttttgcaaatccctcagacaaatcctccgacttcaattgaatgtgccaaaaacaatgccaaacttctcgttcggcacttgacctttgtactgaaagaaggcacagcttaacagttttgccgtatcaaatgcctaccgtacacgcacagtactcttcccccggtgccatgtcattgctcgcttttgtccccttataacatgcgtagcacgtgttttctccgttgttccgttcattgtcaatgaaaagcggcgaattaagccatggcgggcgcaaatggcgcggcacgaaacccttctgtttgaccaccgccgagtgccggcactgctcgtggaacggagtgccatcgatgggacggcacaattcgtcggcgccatcaatgcattaaattacgaggaataattaaaaatttcaatttcaatgaatttttaattttaatgaccatttgttgtgttgtttttggatgtaaccgcaaaataaatgaacattctgatggccatggcaaagatggaaaaattcggatagaacattttgatgagcaaatatttatttattaaattaattatttacaaattcgagtttgtttaaatcgaaataagaattataattatttacctttactatttattaatttgattttaaaaatctttgaaaatctcatgtccttgaaatttcctcgaaactctaattaattattcaattaccaataaactgagagatttgtcatgtgtaatgatatgcttctgtgaattattttgtttttcaaataattattcatcatcactaatcaaaataattttactgacagctgaaaagtcgatttttttttctgtagtgaaatgaatgagtcaccagatgctgagaaccacaaaaattttttgcttttatttaaacaaaccataatcattctcattcagttgtccatcttttagccaatttcatccgatcattttcattttaattgtaaaatttccaaaataaatattttctttttttttgaacagtaactttttctgatgttgtcgaaccaactcaaactttttattcttattcttgcaacattttccatcacctctgtggagggcgactttttggcttttttttataaaaaagtaatccaaccaatcgtgagttgaagcattttatttgttgaaatttgtaaaaaaaaatatttaaggaaaatgaagttgggaaagccgtggtgacagtcgtgagttgaagagcattttattttttcaaatttgtaaaaaaaatattaaagggaaaagaagttgtcaaagttgccgacaaaatcatcgatcacatccctcttcttgcccaggcgcgcgcgattgcgagagttgccgccaaccgaatattgggcaacaaagaaaaatgggaatgcggacctgaccatgaaattaaagtggttgacgaactgttgcac

SEQ ID NO: 71162 - DNA, 903 bp, Heterodera glycines
  Genomic contig location: Contig_ID=SeqID_1272; Location =12266..13168; Strand=-
  SCN-specific regions: Sequence locations=1-266,303-556,578-640,663 -862,894-903
atgaccccatttttcccagcagctggtttgcagggaaatcaaatactccgtatcaagcttaaaacggtaaataattaggaataaattaaaataaactcacgtgcaacagttcgtcaaccactttaatttcatggtcaggtccgcattcccatttttctttgttgcccaatattcggttggcggcaactctcgcaatcgcgcgcgcctgggcaagaagagggatgtgatcgatgattttgtcggcaactttgacaacttcttttccctttaatattttttttacaaatttgaaaaaataaaatgctcttcaactcacgactgtcaccacggctttcccaacttcattttccttaaatatttttttttacaaatttcaacaaataaaatgcttcaactcacgattggttggattacttttttataaaaaaaagccaaaaagtcgccctccacagaggtgatggaaaatgttgcaagaataagaataaaaagtttgagttggttcgacaacatcagaaaaagttactgttcaaaaaaaaagaaaatatttattttggaaattttacaattaaaatgaaaatgatcggatgaaattggctaaaagatggacaactgaatgagaatgattatggtttgtttaaataaaagcaaaaaatttttgtggttctcagcatctggtgactcattcatttcactacagaaaaaaaaatcgacttttcagctgtcagtaaaattattttgattagtgatgatgaataattatttgaaaaacaaaataattcacagaagcatatcattacacatgacaaatctctcagtttattggtaattgaataattaattagagtttcgaggaaatttcaaggacatgagattttcaaagatttttaaaatcaaattaataaa

SEQ ID NO: 71163 - DNA, 659 bp, Heterodera glycines
  misc_feature (580)..(580): n is a, c, g, or t
  Genomic contig location: Contig_ID=SeqID_9376; Location=1164..1822; Strand=+
  SCN-specific regions: Sequence locations=1-153,175-324,509-659
atgccaacaaaggatggcaccgagttcgagttttttaatgttagaaaaggaataatttgcccattgaaaaatctgaggtttttttttgcaattgcaattttggggtaaattattcattttatgccatcaaaaaacgccgtgcattttgttggcatattttttaaacttttggggtgcgtgcacaaataaatttgtataccaaagattggcgttctgtttacgatgttcgcgcacgaattgtcgcattgtcgcaatggtgttgatcactgtcaactttgaagaggtcgacatagttaagaaatttgttaaatacagttgaaagagttaattttaaaataaaatttatttatttattaatcgaaaatttgttttaaaaataggaaaattatttttgtttataaagaaatgatattgttaataaccaaaaattgtttatcattttataaatttggttcattagaatcaatttaagataacaaattaatagatattaatatattaattaataggatgttcgtgtcatgtgatcagtcagtcagtcagctggggacaactcagccgacagaagacaaactcagcntgatgggacaattcggctgatggacaactcagatttacgagaattaacaaaaatataaaaaaaaatgaaaaatgattaa

SEQ ID NO: 71164 - DNA, 1008 bp, Heterodera glycines
  Genomic contig location: Contig_ID=SeqID_9376; Location=462..1469; Strand=-
  SCN-specific regions: Sequence locations=1-132,154-452,474-527,564 -591,621-732,754-1008
  Gene Ontology: Biological process=coenzymes and prosthetic group metabolism
acaaatttcttaactatgtcgacctcttcaaagttgacagtgatcaacaccattgcgacaatgcgacaattcgtgcgcgaacatcgtaaacagaacgccaatctttggtatacaaatttatttgtgcacgcaccccaaaagtttaaaaaatatgccaacaaaatgcacggcgttttttgatggcataaaatgaataatttaccccaaaattgcaattgcaaaaaaaaacctcagatttttcaatgggcaaattattccttttctaacattaaaaaactcgaactcggtgccatcctttgttggcatatttttgaaaattttggggtgtatgtacaaaaccgaaaaaagtaccctttcattaagcgtggcattggtgccgacaatgggtgcccttcaccaaggccatctccgactggcacaccaggcacgccaatggaataatgacaaaaaagtcaatgtttatttctgctattttttcactaactttttaatttcatccaaaattttaagaagcattagaacccagttttctgactttaattaaatcagaacttcaattttttaaacccacccaaaatgccgattgaaacttttttaattcaaattttcattttgaaaaatactgaaaattttgtctgattaacaatagtttgccaagataaaatccgtgtatatcctgaggctgacactgtgtattcctgaaatctgacctctaatttttatatcccattgtataaatgccaaaaaagtcatggcaaatacaaggaacaaaatggcaccactgatcagtgcgcctctccgcccctggtgatcgtctccatttttgtgaatccgctccaatttggcgcaaacgaggactatgagcgctatccgcgcacattggaagcggacttggccaaattggagggcgtcgtggattgtgcatttgtgccaaatgccgtggaaatgttcggggaggaaaagcaaccgctgaatcacaaggatgaggaggatggcatcggcattaaa

SEQ ID NO: 71165 - DNA, 416 bp, Heterodera glycines
  Genomic contig location: Contig_ID=SeqID_9376; Location=3280..3695; Strand=+
  SCN-specific regions: Sequence locations=1-75,99-109,131-187,211-416
atgatgttctttttgtcggcatttgccatcattctccaatgccaaattgctgttggacaggtgccaacgtttcggaaatttttaattttaattaaaatgtttttgctaagctcgtcgcaccgcttcttctccatgctcaaacaggacccgatttcattgttcatccccatgttgagcccgaacatttggatgatgatgatattgatgacgcacctgtgccacactcggcacggcttggccttttggaacactttttgggtggccaacgcactttggaactgattgagcaagagcatcagttccatgaacgggagaagtaaccaaatgagctattataaaattcgacgacaatttcttggcggaatggagggagtgggttaattaggcggcactaattagccagattagctcaatta

SEQ ID NO: 71166 - DNA, 1319 bp, Heterodera glycines
  Genomic contig location: Contig_ID=SeqID_9376; Location=4288..5606; Strand=+
  SCN-specific regions: Sequence locations=1-206,228-253,282-540,604 -1190,1213-1319
atgtgttatgcggatgcgcaagacaacggcgattgttgcgcaaagaaaggtgtgccatcggaggtatgaaaaaatgccggaaaaaaaaattgttttcacccaaatcaaatcttttaaaggtgcaatatatgttttggagcgccaattgccaggacctttgccgaggcctcagtgccaaattgaatgccaatccggcgtaagaaaagaattaataatttaaaaaaaatcctttttaagttttcgaattctttagaaaattttagaaaaaaaattataattttctctgtcccaaatttaataaatagtagtgcaaattagcttttcccatattgtttaattgagcgctaattaaaaaaatggctaaattgaattaagctgggacaaatgttcgccctacaaaaaaagcatttactactgtaactaccaaaatgtccaaatgaaaaagccgacggccgcgactgtgcgcggcttttgcaacaacgccaaattgtgcaaggtaacatggatgatgatgggcaggcacttcttggataaaacctgttaaaattttaaaaaattcgaataattttttaatcaaatttcattaaaaatttcaaatttaatccttatttctcttaaaaaattggctcaaaagtcgcaaaatttggtcattttttggacaaaatctgttaacaatttgttgaaaaaatcttcaaaagtgtttttttttcttctaagaatgaaattttctaaaaaaaagtctcgattctcgagtcgaaaaatttcaaggattttttcgggtaaataaatataaatacaaaaaaactcaaaaactgaaattttgtgaatttttttttttacaatcttttcagaatccaatgggatggagagacacatgcagcaaggcctaaagagcagtgggtggtcagtgagagagagagagagagaaaaagcaaaaaaaaaaaatgccaaggaaattggagaaaggacagaaacaacaaatggggggatacggtagacagtgttgaaaggatgatacggtaaatggagaggggagaggtactctgtacagatgtattgggatgtggtgtaagggctgtgcgaagctgaaatttaccgagacaagattaacaagaatagagcttaaatattcggaaaatacagtaactggctcggtaattttacggtacagaacaaaaaattacagtatgttttaaaagtttaaattgtaaaacggcggaaatttgatttgactcctgagaaagttgatgtttaagctttcgcatagcccatgaaaattggaaaatatgtaatgacgatggcaattgtttaaaatggga

SEQ ID NO: 71167 - DNA, 588 bp, Heterodera glycines
  Genomic contig location: Contig_ID=SeqID_9376; Location=5730..6317; Strand=+
  SCN-specific regions: Sequence locations=1-84,123-223,245-425,447-588
atgttctgcttcaacacgatgcgtgccatcattttgctgacattcgtcgtcatccaatgccaaattgtccaaatgtccggcgggtaatttttttgttaattgaaattaataataattaaattgatgcattaccgttataagccctgatcacttttacttatgtttatcaaatagaaacaattgtgacagtaaactgagagatagttccaaattatttggacattgatctccttaatcacttactgatcaaggcgactcatattgttagtttgatcaccaattcattacttatcgcttattaattaattggtcaattaaactattaagttttgtaattttatagacgctgctacaacccaagcgacaaattccacggatgctgccagcaaattggtatgaccagcacaatgaccaaccttcaatcactgatcagagatggtaattaattgccctgattttgatcattccgatcagtttgcatgctttaaattcctttgaagcttgccgttatcctccggccgatctggcgatgaaccagaaaatgacgctgggatcatacttcaacgaagtaaatgactcaaatttgaa

SEQ ID NO: 71168 - DNA, 669 bp, Heterodera glycines
  Genomic contig location: Contig_ID=SeqID_43522; Location=1..669; Strand=+
  SCN-specific regions: Sequence locations=1-107,129-669
  Gene Ontology: Mol. function=oxidoreductase activity; Biological process=epoxygenase P450 pathway
ttataatagtgattgaaaggtttctcaggttaaaaattcgagttcaaactttagattttcatgatcggatcaattttttgaaaatccgatgatcgatcggatcgatcagtttgtgtttaaatgaccaattgttaagtgttctgaatcggacgtgctgccacacgacgacattgggcgacataaccgtggagaagggcaccgccgtggtgtgcgatttgctttcgctgcaccacgacaaagccgtgtggggagaggacgcggacgaatttcgaccagaaaggcacaaaaaaaaacccaacaaaataatcataataatgggccaaatggaattgaaatggcaaatttgtgcacctttgttcaaacagggggacacattaggcattttggttttggagaataagatttttgcaattttttaatcaaattcactgagactgaagccaggcaaaagccattaaaattggaagtcgtttaaatccaaaaattgtaatccaattgaaactgttttcaggtggctcgaagcagggcatcaattgccgccgttttacgcgttcggcggcggtccgcgcatttgcattggcatgcgattcgcaatgattgaggagaaattggcattggtccgaattttgcgcaaatattccattgtccaaactgcggacactgaggtga

SEQ ID NO: 71169 - DNA, 49 bp, Heterodera glycines; identical to SEQ ID NO: 51181
  Genomic contig location: Contig_ID=SeqID_43524; Location=191..239; Strand=-
  SCN-specific regions: Sequence locations=1-49

SEQ ID NO: 71170 - DNA, 255 bp, Heterodera glycines
  Genomic contig location: Contig_ID=SeqID_43525; Location=307..561; Strand=+
  SCN-specific regions: Sequence locations=1-255
atgacggaatggcatttgttggaattggcacttctcgaaaaagggcaaaaccaaaaatgggaaaaaattgaacaattaaaagaaaaatggaaagaagcatttgatcatcatttaataaatcgagaagaaaaaagtcgaatctttaaacaaatagtggagaagctcaaagtgatggtgacattttcgattgattgttcaacgacattatacgaaagtttaaaaatggcaaaaattgttagcacaagtcgaattttg

SEQ ID NO: 71171 - DNA, 296 bp, Heterodera glycines
  Genomic contig location: Contig_ID=SeqID_43528; Location=628..923; Strand=+
  SCN-specific regions: Sequence locations=1-111,137-296
atgccaacaaaaaatggtctttccaattacctaattggttccggtttgaaattaaattttaagcttgtgagttgtgatcatacggggattaacagcggcttaaaaaaccccaaaaaataattttaaaaattttttacaggcaagtggatttgaacccacgcgcccaaaaccatttttaaccatccgagcaattcgtctcccttccttacgttaagtcgagaatgggcccgcagcaccaaaatttccgatttttgaggccctgtaacttttgaactaggcgcttgacaccgctaaaa

SEQ ID NO: 71172 - DNA, 416 bp, Heterodera glycines
  Genomic contig location: Contig_ID=SeqID_43529; Location=473..888; Strand=+
  SCN-specific regions: Sequence locations=1-2,30-32,155-206,236 -236,320-325,358-416
atgaaaaagctatcaatctgtcaatccttacggtgtccgggccgggtgagtttccccgtgttgagtcaaattaagccgcaggctccactcctggtggtgcccttccgtcaattcctttaagtttcagctttgcaaccatacttcccccggaaccggaagactttcgtttccgggaagctccccaccagggcgaataaatccaccggcggatcgctagttggcatcgtttacggtcagaactagggcggtatctgatcgccttcgaacctctgactttcgttcttgattaatgaagacattcttgccaaatgctttcgctgtagtccgtcttgctacggtccaagaatttcacctctcacgtagcaatacgaatggccccgtttgtctctgttaacattatctcggtcagcaaacca

SEQ ID NO: 71173 - DNA, 452 bp, Heterodera glycines
  Genomic contig location: Contig_ID=SeqID_43529; Location=8..459; Strand=-
  SCN-specific regions: Sequence locations=69-140,208-343,379-452
gtggtgcatggccgttcttagttcgtggagcgatttgtctggtttattccgataacgagcgagactctagcctactaaatagttggctcattgcttctgtgggcacaacttcttagagggattttcggtgttcagccgcacgaaattgagcaataacaggtctgtgatgcccttagatgtccggggctgcacgcgcgctacactggcaaaatcagcgtgcttgtccttccccgaaaggggttggtaaaccggtgaaaatttgccgtgattgggatcggacattgcaattattgtccgtgaacgaggaattccttgtaggggcgagtcatcaactcgctctgaatacgtccctgccctttgtacacaccgcccgtcgctgcccgggactgagccatttcgagaaattcggggacggttaaataagggcttcggtcggtatgcagactggaacc

SEQ ID NO: 71174 - DNA, 505 bp, Heterodera glycines
  Genomic contig location: Contig_ID=SeqID_43530; Location=145..649; Strand=-
  SCN-specific regions: Sequence locations=1-107,156-218,240-264,293 -413,445-505
atggagaaggcctgcaaaatttggagagattatatcgattttagtgcgctaggttcgatgaaactttttaaaatataagcctaaactttttcgcatatttaaaaagcaattaaaaatttttaaaaattttattcatctccctttttgatataaaaagcatctgagtgccttatttaacttttaattaacatttgatgcgtttcagagcagtttctgaaaaaatatttatgaattaattttgctaaaaaaataaaatagtgaagctttaaaaattaataaaaaattttaaattcagaattactggtgttagcatcatagcagtgcttttccttgtctttttgatgctctcgcaaaatctggttcgcttctgatcagtttctgaaaaaaaagttaagcctaaactttttggcctgtttaaaaagcaattaaaatttttagattttttattcatctcccttttttgatagtgaaagcatctgagtgcctaaactaacatgtaaataaa

SEQ ID NO: 71175 - DNA, 217 bp, Heterodera glycines
  Genomic contig location: Contig_ID=SeqID_43530; Location=717..933; Strand=-
  SCN-specific regions: Sequence locations=1-217
tggtgcgcttctgatcagtttctgactttaaagttaagcctaaactttttggcctgtttaaaaaggaattaaaaattttattcatctccctttttgatagaaaaagcatcagagtgcctaaactaacctgtaaataaagttttgtgtgtttcagagcactttctgaaaaaatacttatgaattaattttgcaaaaaataaataattaatgaaaaagt

SEQ ID NO: 71176 - DNA, 66 bp, Heterodera glycines
  Genomic contig location: Contig_ID=SeqID_43531; Location=182..247; Strand=-
  SCN-specific regions: Sequence locations=1-66
gtttaggcttatattcgtctggacatttcgaagctaatcacagcagagagccgaatgacagaggag

SEQ ID NO: 71177 - DNA, 355 bp, Heterodera glycines
  Genomic contig location: Contig_ID=SeqID_9378; Location=414..768; Strand=+
  SCN-specific regions: Sequence locations=1-46,68-355
atgggagctgaggcacaattccatcgcaagggtcgtgagcttggacgcggcaagtttggcgttgtcaaaaaggcactcttcacagaccaacagggcaacgaaacggcggtggccataaaacagctgcattgtgtgaagagcaacaaggaacaggtaaagtgggagtttgaagaagtgcgaccgcgcattcacacattaccccgtttcgtttcaggtcacggaattcatgaatgatgctcggatcatgcgaaagcttagacagaatgtcgtccaattctacggcattgcagttgagcgggagcccgtgatgatcatcatggagtctgtgtcgggcggcagcctcaaggacttctga

SEQ ID NO: 71178 - DNA, 772 bp, Heterodera glycines
  Genomic contig location: Contig_ID=SeqID_9378; Location=1070..1841; Strand=+
  SCN-specific regions: Sequence locations=1-347,373-446,468-546,572-772
atgtgtggagttttgggatattgtgctcgggaggttttgccaaatggcgcaatgccattccaattcgccggctacagactcccacatcatgtcccctcgccctcgagggtggagacgaaaagagcgtgagtgaaaagcccaaaaacgtgttttcattttttttatcattttcttttttgcaggtctcaagggacagcgcctggtcttcccgccgaagttcgtcatgcagcacgtctgggccccgaatcacaacaaccgatactcaatgggcgcggtgtacgactggatgaagcgaacaccgaaggaggaagaaggcgccagtagaactagtgcatgtgatcggaatgtgtgtatattgtatatatgtatattgttttttgtaaaatgtttttgtctttttcgtgtcaccgtttagcatattttatttagatttaaggatctctttattttgacaaaaacaaaacaaattggaacccttaaaattcaacaatgcgtgctttgggtgtaagagaacgggttagacacgtttatattttgtaggccgaacccaaaaaacttggaattttttaatggaattaattaagaataccgaacactggttattttccaaaaaagctacaaagggtatcggaaaagggaaggcacaaacaaccaattaccacggaaacgaaaaccaccctgttttttttttgccgggactcccgatttttttttagtctcgccgagggcccgatttcaatccataccaagatgtcacaattaggcgaaaata

SEQ ID NO: 71179 - DNA, 517 bp, Heterodera glycines
  Genomic contig location: Contig_ID=SeqID_43534; Location=176..692; Strand=-
  SCN-specific regions: Sequence locations=1-517
ttgtacctcttctaatcactgttgtacctcttctatcactgttgtacctcttctaatcacttttgtacctcttctgatcactgttgtacctcttctaatcactgctgtacctcttctaatcactgttgtacttcttctaatcactgttgtacctcttttaatcaccgttgtacctcttctaatcactgttgtacctcttttaatcaccgttgtacctcttctaatcacagttgtacctcttctaatcactgttgtacctcttctaatcactgttgtacctcttctaatcactgctgtacctcttctaatcactgttgtacctcttctaatcaccgttgtacctcttctaatcactgttgtacctcttctaatcactgctgtacctcttctaatcactgttgtacctcttttaatcaccgttgtacctcttctaatcacagttgtacctcttctaatcactgttgtacctcttctaatcacagttgtacctcttttaatcactgtttacctcttctaa

SEQ ID NO: 71180 - DNA, 341 bp, Heterodera glycines
  Genomic contig location: Contig_ID=SeqID_43535; Location=133..473; Strand=+
  SCN-specific regions: Sequence locations=1-341
tagttgcttcgtgctccggtgccgctgcttcatcatcaacggttggctccatggtggtgtcccatttacaacaacagcaacaacaacatcatgctcaagcagttcagcaacaacagcaatacgttcaacatcatcagcaccatgggacaaatgcggatatgacggctactgctgttgttgttcagtcaccaccaccaccgccttattcggcaggtgttgtttctgttccgtcgcatcaattgccttccgggatgagcggcactgctgcgcatgccgtggccggcggtgccgtgccgattgcgtcaaacgccaccgcagcaatggttcagcaaacgcagcag

SEQ ID NO: 71181 - DNA, 397 bp, Heterodera glycines
  Genomic contig location: Contig_ID=SeqID_43539; Location=1..397; Strand=-
  SCN-specific regions: Sequence locations=1-192,216-359,381-397
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtaaacgaaacatttatggggagcaaaaatccaacgcagaattaa

SEQ ID NO: 71182 - DNA, 483 bp, Heterodera glycines
  Genomic contig location: Contig_ID=SeqID_43540; Location=92..574; Strand=-
  SCN-specific regions: Sequence locations=1-483
atgcttggtattacatctaggcaatcaaaatgcacaaaaataattatgagtatttctgatcatgaaattgtggagtgctgtagtgggggtgtatatcaggtaatgtgttattcttttcaaaggtaaattaaagcttttgttttagtatggtttgaaactgaggaggctgtacgcacctgcagatgcggagtttgaatatgtgctgaaggtgcgagggatgacgctgaactacgacgtcatcaacaaccaaggactgcgctacgattcaagcagcaggtgctgaacttcactgcgacgggtgactatgaaccaatcatcgtcacatatcccaacttcctgagaccaagcattaaagatggagggaaagtggtgtcgggaccccttcagaaatgttataggccatatgtaggaaaaggaattgttaactctaattttgatgttttgaattttggtcacacattgtaaaacttacttttgaataaa

SEQ ID NO: 71183 - DNA, 49 bp, Heterodera glycines; identical to SEQ ID NO: 60106
  Genomic contig location: Contig_ID=SeqID_43541; Location=264..312; Strand=+
  SCN-specific regions: Sequence locations=1-49

SEQ ID NO: 71184 - DNA, 1394 bp, Heterodera glycines
  Genomic contig location: Contig_ID=SeqID_9379; Location=256..1649; Strand=+
  SCN-specific regions: Sequence locations=1-133,157-272,294-321,343 -369,391-682,705-853,875-1013,1035-1046,1068-1394
atggcagccgaaaaatattccacggagagaattgccaccctcggagaatcgctgcggcacgcaaaaggacgtgcgacctattacaagcaggaagtgagtttggacagactgtaatgtggcggttgggcattgtttggaatccaaaaccctggctgatacccacttgaccagcgcccatttgtcccaattcgttctaattgattgcctgtggcaatcttgtccatttgtcagtattagaaagatctacaaattggttcggcgcacagtacagtcattgctgttgtgttttgtttcccatatggctcattgggttttgcgtagttttgctttgtctttctcatgggttcggttcccttccgcgtgcgtcgctttgtttgccctcttttggtttccgtgcgaagaaacgtcagctgtcagtctctgaccttcggcttacagtacttactcccttcgcaaattgtccctgcacttttctcgttggccttttctgtcggagatttcctcaaaaaggcctccaataaatgtgcaacattttttttaaattttttcaacatattattttgagattttttattgtttaagtgtgaggaattgctcagaaaggcaatctgtgaccagcagcgcatcgaagcattggagcagaacattttcgagttgacgagcaaatgccattcactgaatgtttgtcaggggatttggcattttcactttcatttgtcttgctttttttcattagccaattttcaggatgctcttgagaccacccaaattaattacgaagcgcaatttcgaggcaaacattaaaaacagacaaatccaacaacactaaatttgttccctttatcagatttacatgagcatttggcagaaaatgaagcaaaaatgacgggccgaagtgatcggacattggcactcaatgggacggaacggagcgtggaaaacggcggagaaagtgcgttttgagacgcatggaaaggggcgaccctaattttttaggcaccacatggaaattatgcaaattttaacaaaatttttcataatttttgaaaaacgcactcatttcccacgaaagtcttacaggtctctcctccccccctccctttccaatgtttttatgggctttataaggcttcgctttttcttcagaaactaccaattgtaagaaaagtgagaaggtccgttcccattggttttcgtcctcgtccaaacagtcgaaggaatgaatgactttccccgtgccgacttctgtgattttcactctttgttaagttcgacttgttaaataacctatgcaacagtggacttagtcgaccgaatcgtcaaaatcagtcgaatcgaatgttaataattaattgtaacgcttgtgccatggaaaacactttttcatctttcga

SEQ ID NO: 71185 - DNA, 1879 bp, Heterodera glycines
  Genomic contig location: Contig_ID=SeqID_9380; Location=368..2246; Strand=-
  SCN-specific regions: Sequence locations=1-221,243-400,423-521,569 -834,856-859,1524-1637,1659-1780,1807-1843,1866-1879
  Gene Ontology: Mol. function=calcium independent protein kinase C activity; Cellular component=membrane fraction; Biological process =chemosensory behavior
atgtcgagccgagcgaagcggaagccgttgagtgtgtcggtgtctgaaagcactgctgggctcgagccgagcacgagcagtcccaaaagtgccgcttccgccgctactgccccctcgcgattgccgtcgagcgtcgcctctgccgaagtctcggaaggacgcggcggcgattcgcccaagggaatctctggcacggacggacgcgcggcattggccgatttcacttttatcaaagtgctgggcaaaggatcatttggaaaggtgggaatgggatgggaagtgacaagcaaagccaaaacattactgattggcacgcgacttatttgatggtttatccgatgattgatctatttactcgtcaaactcttaaattggatgatttactcctatcgattgattacatttatttattgattgattgttggctgtgtcggttccgatcgattagttcggttgatttgcgactgtttcaggtgatgttagccgagcggaaagggacggacgaagtgtacgcagtcaaagtgctgaagaaggacgtgattctgcaggacgacgacgtggagtgcacaatgtgcgagaagagaattttggcattggcggccaaacatccttttctcaccgcacttttctgttcctttcaaacgcccgacaaactcttttttgtgatggtaaaactgaaatgcaaatggtcgatgcatttggcattttgttgtattacaggaatatgtgaacggcggcgatttgatgttccaaattcagcgagcgaggaaatttgaagagccacgggcacgattctatgcggcagaggtgccattcttgggctttaaataccgaaaatggagaaacaacagcaagggcagagaagggatgaaaagggaaatgagggagaaaagggagaaagaaaatgagagggcagcagagacgagaaaggaacatagaggggagagggagaagagagtgccaagacagggagtcagagggagggaagagagagggtgccaaggggagagagtcagagggaagagggagagggtgccaaggggagagagtcagaggggagagggagaagagagtgccaagacagggagtcagagggagggaagagagagggtgccaaggggagagagtcagagggaagagggagagggtgccaaggggagagagtcagaggggagaagagagtgccaagacagggagtcagagggagggaagagagagggtgccaaggggagagagtcagagggaagagggagagggtgccaaggggagagagtcagaggggagagggagaagagagtgccaagacagggagtcagagggagggaagagagagggtgccaaggggagagagtcagagggaagagggagagggtgccaaggggagagagtcagaggggagagggagaagagagtgccaagacagggagtcagagggagggaagagagagggtgccaaggggagagagtcagagggaagagagagagggtgccaaggggagagagtcagagggaagagagagagagggtgccaaggggagagagtctcggttctcgaaagtccatattgacaaatcttcctcaaaggtcacttgcgcgttgcaatttctccatcggcacaatgtcatctaccgtgacctcaaattggtattttgccaatgttttaatttgagcagacatttttgggagtcccgcgcaattgcggctaattgaatgattggcctaatcaccccatatttaggacaacattttgttggatgccgacgggcactgtcgtctggcggacttcggcatgtgcaaagagggcatcaccaaagacagcctcacgtcaaccttctgcggcacgcccgactacatcgcgccggaggcatttttccaatga

SEQ ID NO: 71186 - DNA, 592 bp, Heterodera glycines
  Genomic contig location: Contig_ID=SeqID_9381; Location=661..1252; Strand=+
  SCN-specific regions: Sequence locations=1-79,103-501,523-592
atggtgagaatgatcagctaacaaaagacgaagagtcgaaaatcggcggaagaggggaggaggtcgaaatgagacacaatggagaggaagaaagaaagaactgtttgtgatgagttttggaaagggcactcgcgcgggagggaaggctaacaaatgagaaaaagggggggggcaaacgcatttataatgagaggggggggggacattgaggaaagggaaaaaaaggggggacaaacgacggggaaagtgctgcacggacaggcaaagaatgggcaagaaacactcacggagaaaaatgggcaaattattatttgcgaaaatcaatgccccgcgttatgtcaccctccctgctaaaaatttgtcctaaaaatgcttttacaaatttcagaatgacaattcaagagaagaaattgagaaaactgagaaagtgttcgagtcaatggtgcaaaatatgaagagaatgattgggaaaatgatcaaagtggacgattctgactccacagaaattgtccaggttaagatcaaacccatagaagcattttaattttattttcacaaattctgaagaaaccttggattggccaaagatata

SEQ ID NO: 71187 - DNA, 599 bp, Heterodera glycines
  Genomic contig location: Contig_ID=SeqID_9381; Location=73..671; Strand=-
  SCN-specific regions: Sequence locations=1-27,50-55,78-177,199 -298,320-599
  Gene Ontology: Mol. function=protein kinase C activity; Cellular component=membrane fraction; Biological process=signal transduction
attctcaccatttcctctcgtccttcgcttcctttcctttcgctctttcgtcgcttttcctccgccctttcgtccgttgtcttacgccttttctctgctcattgaatgcggggattagcctccattgatcagctgatcacctcacaacagcaaaaggccaaaggacaaagggaccgacgggggaaaaggccaaacggaggccgaaaaagcgatggttttgttcaacggaacggccaaaattcgggtggtcgaagcgcgcgaccttcagcccacagaatggtcgaaaaggtaaaaaggggaacaaaatgttcagaaacattctgattaaaagccaatcctttttttctaaaaaaaggaaaatctaaaagggggggggggagggatatagtacatccatcactcccactccaaaggctctgatttatcgcaatcacttcatccgttgatcgctcccttaacccctcagattcaaccagtcggacgacccggacagccaattggtggatgcgtatgtgaatgtcgactgcgatgagtaccacgttggcaaaacggtgacgaggcccaagaccaaaagtccggtgtggaacgaggactatcag

SEQ ID NO: 71188 - DNA, 136 bp, Heterodera glycines
  Genomic contig location: Contig_ID=SeqID_43543; Location=194..329; Strand=-
  SCN-specific regions: Sequence locations=1-136
atgctgggcaagccgaaaatggacgagcagggaattgaagaggagttcaaaaagcggatggaggagcttaatttggaggaaagtgaagtgaaaaaaatggcaggattaagcgaggctttgggcgaagtgattgaaa

SEQ ID NO: 71189 - DNA, 553 bp, Heterodera glycines
  Genomic contig location: Contig_ID=SeqID_43543; Location=582..1134; Strand=-
  SCN-specific regions: Sequence locations=1-188,210-553
atggcctatgttgagctgagcaaagacatggccgaatacaaattggtggaaaatggcatcaaagcaatggcattggtggaacaaacggtgtacgatttggacactttcgggttgaggatggaaccgcaaaatatactcgatttggaccgacaatacctcgaaagggccgaacgaattaccaggaacgaccatttaaaaagacattttgggctgaggaagagaatggaagaagccatcaaaagtcagctgggaaagcaaaatgccaattgggctgtgcttttcagaattaaacaatgattttgacataattgtgcaaagaaaaacgtcactgatcaacggaaagccgaaaacgctgtgggaaaagctggcggaattggacggaaaagctgatctgaacttattcggcaccccttcggactttgaaggatttgactcggaatatattcgcaaaattgaggagatcaaaacggatgcggcttcattggtggattacaaagggctcaaaatgcgatcggaaatggcaaaacaacgtgaaaatacgggcagaaaataa

SEQ ID NO: 71190 - DNA, 797 bp, Heterodera glycines
  Genomic contig location: Contig_ID=SeqID_43545; Location=324..1120; Strand=-
  SCN-specific regions: Sequence locations=1-633,662-746,789-797
agctattcccgaaggattcggtctccccataaatctgtggcgcatcggttcggggggactgccccgaaaacaaaaataaatcgattttttcaagtgttcgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaactccaacgcagaattaaatttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaattttttaaaaaattttattcatctccctttttgatagaaaaagcaatcagagtgcctaaactaacatgtaaataaaaatctggtgcgtttcagaaccctttctgaaaaaatatttaagaattaattttgcaaaaaataaataaaaacgaaagact

SEQ ID NO: 71191 - DNA, 700 bp, Heterodera glycines
  Genomic contig location: Contig_ID=SeqID_43547; Location=79..778; Strand=+
  SCN-specific regions: Sequence locations=1-700
  Gene Ontology: Mol. function=ATP dependent helicase activity; Cellular component=alpha DNA polymerase:primase complex; Biological process=DNA replication
atggtaagaaaacgaacagacatttccgtccctaataataatgtacgaatttcggctgatctctcctctggtcctttgtcctcaaaacaaaaatttctgatcgatggtccgcttgtgctcatcgatacggtgagctatcgcagagacatttcgggatatttcgaaattggaaagcccacttttcgcactgagttgaagcattttcgcataatttgtaaattctcagcaattttataaagtagaatcattcccgattaaggacaaaggcatttctgacagtaaatggcagaaagtctacagcttgttcaagttgtggtatcccctctctttccgcgagggtcagaatgagcacacgcactccttccacaacattggttggtttcccattcttttcaatttaactttttgcttaaggcgaggctttctgtgccgtccttcacctccacgcgttgaatttattcggcggtttggatttgtcgaaaatcggttgtattacgccgtactcggcacaggcggaaaagattcaaaagttaatggccatgggaagggacgagggaccacgcttcgaagtcagctctgtcgacgccttccaagggcagcagcgagaagccattgtgatgtcattggtgcgcaacaacaaaatgcgcgacatcggtttcctgagagaacaccgtcggacaaatgtgagccattctgacgg

SEQ ID NO: 71192 - DNA, 329 bp, Heterodera glycines
  Genomic contig location: Contig_ID=SeqID_43547; Location=1131..1459; Strand=-
  SCN-specific regions: Sequence locations=1-304,327-329
aaggccaaccatttgcctagcatttttttggaacggcgacgcgacgaactgaacccaaagacaatggacttcgaatatgtggaattggtcattctgacgggcatcgacggcgacgtatttgtgagatttgtcttgcaatttgttacttcccctggtccaatgtccccccccccccccttcaaaaggcgtgcgagagggaccttcgcgcgtattgtgaaaagcgattgggccacccaatcgccacccacgtcgacgaactcaaaggaaagatcaaaataagcggcgccgatcgcaccatcgccgagcagttcgtctacgactatgaaacg

SEQ ID NO: 71193 - DNA, 321 bp, Heterodera glycines
  Genomic contig location: Contig_ID=SeqID_43549; Location=463..783; Strand=+
  SCN-specific regions: Sequence locations=1-87,113-253,279-321
atttataagcatttgaagggttctcagcagtttccctgcaaaatttggtgagctttcgatcagtctagaacgttggggatcaaatgcaaaaaataattaaaaaaaaataatactggtgtggtaagtgtgaagaactgtgttcctccaggcaaaaaattctaagaaaatttataagcatttgaagggttctcagcagtttccctgcaaaatttggtgagctttcgatcagtctagaacgttggggatcaaatgcaaaaaataattaaaaaaaaataatactggtgtggtaagtgtgaagaactgtgttcttccaggcaaaaa

SEQ ID NO: 71194 - DNA, 321 bp, Heterodera glycines
  Genomic contig location: Contig_ID=SeqID_43549; Location=961..1281; Strand=+
  SCN-specific regions: Sequence locations=1-87,113-254,278-321
atttataagcatttgaagggttctcagcagtttccctgcaaaatttggtgagctttcgatcagtctagaacgttggggatcaaatgcaaaaaataattaaaaaaaaataatactggtgtggtaagtgtgaagaactgtgttcttccaggcaaaaaattctaagaaaatatataagcatttgaagggttctcagcagtttccctgcaaaatttggtgagctttcgatcagtctagaacgttgggtgatcaaatgcaaaaataatatataaaaataatactggtgtggtaagtgtgaagaactgtgttcctcccaggcaaaaa

SEQ ID NO: 71195 - DNA, 131 bp, Heterodera glycines
  Genomic contig location: Contig_ID=SeqID_43550; Location=264..394; Strand=+
  SCN-specific regions: Sequence locations=1-131
atggaacgcaacaccgacaaaaccaccggcgcaaaaaccatcgccaagaagtgcagcgggaaagcatcagccctggctatgtgtgcttgtccgactcgtggttcatctctacagtggtctccatgtccatg

SEQ ID NO: 71196 - DNA, 2380 bp, Heterodera glycines
  Genomic contig location: Contig_ID=SeqID_9382; Location=212..2591; Strand=+
  SCN-specific regions: Sequence locations=1-137,160-694,716-855,877 -1184,1206-1384,1407-1646,1673-1755,1784-1807,1831-2033,2055-2380
  Gene Ontology: Mol. function=protein binding; Cellular component =Golgi apparatus; Biological process=oocyte cell fate determination (sensu Insecta)
cgaacgattggcgctggcggacagagaaaaggcacaggcgggcgaattggggcttcatctgttgagggagaaggagcaattggagctgacccacgaagtctttgctgccctttgcctgctgttattgtcccaatgcttagaatttgctcaaagagttggactctgtcaggacggaattggagcgaacacagaaacaattggcatccattcggtcaaaccaacgccatgcggcggcgaccgaattggaccacgagttgggactgttggaggattcggccaaaatggaggcgcaattcgttgaccgagtgaccgctcttgaaacggaagtgcgccaactgatggaagtcggtggccaaaggcgggggggggggggtaaaggcagcgaaagtaaattacaaatccccggaatgacagtcagaaataccatcccttaaaaaggcttattccttttagcaattgaacattttcaagtcggagtctgaacgattggcctttgaattggaaagtttccaactccgagtcactgagttggagaccgagaaaaggacaatgcgagaagaggtgagccggggaaagcgaaagggacggaaggaaagaaaaactccgccgtttgttaagctcaaagaattgaagcaaagggagcaatttgcgttgaatgaaaacggagagctcgaagaagaaaacgtgtccctccagaagcaggtgctttttggcatttgttttggtcaattcttttgcaaattgtttttaggtgtccagtttgaaatcaacccaaatcgaattcgaatcgatgaaattgcaactcaaaaatctgcttgaggaagtggtcattttgcagacggtggccgacgaggccaacaaggtcagccggggcacggtgttgaccattggtatgacaatgaaaaaccctgtcattttctttattttaaccccttcaactaatttttggttttaatgttccattttcagcttcgatctcttgccgaacgccaagaggcagaagcattggccgccgctcagcaggaaagggaacagcgactggcactgaaaaaggaattcgagcagttgcgcaaccagggccatctgtccacactcaacagcctttacttgggcatcaaaggggcggaccgggacattgtcaaacaggtgaataagggggggggggcaaatggatgggagacacacggaattcccacttttcagttggaaaattcgttcatttccgacaacccaattgaaacgttcgccaatggcaatgcaaagggaccgaaagatttgttttcggaactgaacggcgatttggaagatcggctgaatggtgcacaagcggagaacgaacgactgaaagaggccaaacaaacgcagccaagggtgggcgaagggcaaaagatttcttatttttaaatgaaaatgttttcttattttgtcttcatttacccctccctttatgatgaaaattgcttcagtttttgtccaaatgcttcttccgtttttccatcggttggacctcaatggcaatttcggttggcttcggttttacttcacttttttcatttacattttcagaagagtgtgacgtttccaaactgaaggattacatggttttggcattggaacgttttgacgaacgaatggaactgaaaaaagaagcgaaagagacggagaaacgggagcaacggatgagaggtgagaaacgcgcgttatctgtggaaaaaaaagaaaatttagaagccctcagagaagcgattcttctcgcgggacgaaaggacgcgcatttgaccatcgccaggggaatgatagtcagactgggccagacactgcacactttcttcaccgaactcaacggcacggaggaaggccaacagaaccaaagcgaacgcagacacatcgccaatgggttggccgaccgtctcaacgccgtggcacaacgcattcaaccatttgaaaatgggatgaaaaggtgggcaaaagggaggagcatgagggatagcaaaaaagggagtgaggggggaatacgcgccaaaaatgaaatgttttttattacttttaaatttgcaaatttctcgacacgaaggattttatttttcgtaacattgtctctttcaagccaaatcctgtgttcgttgatgctaaaaatgccaagattttccctctatcttttgccactctcttcccttcttcagactcggttcgcctcctccaaatggcggcggtgagtcgcctcctccgaccgacgtttcgtcattcgtctccgtcgaaacatctgagtccgactcgccacgcgttttgctaccctcgccagaattatgtcggccaatgctttcgcagaatttcctaaaagaattggagggcataaaaattggtgcggatgcgcagaaag

SEQ ID NO: 71197 - DNA, 246 bp, Heterodera glycines
  Genomic contig location: Contig_ID=SeqID_9383; Location=1058..1303; Strand=-
  SCN-specific regions: Sequence locations=1-246
atggccaaactcttcgccattttggtcttttcctttttgctgctttggtgtccctatgaattggtgcgtttttcgtccctttttctgctgaatcctccaattgttcagttattcgccgtttccagcgatctttccgttggatggacgcccctccgcctcaaaattgtgctcaatgtcatttttctgctcgccatgagttccaccgtagtgtctcccatcgtctattaccatatgagtgaacggtag

SEQ ID NO: 71198 - DNA, 776 bp, Heterodera glycines
  Genomic contig location: Contig_ID=SeqID_9383; Location=194..969; Strand=+
  SCN-specific regions: Sequence locations=1-40,63-382,404-679,701-776
atgagcatacaacagaaattggcactcactcagcgattggaggagttggagatggacagggaacgacagatgcaacagttgcgcgaaaggggggcgactggggacgcgggggggcacgccaacgcacatcagccacaacagagccaacagccgaagaggacgggccccggaggaggccaacgcagcggtggaggggccacgtaccatcagccgacgacgcgggcagtgcgctacccgggtaaaaaagggggacggagtcagggaacagttcggtaccacccccgcccctcctttttccccggtacgttgtcccctttttaagggtcgtcgtcactgcctaaccatcacaacggcggaccacgggggaagcagtgacagcggaaagaagcagcatttgccttataaaataacatacttaatcactaatggtcggaaaagacgggtcccttaattaaacaaattacaaaattagtcttccaacccatttcccataaccaaaaatttaaaacttgttaaatggtttttgtttctcatattttcatgtgtatttgtcattatttgtttgtccatttttcggaagtaaatttcgttgctttttgtcagtacaattgcagcgacagcgacgcctttgcacttgcgacggtcgtttcgcacgtgcggcgacggctttcgaggcattctttgtgaaaattatggaaaacgagcgaaatgcgcggcccacacagtgcgaatgcttggcgatattcgtcctgggagacacggacacttttgggtag

SEQ ID NO: 71199 - DNA, 478 bp, Heterodera glycines
  Genomic contig location: Contig_ID=SeqID_43553; Location=161..638; Strand=+
  SCN-specific regions: Sequence locations=1-44,66-115,172-223,245-478
  Gene Ontology: Mol. function=ATP-binding cassette (ABC) transporter activity; Biological process=embryogenesis and morphogenesis
cttcatcctgcacagcaaaaagagtggcttcattgttgagcacgattttatcatgtccacttatttggcggaccgcgtcatcgtttttgacgggtgggaaaagcacagagagatcaattaaattattactactatttaattataattaaattaaatattactattttaattgtccttttttcagacaacccgccataaaagccactgcaaatgcgtaggaatcattttaatatatttttttattgcatttttttcaatttttcttagccctcaaccgctggtgaacggaatgaaccgttttctgagccaactgaacatcactttccgaagggacaacgaaagtcatcggccgagaataaacaaattgaattcgcaggtgcacaaattaattgagactaattaatttggttttatttgtccttttcagctcgacgtggaccaaaagacgagtcaaaattacttttatttggacaattga

SEQ ID NO: 71200 - DNA, 574 bp, Heterodera glycines
  Genomic contig location: Contig_ID=SeqID_43553; Location=622..1195; Strand=-
  SCN-specific regions: Sequence locations=1-130,152-164,297-327,353 -446,469-574
atgcttaatttgattgacaatgaacaaagttatggtccaaaaagtcttccgacgacgttttggggtgcatcgaattaagaagccaaaaagtccaccaaaaatgaaagaagacccgccaaaaattctgtaaatttaaatatttgtgcaatttctgcagatggacaaaagaaacggacggagagaaaagtgacggggaggggaaaaagtggggaagagagagagagcagcagagaaggaaagagagaagatagagtagaggaagataaaaaggacggaaaagagtgggcacagagaaaacagacgaaaccatcgcaggcgaaagtgacaaattttaaaaaatttggataaaaaagaggcggagaaatggaaagatttggtggagtttcggataaattttaatcacttttttcatgaaaatgtatttggcacgcgaattgtaagccaaatccattcacatttatgcacttttaagaagttaaaaatatggtaatattatcaacaaaacggcgcaattgaacagcaaccaaaaaaacaagaacaacagagaaaatggtaattcaattgtccaaataaa

SEQ ID NO: 71201 - DNA, 1147 bp, Heterodera glycines
  Genomic contig location: Contig_ID=SeqID_43554; Location=203..1349; Strand=+
  SCN-specific regions: Sequence locations=1-24,52-54,177-228,258 -258,342-347,380-572,594-651,673-687,728-832,866-949,991-1109
atgcaccaccatccaccgaatcatgaaaaagctatcaatctgtcaatccttacggtgtccgggccgggtgagtttccccgtgttgagtcaaattaagccgcaggctccactcctggtggtgcccttccgtcaattcctttaagtttcagctttgcaaccatacttcccccggaaccggaagactttcgtttccgggaagctccccaccagggcgaataaatccgccggcggatcgctagttggcatcgtttacggtcagaactagggcggtatctgatcgccttcgaacctctgactttcgttcttgattaatgaagacattcttgccaaatgctttcgctgtagtccgtcttgctacggtccaagaatttcacctctcacgtagcaatacgaatggccccgtttgtctctgttaaccattatctcggtcagcaaaaccaataaaatcggaccgaaatcctcttctattattccatgcacgaacattcaagcgaaacgcctgtttgaagcactctgatttgttcaaagtaaactcgccagcccaccgacgccgaccggtaaaggtcaacgccggggagagaccggcagaaaagccaaccaaaccagtaacacacaaagtgtgcaccggacgggctagcacagattcaacttcgagctttttaaccgcagcaataatttttatgcattttgagagctggaattaccgcggctactggcaccagacttgtcctgtcatggatactcgttaaagggtctcaattgtacgcattccgatgaccggcctcataagagatcggtctcgttatttctcgtcaatacctcctcgcgttgagagggggtaatttgcgcgcctgctgccatccttagacgtagtgaacatttctcaggccccttctccggagtcgaacccttatcctccgttacccgtcatcgccatggtagtcagatacactaccatcgaaagttgataagacagacacttgaaagacacgtctccggtacaagaccgtgcgatcagcttagttgttctgagtcaacactggacgcccggagggcgcttggttttgtggcgaacaaatgcactccgctctggggagattggagctttggtgcatgtattagctctagaattaccacagttatccaa

SEQ ID NO: 71202 - DNA, 1463 bp, Heterodera glycines
  Genomic contig location: Contig_ID=SeqID_43554; Location=1..1463; Strand=-
  SCN-specific regions: Sequence locations=1-13,36-108,153-271,313 -396,430-534,575-589,611-668,690-882,915-920,1004-1004,1034-1085,1208- 1210,1238-1245,1321-1392,1460-1463
tgatgtgttcatttcaaagattacgccatgcatgtgtaagtttaacctgccagacagggaaactgcgtacggctcattacaccagctataatttacttgaccttgacttcttacttggataactgtggtaattctagagctaatacatgcaccaaagctccaatctccccagagcggagtgcatttgttcgccacaaaaccaagcgccctccgggcgtccagtgttgactcagaacaactaagctgatcgcacggtcttgtaccggagacgtgtctttcaagtgtctgtcttatcaactttcgatggtagtgtatctgactaccatggcgatgacgggtaacggaggataagggttcgactccggagaaggggcctgagaaatgttcactacgtctaaggatggcagcaggcgcgcaaattaccccctctcaacgcgaggaggtattgacgagaaataacgagaccgatctcttatgaggccggtcatcggaatgcgtacaattgagaccctttaacgagtatccatgacaggacaagtctggtgccagtagccgcggtaattccagctctcaaaatgcataaaaattattgctgcggttaaaaagctcgaagttgaatctgtgctagcccgtccggtgcacactttgtgtgttactggtttggttggcttttctgccggtctctccccggcgttgacctttaccggtcggcgtcggtgggctggcgagtttactttgaacaaatcagagtgcttcaaacaggcgtttcgcttgaatgttcgtgcatggaataatagaagaggatttcggtccgattttattggttttgctgaccgagataatggttaacagagacaaacggggccattcgtattgctacgtgagaggtgaaattcttggaccgtagcaagacggactacagcgaaagcatttggcaagaatgtcttcattaatcaagaacgaaagtcagaggttcgaaggcgatcagataccgccctagttctgaccgtaaacgatgccaactagcgatccgccggcggatttattcgccctggtggggagcttcccggaaacgaaagtcttccggttccgggggaagtatggttgcaaagctgaaacttaaaggaattgacggaagggcaccaccaggagtggagcctgcggcttaatttgactcaacacggggaaactcacccggcccggacaccgtaaggattgacagattgatagctttttcatgattcggtggatggtggtgcatggccgttcttagttcgtggagcgatttgtctggtttattccgataacgagcgagactctagcctactaaatagttggctcattgcttctgtgggcacaacttcttagagggattttcggtgttcagccgcacgaaattgagcaataacaggtctgtgatgcccttagatgtccggggctgcacgcgcgctacactggcaaaa

SEQ ID NO: 71203 - DNA, 346 bp, Heterodera glycines
  Genomic contig location: Contig_ID=SeqID_43555; Location=703..1048; Strand=-
  SCN-specific regions: Sequence locations=1-163,269-346
atgagctataaaattctgtcgatcactcagcttctgatcgctgttgttcttcttgtcgcaacatgtttggcatttcatgggccaacaatcgtggaaaagcccggattcaacgcagaaaaggaagtggaaaaattatacccggccattatgaataacaagatggtattaaaaaaagaaaataaagtttttaagtaatttttttttagaaaatgaatttttttatattaattttataatgtagaaaatgaaaatttttaatattaatttagaaagagattacagccatcatttgctcagtcagcaacagccaagagtagataatattcccaatcaaattatcgattga

SEQ ID NO: 71204 - DNA, 692 bp, Heterodera glycines
  Genomic contig location: Contig_ID=SeqID_43556; Location=87..778; Strand=-
  SCN-specific regions: Sequence locations=1-208,231-341,365-692
atgtggtttgtgctgtgcgcgttcgtcatcccatcagtgttctgtgcactgctcggcctctacctgtgcatttaccaaactcgcgtgccccctgtcaggtaaattgttgttggcatataaattggatatacatattttttggcatttaatgcctttttgggcattttgtggcatcaaaagccagaaatttaacatgtttatcagggtcgagaaaaatcccactgagtttcgtgccgtggcatgggtcaattcctcgatctctcagccaagtttaagatgccatatatttttttttaccattgctgaccaaaccccaacaaaaattaatcggattgaaacggataaaaagataaaatatatttacactgcttgaattgttttgaattttagggatgagtcagcacatttattatatgccgcaaaacgacaaccgccttcaccaccgccggcattgatgaagtgaacaattaaaaaaaaatgttgtgcaattaaaggagaaataatactgagggctattaaatgatgccaattagagatcattaaaaacaatgtaaaagccgtgcgaaattccatcccgtgccgatctctaatgccaactttgccgtatttcctaattatacagcccctcaccctcctgaattagtgccccccccccctcttaatcacccttttgaaggtagttgaaaaataaa

SEQ ID NO: 71205 - DNA, 536 bp, Heterodera glycines
  Genomic contig location: Contig_ID=SeqID_43556; Location=947..1482; Strand=+
  SCN-specific regions: Sequence locations=1-121,178-298,333-348,370 -409,437-536
atggagcagcaggtgttttacataattcttaaaatgattttcagttaattgtttgatacaaaaaaataaaaaattcaaaaaccaattaaaaacaggtgagaattcttttaattgggtttgctttataaatatatatttctaataatattaaaaattaaaaaaaaaatattttaatatcacaaaaaattcccgtgttttttccgagtataaattccaatgttcgtcctcataaaactgaatttgtttcactcatcattttaagcgaggcttttcccgctaaatttcatttggccaaatgacaaaaaatgtccattttaaaagtgactcgatttagaaaaaaaatgtgcgttaaattttattaccaaaaaagggaaaattgaattgaacgaaagaacaatttaaattgggcataaaatttaaaattaaatttttttttgaaaattcagtctttcaacagttcaacttttgcaacgcgttacagcaccggtggtcgctgtttttcaacgattccatcaacgacaagcaaattggcttaa

SEQ ID NO: 71206 - DNA, 534 bp, Heterodera glycines
  Genomic contig location: Contig_ID=SeqID_43557; Location=372..905; Strand=+
  SCN-specific regions: Sequence locations=1-534
gaaattctcgactcctgctcgctgatagaaaacccttccgaagcgaaaaagtgccgtgatggagtgaccgatgccaaagtggcgagactgaggaaggaaggaacggaggaaatgtgcgtggcggagggattttgcggaaagggcgagatgaaagagttggagaagaagatggagcggatggagaagagaatcgacgacacgaagcaaaagttcgagaagggcctgagcattattccgccggttgactcgaacccggtagactcagacacagggatcaaaatggataacaagtgaaatagcttgaaaatgagccctcaagcacacaatttcgatttttgaagccctgtacctctagaagaaagcaaaatgctactctaaacttaaaaattcacactagaagtcgaccctgctctatccaatgatatgtcatttatacgcattttcctagttacagctcggaatgttcccttgtaagtataattccaacgaaacattcacaattcgaaatatttccttgtgaacagcgccagcata

SEQ ID NO: 71207 - DNA, 262 bp, Heterodera glycines
  Genomic contig location: Contig_ID=SeqID_43557; Location=370..631; Strand=-
  SCN-specific regions: Sequence locations=1-262
tctaccgggttcgagtcaaccggcggaataatgctcaggcccttctcgaacttttgcttcgtgtcgtcgattctcttctccatccgctccatcttcttctccaactctttcatctcgccctttccgcaaaatccctccgccacgcacatttcctccgttccttccttcctcagtctcgccactttggcatcggtcactccatcacggcactttttcgcttcggaagggttttctatcagcgagcaggagtcgagaatttcct

SEQ ID NO: 71208 - DNA, 313 bp, Heterodera glycines
  Genomic contig location: Contig_ID=SeqID_43558; Location=263..575; Strand=-
  SCN-specific regions: Sequence locations=1-202,226-313
atggacccgaataatggattttatgataaaagcaaagacaaagtgacattggccattgatgtcataactgatgatgaaccaaaagtcgaaaaattcactttggatcaacgcaaatcgactgggacaatttcgatggaaattgaaaaagtgtcggaattttctcgagaaatctttttgagtgaacgtaaaagcaaaactgtgcacatcaaaggattgccatggaaaatatggacaaaaatagaaaagaacaatgaaagcactggcaatgagaaatgcttgggcttttacctttggtgtgatgctccaaaagaag

SEQ ID NO: 71209 - DNA, 348 bp, Heterodera glycines; identical to SEQ ID NO: 62244
  Genomic contig location: Contig_ID=SeqID_43559; Location=133..480; Strand=+
  SCN-specific regions: Sequence locations=1-1,24-160,190-348

SEQ ID NO: 71210 - DNA, 497 bp, Heterodera glycines
  Genomic contig location: Contig_ID=SeqID_43561; Location=345..841; Strand=-
  SCN-specific regions: Sequence locations=1-155,179-196,219-497
tgtacaaagaagggaagtgagtgggaaattggcgaacggatccgatgtcttcatcaagcgattgaatacgaggcaaagattacgtacaaatggcacaacaatggagtgaccttttacagaattcactacgttgtaagtggctgccaattttatgataaatcccccaaatttacacacattttttgggggcggggagaaaaaaatttttttttttttttgaaaaaggcaaacttttcatttttgatatttttgggcagttttttgcaataatgaaaattgtttgttttaagggttggaatcagaagtgggacgaaacggtctgtgagacggaagcggagagccgtttccgcgcctgggactcgtccccgctaccgcccggcatgttcaacgtggagatgttgtgcgggaagcggttccaaaagcggcgctgggagtaccgggtccgctgggaaggctttgacgaaacggaggacacatgggagccggagtacaaattg

SEQ ID NO: 71211 - DNA, 1402 bp, Heterodera glycines
  Genomic contig location: Contig_ID=SeqID_9385; Location=126..1527; Strand=-
  SCN-specific regions: Sequence locations=1-738,760-892,923-1002,1024 -1181,1341-1402
atggcaactgaagcgtgctcaaaaagtacacttcagtaccaggtgaataccgcgccagggtttgatctgagcggggggtggtcagcgaacttattgtagagctttcaaagctcgattttttgaaattttaaaatttcgaaaattttcaaaatttttcgagttaggcctaaaaaacggttttcgggtttttgaattttaggattttttaacgatttttcccagagaaacggagaccacttccaaaacatagtttttcgagctctatcgactggtatttttttcggaaaaatttcgattttttcccggaaatagaaaaaaattttggcctgagcgggacatttgagtcccgggcccataactcgtcaggcgtcggttttagacaaaaaatgccttagagcaaaattgtagagctttttaagctctatctaatggtatactatatgtagggaaattttcaaaaattttcgagctaggccccctagaaattttcaaaaatttttttggggtcgaaaaagggtgtgaaaaatatttttctggggtaaattagggtcctgagcacgaatatgatgtttatttttcgtttcaaaatttttggaattttttaaaaattctttattttttggcaattttttggcccttggaaatttgggctaatattggaaaattcataactcggtgatggtttcatcgatttaactataataaagctttaaaaatagagaaaaataaggagaattttttgggatttatttgggttttctaacttcaatatgaaagaagttattccagaaattctggaaattttagatttttcagaaaaaaattcagaactcgcttctgaaaagtcattctgtaaaagtaatatactacaaaaatccgcaatttttttctctataatataaattttattttacatttttatctcttttttgcgaattgttataaaaataaaagtgatttttggtttcgggaccaaaggggggtgaccaggatttttgagtgaaaaaattttttcacccaaaatattcaaaacatgtctttagagctattttagggttctgatcacaaatctgaaatcagatttcagttattacatcgttaagccctcagaatccctgtgtgattggggattctggtacatgttctgaggggggggggggcaggttcggaccctgacggtgtaaattatttttctattatttttgagttaattttcattacatttaatacatttaaatgttttagttttattaataattaataaatttttaaatttgctttattatttttagagaataatgattttcatttacataattaattattattttttaattaaagaatttcagctattcttttaaaattgaatttgtcaaaattttttcatttcaatttaaataaa

SEQ ID NO: 71212 - DNA, 381 bp, Heterodera glycines
  Genomic contig location: Contig_ID=SeqID_43564; Location=1050..1430; Strand=-
  SCN-specific regions: Sequence locations=1-8,30-79,119-303,325-381
atgttcaacaatattttcttcttctttttaattgttgcgccatttattgctgcttataaaccaagttgcaaagtgagtgaaattataaatataaattgaataatttaatttttaatttcaatttccaattaattcagtgtcccgaaaatgagcagccaggccaattgagttgtaacggatgtgagccgagttgtgacaatcggaaaccggaggtgtgcaccaaaatggcatgtgaatgctcatgcgactgtgtgccgggattgctgcgagacaaaaagacgaaaaaatgcgtgccgaaagagaaatgcccttattaaagaggacaattgagtgataaaaaatgataattaatgcatttggagataattagcgcggaataaa

SEQ ID NO: 71213 - DNA, 451 bp, Heterodera glycines
  Genomic contig location: Contig_ID=SeqID_43569; Location=544..994; Strand=+
  SCN-specific regions: Sequence locations=1-116,141-430
atgtttctgaaaaggagaatctccgagcctagcgacgaagatgaaaaacaacggacaaatcaaattcctatcgataacaattcatgtgttgacggtattccgctgaacatccaatgtaaaaaagaaatcaaataatttttcatcgttacgacaaaattagtcctttttagcattacgaaaaacttatgtggacagagaagagccatttttactggaaaaggacatgctttcctgtccatttgaccaattctctatttggttcggaaatgcgatcacgcaaaccgacctcaaatacgaagaagtgaatggctttgctttgtcaactgtctcgaggcttgtttatgttttctgtattaacttgaccacacccaatagtgatcaaatcatcacaaaagtacactttgaacagacggcaaaatatgctattttcatatctttaacaggaatttaa

SEQ ID NO: 71214 - DNA, 2328 bp, Heterodera glycines
  Genomic contig location: Contig_ID=SeqID_9386; Location=386..2713; Strand=-
  SCN-specific regions: Sequence locations=1-102,223-255,289-498,527 -684,706-959,991-1262,1288-1399,1421-1585,1608-1809,1831-1945,1975 -2007,2031-2057,2083-2098,2159-2281,2303-2328
atgttcgttccacaagttccgctcaatttggtgatcagtaagtgcaaaaatcaatcatttaaaaatttatctaatccaattgcatacgccaccaaaaacaacatattttcaattataaaatctattatttttttaaatgattatagataagttttcaaaaaattattttctgttttataaaataattattttatttttttgctgatattttaatttttattagtaactttgagatgattaatgcaaaataattcgttaatttaattttcaatattttaattaattattcccccttttaattgcttttattttgaagagcacaatggtcaatttttgccaattgcgccagaaaatttggcgtgccgcgaggcgaccaatggcagcggtttcaattgcgagctgagcgtcaaccaaatggtggtggacgacgagtgtagggacgtgtccatttgggcacggatggacaacgacacgagcacactccaactgttgggcgaacaggtgaagaagaagaagaagttgaagcagttcagggaaaattggataagggtaacactggagaattgaatgatcaaaaattcttggaaaattggcacggattttcataaaaaatggactcaatggattttttgggcagttgggaagctggtttttcgaaaaatttaaataccaaggatttttgggaaaatgggcactggaattgatgaaaaattacacagggtttttgaaaggatttttggaaatttgtgagatcggcatcagggatgtgcgaaaatcacaaaaaaaattttcgtatacgaaaacgaaacgaaaaagggcattcgacacgaaaacgaaacacgaaacgaaaaaagaaattttgaaaaccgaaaacgaaacacgaaacgaaaaaattttgacggacgaaaacgaaacacgaaaacgaaaaaatagccatttcgtacgaaacgaaaaaaccgaaaatttttaaatatattcaattttaattaagaactttaaaattgtatcctctaactgagggaattaagatcatagtaggtggaaaagcggatgtggctctaggacaggggtatggccgaaaaattttcaaaataagaacatcaaggacaaaaaattattgaaaaattttacgaaattggaaaaaaatgttttttgtgataaaaactcaaaatttttacgattttgaatagcatttcgttcaattttttatgaaattctatttagtttccaattcgtaaatttcataaaatatggttttattgattaaaaaacttttcaaaaaaccctgatccgtatacgggtccgtattttcctgcatacggacttatacggagtaagggttttccgggtttttagtccgtaagaaaacgaaactcaaaaagtgccgaaaatgtaggacgaaacgaaaacgaaacgaaatttcgtccatccctgatcggcattgccattttcgagttttcagatcaccatgaaagagtgttctgatgaacatggtgtaattgacttttttttttttgataagcttcaaaacttaagctaaaatgaacaattatttcaaactttttggggcgactttttggatataatgaagttttcaaagttgaaaggatttttgaaaattgggaattaaattttcggaagatttttgtaattgtggatttaaatgttttcgagttttcaggacttgtccaattgtaccaaaacggatgatcacatgaattgtgtcgccgaattggtgatcaagcctgatcagattggacaattacaacgagtgccaaccgcggcgattagcaaaatgatcaaaatgccgaaaagcaatttaacagaaaagaatcgacgacgattggatgagggtaattaaaaatttagctcacatttatatatttagcctatttttcatcaactttttttggaagaatttttccgacattttagcgaaatttccttattttaagttttatttttaaaaaatttggtccggcggtgacgatagaccatggaaagaactttttaaatgaaactttataaagaaaaattttacggtttcaaacaagttcaaatttcattttaattatttaggtattttcacccaccctccaaaaaaaaaatttaaaaaaaaaattattattatttaaaaaaaagtatatttgtttataaaccagtattcccagcagggggtttgttttcaagctcgctaatttatggatatgagaattattctgaacaaatcagcagaaaccctacccgcataacatttatggttttgtacaaaatatgcccgaaaattaaaaaatttaaaatacaaaagtaaaggataatttcaataaa

SEQ ID NO: 71215 - DNA, 272 bp, Heterodera glycines
  Genomic contig location: Contig_ID=SeqID_43573; Location=1..272; Strand=+
  SCN-specific regions: Sequence locations=1-186,208-272
gcgaaaccaaccgcactcacactgtctcgaagacatctgccggcgtaaaaaataaaatgcttaatttgcatattaaactggagtttaagcccgccgcacgtcgttcttctcgcttctctctgcctcagttgtttggaacgaaaaagaaaggcggcaagggaaaaccgaaatagaaaagtggaacgggtcaaatgatggaagcaaaaagaacaaatttgatggaaaattgagatgtgttttttatccaatttttttttttgctcctatacata

SEQ ID NO: 71216 - DNA, 312 bp, Heterodera glycines
  Genomic contig location: Contig_ID=SeqID_43575; Location=5..316; Strand=-
  SCN-specific regions: Sequence locations=1-312
atgatcacaggtcggtgtgtttaattttagaaaaccaagaaaaattctcaaaaatttaaatacctagcccaatacgaaaaaatctagaaaaattcgaaataaaaaaaattttcaagttttttttgttttttttttctagaaattcagcaattttagtttttattgacacttagattttcaaaaaagctaaaaataagttgaaatttttttttttgcggcgacgttatcacccggcaacatttcggccggcgatgttttggggtgtacccggaaacggcaggggtgaagatctgctcccgcctattaaataaa

SEQ ID NO: 71217 - DNA, 1065 bp, Heterodera glycines
  Genomic contig location: Contig_ID=SeqID_43576; Location=128..1192; Strand=-
  SCN-specific regions: Sequence locations=1-16,39-129,169-421,461 -936,961-1065
atgattacgccagaaagctattatcccacattacaagtcaaggacattggcaatgcttccaagccaaatgaggagcgattggcacaaattattcgttggaattggggcgaaaatggggcacaacgaatcgttgaagtaagaaatataataaatgatcaaaaaagtgaattaatcaataaaatgttttagacccatacgcttaacaagggcagtgagcttaattaccgtagatgcgacaatgcttcatcatttgtaatccgaattctcaaaaagcgggagacaaaaaagtaaatgtgattaataataattaaaagtggtcgaaacaactgattttttggttcccgtttttatcagtaacaaatgctctaataatgtgcagtgttttttttacttgataagaaattttaagcaacaattggaagacaaaaaacaatgccaactttctctaatttcgaatttccatatatttttgaaaaactaaatgtgactgacgcgttttttactgaagaatttttgggatgggtcctcccgatcactaattgatttaatgttccattttttgttattttccccatttttttaagtgcgttcccggcgtcttccaacagtttaccggacgacgatttgacggtggaaattggtgacaaacaggtgaagaaaaaacattaagctttaaggcctgttctgtcaaatctatcacaaaattcgtccgcaaatgtccaggatttgtaattagaaaatgggtgcggaaggggggagggctcgactttatagggtgggggcataatcactgacaaatgattttgatcagatcatataaatctcaaatcgttgataaattccggtcagatcactgataatctatcccgatcagatggccgtgtccgcccattggctgatgtccgtttccccggtgatcagtcgcatgctcagcgtggagatgaaggagaagcagcagcgaatgatcactttgaacgaattgggcgtggacatggaccaattcaaagaatttttggaggccatcacttatcttacaatgaacgaaccttttctgcccaaccgtaa

SEQ ID NO: 71218 - DNA, 1017 bp, Heterodera glycines
  Genomic contig location: Contig_ID=SeqID_43577; Location=136..1152; Strand=+
  SCN-specific regions: Sequence locations=1-573,597-689,711-1017
atggatcccgatcccgaggatttgggccaaataacaatcagtcacgaactaatcgatggcaaaaaagtaatttctggaagtgtgctgccatttttgggtcaaccgttgccacaacgacttgcaacatttgaaagcatcgaaataaagttgaaaggatttggaattttctaaaaagcatttaccaaatttttcagattcatcaatcggatgtcattcagttgttgcaaaattggaaatcaattttcgagtcgtgcccgctgaatttgtcgatccgtttcttgtctgatcgagtttggcgcctcattgagcgcgacattttcccattgatgtcaaaaaacattgaaaatttggatttgtccgacaacatcgttcgtatatgcccaaccatccttagccaatgcgccatacttcgcactgtcaattacactctcaactcgtcgatctatgacccgtctagttggcaaccagtgcaagactggttgatttcacctcgtgcagacaatggcacgccgttaagaattgtcaatttcttgtgcgaatcagaggccgtcaatttgcagtgcattcaagaacttaaaaaggtaaataaattaaatacattcttaattttcattttaaatggtttttgctaattgctttttcgaaatttataggccttccgtttggccacttcacgtgcctctttcattatggtattttttgatcaacatcgcctttcccccttttcgatcaacaacaaatgcactggagaggaattgacgcttattcgccatgacagagttttcaacaattttaaattggtccgtcatggccgtccaaattttttgccaaaagcaacgctcgatcgtgccgctgagtggcttatggaagatgaaatgcatcggattgtagttaatttgagagatgacgacgttggcgatgggtgagaatgaaaactcatttttagggatcaatttcaatttaatttttaggctgctcgattcatttccatccgccggtccaagtgatcgccactga

SEQ ID NO: 71219 - DNA, 1180 bp, Heterodera glycines
  Genomic contig location: Contig_ID=SeqID_43578; Location=9..1188; Strand=-
  SCN-specific regions: Sequence locations=1-184,206-640,662-1180
atggccgaaatgtacaattggtcggatattgcgcagcggacggaacgcgtttatggcaattcactgaaagagccggagggcagcattaaccacaaattgcgaaagtgaggcaaaaattgaaattttaatgctcgtggagttaaatttcaatgccttttatctttgatcaaaattcgaaaatcggagaaaaaatcctttaaaatttccccgttcattttttcagtcagttgaatgccggtttctggttcgggctgatctgggcatgggtaacagcagtgaacatccttttcgcctcggtgttggattgggtggacccccgggatggcattgagacggttgacaacaaggcgaagacgaacaactgatcgcggttgatcggactgggatttgtgggagggaatgcgcgcataccttttcatcggtttgccaaattcaaacgagggactcataaaagtgttgggggaactgacggaagccaaactgatcagaatgatcaaaaatcaccactgattagagttgaggtgatcgataaatggcacatttccgttctttttttttgctcattttttaattcttcaggtctttttgccaaaattcaaaattgagtcgactccaactttggaagagctgttgccatcgcttggttttaaatgtgagttttcgcaataattgttattttatgaaattagactcaaaagtcattagcataggtaacttacattggcactctctttccactcattggaacttaattgcatcatgttttttatctgcccaaattttccggcacttattgtagattttgagtcgacaaaatattcgattagtgattacttttgataatttaagtcgggactcttgatttgcaaatttttttttttgaaattagttaattaaacacatttttaagaatgctgatcattaatatgctaattgctttggtcatttttgtttttttttgaattctttttccaaatctaaagttgtttccccattaaattagcaacgaaaaacttatttttccaccctaatattttttttgtcaacctctaatctacagaaatgctttttttcctgtataaaagcacttggaaatcgtctaagtctatcactttcgactctttttttttgatgaatctactcactctacataatttcccacacattttccccaaataaa

SEQ ID NO: 71220 - DNA, 287 bp, Heterodera glycines
  Genomic contig location: Contig_ID=SeqID_9388; Location=1639..1925; Strand=-
  SCN-specific regions: Sequence locations=1-1,24-66,162-287
atgggcaaaagcagcaaaaatagcggaagaaaattgaaccgcaacaaattgatggcacaaaaagatgaagaagagaaggaagatgaagaggaggaagagaaggtggaagaggatgatgatgaggaggaggatgaggaagagcagggggaagaggaaggggacaacggccgagagacggagccgtacatcgacggatggacgaacggaaggaccaaaggaaaggcgacaggcagcaatttttttttaacaatctgaacggttttctaaaaagaaactgtccgaataaa

SEQ ID NO: 71221 - DNA, 1320 bp, Heterodera glycines; identical to SEQ ID NO: 9389
  Genomic contig location: Contig_ID=SeqID_9389; Location=1..1320; Strand=+
  SCN-specific regions: Sequence locations=1-738,864-1023,1045-1320
  Gene Ontology: Mol. function=serine esterase activity; Cellular component=endoplasmic reticulum; Biological process=embryogenesis and morphogenesis

SEQ ID NO: 71222 - DNA, 1764 bp, Heterodera glycines
  Genomic contig location: Contig_ID=SeqID_9390; Location=18..1781; Strand=+
  SCN-specific regions: Sequence locations=1-270,303-1079,1101-1764
atgaccgatgggctgagtgtgatggtggcggagcaattagtggacaatttaacccaggggttctcgggattcaccaaccatcggctgatccgcgagggcgccatgcacgaatacgtgtggacgagggtggacccgtcgctgaaagtgtcggcgttgaacgagtccattttggaggtgcactcgtttaaattttgaatgccaatttcggaacggagaaattgcctttgggtggcgcggggggaggggggacacagcggcaaaatgatcggcttattttttctaattatttttccaattaattaatgctctcttggagatggattaaatgccctctctctctctcttctgctcggatcggtactgattgtgattagaaagactaatgacgggcatttgtcggttaggcattttattttgtattgcccccctcaaaagataagggttttccgatcggatatattcttggggacacaaagttcaactttatgtcaacgtttcaaattctttggacccaattcgcagatgttttcccacttttggttcgattcgcccgccgcccgtttggccaattattattctcgtcaggcggtgcccgtctttttgtattcgtttgatcacgtcagcgaaaacttcgagacccaaagtgatcacagcgttactttactttgtttttttgcaattgactaaaaaataccactcttttggccttcgacctataaatttacctaaaaggcccaattttgttttatgaaaaatttaggagttttccacggatgtgacgaaatgtttctgttccaattggagcggcgctttctcgagacgcgcaaagaccgaaattggcaattggacaaacgggtgaccgaactgtttgccgaaatggtggtcaactttctcaaatacgagttcggcactcccagccgccccccccccctccaaaatcgttcatttttagtgaccccactcccgaattgggccgtttcccattcaattggacttcgtccacctcttcaaagttggactttctgtccatcaccgactctcccacaatgaacgtcggcttccgatggcaggcccacgtattctggaacaaatatggtcattcattttgctattttttgcaattgacagtttgcttactgtaatttgtaatacaatatccattctccgttcaaatggcactttatcttttgtttcagtcgaacatttggactccgtcgatgtgggaaatttgcaaaagatcgcttatttggacaagcaactgggcgattatcaggtgcaaaaatgcttatggcacaaatgagacgacggccaatcggaaaaatgccgaaaaagtcgtaaaagcaacagaacactaaacataggcagaacctattgatatgtacatttgtatcttttttatgatcactgattagagggtacgaaggtgtgggttgtttttatagctcacaattttgcgtttttgcgcaaccaaaaccaattgtgtccctcctccgccgccgctaatgcttttcggtcggttattccactgatcagtgatcactgatcagtacagcatcccttttttccgggtttgagtgggttttctttttatcatgccaataaatgataagggcacgtcccatccatttgtgccgtgccattttctgctcccattttcagttggccacttggatgcttctgttctgttcacttttcttcttcgccatactcgtcggcttggcctgctattgcactcggaaggaaactgacgaggacgaactttga

SEQ ID NO: 71223 - DNA, 978 bp, Heterodera glycines
  Genomic contig location: Contig_ID=SeqID_43588; Location=64..1041; Strand=-
  SCN-specific regions: Sequence locations=1-534,556-978
atggacggctcctccaaagaaaacagcacagagcaaaacaacccggacgccgcagacaatcaagaaggaatttcgcccgaaaaagtggagttgatcaactccacgcttgacaaactgtacaacgacccatcctccccagcggcgttcgcaggtgttacagcgctgtggaaagaagcgcgaaaaaagttgaaaaatttacggaaaaaggatgtgcagcattatttggaggggcaccgcacctacactctgatgcgctcccgaagggtgcgctttccaagagccaaaactgttgcggctgggttcatgaccgatgttcaagtggatttggccgattttcaggcgctttcgcgccacaatcggggtcaccgatacctgcttgttgcggttgatgtgctgtccaaacgcctgtttgttgtaccgctgaaaaacaagagagccgaggagatgttggaggcattcagacaactcatcgaccaaatgccaatggtcccacatcgcatcttctccgacaaaggcaccgaattcaagaaccgattgttgaaggaattctttgatgagcaggaaattgagaagcatgagccagtgcattcatcagtcaaggcatcggttgctgagcgggccatccggaatgtgaagcagcgactgtaccggtattttgctcaaaaggagacgctgaattgggtggatgcagtacagaaaattgtggacggaattaacagcgctccaactcgtgttcacgggatgcgccccattgatgttgacttttcaaatgcgcagaaagtgtggaagcgattgtacggacaccctgcccttcaaaagcggacgccacgcttccgtaaagatgaatttgtgcgcatgagcagagagaaagggcaatttgagaagggatatttaccaaattatggagacgaaatcctggagattgatgatgtgttgaaagcggtgcgcccaattcggtacaaactggggatgagcacg

SEQ ID NO: 71224 - DNA, 947 bp, Heterodera glycines
  Genomic contig location: Contig_ID=SeqID_43589; Location=181..1127; Strand=+
  SCN-specific regions: Sequence locations=1-487,509-901,924-947
atgcaattcatggtatgaaagttactttatatacaatcttcaattttgcgctctggaggattggttatcgcgcaccaatatttgccaaccccccctccccctccaaaatatttgcaaaaattgaaacaaacaatttaaaaatagtgatttcacaaaaattcttattttttatccctttcgttagcacaagtgtaaaccaaaatcataatgctttttggcgtaatattttctcgctccctaaggttgacttatttttcgtaattttcttcgataaaattcaaattttgccttaaaagtcaaaatgaaaataaaattttgaatatttcggacattttggcaacaatttttacttttttaaatttttttgcatcgaaaacatgaaattttaccgactttccaataatgtcctaatcttgactattctgaggtcaactatttaaaaaatatggattattggtccaattaaaagtgaagctacatattcataaaaagctactttttagcaaaaatctgtgggtcacattcgtacggctaatttttcgtgccttagatcagtcagacatacagaacccgttacagtatgtattcagcaattgacactttgctacctaatgcaatattcgccacaagttggagctgttgttgtagaacaaccggacgatttgtatgacaaatgcactcgcgtgatgcagtgcgtaaagttgcgtgaggctctcaccaatttggtgcgctgtgtggacaccgacaaaagcattcggttgcgtgctgagcacatgcgcaccatgagggggttggacatgggcaagtttaacggtcgctttaccaaatgcgaacagtggaaagtgatgtgatgatcaaaacattaatcaaacgatgaaatgtgttcattgcaactaaaactttacattatatatttttcattaaaatttgctgtatccgattaacaa

SEQ ID NO: 71225 - DNA, 625 bp, Heterodera glycines
  Genomic contig location: Contig_ID=SeqID_9391; Location=2325..2949; Strand=+
  SCN-specific regions: Sequence locations=1-595,617-625
atgaccacggaagagaaaagacggccaattgagacggattcccgcagatttgaagagaccgggatgttggagagcaaaaactcgcggaccgcctcttgcgcatgccccggcgacgcggaagggcacggtgagcgattaaaggcaaattgggaattggcatttgcattaagccagctttttatctgcacattttttgtccttccttctttgattaaatttttttccgtcccttcgatttttacaaattttactgttttaatccatttttttaaaccaaataaatccccgcttagacccgcgcatttgtcggcacgcccgcttcgtccatttcgccgcttcgtcctcctccacccaattgccttcgtacgaaatgaataaaatggcacccaacagaaaaccaatcattcgaagcgatttgccgaagaagttcagcatcgaatggtttttgatcacttgaattgcttagtaattaataacttattaactcaattaatttggcttattaaacgttaaattctttttttaggattctcagtgatcattgagcacctaccgtaagcattggtccatcatattgtattttttgtctcaatttattatttattgcttatcttttggaacttta

SEQ ID NO: 71226 - DNA, 811 bp, Heterodera glycines
  Genomic contig location: Contig_ID=SeqID_43592; Location=1..811; Strand=-
  SCN-specific regions: Sequence locations=1-632,654-657,679-811
gtcattgccttcgcgttccgatctgcgcgaagaatggatgaacattcgcaagaatgacgtcttctttctgcttaagcttaagcccatccatccagttgggcataaattcgacgtccgaaagccgttcaaatcgcaatttgaaattgaatatttgcgggggtgtgaggtggaaggaattttggggccggacggaagagttttggacgaaatgggtgggcacaggaatgcaaatttggaagttgattcatactttagagaatcgcgacatcatccgtaaaattccgggcgatttgcgcatttaccgtgtccgttttgacgccaaccaatacagagaagacgcgttgaggggcgtggaaaccgacgtttatttcaccttcaatctcgtcatccgacgcgaccccaaaactaacaactttaaagccgttttggccacaattcggcagctgctcaacaccgaatgcgttgtccccgattggctgcacgatttgatactcggttatggcgagcccgacactgcgcattactccaagtaaaatgggcgaaattagactgggtcaaacaaaagagttggctggtttaataagtgatcactggctttcgtaatagagttccaatacgacactcctgttaaggatgaatagcactgtggccagcgtggatttcaatgacactttcctgtcatttgaccacctgaaaaagtcatttcccggcaaaaaacataatttgtgaagaccaaaaaccggtgccgcctttcaggtcatttcccttttactactactgattgttgttgcatttgtcatttttaaccttc

SEQ ID NO: 71227 - DNA, 327 bp, Heterodera glycines
  Genomic contig location: Contig_ID=SeqID_43596; Location=292..618; Strand=+
  SCN-specific regions: Sequence locations=1-327
atgtgttatgtgcctgccacaacaaccgctcaacgacgcacagatgccagcacagccgttaggtcgccccacgagcgtgcatcccacattggcgcagcgaaccaaccaagcgaggcggcccgccaccgacacattgccacgcagcagccatacacaggctttcacacgtgcagcactgagcggtataccacagctccaacgtatggaagcaccccaaaagcatggatcgtgaggcagctgccccgtaatgttgggcagcgtccacaagtcatctcgaacgacctgtgcccatcagcggacgggggcatttggtggtgccaacgctag

SEQ ID NO: 71228 - DNA, 378 bp, Heterodera glycines
  Genomic contig location: Contig_ID=SeqID_43596; Location=737..1114; Strand=-
  SCN-specific regions: Sequence locations=1-64,132-267,303-378
aaatagttggctcattgcttctgtgggcacaactttttagagggattttcggtgttcagccgcacgaaattgagcaataacaggtctgtgatgcccttagatgtccggggctgcacgcgcgctacactggcaaaatcagcgtgcttgtccttccccgaaaggggttggtaaaccggtgaaaatttgccgtgattgggatcggacattgcaattattgtccgtgaacgaggaattccttgtaggggcgagtcatcaactcgctctgaatacgtccctgccctttgtacacaccgcccgtcgctgcccgggactgagccatttcgagaaattcggggacggttagtgttccggcttcggtcggtatgcagactggaaccg

SEQ ID NO: 71229 - DNA, 3627 bp, Heterodera glycines
  Genomic contig location: Contig_ID=SeqID_9393; Location=96..3722; Strand=-
  SCN-specific regions: Sequence locations=1-144,166-315,337-355,393 -414,436-510,535-670,692-707,733-877,899-925,947-947,969-1014,1036 -1235,1258-1506,1528-1979,2001-2037,2069-2744,2766-2855,2879 -2939,2961-3318,3341-3577,3600-3627
  Gene Ontology: Cellular component=nucleoplasm; Biological process =chromosome segregation
atgagaaaaagaaaaatgaaagcaatggtttttcgcccgagaaagtgggacaacaacacaattggcacagaaatcgaaattggcacaattactcaatgcatagtgatatggagagaaaccatggacgctgaactgttggcagttctaacaaaagttgaagaaatatgttacgaactgctatgcatttgggttgtccccaaaggagtgccaattcatgttatgaagaaaaggtttccggcaattgttcgagtaccggaagaagaaaatatcaacaatttattaacgaagttggagcaaattggaatgccaattgagaaaaggggcgaacaaaaatggcacgagacagtggcaacaaacgcacagaaagtgaattggaaccaattggggaatggacgcagagagaaggccgcgggaagccattcacacaattcatttgtgccgacacatttttcatcatatttgccaacaactactaaaatgttcttcccaactccggaaatgccgaaaaaaggtgaaaattttggaaaaatccaatcagaaaattttgatccctttgtggtattgggagtaaaacgaaagtctcaatctccagaatcaaattatgaatatgaagacatttttgaaggccctttgtgcacaaaacgaacaaaattttgggtaaactcaaaatgtgaaactacaaaaacagaaccgttggacgtcaaaacatttttcaaaaatgaaaataaggaaatttatcagccacattggaaaccaattgttttaagttcaccttcaggcaaaaaaggagctttctttttcgggaaaaattttgttttttccaattttcatccgtcttcttttatgatggatggctttaaatgggataatgtggaacaaaaatattgctttgaaaaggcctcgtattttggttattttaatttggcaaaaatgatcaaattcaaaaatgggatcacagaacccagtgaattcaaaaaatttacagacaaagacatggaccaatataagtcgcttgaagaaaatcccaaatcttttgatcagtatgaatggaatagagttcgagaaggtgtcattcgccctattttatgggcaaaattcacacaaaacgaaaaatttggtcaaatgttgttggaaactggaaagcttccattatatgaagcctcagtcaatcttagctggggcatcggaattgacattagagaaagacagctaattttttcaaacatggaccaaggatttaaaggcaaaaatatgtgcggtcgtctgttagaagacattcgccaaaaacttaacccaatgggtacggtaaaccaaaaaaggcccacaaatcaaataaatgaaaaagatttagaccaaattttgaaaaagattgaaaacgacaggaaaatctctgttttcaaaactgaaaatattttgagacaatgtactcggattaaagaagttgtcaaagaaaattgggacatgaatgtatttatccaagggagcatatacaatggccttggaagaaaagaaagtgatttggatttagttatgataaactcaaaaggaataccgaatgattggacaaaaaacgacagttgccaattttttgacaaattgcggaaaaagttaagagaatcgggaatggcattaacccggactctgataatcccttcccgaaatgtctctattttggaaatcacaattgattctgatgaccaagaaattaatgctcaaattagttgcaataacttgattggattaattaattctaaatggttggcatgttatgtgcagttggatgcacgatttaaaactttatattttgccattttggaatgggctgactattttgaaattcatcaaagtgctaatggaggcggcaccttaaattcttatggttggacatcgctcctaattttttatttgataaaaattcctaatcccgttttaccaaatttaatcaaaattttaccagaaatttttgaaattcgaaatatcacatacacaaagaaacaaatttttgaaatactgaaacaaaaacttatttgggagacaaccaattcccagagcatttcatcactgctcattggattttttgaattttatacaaaaatcaattttgaagagagccgattgaatatgaaagaaggaaaaatcgatttttgggagaaaagtgctcaggaaatgaaaatgcatttattcattttagagccgtttggtgctttcaatgtcgcaaggagtgtgacacaaaatggatttagcaaaatcaaaaatgcttttcatgcaacttgggaaaaattaaaattcggtattcaaaacccaaaaaagctgttagaagcaataaaaggaaaggaaaatgacgaaattatcgaagaaaaattgaatttgaacagaattttaatatctgatcaggaattagtccaaggacaagaggcaaacacaccaatggacagtgcgagtaagtcaagaaaatgggttcttaattcacaaaaatatttcttcaacgctttaatgattatcaatataataaatttctgtgtagccacccaaccaatgatttgccataatagagcccaaacaaaattggtccaattcaaaagggacacctcttcgtgcggaaaaatcagtagatttcttgaacaacccacccgagctttaatgctagatttatttcggccaaacccagataattttcaatttgaggcctggagatgcataaaaactagacaaacacaaaaatacagaactgatttatttgggtacaaaattgaagaaatccctgatcaaattcttttaccaaccacttttgaagattgtcatcaaatggcaatttacaaaaaatgtgagtttggtgttttgtcaggagaaattggccaaaaacacaccaacaaaaaattaatcattgaacaatcatggtggaaaattgggttccaaaaaaccgagtccgaaaattgttttttgtcaaaaatcactttgtttggaaccccagggtcagacataatacattcaccagcagatgatacaaagaattgtaaatactcagatggacaatgccagttagaaaatggtgtttatcttttatgggagattaagaaaaacattaaaaatctttttgatgaaaaaacttgtgtttataaaagggaagcaaaaatcaatggcacttatgtcccaggtatttggatgtcaaatgataacaatcgggctttagtttttgatcaaaattcaaaaaaggtagagtcatgtggtgaaagattgcgtgttagtgcgcaaggatttgcaataattgaggaacaatttaaggaattaatgaaaaatgagaaaaattcgtttgatcaaaacataagaaacaaaagaaaaagattcaaacgttggaatactcctttctcaagtgaaatagagaagagtctgtatcgtttcggcgcaaccgtttcggcgcgaccgtttcggcgcaaccgtttcggcgcagccgtttcggcgcagtgtcgtttcggcgcaagggtcgtttcggcgcgaaaccaaaaaaagggtcggaaaaagtcttgactcaaacttgaaaaactatttcacagcttacccaaaattctgaaaaaattcctatttatataacttttgataatgatcaaaaaagtctcttacatcattaaa

SEQ ID NO: 71230 - DNA, 732 bp, Heterodera glycines
  Genomic contig location: Contig_ID=SeqID_43604; Location=102..833; Strand=-
  SCN-specific regions: Sequence locations=1-98,137-222,246-434,461 -561,583-732
atgtgccgaagagattgccgaagaccaatgggacggtctgatcatttccaagcaccaagacggagtgatcagctacgaatcgaggcaaatttcaaatgaaaaatattttaaaatttggatttaaatttaaaattaagccatggattcgacgacattttcggcaccgaacaaatgaaaaaaacggaaaaatatttggaaattaatttgaccaaaagtaaagccaaattaataataatattttaatagtaattaccattttacagatgctgaaccacttggaaatgaacttcaagaagcgctttcttctgcagcattttttgacgattttatgccatttgttttggcatttgaatttggcgcaacattttgcggagaaaacggcggtaccaccaaattgtgcaaagagaaagttcaattttcatatttaaaattcgtaatttataaataatttcattttttagtgcctttcccaaacattggtcgccccaaaaacaaaggcaccgtttgttggcacaaccaaattccatggcacaacgccacgctctgtgccaaaaacaacttttggcattgtgccaacaactgaacaaacttttgcctttaagccatttgtgcggcatgtagaccattttggcacgaattgtacccacattttcttcacgtcggaagtggacaaattcttgttgaatatcaccgcgacgccctacgaaattgcatgcaatgactatgaaaaac

SEQ ID NO: 71231 - DNA, 819 bp, Heterodera glycines
  Genomic contig location: Contig_ID=SeqID_43605; Location=923..1741; Strand=-
  SCN-specific regions: Sequence locations=1-659,686-768,811-819
aaaaaaaatcgattttttcaagtgtccgtttgggggtactcaaacaattatgggggagcaaaaatccaacgcagaattaaagtacaggctatagggaagctattcccgaaggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacaggctatagggaagctactcccgaaggattcggtctccccataaatctgggcgcgtcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcagggggactgccccgaaaacccaaaaaaaaatttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagact

SEQ ID NO: 71232 - DNA, 541 bp, Heterodera glycines
  Genomic contig location: Contig_ID=SeqID_43609; Location=73..613; Strand=+
  SCN-specific regions: Sequence locations=1-1,24-63,85-85,109-118,140 -310,333-357,379-474,498-541
atgaaaatgaaaatggcacatccgatgagcaaaatggaggtcagtcagtcattggataaatgaatgatttaaaatattggatcagcaaaagtaaatttgtaataatatttggattacgaatttaaaatgtattttatatcggtttatctcagttgggcgccagcagatttttggattataacttttttctttatcaaccaaatccaacaattttagtatcattcgaaagtcctccttagtgtctgtcttctattatcctgcaaaattacaaaaaatttcgtcagggttaaaaaaaagttatagccagaagaattaaaaaatcatattttccaacttttttggccataacttttttgaaccttaacaaaatgtatcaaaattttgcagataattgaggacacttagggctttatttggttgacaaagaaaaaagttttagccaaaaacgtgccggcgcccaactgatgggttccgatttaaatttttatttaaattttctttttggtgcctttgtttttatgagtaaatgtttttggcacaa

SEQ ID NO: 71233 - DNA, 441 bp, Heterodera glycines
  Genomic contig location: Contig_ID=SeqID_43611; Location=411..851; Strand=+
  SCN-specific regions: Sequence locations=1-180,202-244,266-441
atggacacagctcagcgcaggattgccatcagaagaaaattgaaaaaggacgaggcttacgatgatgatgatcaacgcaaaaaatataggatttatcaaccaccaccactgcctcgcgcaaaagtaaaagttgagcacccgaggcctcctccaccccggccgcgtcctaacgtcaagagagaacaacaacaaaagccaaagtcagaattcaaaccgccggcgacatcaaagaaaaccggtcaccccactccggcaaaaagagtgccagagtttgttgatctcgatccacgaccatccacatcaaggcaggccgggtataacccgcctcccccgacgcccaaaataaaacatgagccgacaacaaagagacctatgccataccgtatcccaaaaagagaaccaaaagtcgaggaagcgccacaacagcaacagcctcagtag

SEQ ID NO: 71234 - DNA, 169 bp, Heterodera glycines
  misc_feature (24)..(24): n is a, c, g, or t
  Genomic contig location: Contig_ID=SeqID_9394; Location=1..169; Strand=+
  SCN-specific regions: Sequence locations=1-169
ttgtgccgcgaagcttgcattacncatcgcgttattcttttccgatttataaattcgatctgattttttcaatgatctgggtttaggagaccgcccaaaaagactcgcattttaaaaatttgaaaaaatttacggaaatatttttgtctgccattaccaattaatcaaa

SEQ ID NO: 71235 - DNA, 3546 bp, Heterodera glycines
  Genomic contig location: Contig_ID=SeqID_9394; Location=1710..5255; Strand=+
  SCN-specific regions: Sequence locations=1-62,84-249,278-796,818 -1162,1184-1207,1231-1378,1400-1533,1556-1915,1937-2504,2526 -2645,2668-2870,2893-3196,3221-3381,3404-3450,3472-3546
  Gene Ontology: Mol. function=microtubule binding; Cellular component =cytoplasmic microtubule; Biological process=microtubule stabilization
atgaagtgctgccaaatctgtcatggaataatttcccgttatattctaaagtaaaattaaatggagggggcgggagggttttgccgaattttcaaatttttactatattataattattgagagaactaaaaagtcggcacatttttcctccccggtacattcttccaacaatgccgttttgtcatttttaagccggcagtcggagttcgtcgccaggccgcgctcgtcacccgcctccacgaccgcctcctgtcgctgctgctgctgctgccgctgcccatcacgcgccgattgcggccgcgcgaaagctgcagaacggacgcgaccaccacgacattggcaatacgccaggcaattttttgttttaaaaatcctagcaattttaaataacgaaattattttagtaaaatcggccgcttcacatggacaaccaattcacaaagactttgttcgtgctttggtcgtacatttttcgattcctttctcttctgatttcgctcctttagaaaaacgtggacactcaggcgagggatgtccgaccaaatgacatacggttggtcatttttggtttatttgggccatttattcctggacatatttcaattaagaaatgatgatctgcccgcagcaaatgtccgttctccgccgaccgtgcaaccttcgcatcattttgcacgtaattctttgtcaaatatgccaatttgattaatttaggatgggataatcttatgcaatttgggttaatgtcttgaaatgggatcactgttcatcggattcattaccacttctgcgttcgaaaaattttaacgattttaaaccggtttttttaaaaaactttcatagctcattaaaaaggaaaatcgcttgaaatttttttttggaaactttgtacatccatcgaagtcccatccgccattttcagcccgccccagcggcagtccgtccaccgatttctacggactctcacaacggcaggaggcggtgctgcagcggatcagttccgaggagcacaacacatcgggcggcagtgtggggccgtttccgcgaaagtcgtcggccaacaattcgttcgtcagcgacaacaagcgcaacctgtctatgcgcgacagtgggggcaacactcttcagaatggccaacataaggcgagcgttttaaacggattgtcagtctgtcacactgcaatttatgtcgaaattcgttttataattaccagtttttagaaatgttttcccatcttttggtatattttgatatttaccgaggtccgaagggtgcacttataaaaaaatttttatgatcggcgggtgggaaacgaattgctccgaggttcgaatgctttttacgagtccattttactctgtttttcatttcttagcctatttactttgacttttttaatttatataagacaccaatttgcagtggtccttcctgagctccgaacagttggccaatgaccacgagcagcaaattgcattcatccaggaaatatgtgacacaattggggccaatgcagtgacgtaatattcacattttgtttcgttttttaatttgtcaaaatttagcaatgaaaaggaaattgaggaggctcttcaagtgttgtcgcgaatggtaaggaaaagcaacatttgtaagcattcacaatcacttctctgttttttaagatccgcgaaggagggattacgctgtggaacgattattttaacacaattttcttcgccatccaacagatcatttctcaagatttggagcgtcactttaacatcatcaaaatctcggcacttaaaacactcaaagagttgtggtgagttggcatttgttgagggggggggggtgattaattagggaccatttgccaaaccaattatgaatcatttcattaggcactcaattaaattaagagaggcggcatttctttttctatcccttttttcagcttggtccagccgaagcgtttggttgccaaaactgaacttttggtgatgatcattctgaatgcgcacgaatgtgaggatgccaccgtggtcagagcgggtaattctcacagtgatttgtccacttttttggtacaacggctcggcatatccgaactctgccccccccccccccgaaaattaaaaaatcaaataaattaggcgaaacgtatttgcttttccgttttgatgccgtaccccattatcctcaaatgcagactttgtgtcgcttataattctctcgccagagaaatttgcataaatatgaatgcgtcaaacgtttgataaaaaaacggggtgtgccaccaaaacgtaaaagtaccgaaacgtaatgcacccattcgtagattggtcaatttcgtattatgattgcatgcgttgattacatttgttccccatctccgttcttcagccgaggattgcggtgctgcggttgccaaccatttgccgaccaacacgtgcatgcaccttttgctgaccgtcatcgacgacaaacacagcaaataccaccaactgtcgggagcgatcaaaatgcttggaagtatgctctccaaactgccgccagaagaagtgagagagggaaacaaagaattgtttattcgtttcattttaacacatatttcaggtggttgaactgctccccaccgttgtgcctcggatgactcaggtaaaaaagaagcaaattggacacaaaaggagcaagcacttcatttaccccacgaaatttttatttttattttcaaaaagattctaaaaagttatgaaattttcagtcacggaattttctttaattttttctttttttgaagaatttctaagtgtatattttttaaaagttttttggatcgggaggggtggaaacgaccggctctgacaaaaaagtaccagcaaaaaaaggggggaggccgaatgggtggaattgccagaagagcatataaccaaccagtggcaaatgtttttcccattttctacaattttttcttcattttaatttattttggaaacggaaaactcatttacacttcccatttgatttttatgtgaataattcgttgattttcctccaaatgctctctcagtgctacgacaattcccagtcgatggtccgacgttcggccatcatttgtttggtttccatcagtcattcgattgggttgaatgtgttaaagccacacctaaacgcagcgacggttcgtttttagggttggggttaaatgagtttctattttaattttatttttgattgtgtccgttgttgttaagcttaaacttgtggacgtgtaccgcgaaagaatgcttaagcgatcggacggcggtgcgaacgcatgagaagcgaatgaatggataacaaacgaataatccgaacacagcaaaaccgtccaatcaaatcacttaccaaaagcacccaaaatatatttattttcccaattgcttttcctttttcttacgttgtgttgtattaattcaattcttgcattattttattttttggtgggaatgtccgttgattgtgagccgtgctcttcataatgataatgaccatcatttgtcttcactgttttgtctggttga

SEQ ID NO: 71236 - DNA, 383 bp, Heterodera glycines
  Genomic contig location: Contig_ID=SeqID_43614; Location=630..1012; Strand=+
  SCN-specific regions: Sequence locations=1-20,42-275,297-383
atgccaaaacaaaacgaaatcgttttaaaatattcctttctggacttgacttggtttcttgatatcgaagctgttttctacgctatttctaaaacggtgataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaacgtatggaaagaaaaaatagttatttctgggactttttcagaaatcagaattaattctccaatgtggcccaaattttaggcccccagccacagccccttgcttctcccagttttaagtcttggatttgtcaa

SEQ ID NO: 71237 - DNA, 49 bp, Heterodera glycines; identical to SEQ ID NO: 51181
  Genomic contig location: Contig_ID=SeqID_43617; Location=399..447; Strand=-
  SCN-specific regions: Sequence locations=1-49

SEQ ID NO: 71238 - DNA, 510 bp, Heterodera glycines
  Genomic contig location: Contig_ID=SeqID_43619; Location=181..690; Strand=-
  SCN-specific regions: Sequence locations=27-254,285-293,331-510
  Gene Ontology: Cellular component=membrane
atgtgcggagacggggccaacgactgtgccgcgctgaaggcagcacatgccggcatttcgttgtccgaagcggaggcgtccatcgcggcaccgttcacttccaaagttgcggacattcgatgcgtgccaacggttggaaatgatttaatattatgcacaaaaaagtcaacaaatttttggcgaacttttcggcacaaaatgacaaattctattagtaatgaattcggtgaagcggtgctgactgacgccgccgcaaaaaaaaaaatatatatatatatatattaggaaactgcaatttttcaaaaaaaaagttattaaaattttttatttgcctataacccccctcccccccccccctccgttttacagatcattcgcgagggtcgtgccgcgttggtcacttcgtttggcgtgttcaagtacatggccggctattccctcacccaatttgtgaccattctgcaactgtactggctgaacaccaacctgaccgacttccaagtaacttag

SEQ ID NO: 71239 - DNA, 774 bp, Heterodera glycines
  Genomic contig location: Contig_ID=SeqID_43620; Location=421..1194; Strand=+
  SCN-specific regions: Sequence locations=1-261,283-394,416-774
atgtttagggtcactgcacgctatttggtaagacttggattaatggggaaccgcaccacacacatttgcagtctctgctctgactgataattactaaatatcgacgatactgatagaaccatttactgttacagtaacaacacttaaccgtaatgctctaccggcgaagcgtcagctgaaagggggagcagcccggaaattagcaccagttcaccaccatattcatacaaattgtctaattaaagttaataatttataaggttttagttaaaaataaattttagatccaaaattttgatgaggacaattactgtttattttacgctatgcaagcaacactggttcgatcaattagttacttggatcgtcgtcgctttcatgattacgtcaatggaaacagtgaaatgagaggaaaacttaaacatgatgctttggaaatgatgaatgctgttaattcaccagctggccaaccaattacgatgcggaaatatatgtgccgagaattgtggactggtggaatgggaaaaaattcgttggtcaatggaatttcaaaacatttgtcttcggatcggcaggccattacaagcctttattcaaatatggaccagaggactatgttgtaccgatcatcctttacttcgaagaggggcattttaatggtgtgcagaaaagtgggaatttgttcggcaagccatattgtctaagttgtgaaaagacctacgatcggccaaaacgtcacattgttaattgcgaagcccgctgcgttaaatggta

SEQ ID NO: 71240 - DNA, 676 bp, Heterodera glycines
  Genomic contig location: Contig_ID=SeqID_1273; Location=182..857; Strand=-
  SCN-specific regions: Sequence locations=1-391,413-497,519-676
atgcagaaaacagaaccagttcacttttaccaatcagcatgtatgatttttttacaattaatttttttctattcattaatgagattaattaagtttggaaagaaaacatctttgcacaaaaactttacctttaatgtcgacgatcagagagaatatgagtttacactcattttcaatgacacatataaattctatgtgaatagaattttgttttacgaacagaacacaagcattacgccggcttgggcaataaattttgtccgggtaattaacgtactaattgggcaattaacacttttattgaaaaggtggaaggcaatgtgaatctactcgaagagccatcagtgaatttcacggaagtaattaaagggaccggatattcattctccaaaataatattagcatttttattgtactaatgagagatgagttttggtttcattaataaatgccattaaaaaggggcggggtggggcttaaagcaagcaacagattaaatttgaaaatattttttaattcagtgcgaatccgaagatggcatttcaatggaactgtattctttgcttaattatggagaattagtgaaaattgaaggacgagtggatcgtaatgccacagtaatcaaaatttatttgtttcatgaagtggcgcaattcaccgaaatgagttaattaaa

SEQ ID NO: 71241 - DNA, 430 bp, Heterodera glycines
  Genomic contig location: Contig_ID=SeqID_1273; Location=1547..1976; Strand=-
  SCN-specific regions: Sequence locations=1-309,339-430
atgcttttacttgaggagccgacaaccgttgaaattgatgtaagaaaacataatttgttaaaaaattaaaaattgaattaagcttatgaacccagtgaagctcaattacagcaaattctaccaacaaatttgtatcggaacaaaatttttgttccgtgtccaattgttggaaaacaacgccaaaaattgcaaaaacgaaaacaattttgcaatcagtttgttgcacaaccgaccagaacagcacatcagaggtgtttttcatatgaatgaaaatctaatcactgatagtcggaattaaaatggtttcttggcataacaaaaataatattttgtaaattctatttaaatttcgaaggcgccttgccgaagcaaaaattgccttttgtttactccttaaataattttggcccaaattttttgagaaaataaa

SEQ ID NO: 71242 - DNA, 1112 bp, Heterodera glycines
  Genomic contig location: Contig_ID=SeqID_1273; Location=3223..4334; Strand=-
  SCN-specific regions: Sequence locations=1-84,124-492,514-586,647-1078
  Gene Ontology: Mol. function=aminoacylase activity; Cellular component=cytosol; Biological process=amino acid metabolism
atggacccatccgccgtattccgcgcacaaagacgcgcagggaaatatttacgcccgggggcacaggtaaagcgcgtctttttgtaatttttattattttttttgtattaatttaattaatttcttgaattaaattgttgaggatatgaaaagcgttggtgtccaatacattgaggcattgcgattgcttctcaatgccaacgggcacaagcccttcctgcgcactgtgcacgttttgttcgggccgggtaacagaaacaaaaaatgccgaaaaaaattggcaatgaatttttttcccaatttgagacgaggaaatcggaggccacgatgggatggaaaagtttgttcagacagacaaatttcgggcgctgaatgtccggctttgcattggacgaagggttggccagcgaaacggatgtcttccgcgtgttttacggcgaaagggccgtttggtgtaagttttaattgccgaaaaggggaaattttgacaatttcaattcaaattcaaatccattttgttatttttaagtttgtggcacagctttaacacattcaaaagaatgtaaaaaaatgtacaaaaaagagcataaaaaagtattaataaataatttagttcatatattaaaaaaataaaagtaaaaaatttggtccaattttccggctttcattgcttatattttcgcaacaatttgcccattttgtgaacatttttcatatttttattctgattttatttgttttttcagggatgaaaatcatttgtcgtgtaggtttggcatgttaagcatatgttttcttgatttccccattgaaaagcccctggacacggatcacgatttatcgaagacacagctggggccttatgctcgtctcgcggtttagagctaaaccacggttaacggcgttaaccgtggttaaaaatccttaaccgcggtatgctcgtccttcccttcttccccgtggttaaggctaaaccacggttgagttaaccgtggtttatttccaaccggtatgctcatctaaccgtggtttaatctttcttaaggaatcttaaccacaactcgagttgtggttaacgtaaatttatttaataatttaaatagtaaaataaa

SEQ ID NO: 71243 - DNA, 850 bp, Heterodera glycines
  Genomic contig location: Contig_ID=SeqID_1273; Location=5876..6725; Strand=+
  SCN-specific regions: Sequence locations=1-77,99-155,177-211,233 -475,529-588,610-850
atgcttacgactctggaagagctcaaagccacaccatgtggcactcagcttgcgtaagtgcttgaattagtaatttgttttaagtaaaattgttaaggtctttttgtgggcagattgtaagcattttaccgtctgagaagaagttgacggctttgttggcgtgtgcttctgggaagaatgttgttctcacagaatttaagagcgtgtcgtccaaattttcaaaaatttgttcccttggaattgtaagtttgctgtttctatttacagatgcttaccttactaaatacaggtcgtcaaattttacatgctgaaagctcaacgctttcaagagcgtttcgatggaaagacaatttacgttacgccactggattatgaatttgtggtgatgactttcacaagaatggagctgattcaatgtgccattgcgactgcggattcatttgagaaattgacttcgggttgcatttattgtgagttttaatttttttattaatttataatatattacttggtttgtaaaagtgtttataaagcaataatatactcttcgtgcttttgataaacattactgtttgttctgtgactttcgtgtgagacacaaatgtgtgtcatgcttttgataaagcataagtggtttgttctgtgactttcgtgtaagtcactaatgtgtgtcatgcttttgataaaacattagtggtttgttctgtgactttcgtgtaagacactaatgtgcgtcatgtttttgataaacattagtggtttgttctgtgactttcgtgtaagacactaatgtgcgtcatgtttttgataaacattagtgtttgttgtgtgactttcgtgtgagagataa

SEQ ID NO: 71244 - DNA, 1443 bp, Heterodera glycines
  Genomic contig location: Contig_ID=SeqID_1274; Location=1683..3125; Strand=+
  SCN-specific regions: Sequence locations=1-4,26-370,392-451,473 -861,883-904,927-1141,1171-1443
atggcttcttctccttcttccccctctccgttgttctacgttttgtccgttttggccaattccaatttgttcccttttttcttcgccctttccattggcattccgtctgctttgctgtactgcttggagttggtggtaatcgtcgccaattttgctgatttcaattccgctttttttgttctcgtcgcttttagggtggtttcggtaaatatttaaaaatgaaatgccaataatcaatccgttcactttagagtttgatcaattttgttttttcattttttgcccaacgcttcggcgaaattggcctctttttggcgctttatcttaatttgccccgctttgtgttggcttcgtttttcttctttttttattacacattttatattgaaaatttgctgaccacttttttgctgcttaatcgtttcacggccattttattcccaacaaaatatgaaaaggtaaactaaattaaatgattatttagaataatttctttttcagttatggcgccatggattgccactttttttggctgtcacttttattttgccgttgcccttaacaatcccaattttaaacaagggcacatatatccatgtgcaagatgacaatgccacatttacattggacaattataaaacagacaatgttcgctaattagcctaattagaaaatgatttttaattgttgattaatcattcgtttagaaatttgattctagtgaaattgccacttcgttttccttttttgttggcgtcgtttgtcttctgttaaatttggcctcaattgtagcttataaattgaggaaagttggtcatcaaaatgcaaccattgaacacaaattgactattttcacaatgattacattttttggccatttcatcgccacaatttcttgggtaggaattttaaaattatttaattttccttttaaattctttaattgcaggttttggtttccctgacttcaataaatgaagtggatgagcaaaacaaaccttcttcatatgtccaaatgtggtttggcctcactttcgaggaaaacgaaaccctttttcaagcaaatttcaatcagtttccctgggtcaatgatttgtccatgttggccatcccggcatggtaaaaacaatggcaacttttcaaataatttattaatttaaaaatattttacactgtctttcattttaggcttttgctttgggcatcgtcaaaaatgagggaaattattgccaaaaaatttaattggataagaagaaatggacaacaaaaaaacattgcaattgtaacagtgaaaaggaatgttgtgccaatgtctgccaaagttcagccccaaaagcatttattgaccaaccaacggaattaatgttgtaatttaaacgtatcccaggaatattaagatgaaatccattcaaaaagagcaaatcttttcctaaaattacataa

SEQ ID NO: 71245 - DNA, 1480 bp, Heterodera glycines
  Genomic contig location: Contig_ID=SeqID_1274; Location=3132..4611; Strand=-
  SCN-specific regions: Sequence locations=1-312,334-350,373-433,477 -632,656-712,734-857,889-1266,1292-1380,1403-1413,1437-1480
atggagcaaatgggtgagcatttggtgcacgttctgaatgccatggatgtgcagaattgcgttggcattggcgagggcgctggcgcggacattctttgccgttttgctgtaaataaaaaatttaaaaaacaaaatctttttctaaaaatcgaatggctaattaatcccagatggcttggccaaaccgtgtccttgggctggttctgatccattgtttggccacttcgcacggaatcatcgaaagcctcaagcaaattgttcgtttgccattgacacaatgacagaatcaatgaatggtggcaattaaaatagctattaatttgcaaatttagttcttaaatttgcgagtggaggacgggaacatgaacaatgccgcgtgggattaccttttcttgcacaaatttggattggtcaatgtctaaaatttaatgcgaaataaaaattgaaaataattaattaattcttttaaaatatttcctcaaaatttagcacgaaaaaacgttgaaagaagcgttcattgccgagctgagttccgtgctgaatacgaaaaatttgagccgttatctctacgcgtacaacaaacggacggacatttgcggagcaatcggcgaaaaattggcaaagtcaaaaaggaattaaatttcttttttaaattgactcatttgcttttcagcattgacattcttctcgtcaccggttcccgagcctcccacattgaggtaaaaaaggcaaatgattggcaaaaccagtggaaaaatggcttttcccagaatgtcagacatatgttcgagaatatgcgccgagaaaagagcactttgctcgtcattgacgacaaaatggacgttttgatcgaagcagtaaattcaatttaaaaaatgcacttttttaaaacatttctttagcccgatcgcgtggcccggtcgctgatccttttctgcaagggacttggcgcactgagtgcggtcgaaacgccgggcatcggccgagtgcgatcggcgagtctgtgagtgatcggaacttttgtaaaagttcaaaattaatccggcatttatttgcaatgcttttgtgttgaaaaaccagctgatcagtgccaaatttaagaagcatggaaaaggctgaccgaccaacgcgcaaattctcgtcgcctgttgccaaagaaatcgcaaagaaagatgcccgtgacaccaacaaaaacatttgcacggtgccgttgagaaaagcgaaagcaaattaatgcagtaatttgacaacaaattttttctaatcattttacatttattttgaaaaataataatctgtatgaaataatttacaaaaatccacctgcgtaaaacaaatttttggttttaaaaatgaattactacttatgctttatatttgaagtaaattatcttcattattatagccaattaattttggtctcacaaaatcactgaaattgaaatttttaatgaacggaacaatagaatgaaaaaataaa

SEQ ID NO: 71246 - DNA, 1145 bp, Heterodera glycines
  Genomic contig location: Contig_ID=SeqID_1274; Location=4757..5901; Strand=+
  SCN-specific regions: Sequence locations=1-106,144-437,460-598,621 -666,688-713,766-1019,1041-1115,1137-1145
atgcaagaacatggcatgatttttgacgctgttcatgggcgaactgttcacaaattcgatgaacgattgggaggtggagccgacgtcatggacagtgagaaaaacctttaaataatatttaatattaattctaattaaattatgccagtttatatagttacagttttgccctccaaattctctctcggtttctgcacataaacagtgaaatgacaattcggtggcacatccacagtgaccagctaaaatgatcaaaatattattaggggcataaaacagtttaaaattacattaatttcgtcagtattcgccatttcctcaaaaatgttgtggaataaaaaagcttaatttacgtattttatcttttcatttgattaatttttatttgtgtttgtatttgaacgttttgtggcttttgaatttagtcgttgatatttaaaaataaaaattcaaaacaaattctctgtttcgggaatgaggttattccatagtcgaccaaaaatgaagaaaaacaatgagtgacgagaggcacttttagcaccaaagccattcccaacgaccgctcgaaggtggttgttgtttacgcggatgttgcctcattttaactcaattctctctctcccatgaaactcataacatttgtgtgtccctttcccgtcgccgcccctccccccggggggaggggtgcacatttatatttgtacaaatattccatttaaataatttaaataaataaaattaataccatcattgttaaaagttaaatagcgaattatttatttgttagtattgattaaataattcaaagtgattgggccaaagatgaagagagtgaacgaacagtaatgactgagactttggggggagaagggaatttggtgcaaattttatgagttttaaaggctcccgactcaaagtactgacaaaatttaaaacaagaaatgagagaagatagaaatggaaaaaagaaaaacataaattattgagagtttaacagcaaatgagcaattaaggaataattgaaacatttttgtatgcctttgaatttgaatggataagtttgataaataaaaaataaaacaaaaatcaaatttagatattcgaatgctctatttaagaaaagacaaaacataaaattgcaaaaa

SEQ ID NO: 71247 - DNA, 627 bp, Heterodera glycines
  Genomic contig location: Contig_ID=SeqID_1275; Location=18..644; Strand=-
  SCN-specific regions: Sequence locations=1-373,395-576,598-627
atgatttcgcgtttgttagaacaaaaagaagctatttaccaatatgctttcgaaaatcggagttttgatttgaccttaaccgaagaagagtggaagcttattgaagaattaatttctttgctccagccaattgaggaagcttcaaaaatgctcatgaaatcgcctttgtcgggttaacaaaagatttaattttaagttaagtcgcatatttcagctcaaattcccattgctgtaacactccacagcaagctctttagtgcaaaattaatcaacaaagaaattgacagtgttcggtgttcgctggtcaatgagatcgaaaaatatttctttggtctacgcgaaaaacggttcataaacacatatttatttagttaattccattttttatgttttagtgttcattgtctatcaacattttttgacgttcggtttaaagacaaatttttgctcgaacgaagaaacatctttctggcaaaaattttatcatggataagggaagaaaatgacgtgttcattagcccaccaattacggaaattgatgagcttgactgtgcgccgccgcctataaaaaaacaaaggccttctctgttcgacgatcttgatgaaatagcgtcatctagcaataaa

SEQ ID NO: 71248 - DNA, 1587 bp, Heterodera glycines
  Genomic contig location: Contig_ID=SeqID_9395; Location=385..1971; Strand=+
  SCN-specific regions: Sequence locations=1-731,755-1019,1041 -1046,1068-1107,1129-1226,1248-1587
taagcgtcgtcgctctcgcagtcgttcgccattgcctcgtcggtcgcgcactcgctcaccaccgcggcgctcgcgttcccgttcgcgttcacctcgacgccgcgacgatgacagtcgttcacgttctcgctcgcctctgcgccgttctcgctcgcgcagtctgtcccgttcgcgttcaccacgtgactgacagagtgaacagccaacgaattggagagaaaagtcgaatgatgaatattttcgattacaaaccactttatattattgtttgcatcattcgaatgcattcatttccgtggtttcctttaattgtggacatacatttttaatgaattaaacgaaaatgaatcagcgcaaccgaaaagtcgcatttaaatttctttgttgatgtattttatgtttcaattaggccgtgccttagtcgggtagaaatggtttcgaactgatgaagacggtacttgtctgatttcgttgggtttcgaaatggttaattggtgctgcttcaaattttggttttgctttcgacttttgcttgcttccatcgcgcacttcaattggtagaaaaattcctcaatttttgataagacgaccaattgatgagtttttttaggtttgccgccatttatgtcaattgcattttctttacattggtctgttttttgttagtgaccggtattattttgcacttcagtggaaatcttatgacattttgtggttttggactcatttggctctttgtgtttgttttcctgcgcttcgaccgaacaataatttaattgtcttcgtcaaattggttagagcaaaatgcacggatcactccagcaaaaacggggttttgaagggcaaatttggagtggacaacaaaccgatcaaaatcacagatttggagaaggctcgcgcaaaaaaggaggaaagtgagcagaaacttatggagaaaaaggagcggagagaacgaaagaagcgacaaatggccgaattaagggaaagagcgcggattgaaagacggtgagcgaaaaggagggggaaaaggcgggcccaaagtggtaatttaaattagggatttaaatacattaaatgaatcacagacatattgcaaataggtcggaatttgaaaattttttcttagccgtaaaaactttgctggtgccgttgatttgctgctcacttattgtcgtctgatcacttctttcgccgttttggtcggcaacattcacaaaacgttcattccccgctatttggcccctccgctggagaatgtctacgacagtcccgaccttttgatgtttttcacgtaggcgaaaatcttggattattcggaatttaaaattttctttctaaagcataacacttctcatcgacgtcggctttttctggttgctcgtcttttggaggtgctaattacttttcaccctcttaattggtgtctctctctttttcagctattgtcagcagatggccctctgttgtcggctcggcttttgccgttttttgctttggtgcgttgctttggtttttgttggcggtggactgatgctttatccaatgcattttgttcatgaacaattgggtctgttgctcatcctttag

SEQ ID NO: 71249 - DNA, 215 bp, Heterodera glycines
  Genomic contig location: Contig_ID=SeqID_9395; Location=1..215; Strand=+
  SCN-specific regions: Sequence locations=1-215
tgagcacaaaacctgaaagaagggtttgccttgggctcttcctcagaggctgttttctggctgccgcttgagatggcgctgatcgcctcatccgagatcgatttataagattgcagggcattgggcggtcatttcggttaaaaaaagaatgccgtgtcaatgagggtcaaaattacattcttcccgcttgcattgggctctgttttgaatttttc

SEQ ID NO: 71250 - DNA, 374 bp, Heterodera glycines
  Genomic contig location: Contig_ID=SeqID_43622; Location=475..848; Strand=-
  SCN-specific regions: Sequence locations=1-28,54-57,93-142,164 -176,207-336
atgaccggcctcataagagatcggtctcgttatttctcgtcactacctcctcgcgttgagagtgggtaatttgcgcgcctgctgccatccttagacgtagtggccatttctcaggccccttctccggagtcgaacccttatcctccgttacccgtcatcaccatggtagtcagatacactaccatcgaaagttgataaggcagacacttgaaagacacgtcgccggtacaagaccgtgcgatcagcttagttgttctgagtcaacactggacgcccggagggcgcttggttttgtggcgaacaaatgcgctccgctctggggagattggagctttggtgcatgtattagctctagaattaccacagttatccaa

SEQ ID NO: 71251 - DNA, 754 bp, Heterodera glycines
  Genomic contig location: Contig_ID=SeqID_43624; Location=19..772; Strand=-
  SCN-specific regions: Sequence locations=1-53,75-709,731-754
atgaaccgacggtaatgaattttttaaaagtcacatattcttgtttgcctaatttattttcattatttcagttggatttgcaatgacgtttggatggacattttcccatcctttgaccatgctcaactcggcctcaaattggcacttctttcgccacgtttcaatgcgttggtggacaaacatttcgatggcaaaagcgaattgacaatttggagacgaatcgaaattcgtcgcaaggacaaaggaccagaagcgaaactgtctgtacttatgggtgaatacaaatttgcggaatttcaattgcccgaccgtccgttgcccagcaaaatccgtttaaaatgccttatgattgagtaatttaaaatcagagagactcacaataaaagcattcattccattttcacagttacatcgatcactccgtcatcgcttttcttcgttcaaatcatcaaattttcgacaaaagaggcaccaagttgcgtctggggattcttccctcacagaccacggatgaccggcagccgatttgggatgtttttgttcgtgaaatatggccaatctttgcgtcaaacattcgccgtttgcgctttatcgatggtgatcatttggacaatttgcgtcgtcgcacttcgccaacaattctcaccgatctcgatcagttgattgcaatttattccattcacttgttgcctgatccaattggtgataattttgatgggccaaatgcaactgcgggccaagcattgtccaaatg

SEQ ID NO: 71252 - DNA, 65 bp, Heterodera glycines
  Genomic contig location: Contig_ID=SeqID_43626; Location=411..475; Strand=+
  SCN-specific regions: Sequence locations=1-65
atggctgtctcttttttctcctggggatttgaccgcaaacttggtaccaacatttgccttctcta

SEQ ID NO: 71253 - DNA, 59 bp, Heterodera glycines; identical to SEQ ID NO: 52421
  Genomic contig location: Contig_ID=SeqID_43626; Location=69..127; Strand=+
  SCN-specific regions: Sequence locations=1-59

SEQ ID NO: 71254 - DNA, 59 bp, Heterodera glycines; identical to SEQ ID NO: 52421
  Genomic contig location: Contig_ID=SeqID_43626; Location=199..257; Strand=+
  SCN-specific regions: Sequence locations=1-59

SEQ ID NO: 71255 - DNA, 59 bp, Heterodera glycines; identical to SEQ ID NO: 52421
  Genomic contig location: Contig_ID=SeqID_43626; Location=589..647; Strand=+
  SCN-specific regions: Sequence locations=1-59

SEQ ID NO: 71256 - DNA, 59 bp, Heterodera glycines; identical to SEQ ID NO: 52421
  Genomic contig location: Contig_ID=SeqID_43626; Location=719..777; Strand=+
  SCN-specific regions: Sequence locations=1-59

SEQ ID NO: 71257 - DNA, 59 bp, Heterodera glycines; identical to SEQ ID NO: 52421
  Genomic contig location: Contig_ID=SeqID_43626; Location=849..907; Strand=+
  SCN-specific regions: Sequence locations=1-59

SEQ ID NO: 71258 - DNA, 59 bp, Heterodera glycines
  Genomic contig location: Contig_ID=SeqID_43626; Location=964..1022; Strand=+
  SCN-specific regions: Sequence locations=1-59
aacatttgccttctctaatctggctctaccaaacactcacacgatatttgaaatgctaa

SEQ ID NO: 71259 - DNA, 1138 bp, Heterodera glycines
  Genomic contig location: Contig_ID=SeqID_43629; Location=175..1312; Strand=-
  SCN-specific regions: Sequence locations=1-485,507-744,766-1138
atggcggcgcgattcaatgaagccatggtggctcgcttgatcgaacttgttcaatcgcgtcaagatgatttgaaccctccaactcgaactgcaaaagcaaacgaaaagcaaaaagaggcgtggaaatttgtcactgattctatgaatcgtgagtttcctcaggaagtgccccagggcggcttaacgattgcacaaatccaaacaaaattcaaaaatctaaaacaaagggccaaggacgaacgacaaaccgaaaaaagttaatcatatgtgcgcctgtgctgggtttcagcattttctttaggcatcagcgtgccacaggcggtggaaagaaattcgaaatgactgaagtttcgcgcaatgtttcccaattgtttgctgattcaccggcatttgagggtagatatgtgttcgagctaatgtgtaagtagatgtttgttaaaggagtgcccggcggcgtacagaccggtctcaacatcggcgacaccattttctttgaaggcaaagaacaagaggaaagtgccgaattttcctcacagcaagttgttgttgaagaaggaaagtcctatgccgttcttggcactgtgccacgcggagaggcggtgaaaactccaaaatttgaatcaagcacctctcgcgtgccattccgatctcgtgccggaactgcttcaactgttacagctgctgatgtaatggaactgcagcggagtgttctcgagatgcaattgaaagaaatgacaaaaaaacaagaaatttttaaaaaatttgaggatgttcttgacgatgctaagacattttttactgagggtcgcgaattttttcgtggaaagcattcgaatgagaaagaaatggccgattttcaaacatttcttgccaatggcctggttgcagccacgatgcctttgttctccgccagtcaaacgtatgggaagcatttgaaggtggccaaatccaaggaattattctgggtgatagtgcttatccaacacgtcgctggctaatgacaccttttgcaaaccccacaactgctgctcaacaacaatataattatgcacatgcaaaaacaagggttattgtcgagaatgcatttgggagatggaagcggcgattccatattttacattccgaagtacgaattaaa

SEQ ID NO: 71260 - DNA, 771 bp, Heterodera glycines
  Genomic contig location: Contig_ID=SeqID_43631; Location=25..795; Strand=-
  SCN-specific regions: Sequence locations=1-93,136-175,197-305,482 -605,630-637,659-771
ttgcacaatccgttaatacaaactttgctgatcttgtcgattctaagcgaaaatctccatatatgcaaacgagttatcaacgtacaattctggatattttcaattattttaaaaaataatttttttaatattatagaaaaaagttgctcaaaaaacaagcataatgatggtagtgttcgtcatcgtaaaattaagccggtcaaactgttaatgaataatccatcagcggatgttgaagccgaagtcgtaaagaggccgtcttctttatctcgtccaattttgaacagtaagaaccattttttgattttattaattagtaattcttaattactgttaataaccaatcctttaattttgttaattagccaatgattttattaatttaattaagcaagcaattactttattactgttaattaaccaattattttattttttaatttgccaattatctattacttttaattaactaattatttaacacagcccgacgtttggaaaagggagaatcatcgatgagcaaatattttgacgattctcttaggcgatcaagatcaaagaattcatccttttcttcaacttcaagctcatcatcattagcaagtgaatttttggtttaaaattttgggaaatcaagcaaatagcttgctgaataaggtgtttttcattagttcgtcgacacttgcggaccaatatttccggatgaaaatgccaacaaaaaaatagaatttttaaaaaggtatttttaaaaatttctaaacaaaaattaaa

SEQ ID NO: 71261 - DNA, 1755 bp, Heterodera glycines
  misc_feature (1710)..(1710): n is a, c, g, or t
  Genomic contig location: Contig_ID=SeqID_9396; Location=14..1768; Strand=-
  SCN-specific regions: Sequence locations=1-110,132-439,463-467,508 -672,695-1059,1105-1482,1508-1652,1698-1755
  Gene Ontology: Mol. function=protein binding
atgcggaaagggcttttttcgtgcttatctgtgcgtattaagtgcgcaaaaattttaggcatttgcctaaaaatcgcatccctactcattaatatatgtctcccaattaataaaagatttaaaatatttaaggcacaagcgatggacaaattgtcaattcgttgacggaccaattggagaaagtgtttaagaaaagagagtatacggatgttgagtttttggttgggaaggacgacaaaaaggaggcgagtcaaaaaaaaatttgttttttttaattgacgacatttacaactatcgatgatgcaaaatcgttttttcgaactaaaaaaccgatagaatcaaatgaaaataaaaaaaaattgaaaaattttgaaagaccaaaaaatatccaattcaaatgaaaaatgccaaatttgcgatttttgagtctttttctaaaatttattaataaaagcaaattttgaatgatttattatcaatacataaaaactttcaaaaaatttcaaatagctagaaagattttttccggatttttcatctaatgaaaaacatttattgctatcaaatgattcaaatagagacgggcatttgaaaaatcaaccgaaataaaaattttattttatggaaaagctttttttatagatttactaagaagaagcagactggcgaggtaaaaagtggaaagctggatttataagaaccagaaaaataaaagttgattttgcctcagtagctcaatggttgaatatccacggattgggtgtaggcgcgggttcgattcccacccgagtcctaacatattctcattatttttttgtactaaaattataattctcaaaatttttaataatttggaatttttttagattatatcagctcatagagcgattctctccagtgcttccgatgtatttgaagcaatgttccgttacaatgaaggtcaaattgagatccccgacattgaaattggcgcgttcaaaacgatgctaagatttatttatacgaagagttttgatggattggatgccaataatttgttggaagttttaaaagctggtgaaaatttattaattgaattttaaataaattggaattttaattatagcacacaaatataacatcagtggcctggtaaaagaatgtgccaaattttcaattcaaaagttgccaaatgtttttgtggcttttgaacaggctttgttgctgaagatggaggtgaagaaagaattttaattattagtaacatataagcgcaaattaatgagactttgatgttttgctgagaaaaaaagacaatgtgattaataattagagcccgggtaggaaaggatcaagtactgagccaataacacaaataagcattataaaagtcataatcgtaaacacccaaaccaagcggaaagccctttgcttgtttatctgagcgtaataagtaagcagtaattttcggcacttgcctaaaaaaatgaatccctaaatgattatatttattttattttaggattttgctctccgctgtttgcgttacattgatcaaaatattagtgctttgatcaaatcaaaagcctttttgcaaattaatcaagatttgttatgtattattctcgaaagtgatcagctgaaaattagtgaaatcgaaatttggaatgcggtaaaataaatatttaaaattacaattaattaatttttttaatttaggcactccgttgngccgacgaacagtgccgtcaaaagggcatcgaatgttcccgctga

SEQ ID NO: 71262 - DNA, 352 bp, Heterodera glycines
  Genomic contig location: Contig_ID=SeqID_9396; Location=2947..3298; Strand=+
  SCN-specific regions: Sequence locations=1-31,53-149,172-313,335-352
atggctaattttaaatgccttttccaatgcgctttttgcttcttttttctccgattttccgtaatcgctgttgaacacaatgaaaaggatttatttgatgaaatttggaagaatttaaataataaaacgccaaaagtgaagggatttgagaaaataaaagttaaaatggaaccacaaatggacaatgaacaaatgataaatatggaaaaatatggccaaattgggaagacaaaagtgaaaaaagaaaaatgcgaaaatggccaaaccgaaaaagcaaattattcgacacgaaagcaaatcaaaaaggaacaccaaagtgaggaaggaacggagattaatcgacaaacaaaag

SEQ ID NO: 71263 - DNA, 362 bp, Heterodera glycines
  Genomic contig location: Contig_ID=SeqID_43632; Location=448..809; Strand=+
  SCN-specific regions: Sequence locations=1-3,25-214,237-263,285-362
atgatgatcagaagagcaagaaagacaatgctcgatgttcgttcaacccatccatcccctgtccgtacaagcaaaattcaaagaaaatacgtgtcgtgttcgggatttccggagtcgaaggattctcgcccacccacctcgtctgatgacctaattgtaagcccaaggacatcctatgggatatttggtattatttgttcaggcaaagaaaatatgtaatttgaaaaagaattcaattttcttagctctctctcacttgcttttcaaggcagcctctttctctccgtttgtttgagaatccaccaactccgaccccgttggaggagaaggttcatcccccattccaattccatcacaatgtc

SEQ ID NO: 71264 - DNA, 427 bp, Heterodera glycines
  Genomic contig location: Contig_ID=SeqID_43633; Location=271..697; Strand=+
  SCN-specific regions: Sequence locations=1-427
atggaccaattcccacgtggattctctcctgctgggtcagattcatctcgcccccaacactataagcgctcttggccaagttagttgcaattttgtagataatcacgattatattgctttttgttcaactcagtgaaaagcaagctaaatatagaatgtaatttggttaaatgtgccgcggcattctaatgcatatgcaaagttaccaaaattgttgggaatattcaatttcagctagagttgagcggggcagggaattttgggcaaaccgggacttttcgggttgaaaaaacgggaatttttggctgggaaaaccgggaaaaaaccgtgaatttcccggtcccggtcaaaactgatcaaaaccgggacttcagtactcagttgtccgtgttttggtcccggtcccgctcaactctaattgcagcca

SEQ ID NO: 71265 - DNA, 804 bp, Heterodera glycines
  Genomic contig location: Contig_ID=SeqID_43634; Location=42..845; Strand=+
  SCN-specific regions: Sequence locations=1-64,205-255,397-804
atgcgaagtcagtgccacaggcaaaagcgatgccaatcagaggacggggacccctccctcaaaggtatgagcacaacgacacgaatcttcgggaacacaccgcgacggcaactgtccgtaaaagagcgaagcgtcgcggaagaggccgactcggagttgggcgactcgtccgcaacggaggaaggcggcaccgagtcgatcaggtggacagcggcgggggatgtgccattgttgcaaaatgagagactgtcccgccaggagttcgttgccgttcttcgattcgcttcgctccgccactctctcgccccatccgtttataacaatcgcagcgagcggagacaaacagttccaatacgcggaacgagacgcagtcgcggaacccttgcgctaccgcacgcggccgcctcagacggaactgccgaaagggcgcgcgacttccgtgcggtcggcggccgagtcggaagggacgaaccgaaagacgagcaaaggggcactgggcgagaaaaggtcggcacccgtggagatggaggaggacaaagacagacgaaggctaacggaagtgacggcgatgatgcgacgcctcagagacagcatcgaagcacaattggacagactaactgaacagatgggcaggacggaggacgacgacgcagcgggggacagaccgaacagccgacggggggaggagggcgaacagcggggggacagctgcgcatcactctcgccatctcgcgtttcatttgcatcgaccaaatagaaacaaattgagcccctccacctcattctcagattaatccacaaaga

SEQ ID NO: 71266 - DNA, 69 bp, Heterodera glycines
  Genomic contig location: Contig_ID=SeqID_43634; Location=1036..1104; Strand=-
  SCN-specific regions: Sequence locations=1-69
aaaagtacccggccatcaaccatttgatgaacaaaattcggatgaagaagcgcaaggacacactcattc

SEQ ID NO: 71267 - DNA, 76 bp, Heterodera glycines; identical to SEQ ID NO: 51235
  Genomic contig location: Contig_ID=SeqID_43635; Location=1115..1190; Strand=+
  SCN-specific regions: Sequence locations=1-76

SEQ ID NO: 71268 - DNA, 503 bp, Heterodera glycines; identical to SEQ ID NO: 62004
  Genomic contig location: Contig_ID=SeqID_43637; Location=279..781; Strand=-
  SCN-specific regions: Sequence locations=1-107,134-217,239-263,292-503

SEQ ID NO: 71269 - DNA, 414 bp, Heterodera glycines
  Genomic contig location: Contig_ID=SeqID_43639; Location=636..1049; Strand=+
  SCN-specific regions: Sequence locations=1-29,51-324,355-414
atgcgttttgttggtgagttcgacttggacctggatttttgtcccggaaatccaggcccaacatgagattaagtccaggcttttttcaaaatgtcgaacttatttaatttggttgagaaaaaatgatggtccaaaaactcgtctggcgacaatttcgacaacaatgctttgtcctgctttggagattataaaagcattatttaaaattacatatatcccctgcacaaaattttttttcattaaacatcaaaaaatttcagtgccgactgtgatttgggcaaatttggagtctgatggtgcaaacatgcgcccccgaggaaaattagaattttgaaaggattttgttaagaaaagttgggtcaatttcagaaaatgctcctattaaaacaatcgcgcagatacattttttaaaaa

SEQ ID NO: 71270 - DNA, 2151 bp, Heterodera glycines
  Genomic contig location: Contig_ID=SeqID_9398; Location=920..3070; Strand=+
  SCN-specific regions: Sequence locations=1-752,778-1753,1775-2151
atggacgtcgacaaagtgcagccaattacaaaccttccaatgcctcaaacgcgaaaggaattgcattctcttttgggctttttcacatactataggaagttcatctattcctttggtaccatcgcagcaccactttttaaactcctgcaggaaaacgtcaaattttccattggtgaagtggaaaaagaggcaataaaaagtctaaaagaaaaagtcctgaaagacgtagttttgtacttccccaacttcgaaaaagcgaaaaatgacccctcgcgttgctttatcatgatgaccgatgccagcaaagttggactttcggctgttttatgtcagcatgacgatgagatgaaactgagaccaatttatttcgcttctcgacaatgcagcaaatatgagagccgttatgccgcaactgaattagaagcgttagcagtgagattcggagcaaagaaatttgctcagtttataacaatgctgccgacgagagtcctcacggatcacaaatctcttgtgcccatgttcaaaagcaaggaggagactggaaatgcgcgagtcgacaaatggctcatggaattgaattcgagatttatcttgaaagtagaataccaaccaggaaaaatgaatgtgattgcagaccttttatcgcgatcatttcaactaaacaacgaaggaatcgccgaaccgctcctggaggaagataaagcattaattggaatgataaaaatactgacagcggaagaagttgaagcgtcaattgaggagaaaagagaaaagtggagtcgagcatccgaagaaagtgaaatgaagcacatatatgaatttttaaagaaaaaaatcttcccggacgatccaagacaggcgcaaaatttgaaggaaacgtgccacaaatacacgctgctcgacggactgctttatttatgtgaagataatggcaaactgcgacttttcgtcccatccgaatttcgtgaaaatttggtaaagcaacgacatgaaggaaaatgcgcagggcacatgagtgacaaaaaactctttcttcaattggcagaacagtatttctggccaaatatgctgaaagattgcatgaaaattcatcaacactgccgaatttgtgctcatacaaaggaggcgagagcaaatgaacctccactgaaagtcgttagaacgtcagaaccattcgaattgctatgcatcgacattttggacgttggccccagtcagtcagagttcaaatatatctgtgtgatggtcgaccatttttcgaaatatttaatcgcggagccgatacgaaataagtcagccgaagcagttgcgaaagtgttggttgagaaagctattttgatatacggcacaccgaaaaaaatccattctgacaaaggaaaggaatttgtcaattcaacgattgaagaaatcgtcaaaacttttggaattgaacgatctctcacagctgggtatgacccccaggcgaacgggcttgttgagagagtaaaccgaataataatcgctatgcttaaaaagtcgacggcaagctgctggacatgggatgaacgtttgccgtacattgtgttcgcttacaacattacgccgtctaaaacgacgaaattttcgccattttccatgatttttgggaaaatcgctcgatttacgatggatggggaagtgcccttacaagtcaacccagcatacacaattgacagcgacacatacctccaattatttcgtgaaaatgtgttgaatatgctgaacgaagcgaggaaaaattctgatgaagaaagaatgagaagtaaaatttggtacgattcccagccgaaagtgacggctaacaaatttgaagcggggcaacgcgtaatggttgcctttcccggactgaatcgccgatctcggcacaagaaatttttgtggtctcatttcgggccttatcttatcctagaaattaacgaatcgtcggcatttttagtcccaattgacaacagaaatgctgagcccataaaagttccgattgagcgtctaattcgaattcctccaggaatcccggacatttcaacacttccaaaggggaaaaacccatttaaaaatgcgttaaaatcattaattgtcagcattttatcgagttttgaagtctgtgaatcagatggacaaatggccccattatga

SEQ ID NO: 71271 - DNA, 906 bp, Heterodera glycines
  Genomic contig location: Contig_ID=SeqID_9399; Location=182..1087; Strand=+
  SCN-specific regions: Sequence locations=1-247,269-464,486-906
atgacagccgcaagaagtttcgtcaaatcaataattgaaggagcgccaaaagaggaactccatctgttcgtgaccaaaaagggagactatgtggcgacaggacaatgtccaactgaagaagaccaaatgaaggcgctggagtgttggttcgaaaagtgctccgtggcaaagcatgctttggaagagagcggattcaaaaaaatcggcatgtacgaacccgtcggactcaatcatttagccgattctgagaagaagaaatgggaagaagcgatgggagagacaccgtgggtgctggagaaattgagggccaaaatcattcacaaggccacaaaactgatcgccttgccacgtgtcataatcggagattcgacagcccaccaattggccgaaatcttggaccaaacggcggtgatcgggccaaaaaatggaacattggcggagacagtgcgaagcctgaagcccgtggtgctctccagcaaagtgaaggccgcactgatcattgtcggacgagattcactcttgggcggagaaaccattgcagtgatgatggagcaatacgagatgattgccaatttgtgccgccgattcccgcaagtgaagttcttttggacatgcccaccgtacgtgcacgacaaacacgacgagtacgaagaactgatcgaaagcttggtgccgatgatgagccaaaaaccttttcttcctgtttgggtgacagaaagtgacaacggatggactgatgaaagaggccggtttgcgagcgctgaaggcatggctgttcacccaatccgacttcccgggcgatcagaagctgaaaattcggtcaattcgatcgaccgttcgtgccgttgctacgataggtctgggggaccatcgccaagcaagcacttcgtctttggccgtaaatga

SEQ ID NO: 71272 - DNA, 1333 bp, Heterodera glycines
  Genomic contig location: Contig_ID=SeqID_43642; Location=85..1417; Strand=-
  SCN-specific regions: Sequence locations=1-482,504-760,782-909,931 -992,1014-1042,1064-1305,1327-1333
atggtgctaggtctgtgcgaaacttggcttactaataatgaaacaataattttctcagaccaaacgttaaatgaaaattatgtaatcttttcggccataagaaataacagtaaaggtaaagggggtggaacctcacttttaattaataaagcaattgaaccatattttacccaaactttttcaaaatttgggtgcgaaatttctatcgttaaactaaaaaatacaaaaaatataactattatatgtctataccggccccctaacaccaaattgaaacctacaaaatctctttttttacttctagaaaaatatataacaaacaatacgattatcataggagactttaacattggcagcaaagatataacatgggttaacaatattcctgtacctcataccggtctaggaataacttttcttgacttttttaataaattttcacttaacactaatattataggcccaacaagaggaaattcaattcttgatctttgtctttttacaaaccctgatttagtctcttcaattgaactaaaggatagtattgttttttcagaccattcagcattgtactttaatattgatattcctttccaaagacaaaaacccccaaaaattacggtcagaaatttcacccagtctaaaattaaagcattcaattcttatttactctccaatttatcttcatctctaactaccacatatactttggagagtaaatataatgtttttgctaatacaattcaaaatgcccttgatctttttattccaaaaaatacatttgtcaaaaatagacctccaaattttccgttatcacttagatcatcaataaaagaaaaagcttgtatttggcgtaaaatgaaaaaagatcctgttaaatttaaaccaatctatgattccttagctctccatattaaaatccaagttaaaaaattttacgaaaacagacaaagaaaatttctttctgcaaatccgattaatctttataaaattattagaaaacacaacttttccagtacttctattccatctatagaaaccgaaagtggttttatttttgatgatttcgaaaaagcacaatattttgcgaaatatttttctcaaactttttcaaacgatataagctcctcttatcctctcccaggaggggatcaagctcaagtttatctctctgaaataatttttgatgtttcggatactattcaaaaacttaatcttctggatggaaaaaacaatacgtctcctgatctcattaacaatcaaatacttaaaaactcttttcttcctcttgctaggcctataactgatcttttaaaattatcttttaacaccg

SEQ ID NO: 71273 - DNA, 335 bp, Heterodera glycines
  Genomic contig location: Contig_ID=SeqID_43643; Location=1..335; Strand=-
  SCN-specific regions: Sequence locations=1-335
  Gene Ontology: Mol. function=glycine transporter activity; Cellular component=plasma membrane; Biological process=alanine transport
ctttggagcattcgacaattgaaagtgttggcaccgcttgcgttggttgccaacttggtctatttgggagcggtgctcatcattctcgaatatatgatcatcccatttgtacagcatcgacgaattgcccgccgtcggcaatttgtccgatttgcccctctgttttggtactgtcattttcgctatcgaaggcattgccgtcgtacgttttctctccgttccgattgagcaatgaagcgcaataattgccaagaggtactgccagttgaaaatcatatggaccgaccgcaacatttcatctctccgaacggagttctgaaaccttcgtgtctgct

SEQ ID NO: 71274 - DNA, 258 bp, Heterodera glycines
  Genomic contig location: Contig_ID=SeqID_43644; Location=1..258; Strand=-
  SCN-specific regions: Sequence locations=1-258
aaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaaaagatagacatttttctgggatagagtataaatttaaaaat

SEQ ID NO: 71275 - DNA, 304 bp, Heterodera glycines; identical to SEQ ID NO: 51570
  Genomic contig location: Contig_ID=SeqID_43644; Location=335..638; Strand=-
  SCN-specific regions: Sequence locations=1-304

SEQ ID NO: 71276 - DNA, 107 bp, Heterodera glycines
  Genomic contig location: Contig_ID=SeqID_43644; Location=841..947; Strand=-
  SCN-specific regions: Sequence locations=1-107
tataaaatttatcaaaaaaagagatagccatttttctgggatagagtataaatttaaaaattccctcaaaaataaaaggtatattgcgcaccgccctccctatcatg

SEQ ID NO: 71277 - DNA, 211 bp, Heterodera glycines
  Genomic contig location: Contig_ID=SeqID_43646; Location=1..211; Strand=-
  SCN-specific regions: Sequence locations=1-123,145-211
ccgacgcagcaagattatatcgagctgcacatcggcgcttcggagctgaatctgtatgccatggcggtgatggatcgcatcctgaaagagcaggcgatcaccgtcgacgtgccgcacggcgacgcctggctgcgggaagagggcagccgtccgctggtgctgatcgccggcggcaccggtttctcttacgcgcgttcaatcttgttgaccg

SEQ ID NO: 71278 - DNA, 61 bp, Heterodera glycines
  Genomic contig location: Contig_ID=SeqID_43647; Location=195..255; Strand=-
  SCN-specific regions: Sequence locations=1-61
tacaggctatagggaagctgttcctgaaggattcggtctccccataaatctgggcgcatcg

SEQ ID NO: 71279 - DNA, 164 bp, Heterodera glycines
  Genomic contig location: Contig_ID=SeqID_43650; Location=665..828; Strand=+
  SCN-specific regions: Sequence locations=1-164
aacgggcgcgaagcgcccgtctgaggccgcgaagcggccttaatagcccaacaaaatttagaaacgggcgcgaagcgcccgtctgaggtctcgaagctgccttaatagccaaacaaatttcagaaacagggcgcgaagcttccgtataagcttcaacaaaattt

SEQ ID NO: 71280 - DNA, 626 bp, Heterodera glycines
  Genomic contig location: Contig_ID=SeqID_9401; Location=31..656; Strand=-
  SCN-specific regions: Sequence locations=1-243,327-341,379-388,410 -414,436-465,487-561,606-626
atgaacagtacgcagaagcaaatcttcatgggcacattggaattgattcaaaattcgatggaattcaaagagacacggaaggacaaggatttggtcggggaatatcaggtgaaagcaataaaaaaacaatgggaaataaaaagtattctaaataataaaagaaaatcggaaataaaatatagacttcagttattaggccgcactttaaaaacttttcctaaattactaccgaaaaataccttcaaatattaaataaatatttaagttaaataaaactttcacattttttaaataaaaattataatttaaaaaattaaagttaattaggtgtatgtaaatgcaaatttaaattcaataaataatattttatgataaaaagtcaagttgagctttggtatatttcaaaatgatgccaaaaaaaattaaaaattaattccatcaaaatggattttaaggacaaattgctggatgcaatgaacaaagttgcgtccgggttgcccgactcggccaagttgcaggcgatcatttcaggaggaagcccaatgccaattattatagcggaaaagccctttttcaacgcacccccaccaccaccagcagcaaatgaagatgatgatgcacaatga

SEQ ID NO: 71281 - DNA, 182 bp, Heterodera glycines
  misc_feature (7)..(7): n is a, c, g, or t
  Genomic contig location: Contig_ID=SeqID_9401; Location=3891..4072; Strand=-
  SCN-specific regions: Sequence locations=1-130,152-182
cttaagnttaaaaatttaggaaaaattatattctgaaagagaacaattaaagctattgaatgatattgaatgataccacgaaatattaatttggttgaatttgagccaagctattaatttaattattttacccattttttgttttcaaacccattggcagttttaagaaacgcactagcacc

SEQ ID NO: 71282 - DNA, 916 bp, Heterodera glycines
  Genomic contig location: Contig_ID=SeqID_9401; Location=1219..2134; Strand=-
  SCN-specific regions: Sequence locations=1-706,728-729,782-829,851-916
atgggtttcaacctgttcatacggcatgccgacctgcaccacgaggcggaaagcatgtgccaaatgtacaatcagctgacccccaaattcatggcatgcatggcacgcgcaaatgccgactctcgacgactgggcgccttcaacgcaatcaaaggtggatggagttgttttagcggcatttttctgatagggatgcttaagagtgggtgttttctgagaactcaagacagaaacaaagcccgagaatcgagaccaaaaaaaggttgagtaaatctgcggatcgactctcaagcagccgaccccgtaattttgagccgatccctgatttgttggcattccattactgaagagtctgaattgcgaacattgtttcgaaattggctaacattccacaattttgtccaagttgtgactcggatgaattgagctggtgattcgagactagattttaacacgagaatgaacaataagtcttcatttttgaatcccattgaaattccaaatttaatgccgtttaatatatgggccatcatttgccctccatattttttttcttcaaagtttgaaagtcaataataaacatttcagctgttggcttcaactcactgcagcttatccctaaaagcaacaacagtcagtggggtgccgaaatgcttaccaaattgattctgtcatttttggacgaattatttgaagtgccaggtaatttgattggtttgccaaaaaagcaataaaaaatatttatttttaaatttataatttttttttgaaatttaattaagaggataatggcgatgttgaagtgaatgaagaatatttctcaattgctgagcccatagattttggcgctttgtatgtggactttttgcgcgatttaatggaaagatcgcgggtgaaaaatggacaattgaagtaa

SEQ ID NO: 71283 - DNA, 743 bp, Heterodera glycines
  Genomic contig location: Contig_ID=SeqID_9401; Location=2782..3524; Strand=-
  SCN-specific regions: Sequence locations=1-233,255-629,651-743
atgggcgcctgctgctcccgtcagcggtggcgtaaagcggcatttccaccccgggatggcatcgcggacgcgatcagtggcacgagaaagaagcacaaggacggggaatggctgaagaaggacaaaaagctgcaaaaactgattgaatattcgggcgcacaccctgaagagctgagcggaattggtgcttatttaatccaacatttgaacaggtaatggaaatagattttgtcaaatttaatttataaatttttgctttttcagagaccttgacaagaaaaattacacacgagttgaggtgaattaataataattagaaattaacatgtaataatcaaatgtgagatgagtttattaatccgtctgcaaaatttgcattttgcattgtacatacttactgtatatataacgataccgtaattttcaaaagtaaggatttagcagggaatggaaaatgccaatttaacaaattgcacccataattgtactttctgaataagttgtttatgatgaaaagagtttagagcatgagaatgaacaatagggctacgtttttgaatctaatcaccaaaatgtcatttaataagtaacagatcaattttcaaacttatctttcaatcactcaaaaaacaggtggctgttaacattatggatttgttgttggagagttgtcgtcgtgcgcccagttggacagtgttggtggacaattgtctacagatggtcaaacatttggtgagaataaa

SEQ ID NO: 71284 - DNA, 130 bp, Heterodera glycines
  Genomic contig location: Contig_ID=SeqID_43653; Location=1074..1203; Strand=+
  SCN-specific regions: Sequence locations=1-130
atggaccttcaaaacagcatgagagccaggacaattaacactcataagacgcgcaaaatgatcaaaatgcgacttgaccggaataaacgaatttcaatgcgaaaagtggcactcgaaatcgggttgaacc

SEQ ID NO: 71285 - DNA, 470 bp, Heterodera glycines
  Genomic contig location: Contig_ID=SeqID_43654; Location=481..950; Strand=-
  SCN-specific regions: Sequence locations=1-470
  Gene Ontology: Mol. function=peroxidase activity; Cellular component =integral to plasma membrane; Biological process=thyroid hormone generation
cgtacatttgtttgaccttttcagaccgaattgatctgttcgtcggcggaatgctcgaagacccggtggtgcgcggtttggtcggtccgacagtgtaagtgccatcaaacattaattattatttcaaattactctcccattaattattcagtgcctgcattattggtcctcaatttgcacggactcgcgacggggacaggtgaagaaaaaaggcattcactaagactgggacgaattcccccccccccctctccggcaaaattggccccacttttcccaggttttattttgaaaatccgggcattttcacccgcgcccaattggccgaaattcgccgttcgtcgctcgcccgagtgatttgcgacaacggcgacgactttcggacagtgccgcgcgaagccttccgcacggggccaattgtccagtgcatagagataccgcaaatggacctgagcaaatggaaggagtga

SEQ ID NO: 71286 - DNA, 60 bp, Heterodera glycines; identical to SEQ ID NO: 52045
  Genomic contig location: Contig_ID=SeqID_43661; Location=217..276; Strand=-
  SCN-specific regions: Sequence locations=1-60

SEQ ID NO: 71287 - DNA, 1546 bp, Heterodera glycines
  Genomic contig location: Contig_ID=SeqID_9403; Location=363..1908; Strand=-
  SCN-specific regions: Sequence locations=1-447,470-557,579-739,780 -1063,1085-1392,1414-1434,1485-1500,1527-1546
atgggagaggcgcagagaacagaacaattggagggaatgagccaattcgatggatctgaaaaggaaagtcatttagggaccgtccgtcggtccccggcccaaattgacctttgcgccaaaagtttggcaattctattcaccattttaagctggacaatattgcaagaggggaccaaagtgaacaatttggccacaattgcaggagaaaaggaatcgacggaaggccaatggacgagggaaaggcatttgagcaaacttccgacccttcggttgttccaatcggacaattcgagcaaagaacgcgcaaccgtgggactgtgcagcggagcatttcgacagagaagcacacaaacgcaagagaagagagaatggcggagggaaagcagaagaaggtcagacgcatccgtgtcgaatttattcagaaaatgcctgcaaagaatggcattgaaaatagagccaaatgccaaccgttcgttgcttttcttccgctacctcagttcgctttcgagtgcatttttttccgcttccaattcttttccgtgttcactttcctcgccatttttggcctcctcatcggttatttgggtaattcgacccaaaattaccccaagaaacaattggcggaacgaatcatcgcccgaatccctcgcaattttaattcggagaaacggcaaaaggaagtgcccccgactgctttcgcggagaacagaaagaatgtcatttggatcgatctgaaaggaaaaaatacagaccaaaacaaaaacaattgtttagagaaacactttcgaaggcactttttggaaatattccaaaagagagactcacaaaatcaaagtaataaatgccaagtgagtctcattcattcatactttgcatttaaaggcgagtgaaataatcccgtcgatttgaacactttgaaaattggagggatttcgaagggaatggcggaggagagaaaggcaaagttcggcaggggaaatttgcaaagaaacggcgaaagatgagagacaattggaggagtaaaactgcgaatcgagaagggcaaagatgaagtcattgaagggcctggaagcagaaatttatgaacaatcgcccaaactcgaaaatgtcacttttgagttcgcaacgcgaaaagacccttttcggtaagtgctgagaaacattggagcggactttcccctttttgggtggaatttgcggacgcaataatcaaatggagcgttttacaggagaattgcgatggcaaaatcacttccattggagcatagcgaagtgaagtgccatttgactaaacgaagaagcaaaacgacggttatttaaagggcaaattcacttggaaagagcggaactgaacggagagattgtgaggcgtcaaaacgacgaccatttgcgaagtgcaaatcacttgacggacaaagcccgactcaaagcattcgaagcaaaagcgaggcgaagcggaccaaacggagagaagcgaatcgaagagggcgagctgaaaaaggaggaaaacagaacaaacaaacaaatggagaaaggaatggaatga

SEQ ID NO: 71288 - DNA, 134 bp, Heterodera glycines
  Genomic contig location: Contig_ID=SeqID_43665; Location=165..298; Strand=-
  SCN-specific regions: Sequence locations=1-134
atgccagtaatccaggcactccgccacagcatgcgaagcattggtgcgcccgagttacggtccgtaaaacgcgaattagaaccacaagttcgcgcctgcacaccaaaaccccacagccgagccgagcaagtaac

SEQ ID NO: 71289 - DNA, 660 bp, Heterodera glycines
  Genomic contig location: Contig_ID=SeqID_43666; Location=334..993; Strand=-
  SCN-specific regions: Sequence locations=1-43,65-535,557-660
aaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggcctccccataaatctgggcgcatcggttcggggggactgccccgaaaacaaaaaaatcgattttttcaagtgtccgtttggggtactcaaacatttatggggagcaaaaatccaacgcaaaattaaagtacaggctatagggaagctattcccgagggattcggtctccccataaatctgggcgcatcggttcggggggaatgccccgaaaac

SEQ ID NO: 71290 - DNA, 624 bp, Heterodera glycines
  Genomic contig location: Contig_ID=SeqID_43668; Location=219..842; Strand=+
  SCN-specific regions: Sequence locations=1-127,149-594,616-624
atgattaagctatgccctgtcggaatgcagccggagccttcagcgattggctacgtgccgtgcgatttacttgcgcccggccaatgcagcgaagggtaagcacggggaatgattccagattttccggaagtccaaaaaattagaatttttcacaaattcccacaacttttgactcaaatttgccaaaaaaaatagtctctgatcactttttaaacatttccgatcactgtaaaatgccaaccgccacaggtatcagtgcgtgcattcgcgtgacgatccggagatgaacatttgttgcagtcggttgcgcaaccaaccgccatctgctgcggcagcgcccatctgccccaatcaggcaaaattttcagtccctttctccatcgcgttcagttggcccatttctgacgggacagatttttttttttttttcaataaaccgaagttggcaattttttcagcaaattttattgcgagacgggtcaagcccgcgctactgctccccacggcagggcatcagcgcgtgtccaaatgggtaccaatgcgatgagtcaattggccaaccgaatgtgtaaattcaaaaaaacaaaattggcattttaatacagtatgtgccaaatttgaaaa

SEQ ID NO: 71291 - DNA, 773 bp, Heterodera glycines
  Genomic contig location: Contig_ID=SeqID_43671; Location=159..931; Strand=+
  SCN-specific regions: Sequence locations=1-773
atgagtcacagtgaaaatagacacttaagtaccgaagaaaaaatggaagaaaataataatttaaagcaaaaaattacgcaaaaaggagcattgaagatggagaaaattggggcgagaagcagggtaaaaataagcgcctgaaaatcgaaaaaaatttgattgtaacagaaaagcacatatgtatggaaatttaaaaacagcaccgttccgatttttcaaagaatgaaatcgaatacacactatcctttctgttgtacttggataagaatgcatctgatctcgaattttgctgttcttcctcacaaccattctttgtttcacttctttttacgcttctgacgcgatgcaatgtccttaaatgtacgtgaaattactgttgaattgtaaattcctaattctctcatttttagccgctttccattgagctcgaagtatccgaagacaaactcacaacaaacaatgaacagttgcattcgttctctcaaggcgaaattgtcattttccatgcccaattttcggatggaaatttctccctttttcttctgctcacttcgaatgcgaatttacttgtccagtacaaattctgcgcttcttctcaattcgcttcggtttcgcttaaaaagtttttccctgaaaaggttttaatgtgatttttttccttagtttcccacgttttttaggatttttcgcatttggcaaccgtagcaatcactgcagacagttctctgattgtttgcttatcaaacgatggaccgacaatatttatggttcca

SEQ ID NO: 71292 - DNA, 279 bp, Heterodera glycines
  Genomic contig location: Contig_ID=SeqID_9404; Location=555..833; Strand=-
  SCN-specific regions: Sequence locations=1-21,44-77,112-140,162-279
atggaattgggcattggtgaaagaacattaataaaatggaaaaatgaattgttgccaaattattataaaagtaagtgaatttttaaagtttttatttaattttatatttaagcaaaaaataactattccaatgaggataaattaataaaaatgaaacaatatttcaaaatgaaggcaagtaatgttgaaattagtgatggaattattgcagagaaattgggaattggaagagcaaccctattcatcagatggaaaaaggaattcattcacttcaactga

SEQ ID NO: 71293 - DNA, 1283 bp, Heterodera glycines
  Genomic contig location: Contig_ID=SeqID_9404; Location=936..2218; Strand=-
  SCN-specific regions: Sequence locations=1-807,883-904,943-1255
atgtccttatttgtaagatttgtccgtatttcgggccattgttcttatttcataaatatattcataattttatggcagaatgtcactaatttatcaagaaaatatagggttagctcaaaatttggttattttttgacaaaaactgttaacaaatcgcattaaaaattacaaatttttcccgtcagcgcctatcggcgccgccagacgccccagtcccccaaaatttttggaagcgctccgcgtaaaaaaaagcgtttttaaaagcgaaaaaagtcgtcgcatggcttttaaatgcaaaaattttaaaaatcttactttttttgatcccgaatacactaaaaaaaaattacgatttgcttatttcctacaaattgttaaaaatgatcatgggaggcgaaaaatatgaaatttgataactatattaattgattaaattgttacacaagcgattttaagcaattttgcgaaatgttcttatttttggccctaaaatcttattttgtggcattgatgttcttattttgaaaaattttcgaaaacatgaaaaacatatttttcagcacaattttttaaattagagcgatttaatattatgcaaaaaaaacctacttgtggtcatataaaaagctatatcggacaacaaacaaaaaagtttattacaccatttgcaccaatcttggagctttttcggaacgaaaatgattgaaacccgtactggacaggaaataagctaaaaaatactgttttgctgatgtctttttcatgcatccaaattttggctgatcaataaaatcaaaaaactgattcaataatatgtaaaaaaaatatatttgtgaattttttcttaatcatttaaaaaaattattttattcaaaaatatatctgaaaagaatgaattggtggcatttaatatttataaatttttttattatttataaaattgagtccggcaaaatccaaccaaatttcgatgaaatattcggcgaacgatgggacaaaaatgaagaagaagaccaaatgataaaaattgaactaaaccagctaaatggaaaatatgaagctgatcaaatggatgaatgaagaaaatggaatacacccaaatgaccaacaagagagaaatgattcaaaaatttgaagcaattaaagaaaagttgagagaaaaaggaaaattcaaaacaaatacagaacaaaattgaattcaaaattggcagagttttaggtgcaagtcgccataaaatatacaaatggaaaaaagaattaaatttatataaatttaaaataaa

SEQ ID NO: 71294 - DNA, 1014 bp, Heterodera glycines
  Genomic contig location: Contig_ID=SeqID_9404; Location=2220..3233; Strand=-
  SCN-specific regions: Sequence locations=1-13,52-134,157-568,594 -781,803-1014
atgaatttttgccatttaatatttataatattttttattatttataaaattgaatccggcaaaatccgaccaaatttttatgaaatatttggcgatggatggaacaaaaatgaaagagaagaacaagtgataaaaaatgatgaacaaaatgaaaactcagcaacagttgatcaaatggatggagaaaatggaaatggtccaaatgatcaacaaaaaagagaaacaattcaaaaatttgaagcaattaaagaaaggttgaagcaaaaaggaaaatatgaatggaaaaacaataacaaaattgagtggaaaattgcaaaattattaggccaaaatcgccaaaaaatatacaaatggaaaaaagaattaaatctaaataaaacgaagaaaaagagtttttatgaggggaaaaagaatgaattcattgaacgatttgatgaatttaaaagtttatatggccaacgcaaacagaaagaatttgtgaaggaattgggcatttccaaagacacatttacgagatggaaaaaagaattgctgccaaattataataaaagtaagagaatttgttttgtattattttaaatttttattattaagcacaaaataattattccaacgatgacaaattaaaaaagatgaagcaatactttaaaatcaaagaaaaaaatccaaaaattaccgaccaaagaattgctaaggatttgagaattggatattccacgctgaaaagatggaaacaggaattagtatctatttctgacatgtgatttttgaaattgtttgtgttattttgatatgttgtattgctataccattttctagtttaagaaattgtaaaatattccaaaatcaaataattaaatatcaagtgcaataacccaaatatacgggccattttctaaattttttacctattttttgtgtggatagcattttacgcggtaaacacaaggctcggatctgtccttatttataagatttgtccttatttggagggtccaaatcttagaaaataaa

SEQ ID NO: 71295 - DNA, 103 bp, Heterodera glycines
  Genomic contig location: Contig_ID=SeqID_43673; Location=899..1001; Strand=+
  SCN-specific regions: Sequence locations=1-103
aaaatttcaggtattttcatgtctgaccatttttgggacgaaaatgtcttcgatctgatcgttgaactagagaaggaaggccgccatgtacggcttgattggc

SEQ ID NO: 71296 - DNA, 411 bp, Heterodera glycines
  Genomic contig location: Contig_ID=SeqID_43676; Location=788..1198; Strand=+
  SCN-specific regions: Sequence locations=1-16,38-80,102-288,310-411
atgagaagaaacgtgcaaattggaaaaattaatgaaagtatagaaaaggcgaagcgctgcgtgctggtgtttgtaaaaggatatgcatgtgtatgtgtatagacatatagcagcagcagcttccttttttgtcttcctttatatgtataatggtgtggcgcccgctttctatttggacggcaaaaatgccgtagttggataggttaatacaaactcattaaagggatggaagtgatgaatggaaagtgaaaattgattatttaatgatttgatcatatgtattacagtaccaaaagaaatgtaaaattggtagattggatcgaaatcataaactctaccataacttggttatacggacaaagaagctttaaaattggccgtttaatacaaaaaataggtttgaaaatagta

SEQ ID NO: 71297 - DNA, 321 bp, Heterodera glycines
  Genomic contig location: Contig_ID=SeqID_43676; Location=21..341; Strand=-
  SCN-specific regions: Sequence locations=1-124,147-321
atgtgcagaatccttttcatcgttccaatttacgctttcgactcgtggctgagtttgttgttcttcagcaatgatgtgtacatttacttcaactccatcagagattgctatgagggtgatttgtttattggatttaatgaataaactgtgcttttatagctttcgttatctacagcttcctgagtttgtgttacgaatatttgggtggtgagagtaacattatggcggagattcgtggaaaacccatccgtcctacaagtatttggactttcacctgctgtctgagcgggaaacagtacacaattgagtttttgcgcttct

SEQ ID NO: 71298 - DNA, 708 bp, Heterodera glycines
  Genomic contig location: Contig_ID=SeqID_43681; Location=84..791; Strand=+
  SCN-specific regions: Sequence locations=1-238,260-389,411-708
ccgtttcccgattggacttcgcccatcacttttgcccatcacaaagcgaatgcttccatagcttctcatccgtcgtcgtcgccaatggccactataatcctattcagctgcgttcgttgctccacattccgttccgtcaatgtgatggtgcggtttcggagatcgggcgttatttttaacgggtgtcacttcgtccccccccccccgagaaattaattttgattaaactacaaaatctaaacttttaaagaaatttcgtaggaagggggggggtgtaaaactgtcaaaatccccattgcgaaactaaaaaaaatttcgcaaatctttcaattcccaaaaaaaacttggtttcatcatcgaacggcacattttatatgtacattttacaccattaattatttttccattgtggcacctttttatgcattgtttgacctcattaggattttcttcttattgacagactaatacaaaaacgaaaagaatcccttcccataggcactggctgaacacattgccaaagtgcacttgcagcaaaagccattccctggcggcgttcgcgtgcgtctgttgccgaacagcaaaaacaatggacgaccactgattcagtcggccaacatcagcagcaccaatggagaacaacagaagaatctgatcgccgtcgtcgagcagcacttggagcagtacaccaaggacctcgttaaggaa

SEQ ID NO: 71299 - DNA, 371 bp, Heterodera glycines
  Genomic contig location: Contig_ID=SeqID_9406; Location=107..477; Strand=-
  SCN-specific regions: Sequence locations=1-371
tatacatcccattatgacgctaaaattatcagagtgccgaaaatcgcatgtgatctaagcctagaaaaaaatggtgtaagtaaaatcgtaattacgctcaaaaagctcctcaaacaattttagcgcttccaattccttctacaatcgcctttatacatcccattatgaacgctataattatcagagtgccgaaaatcgcatgtgatctaagcctacaaaaaaatggtgtaagtaaaatcgtaattacgctcaaaaagcttctcaaacaattttagcgcatccaattccttctacaatcgcctttatacatcccattatgagcgctaaaattatcagagtgccgaaaatcgcatgtgatctaagcctataaa

SEQ ID NO: 71300 - DNA, 135 bp, Heterodera glycines
  Genomic contig location: Contig_ID=SeqID_9406; Location=1761..1895; Strand=+
  SCN-specific regions: Sequence locations=1-135
atgagccaaaaccgtgacgaaaactcgcagccacatgtactcgatggtccatacccaccggcacaagagggtgttgagtttgtggaagatgaagcacctttgatgcttgaggtgttggagcgtctgatacaagga

SEQ ID NO: 71301 - DNA, 1212 bp, Heterodera glycines
  Genomic contig location: Contig_ID=SeqID_9407; Location=623..1834; Strand=+
  SCN-specific regions: Sequence locations=1-150,175-472,494-621,669 -772,803-921,946-1119,1145-1212
atgagccaaaaccgtgacgaaaactcgcagccacctgtactcgatggaccgtacccgctggcacaagagcgcaatgagtttgtggaagatgaagcaccggtgctgcttgagatgttggatcgtctgtcacaaggagtgggttttgttttgaattatttaaattttttaatttttccattttggcttatgctaattgttgattttgtttagggaatttgccaagccatgggcctgttttcgtttgcacttgccgactgttaggccacatttcatacatttgccatactgttcgactgtgagacacctgtgccatttgacgagcagcacaagcgatacgtgttcaaacacatggacaaaccgcggctaatctacgtttcggaagatggtagcgctatacaggttgacggtgtggtgaagcaaggggaatttgtgatgagcatcgagacgatgtatctcgataagcgaaacggagttgatcacttttgcacattcctgcgcacttttggcatttgtttcttgatgtgccattgaatgtgtttatttgttgcctattcagagcagtaaattgtttgcataattctgtttaattattttttgtttacaaccaaaatattgatccgcatttttatgttataattttaattcatttttgaaatttttatttaaatggcaaacgaagacttccgcttgtccgaatgcatccgttttattgagcgaacagcccaagagtatgattgtgttctgccggttccacggcttgggtttgtcacggaaaattttcttaataattttttttaaaatagctcaaggcgcgatgagcacctggatgcctgtgttcttatggaatcagtgggctcaggccatcggctctacattttcgagtttgaggattgcctccaggtatttttaaaatatgaggtcaattaattaaataaataaataaaacaaaaccccacaggtgaaaggacacatcgaaaacgaagacggaacaagtacacgcgtgatgattgagcactatgataaatacaatgggttatgtggatttgaatcgtttttggcgtcatgtgcttttaccttttttggattttttgttcacgtttcctatgaagatgatgattgatttaattttaaaataatttttattgtatattgcgtttcacaaattcataaacaaattcatccgaattacttggccttttcaaaaattgcata

SEQ ID NO: 71302 - DNA, 488 bp, Heterodera glycines
  misc_feature (18)..(18): n is a, c, g, or t
  misc_feature (127)..(127): n is a, c, g, or t
  Genomic contig location: Contig_ID=SeqID_43682; Location=1164..1651; Strand=-
  SCN-specific regions: Sequence locations=1-58,81-488
atgatcgaaggagaacgnggatgttacgtagaaagaagaaggaacaaaaatggaattgtacaaatcagaggatacattttcaaagatgaccaaacaatggacgaatgtggcattgcaaaggcagatntcatttatggtagaaacatttttggatggaaaaaaatttctgaggaacccaaatccgccagcagcagccgcccgaaattggaaaaaaccggaaacaaagcaacctaaaaatgatgatggcacaatctgttgctaaatgatcattctagtgctttagataaaacacctccaactgtttaacaggtgtcccccgtttttggctatcttctgtcttttcttaggggttactcaaaaaccagaaaaaaaacaaaaaacaaattttatctactttacctatgactttttctcaaaaacaatcaaattttaatttttaacctattttcaataactctaggtgttttctattaccgtgcaaaattaaa

SEQ ID NO: 71303 - DNA, 1782 bp, Heterodera glycines
  Genomic contig location: Contig_ID=SeqID_43683; Location=402..2183; Strand=-
  SCN-specific regions: Sequence locations=1-82,105-155,178-206,228 -393,415-438,463-516,540-542,564-603,719-728,759-776,870-881,933 -965,995-1015,1073-1632,1654-1782
atgtcatattcatactcatcgaccctgaaaacgccccagaaatgttttcatgactatgaaaatctacaaactgcagaactacatattaccccacatcctggatatccacgaactaaagctgggaagtttataaaatttttcctaacggttaaatgcaaaatcaaaaaatctttgaaattatccgaaaaagtttttccctgaaattttttcccggaaaggggaattttttggggggggggctttttagggggccccgctttttttgggggaaaaaaccccccaaatttttttcaaaaatatgggaaaaaaagggcccaaaaagggggaaaaaaaatgaaaaaaaccccccaaaatgggggaaaaaccccccctttttttttccaaaaaattgggaaaaaaaaattttttttttttgtgggggggggggggagggggggcttttttttttttttttttttttttaaaaaaaaaatttttgggaaaaaaaaaaagggggggggggaaaaaaaaaaaaaaccccccccccccccgggggggggaagaaaaaaaaaatttttttttttgtccccaaaaaaaaaaataaatccccccccccccccccccaaaaaaaatatttttttttttttttttctttaaaaaaaaaaaaaataaaaattatttttattttttttttttataaaaaaaaaaaaaatatatttttttttttttaaaaaaaaaacacacacaccttctttttttttttttttttttttttttttagaaggagaggggagcgcaaaaaaaaaaaaaaaaaaaaaaaaaaaaaaaaaaaaaaaatttttttttttttttttttttttttttttttttttttttttttttttttatttataaaacaacaaccccccccccccccccccccccccccccccctccccccccccccccccccctcttcatatttccttgctgtgttttttttttttaaaaaaaaaaaaaaaaaaaaaaaaagaaatttttctttctccccccccgcggggggggggggggggggggggggggggaaaaaaaaaaaaaaaataaacaaaaataaccttatcatgagtgggggtccccccaaaaaaaatacctataaaacccataataaaattattgccccatttagctgcccagcggtgtgttgtgctgtggctgcgtactttcaaaaatccaattttttgatgatatctcaaagcttttcatttatcctatcattttatacatcctttttaggtgcggtgggcgaaagcggcgctcagtgcggcagcgctcagtggcatgttgtcgccaccaatctcggcaccattggccacaacagctgcgcccagtacagttgccggcaacgggactatcgtagccgactcacgttgtgcaagaagctgtcagccaactacggtagctgctgccacaagtggccaacaacaaatgccgtccacgcttcccacacaattgagcagaggaggagggcacaattcattgatttaaaagtgtgccaatgatcattcattgttgacacatacagatacccccgtagatgcagttactttagtcattaaaacttttattcattttagcaccacataattatgtttctcatacatcagttagttattttttgtattgtataatttatatgtagttaatttagcatcacttttttttatttatcccccatatattatttatgtgtagttctattgttattttttgaataattagcctagtaattgattaagtatgtagatgatagcatgcatcaataaa

SEQ ID NO: 71304 - DNA, 270 bp, Heterodera glycines
  Genomic contig location: Contig_ID=SeqID_43685; Location=56..325; Strand=+
  SCN-specific regions: Sequence locations=1-15,71-99,121-181,207-270
atgacagcccaaattcaacagcagcagtggcaccagcaaatgcaacggcagcagcaacagggacagcagccgatgatggggtaagggggaggggggacaatgaaaaaacattgttggaaattggggttcctataggtaggcgacaggcacgaaaaatggcaattctcaaaaaaatttaaccatttttttataaaatattaaaatttcagaaaattttcccagtggcgtctatcggcaccgccgtgcccccatttcaccttatttttttaa

SEQ ID NO: 71305 - DNA, 439 bp, Heterodera glycines
  Genomic contig location: Contig_ID=SeqID_43686; Location=340..778; Strand=-
  SCN-specific regions: Sequence locations=1-439
aaaatggtgtaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgc

SEQ ID NO: 71306 - DNA, 304 bp, Heterodera glycines; identical to SEQ ID NO: 51570
  Genomic contig location: Contig_ID=SeqID_43688; Location=392..695; Strand=-
  SCN-specific regions: Sequence locations=1-304

SEQ ID NO: 71307 - DNA, 750 bp, Heterodera glycines
  Genomic contig location: Contig_ID=SeqID_43689; Location=403..1152; Strand=+
  SCN-specific regions: Sequence locations=1-164,186-249,278-283,305-750
  Gene Ontology: Mol. function=dihydrofolate reductase activity; Biological process=nucleotide biosynthesis
catattggaatgaacatcatcgctgctttggatgccaattgcggcattggccgttccaatgcattgccctggcatttgccggaagaatacgcacattttgtacgcgttaccacacacacgactgacccacgaaagcgcaacgctgttttgatgggacggaagtgttgggaaagtatcccaaaaaagttcaaaccgttgaaggggcgcctcaacattgtggtgagttttgattcaaattagagttatttcaaaaaacaattatattttttaaatttagctcagccaaacaatggcacctcaggtgaatttgtgcagcaattaaaacactaagcttttgatgcacttattgttagataaatgaccaactgatagtggcaaaacagctcgacgaagtgttcgccattctaaacgacgaaccgttcaaagacacagtggagaccatttggtcagcttcacaatgtaaaaaaggcgtttaaactagcagaggattattattatttttttgccatttcatcaaaaaaagcatttccaggaatgtgggtggtcacgatatctatgcgctcggtttgcagcatccgtcgctgcacaaagtggtgctgacccgtcttgacaaggcctttgactgcgatgttcatttcccaaccgttgactgggcacaattcgaacgcaaagacgactttaatggaccggaggaaatgcatgaagagcgaaaagtgacttggcacgtgacgtcgtacacgcggaagaaag

SEQ ID NO: 71308 - DNA, 49 bp, Heterodera glycines; identical to SEQ ID NO: 51181
  Genomic contig location: Contig_ID=SeqID_43694; Location=751..799; Strand=-
  SCN-specific regions: Sequence locations=1-49

SEQ ID NO: 71309 - DNA, 350 bp, Heterodera glycines
  Genomic contig location: Contig_ID=SeqID_43699; Location=975..1324; Strand=+
  SCN-specific regions: Sequence locations=1-350
ttttgtacctcttttatcactgttgcacctcttctatcactgttgtacctcttctaatcacagttgtacctcttctgatccctgttgtacctcttctaatcactgttgtaccttttctaatcacagttgtacctcttctgatccctgttgtacctcttctaatcacagttgtacctcttctcaccactgttgtacctcttctaatcactgttgtaccttttctaatcactgttgtacctcttctaatcactgttgtaccttttctaatcacagttgtacctcttctgatccctgttgtacctcttctaatcacagttgtacctcttctcaccactatgtacctcttctaa

SEQ ID NO: 71310 - DNA, 159 bp, Heterodera glycines
  Genomic contig location: Contig_ID=SeqID_9409; Location=5..163; Strand=-
  SCN-specific regions: Sequence locations=1-66,88-127,149-159
atgttcgcgaaagaacgcgaatggaaaggtgcagcgattgcgccgaaaaagccatctgatcaggccgaaaaggaaagtaaagggaaagaaacagccagaaaggacactttagccgatctgatcaaaaaagacgagagaaatgaagagccgacaaattca

SEQ ID NO: 71311 - DNA, 638 bp, Heterodera glycines
  Genomic contig location: Contig_ID=SeqID_9410; Location=899..1536; Strand=+
  SCN-specific regions: Sequence locations=1-54,130-322,411-443,465 -542,564-574,628-638
atgtgccgcttggcaatgttcgtttcgctggcgcaattcataagcattgaaatgaaaaaaattttgtaattttaacatttaaagaaatgtatacattaactattgaatatattaataaaataataattactgccaaataccggtaattaaggaaagaatatgccaaaggaattatcccacgcgcttgcgcaaaaattcgtcgtctttttggacgttcggctgccattcaaactgctgcagatggtgctggcacgggctcaacaacaactccttctatggtacaacgagaatgtaaagcaaaattgatggtcatttatgtaagtaaaattaaatataaaattagaataatcgaagatattttaaataaatctttatttataattaataaaaaaaatttcttaattaattttctcagatggatatcaaaatgaatgagatttactttgagaagatatttgattttatgattgtcgccaaagatttaatgataaaaacaagagcagatgtcggtgatccgcgtcacatccaatcagcccgagtgataagaaaattaaattaaaaaacacgcaaatcattacttaattattcggattatttaattttatttatttatttattttctaattttcaatttaaga

SEQ ID NO: 71312 - DNA, 375 bp, Heterodera glycines
  Genomic contig location: Contig_ID=SeqID_43703; Location=290..664; Strand=-
  SCN-specific regions: Sequence locations=1-375
atgcacgcgttttgcgctcgagctatttatcatcgggcttgtcaatccaaagcgaaacaacaaagatgctgttttgaacgaataaagggcataggttattttgaagaagtgtcaaagaacatgcagcaataagcctgcaaaatctaataagtggaaaatacatgagtatagaatttattttcagaaagtgtcaacagacttttggaaaaatatatttgcaatttatcaacaattttgagaagtgagttagaaatgataatcttcacgattcaaaccaattttcgttgctctaattaaccgcgataaaaacattcgaatcaattaaatagcttctgagataataaggtttatcataaaatttcatttaaaaataaa

SEQ ID NO: 71313 - DNA, 672 bp, Heterodera glycines
  Genomic contig location: Contig_ID=SeqID_43707; Location=47..718; Strand=+
  SCN-specific regions: Sequence locations=1-121,143-672
atggtaacaattgtcagttgtaatgccccgcaggctaaccctaaagttgtgcatattaatcagcttaaaaggtgcgtagaaatcctaggacccgcttgcaccgcaccaaatgtctccgatgaggaaaaactttcattggaaaaagcagatgctgttgaagtatttgacatgcccgattttaatcatctgaactcagacaatccaaataaatccgaaacagaccctaacactgagtccacataaaccttttgcagtattttgttattttcccacgtaccacaacactcatcaaattcagttccctcatttgatttcagattcaaaactcataatcctccaaattcccaatttccttcctcgttttctgatcaattccattccccaacaaagtccgacatccgatctttcatggactccgacaaccgttcaatgtccagcgacacgtctacgattcgccgagtaatcgacgaagctgttgacaacgttgtttgctctgaattgttggagggtcaagatcccattgacatcgacctgtcgtatgcgctggaggtcgaattgctcgggccgcaagagcccactaatccgcgcataacacctcaaccggacaacaactccgaagtttggcaaagttgtgacgatgacaacatggacacgtccagctccaagttggat

SEQ ID NO: 71314 - DNA, 101 bp, Heterodera glycines
  Genomic contig location: Contig_ID=SeqID_43708; Location=146..246; Strand=+
  SCN-specific regions: Sequence locations=1-101
atgcagaaatcgttgccaaaatatccaaatgatccggaacgattgcccaaggaagtgattttgagaagagcggccgaactggcagaagcattgtacaaccg

SEQ ID NO: 71315 - DNA, 72 bp, Heterodera glycines
  Genomic contig location: Contig_ID=SeqID_43709; Location=125..196; Strand=-
  SCN-specific regions: Sequence locations=1-72
atgtctaagcgaggtcgtggaggcgcttctggggcgaaattccgggtttctcttgctcttcctgttggcgca

SEQ ID NO: 71316 - DNA, 264 bp, Heterodera glycines
  Genomic contig location: Contig_ID=SeqID_43710; Location=832..1095; Strand=-
  SCN-specific regions: Sequence locations=1-91,116-144,166-264
atgactcaacaaaaaacagttattaaaaagcggtgcgaacattggagtcactttttcaatcgtttgaaaggttgctcaaaagtgatttttgaaaataaaaaataaataaaattttcagccaattattggtcaaaaattgtgctgaatacaaaaccaaagaaaaaacacggaaatattgaaaattgatcataaaaagccaaatataaaagttgcgtgactttgtccgcacttttttatgattttttattttcatcttcaaataaa

SEQ ID NO: 71317 - DNA, 447 bp, Heterodera glycines
  Genomic contig location: Contig_ID=SeqID_43715; Location=255..701; Strand=+
  SCN-specific regions: Sequence locations=1-447
atgttctactgccactggcagcaactccgaacaattgacgccgctcgttacccagtccggccaaagcttcatcttctcgctgctcacgtcgttccatttgcacgcactcatctctggtggggactgatcagtgaacagggaatggagcatatgcacagaatgcaactatttggtttaatgaataatttttcccattaaaattataaatccaggtcggtcgttatgctcatctcggtactccagagaaggttgttgagaagttggtgaaacacgtgacactgctgaatgcccttcacgatcgaggtgtcgaaaacaatcaagaaaatggaaacaaatacccaaacttttgatcaaatttcatttttccaaacattttcaccatttcacatttccactatctgaatattatgttgaacacatcttttccgctttctatagtactattaa

SEQ ID NO: 71318 - DNA, 265 bp, Heterodera glycines
  Genomic contig location: Contig_ID=SeqID_43718; Location=321..585; Strand=-
  SCN-specific regions: Sequence locations=1-265
ggagtctcgccgccgaagtttaaaccgattggcgaactgtcggattaccagcaacaaatcaacggatcacaaggcaaaagctttacatacggatgctgtaccaaacatttgcttatttgtatttgttttagaagtttcaaacattcgattcgccactcctccgccacaaccgccgccggtgcttcgcaatgttccgttgcctcccgtgacgtcgaataacaacgaaatgatggtggaccgcacttgtcgaaacaacacagcaaag

SEQ ID NO: 71319 - DNA, 85 bp, Heterodera glycines; identical to SEQ ID NO: 65905
  Genomic contig location: Contig_ID=SeqID_43721; Location=291..375; Strand=+
  SCN-specific regions: Sequence locations=1-85

SEQ ID NO: 71320 - DNA, 878 bp, Heterodera glycines
  misc_feature (870)..(871): n is a, c, g, or t
  Genomic contig location: Contig_ID=SeqID_1276; Location=1..878; Strand=-
  SCN-specific regions: Sequence locations=1-209,231-746,768-790,821-878
  Gene Ontology: Mol. function=protein binding; Cellular component =nuclear body; Biological process=mitotic cell cycle
ggagctaagcaaatatgacaaagtgctctatcggatatttacgaattcaaaatttaaattttcttaggttcgaaggccacataaaatgattagcgatgataccaaaatcaaagtgactgtaaggacattgtcaacggagctgtgttgcccgatttgtctagacttgctgacctgtacaatgacgactaaggttcgaaataaaaaacgcaaaattttatgcctttttaatttcgtaatttatagcgccaaaaatgaccaaaaaaagggtctttaatttcattgtatgatagaaatattcttttcaaattcataggaatgtctgcatcggttttgctccgaatgcataacaacggcattgatgcgagggaacaaagaatgtccgacatgtcgcaagaaaattgtctccaagcgctcgctaagacccgacccgaacttcgatttcctcataagcaaagttcataaatttggggtttcctcatttatttgttttttgaatagatttggcccgaccggaagctttatgaaactgaacttgtgggttaagatttgatttgttgttttttttaaataacatctattcagaatgtatcaatgcaatttttccaagaacaaagcaacgttgcagcccttcaagtttgtttggactaattttgaattagaagggaaacatttagaaaagcattgaggaaggtatcaaagcgcaagcagcataccgaaaacaaagagtgcatgggtcgtacgactacgaaagttggtataatgttaaaatacgtgtttatttttcataaattaaacagaatattaaatttatacacaaatggatgggtggtaatttacgaattacaatttaaaattcccagaaaagaaagnnacctgca

SEQ ID NO: 71321 - DNA, 2621 bp, Heterodera glycines
  Genomic contig location: Contig_ID=SeqID_1277; Location=275..2895; Strand=+
  SCN-specific regions: Sequence locations=1-362,386-973,997-1339,1361 -1539,1561-2621
atggagagcactagccaaaatgctgtctcattgagtggttccgattttgaccccatctatttttcgcccgaggaaaatcagagatggggcaaactgttggacaggatgagaacctttgaacaggccgtgtgtcgtcaattccgaagaattgaacacacatttgtccaaataacaaaccagacccaaattcaagacactgtggagagagtcaaaaatttggagagttctataaaggagctcgagaatgccaccgaattggacacattcgagacaaaggaaaaattgattgatgccgaagaagaggtagaacgggtgaaaatgagaattgatggttacgaaagatttacaaaggtacggtttgggaaaataatagaaaaaatgaaaagtgaagttggacgaattactgaaaatttggacacattgcaaggcagagtgcagctgttggagtatgaacaagacgagtatggaagagatgccgaatggatggaagacgagaattttagaggacaggcactaatttctccggagcaaaatgacaaaagagatgacatttcggtcggagagtgtgaaataatggtctcggacccatttttgggaggaattgccccattagaaggctatgatgggaatccgagtgtttctttttcccgttgggttgcccgattggaggatatgttgtctttgtacccgcaattgacggagccccagaaattaagccggttaaggatccttttgagagggcaagctagagcggaatttgaatcgatagagcctgctccggaaacgttagtggtggccttagaacacttaaaaatgaaattcgaaaacgaaaacacccgatcgatagctcgtcagacaatggtaagttgccggcaggcgcctggcgaaagggtttatgagttcgctaataggcttaatgaggtagtccgaactgccttatcgggggaaagcgaaggaataatcagaaaaagactttttgaggaatttttggaaaaattgacccctgaacttcaatttgaagtgaaagcagggagacccacgagttactcaaatgcttatgaaatcgcccagcattttgaacttcttttggccgccaagaggccttcacaaatctcggtcgcagactcggttgcggagttgtcccaaagggtggaggccttagctgttcatcaacaaacaacaactaagtctggcgctgaccgaagagcatgctattactgtaggcggcctggacatttggttaaggattgtcgggagaaaagaagggacgaagaaaggggaggtcacagagatcaaaggggtggccgatttttcagagaggaaagaagatggagtagagaaagaaatgaaagggaaaaccggcatttcacgccgaggggcggaggacaaaggaatcaccgtttaaatcatcgatctccaaccccctatggggagggcgagggaaataatcccaaccgttgggggcctcaagggagaagggtgaactttcggggccgagtaggcgctgctcgagtggcaagccccatatttttggcattgatggttattttatcaatttttggcaatggaagtgcggttaaccaggctacaaatccaatgatatgtcaccccgagtcaccttcaagtttatggtccataccagtggacccaatttgtccaaattgggcaccaacggagttgcccgtggctatgaatttgccagtttttcgtctaaatacggtaaaatataaaacgaaggcaaccgcatgcagatgcatacagacaaaaatagcgagaagaattggaattgttggagggcgatatgaagaggtggcaacaaatactgttgaagtacctacagcaacttgtcgaagaatgaaagaatttgatgattcgcccgcgggaaaattgtttcaaattaatggtactttcaaagccacccaaaattccttagagcctggatggagaagttggccaatgggaattttctggaaaaccatggaaattctaaattgctatctttatgaaacgattgtttttgctcgtcacggtgcctcagggctgagtaccccactaaatgattgtccagcctgctcttatcaagccggaaaattgctgctgtgcgcaattaagctaatttggagaccagaccatactcactgtgtaattatgtgaaagtcgcagactggaagggggagtactccactgatatttggacagcaaattcgggggattttgctctaacatttgtaaacaggactgacaaggctgattgcgatggaaaatggtttgttgcctctgatcagtcatttgcaattccaagagaaagttatttggaaatgatcgataaaagtgagtgggcaaattcgaagaatcgtaaaaaaagagaaattgacaatgaagactcagtgggcttagtttactcatctcagctggcagcgcagttaaccgcattaagtgcaaaagttacgcaaaatacccaaaaattgttcgcggagaccgttaggaaaatatgtaccagtttaagatttttagctgatcaaacgcttacattagcagaagccaacccgactcttttggcccgtttttacttagataatccgcttttatccgcgaggctagtaacaaaggatgtgttggaa

SEQ ID NO: 71322 - DNA, 3380 bp, Heterodera glycines
  Genomic contig location: Contig_ID=SeqID_1277; Location=3565..6944; Strand=+
  SCN-specific regions: Sequence locations=1-140,162-332,355-1061,1083 -1396,1418-1671,1694-3340,3365-3380
atggtgcaaaactttacgggtgagagagtcagaaataatgcagcaatctctcaggaggctgtggaagcgcagctggtcaagtgtaatcccaaaccagtgctgaaaaataagtgcagtatggctggggcaaggccaaatgtgattgaaatggaaaagcacttcgcatgtaacataccgcttactgagaggtggctatcggtcgattcaattccgaccacctcaaaacggagaaaaaacgaaccagccgagcccggaccgtcagaaaatagaaaaatcgttacaatcgcaatgatgcgtgtgaattcatgcgatgaaaagtttagagttatggccagagttaatggatatgaaattaaaatgttgttggacacgggtgcacatgtttcgctgtgtaatgtagaaactgcacgaaaattgggtatcaagcaattaagcccatcagatattgtgggcgttgtcggcataagtgacaaaatgatacccataatcggaaggagtacaataaatttggaagttgcgggctgtcaggtgttaagtacggtttatgttgtgaattctaaaattgggtccacagggtcttacgaaatgatcctaggccgacgaggtttcagacaactgccactatttttagaccttcaaactggcgaattggtaagaaagagcgatggtaaaatatttgtgtgtgaaaaagtggaaacggataaaaacttggtgaaacccatggacaataatttgggaaagcctgtggaattggtcaaatgccttgacagatacagtgacattttttcaaaacacgattatgacttaggaggatgtacaataaaagcacctccaatcataaccacctctgcgacgccggagagagttagaccatatccggtgcccgaaaaatacgagaaagagttaaaagggcacattgaaaaaatgttggaggctggggttataaaggaaagttttacgccatgggcgcataatgttgtgttggtgaagaaatcaaatggccaattgcgtccgtgcgttgattttagaccgctaaataaagtgacagtccctgatccctatcctataccaaggatggacaaaaccatttatcgtgttgctggccgaaaattttactcaactttggatttggcctctggtttttggcaaattcccttggatggaaatagctcctataaatgtggcattgtcaccccttgggggttataccaaatgttaaaactcccatttggtctcagaaatgcaccaagtatattccaaaggacaatggacaaagttttggagggagttagaaacgtcaccgtatacatagatgatatactaattcatacgaatacggtagaagaacacatagaagtgttggggaaggtgttcgatcgactgaggaagagcgggttaaaattaaaaatgaataaatgctctttcctaaaaaagcagtgcacctatttgggccatattttgaatgaaaagggatatcgtccttccctgagtaatcaggaggtaattgaagcttttcccgcaccaaaaaatgccaaggaagttaaacgtttcctaggaatgatgtctttttttcgaaaatttatacctaattttgctgaaattgcaaatccgttacaacaattaacaaaggaaagagcggaatttgtgtggaattccctggagaaaatggcttttgaggagctaaaagggaaattaattgaggccccgtgccttagggccccgaactataaattgcccttttatttatttacagacgcttcatcaattgcgtacgctggcgctttaatgcagtcagaacatgaacaagaaatgtacgcagtcggttattggtcgcggaccttaagcattgcagaaagcaaactgcccgccacgcatggagaattagccgcaattgttaatgccgtccagaattttaggccaataatttatggggccgatttaaccatattgactgaccataggccgctcacattcttattttctaaggcaagtagcaacccaaaaattaaccgatggctgatggcattgcaagaatttgagccccaggttatttacctggagggtaaagctaaccgagttgccgatgctttatcacgggtccctattaagtgggaacaaattgaaatgaagagtaaagaagaaattcccttccttttggttgcggaggaggagacggaagttaataggagcataattgaaaaagaatcggaaaaggacccaattgtctcccaagtaattgcaaaaatccaggaaaattggcaggaacccatccctgaggaattgatgcagtattttagagaaagagataaattgtcgtttgatgggaaaattgtgtggaaaaaccccgggaggcaaatggtgatcccggagaaactgcgtggccaaattctccaaatgcttcatcgagcacattttggaattgtaagaagcaaggcgcgggcaagaagtcttgtttggtggccacaaatgtcggaagaaatcgaaaattttgtcaaagagtgtaatatttgccaaatgaatgcccccagtgtgcccaaaaatgacccggagcataaatggcctgaagcaaaactgccgttcgagagggtgcatgcagaccttgccggacccgtatggggaacaaattttcttgtaattgtagacgcttactcaaaatacccgtttgtagcccaaatgcagtcaactcattcgacagccatcataacttacctcagagagttatttggaatgtttgggtccccaaaaaccctggtaacagataatggccctcaatttgtatcattggaaacggagacatttctgtcaaatgaaggtgtaaaacacttaacttcaccggcatatcacccctcctcaaatggggaggcagaaagatttgtgaggacattcaaagaaggaatgacaaaattgctgcaggagggaaagagcctaaaggttgcgcaatttttactgctgcaggagtaccgggcaacgcagtgccaggcaaacggcggagatactccatcacaaaaattttttggcaggcaaataaggacagcactggaaaaaataaaaatgccgaaaaaagtgcccgaggcaaatgagggggacgaccccccgggtcggacaaatgagaataaagaacgaagtcaaaggcgggacaatccttttagcccaggagatatgatttggttcagagcagcagaaggacagtgggcaccagggatccttttacagccaatgggagaacgaatgtgggaaatagaattggaaggaagtaatgtcccaaggtccgcccatgtggaccagttaaaaggacgaagattgggctcagttcgccataactgaacgcagtttatgtgactaatattttgtacatttgtaaatgcctcgtcctaaattaa

SEQ ID NO: 71323 - DNA, 489 bp, Heterodera glycines
  Genomic contig location: Contig_ID=SeqID_1277; Location=7070..7558; Strand=+
  SCN-specific regions: Sequence locations=1-92,114-489
atggatgccgagaatgttccgccccaaaatgagttggagaaattagaaagagaagcgttggactcaaaaaagtcgaagtcgcgcggtcacgaagagagactgaagaatgaaattgcccaaatgatgggccagctgcgggaggccatgaaagaggaagtgcgcggggcagtggaaggactgtgggcaaaaactgagcctttgttggtggcacaaaagcgctcaacggacgcgctcacggaggcgtttgacgaattcacgtcacaagtgcacatcggcggcaaaaacattgacgagtatgaattcacgtcccaagtgtacgtcgctggtaaaagcgtggacgaggagcgatgtgacaatccgcaaccagcggatgacccgtcggaaaagggcggagaaacggacccaccagtgggtggaggggctaacccacccgtgagtggagagcctgtccaggcttcgtcgttgccgccagagcagccaactgtgaat

SEQ ID NO: 71324 - DNA, 795 bp, Heterodera glycines
  Genomic contig location: Contig_ID=SeqID_1278; Location=1043..1837; Strand=+
  SCN-specific regions: Sequence locations=1-92,114-500,522-646,669 -702,724-795
atggatgccgagaatgttccgccccaaaatgagttggagaaattagaaagagaagcgttggactcaaaaaagtcgaagtcgcgcagtcacgaagagagactgaagaatgaaattgcccaaatgatgggccagctgcgggaggccatgaaagaggaagtgcgcggggcagtggaaggactgtgggcaaaaactgagcctttgttggtggcacaaaagcgctcaacggacgcgcttacggaggcgtttgacgaattcacgtcacaagtgcacatcggcggcaaaaacatggacgagtatgaattcacgtcccaagtgtacgtcgctggtaaaagcgtggacgaggagcgatgtgacaatccgcaaccagcggatgacccgtcggaaaagggcggagaaacggacccaccagtgggtggaggggctaacccacccgtgagtggagagcctgtccaggcttcgtcgttgccgcccgagcagccaactgtgaatgtgagagcgccccagagagggggcaggggccaatggtgcccttcgggatataagggacaatggaaggcccaaggctcaggcccaaagcatcagaaacgagttggttatctgatgagacaattggagagggagttgagggaagagcaagcaccggaagggtgcatgtgctggagttgccgtcgtggaaagtggaacggggaccgtggtggtcgcggaggaggcatgggacgtggacaccggggagcatatggacgagggcgcacgaattaccagcagcacgcgggcccatcgcaccgtggacactga

SEQ ID NO: 71325 - DNA, 810 bp, Heterodera glycines
  Genomic contig location: Contig_ID=SeqID_1278; Location=51..860; Strand=+
  SCN-specific regions: Sequence locations=1-810
atgactgtccccagtgtgcccaaaaatgacccggagcataaatggcctgaagcaaaactgccgttcgagagggtgcatgcagaccttgccggacccgtatggggaacaaattttcttgtaattgtagacgcttactcaaaatacccgtttgtagcccaaatacagtcaactcattcgacagccatcataacttacctcagagagttatttggaatgtttgggtccccaaaaaccctggtaacagataatggccctcaatttgtatcattggaaacggagacatttctgtcaaatgaaggtgtaaaacacttaacttcaccggcatatcacccctcctcaaatggggaggcagaaagatttgtgaggacattcaaagaaggaatgacaaaattgctgcaggagggaaagagcctaaaggttgcgcaatttttactgctgcaggagtaccgggcaacgcagtgccaggcaaacggcggagatactccatcacaaaaattttttggcaggcaaataaggacagcactggaaaaaataaaaatgccgaaaaaagtgcccgaggcaaatgagggggacgaccccccgggtcggacaaatgagaataaagagcgaagtcaaaggcgggacaatccttttagcccaggagatatgatttggttcagagcagcagaaggacagtgggcaccagggatccttttacagccaatgggagaacgaatgtgggaaatagaattggaaggaagtaatgtcccaaggtccgcccatgtggaccagttaaaaggacgaagattgggctcagttcgccataactga

SEQ ID NO: 71326 - DNA, 1266 bp, Heterodera glycines
  Genomic contig location: Contig_ID=SeqID_1278; Location=1954..3219; Strand=-
  SCN-specific regions: Sequence locations=1-102,133-719,741-752,774 -913,935-966,996-1070,1092-1221,1263-1266
atggaaactctgacggacgacgagggcatttgcagggagccgtccgatcagcttaaactgctagcgtgtgcttattacacaattggatactgtatgtttttaggaaattaaacattttaatttgacttaatagaatttgcttcgttaattttcattcgttctcttctttttcaggttcgctttcccgcaagttcctttccttcccgtgggttgccagttgggatgtgctcgatgccgtgcgtcgttcgcgcatgatgtccgcgcttggccagcctggcaccgccaccaccggaagctgctcccgtatgttcagcgcaatgttcgactcgttcggcgaacgtatctccgaacacattgaacgttttgtttctgcacgacggacgcagttggaaggattcagtgcccgttgttttggcactgatcggacagtaactgatgggacggagacgggggaccattcggacagttgcgcgatcaaacagttgctgaaccgttacgtgcttcgacatgaaggtgaattttcaggattttgacaacggagcttttgccattttcaaaggtcttgccccactgatgttcttctgtgtatcgtgggctgaacacatgggccttttcgcgcagagtccgctcaaggaggaacatatttgtctccttttgttaagcgccggtctgacgaatcagccccaaaacgtaatcaactcggaggagcgtcgcccttggctgagtgaggtaattggtaaattgccgaaaatattttgaaaaaggattgatttcagactccggttgaatgggccgagtcggaagcaacgccacgacgagcggttacccgaccgggacgacgcttcagctccttcgttgagagtcttgcctcccgggacttcgaacagcttcactgtttggactttgcacatttgggcttgggttcagccgctttcatgttcatggttgtgttgtgtccaacaccaaattagtttttcccggttttaaagcaagaaaagcaaaactcttatttgttaaagaccaaaagtttattaagcaaaaataagaaagcttcaggcagggaacctgaggtttaagaaatggtaaaggaaagtcctgaatgtgagggcaaaggcatcgcttaaatactgacatgagtaaaggggaggagacgaacagatggacaacaaaacattacataaattgttgagttgtggaaaataggtcatcattgggggatctttaggatggacagaaacagagggacttaaggcaaaaacaaataaa

SEQ ID NO: 71327 - DNA, 1547 bp, Heterodera glycines
  Genomic contig location: Contig_ID=SeqID_9413; Location=1243..2789; Strand=-
  SCN-specific regions: Sequence locations=1-328,351-879,914-1033,1069 -1085,1125-1169,1191-1547
atggcaccgccaaagccaaagaaaattgttattccaacaaataacaatttaacagaggaggaggatcaattggcatctactgataaacagcaacaacaacaagtcgccttaattctggaagaaaatgctgaaaaggaaacgaccaaagagactgaaaattttttgatagcagaggatgatgatgatcaactgtttttgggtgctgctgctgagggcgcaaatgttacaaatttgcgacagggtgatgagcacggcattttggtgaacagaattgtagagaacacacgcatgcttgaggagaagcatttacaggttaaaactgagcatatattatgcttatatacttgaattcaaagaaattttgaccacaaaaaattttattgatcaaacgattttctccgattataagcaccttgtgtgactcttaaacccccgaaaaaaatgtgcaggaggatggcccatttgtggaagcggatgagcctgatttgcaagagcagcgaagggttcgcgttgagattgagtcagtgcaacgggttctgcaacgggcgacacagaacgttcagcccttggtacggaccatggaatttgctgcagacgattttgacacaatgttgcgcgagttggaggagtgtcgtaagcagtcgctggtggtagaacgaaagttgcaagaacgctccactggcgtcagttcggaagttgttgcgttgagcacaacgttgcgcgcgttggacaacgacattcgcgaagtgcgtgaacatttggcacgttcatccgccaatatgcttgaaaatgaacgaaaaattaatgcattgttggaaactaattatgccaaaaaatgatcgtttttaaattgttaatcttttttttgttttatgtgccttttaaatttatgtattatttattttattttttacgttgatgccaaatgaacaactttatattgcatatgaactctattcataacttacttacatttaaaaaaaattttctggttttcattttaattttttttttattcggaaacttcgttacgtatattaaatttataaatataaactattttaaaaaccagataaatggttgcgaaaaatattaaataaaattttttattttaattaataattggctcaattttcagttgcgcactacaggaaggtgatgtacagtaataaaaatggcaggactacaaaatttttttttatgtgttatactcatattaattatttttttgactgacttcctccatgactatttcaacaatttattcgaataaataaacgccggcaaattttcttaggattctgaattttgtttatttccattttatttttatattttttcataagtattttatccgaaaaaaagttttcgagaaattgatgaaacgccgtttggacttcgacaatcagagtccaatggcgaatggaattcgacttcgaaatgaccatttgacattggaatatcggccggacaaacccatgctcagatccattggaaaagcagtgagttttcttatgtctgaagtgttctcaaggtcaccaatgtga

SEQ ID NO: 71328 - DNA, 813 bp, Heterodera glycines
  misc_feature (777)..(777): n is a, c, g, or t
  Genomic contig location: Contig_ID=SeqID_9414; Location=28..840; Strand=-
  SCN-specific regions: Sequence locations=1-294,316-352,375-481,503 -511,556-813
atgggctcaactgatcaaacgaaggcattgttttccacgctcatccaacggccaactctcactgatcagctgttgcagcgaccacccttcaaattcatccacgacattgtgcatgagacattacgtgtgaccggctttttggacggtctgttcacgagtgatgagcttgactcaacaaaagccggctcgtcgcgcgacaataaaatggcctttctacaaaagttaattgacgcgctgaacatggacggtcaccttgacgacgtgaagccagcaaaaattgtggccggcaaggaagcagaaatgaccaatttcttgctacagtcattggccactgaggccacaatgtacgcgaagcaagacaacaacaagcagcagcagggggatgtagcggtaaagaaaagtgcttcccattcctccgcttcatcaaagtccaaatcgactactgttgaagcggcttcttctccatccgcatcaaagagtaaaaatgatgatgacgagaaaaggaaaagcaaaaaagagagcagcagcaggagggacaaggagaagaaggaggaagagcatcatcgttcatcattaacaaagcatcgatcaaaggacaaagtgagcagcagcaaaatcagcagaacaaatggcaaccaccgaatttcgaatgaaactgcggcggagaagaagccttcaacagaccgggagaaaaggaagaagcggtctgaggggttgccaaaaaagaagtcagcatcgtcaattaaaaatgccaacgatgctgctgtgcttgatganaatgtcctaaaccatcagcagaaacacaacagatga

SEQ ID NO: 71329 - DNA, 73 bp, Heterodera glycines
  Genomic contig location: Contig_ID=SeqID_9414; Location=1953..2025; Strand=+
  SCN-specific regions: Sequence locations=1-73
atgaaagaagaaaatgccggaacatcaggcagcacacagaccaacaacacatatgtgctgctgccagatataa

SEQ ID NO: 71330 - DNA, 1146 bp, Heterodera glycines
  Genomic contig location: Contig_ID=SeqID_9415; Location=357..1502; Strand=-
  SCN-specific regions: Sequence locations=1-101,138-463,485-672,694 -696,718-753,789-821,864-911,940-1050,1072-1146
atgcctcaatcacaacaagagttgaacaatagttctgatgacgacacgttggccgtctcatcatcctcatccatccaaccggttgaagggggaaaggtgcgaaatattttttgtaaaaattttaattaagaaaatttgctttgctcatgaatgttgtaggttaaaaaataaattttataagttcccgcactcactgggattgaaccttaaagctggttttttctagtcaagcacatagaccactataccattaaatgctgaaatttcgctttattctctatctattttctattgtgcagattgtccaatcctttaccgtcccctacatttccccgttggtgttgcgccgtgagctggagacgctggtgactaatgccgccgatggtgcactggtgttggcacggcccgggatgcgcattgcacacccaatcattttttggaacctgttctactactgcaggcgacttgaactgcccacccatttgctcacatgggttgctggagcggttgtcattcactgtgtgcaggtcagtcatcagtgctatttgggatactacgacctgtggaccttgattcaggcctgggttcttcctggattccaggtcctggccgtttttcggcaacctgggttttttcaggacctatattttcctattttgtccaagacatccatgtccttcacattccctatccaaattttaaaaaatgacattaaaatacaggaatttttaaacagattgccagaagtacatgttttttaaaatattttttgaaaaaaactaaaatttcttcttgttaagaacattaacaaataatcgaacaaaaatatataattttagaattttaatatttaaaaatataaactattttgcttttaaaggatatgccacgtttgccttccgccgacgaagacaaacagcagcaacaacaacaacacaacgatgctgttgctgaaccgtccagcggcaatgaagcggaggagcctggcaggacaaggaattgacggacggaacacaaacaacgcccacacaattaattgctcatatcttctaacatcatcatcattcaccacccacaccaatatacaaaatgtgagttattataattttccaaagtaattagttatggtcaagtatgctaaataaa

SEQ ID NO: 71331 - DNA, 118 bp, Heterodera glycines
  Genomic contig location: Contig_ID=SeqID_43723; Location=127..244; Strand=-
  SCN-specific regions: Sequence locations=1-118
atgccatcccgccaacgaaagccgccgcccccttcttccgcacttatgggacgaatgcttccaagcaaatccgacgaatccgtgcgctcatggcaattgatggacagaagatcgccct

SEQ ID NO: 71332 - DNA, 516 bp, Heterodera glycines
  misc_feature (126)..(126): n is a, c, g, or t
  Genomic contig location: Contig_ID=SeqID_43723; Location=1..516; Strand=+
  SCN-specific regions: Sequence locations=1-56,88-516
  Gene Ontology: Mol. function=chaperone activity; Cellular component =nucleus; Biological process=protein complex assembly
aaaacgacagctgttcatcaatttgtaaggcttcacatatgtaattggcatttctcttttataatttttaaaaatttaattttttttgtccataattttcgacatctccctatttttgtcatttanagggcgatcttctgtccatcaattgccatgagcgcacggattcgtcggatttgcttggaagcattcgtcccataagtgcggaagaagggggcggcggctttcgttggcgggatggcattgtgctgcaggcaatgcgccgtgggcaacggttgttggtcgatgaaatttcgttggcacccgactcggtgttggaacggttgaactctttgctggagccacagcgtgccattctgttgaccgatgcgggcgccgcgcatcaaagcgacggcactgacagcggcagcagtagtgccattggcggtggtgagacagtgacagcggctggcggtttccaactggtggcaacaatgaacccgggaaatgatcatggcaaaaaggaggtgagtgaga

SEQ ID NO: 71333 - DNA, 656 bp, Heterodera glycines
  Genomic contig location: Contig_ID=SeqID_43724; Location=49..704; Strand=-
  SCN-specific regions: Sequence locations=1-433,455-656
gttttcgggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataaatgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttt

SEQ ID NO: 71334 - DNA, 103 bp, Heterodera glycines
  Genomic contig location: Contig_ID=SeqID_43728; Location=324..426; Strand=-
  SCN-specific regions: Sequence locations=1-103
atgtcagcgtcaaaattttttctgaagtcgaacgacgatgaggtgtttgaggttgaccgcaatgtgatccgtctctccaccacactcaacacgatgtttcaag

SEQ ID NO: 71335 - DNA, 940 bp, Heterodera glycines
  Genomic contig location: Contig_ID=SeqID_43729; Location=24..963; Strand=-
  SCN-specific regions: Sequence locations=1-144,166-229,251-393,436-899
atggccttttttcttgggctggggatggcattttggctttggttttgtgccgtgttcgtcgccgtcccatcgttctcctccccctcattttgcctaatttcgtcttcgtttgccattataacaattgaaaatctcaaaacaattttctctttcttttctccctgtgatggcacttcgatttcaatgtctttgccattcaaatatttctgtacgatttcgttgccatcattgaaaattgcatttaatctaatgttgactttgcgcattggcaaattctggtggaaaattacgcgcagtttcagccttttgtccgtttcatctgccaaaacgaagtcaaaacagaaaaacgaaaataaaaatgccaaaaaatgcatttacaaagcagaaaatctgaattatttttcttttttattcgaaaattaattaattaaatttctaaatgagaggcgatcatttaaaatttgtatattctaattaatgggttttgaaaaacattataatttatggaataattcgatattattttgtgtttcaagcattattgcacattaattactccaataacatgactttcactcgcttttttcaggcgaattccacgtcttcaaaacattgtaaaagccaacattaattatttgtgggaaccatgatcgtctttccactcttttatttccgatgggatcaaatcaaccgggcgatgccagcggcgggcgtagccaaatgggtgatgccaactgggcgatatagggcctaaaccagggatggcattcctaggccccaaaaatttacggaaaccggaattacgggggtaaaaaatttttcgaaaatcggaatttcgaggtccaagaatttttcggaagtcggaatggaatttcgaccccaaaaacgtcggaaaccggaaatttttgaaaaaatataaaatatattaaaatttaataaa

SEQ ID NO: 71336 - DNA, 909 bp, Heterodera glycines
  Genomic contig location: Contig_ID=SeqID_43731; Location=317..1225; Strand=+
  SCN-specific regions: Sequence locations=1-88,110-270,292-909
atgaaagaacactacgacgcacaagcaaaagtcacggagaacaaattccaaatcggagacagggttatggtcatttttcccgggtcccacattcgatcaccacataaaaagattttgtggaaccattttggcccatttcgtattacggaattgaataaatcgacggcgaccgtaatcccgtccgataatccatacggtaatccaatgacagtccctcttgaacgattagtgcgcgtaccaaaggaattgccaaacatttgtacaatgccgaaagggaaaaacccctataagaatgttttaaatggactgataagtgtggccggattaatttgtcaagaaaacataaaattgtatggggaagaaaaattgaactctaaaccggacggaataattgggcaattgaggtcaattgcatttttaggcggtgaggaggagcacatggaaacggaacagacggacgacaaagaggcggagaccaacgaaagcgaaaacgaagaaaatgtagaggaaaagatggacggcaaagaggtggacgcgaatgggagcgaaaaagaagcgaatctggaagaagaagaccaaatttcggtcgttcaggaagaagaggagccgaaaacgctttcttggacattggcatgtgtcggagacgggcacaaatgctgctccgatgtggtcgtggccgacttggatgctgtccttgaccgatcaggcattgggctcacgaagatcgagaatccgctcaaagcgctgttggcaatgtttctgctgaagtctgaagcggtcgcatcggcatctgctgccaaaaagctcatttcgcaaattctggacacggatgccgattgggaactcgcaacatattgcagtgcccgagaagacgacgtcaaaaacggcacatttccatccgaatcggac

SEQ ID NO: 71337 - DNA, 1904 bp, Heterodera glycines
  Genomic contig location: Contig_ID=SeqID_9416; Location=229..2132; Strand=+
  SCN-specific regions: Sequence locations=1-177,200-354,376-505,732 -854,880-1119,1156-1181,1203-1326,1348-1904
atgttagtgagggaaaagcatggaaatgatggccatcagtgagtgcttcggcaataaaaagaaagtcctccggaggcggtaaaaaggagaaaagaagagagtgaaaaaagaatgccccgataaagtcagtgaataccctttgggatgcccttttggatgaaaatgcccattaggatgaaattttgaaaatttgggatgccccttaggatgataaatagataaaaatgactttcgggatgccctaggatgcccttcgggatgaaaaaaaagaagaatgccccgggatgcccttttggatgattaaatgcccattaggatgaaaataagtgaaaattttggatacccttcgggaagacaaatacatgaaaaagaaaattcaggatgcccattaggttgaaaatgtgaaaatttgaaaatgcccagtaggaagataaataagtagaaaaataaattatgaattaggaatgcccttctggatgaaaaacgagagatacccttcgggaagaaaaagagaaaaatcgaaaaaaaatcaaaattagtcagttaaaaaaaaaaaaaagattaaatgtgaaataaaagcaaaaaaaaaaaaatgaaatacaaatatacaaaaaaatacagtaggtccttcgggaagacaaagagatgattgataaaagatatattaaaaaaaaaaatacatagaaaattaattttaaaccatatacagtatacaaaaaaggggaactacagtactcaaaaaaaaaagggggggaattttgccggatatgttgatgaacaaagtacgctcgcagtcagcactatcgctctggcccatctgctgagaacattgctcgcttaacgttagcaatgcattttctctcctcctctcttccccccggcgctgttttccctttgtaatcggaagatctgttgcaattcacacatcttttcacagtcatctcttcccttcttcttcttagtcttcttccccccccggcgatgatgggcggaggatggcgtcgcttggccgtttactcataatacgccaataaatatgcggatttatacagcacatttcattcttcccatcatcattcgttttgtgtcactttattattgtcccatttgctagaaatgtttattaagattttcaatttaaaattaattttttttccacattcctttagaaactcaatttcaatttaatttaatacaactcttcagtgcaaattgtggacattggactgtcaacgaaagccttggcaaggacaaatcgctttggcatttttctgtgagtttactgtaatgggtactgtagcagttaagatgggtaggatttttgaatttttgggaccattttggggacaaaatctgttgaacttttgtcaattattttcatggtaatcctgataattcaaaatattggccaaacaaaaatgcggattatttaattacttgttggtgataattttactttcaaattataattaatgggttcctaaagggcttaataaatcaatttattttgtgttttatgagttataggagtttttaaattacggtaaatcatatgtcaaatacatgacatttgttaacattttgagcaccatttcaggctcttccttttgctgtggattttgttggacttggactgaattactggttgtttatctgcttgaaaggacaattgcaaatcgcttcggcattttctgtaagtcaacagtatactgtaatttatgggttaatttttcaaatgacatggctaattaatgcaccgtttgcattaattaattattacagattcctaaaaccacagtaatcaaaattgggttaatcttttcaaatgtacagtaatttccctatgcttttggttttctttggtcaaatttgagtattattggttcaaaaacgatgagttagca

SEQ ID NO: 71338 - DNA, 246 bp, Heterodera glycines
  Genomic contig location: Contig_ID=SeqID_9416; Location=2758..3003; Strand=+
  SCN-specific regions: Sequence locations=1-194,217-246
atgaacgaaatggttatactgtattacaattaacactgtaactcattcaggttttggcattgtgtttttgctttggaatttgtcgtcgtcaaggacctgagcagcgtttggattttggatttggaatttgacgcaacagcctttgaacactttgatcttctgtggccaagggttggtcaaatcactgattattgacttaattattcaaattattcaaaataataatacaagacaagacaaaacaaa

SEQ ID NO: 71339 - DNA, 233 bp, Heterodera glycines
  Genomic contig location: Contig_ID=SeqID_9417; Location=768..1000; Strand=+
  SCN-specific regions: Sequence locations=1-107,131-189,227-233
atgaccgaattggttatactgtattaaaattaatactgtaactcattcaggttttggcattgtgtttttgctttgggatttgccgtcgtcaaagatctgagcagcatttggattttggatttggactttgacgcaacagccttttaacactttttgatctttgtggttcaagggttggttataatttcgaattaattattcaaaataataatatacatataaaaaagggacaa

SEQ ID NO: 71340 - DNA, 829 bp, Heterodera glycines
  misc_feature (456)..(456): n is a, c, g, or t
  Genomic contig location: Contig_ID=SeqID_43734; Location=38..866; Strand=-
  SCN-specific regions: Sequence locations=1-6,32-206,228-265,324 -348,467-507,564-649,679-829
atgttcatgcagaggagggaggaggtgtgctctggcacaaaatggcatgccatgccatgccgtggggagatgaagcattttggaggaaaaacataaaacactgggggaaaatgcagaattgcttacgcattgtttaaaatggagaaaaatttgaaaaatctattaatgtaaaacggaaaatttgtttacaaattgttcaaatggagttaaaattttgaaatttaaatcagaaggttgaatcaggaattatatgaatttttgtaacaatttttaaatttgaaaattaaaatatagaaaatgaagaaatacttttataaaaatttgggaacatttttatactgaatggagaaaaaaattaaatttgaaaaatttttaaactatcagtagaaaaatataaattttaaaaataaatttcataaaaaattgaaattgaaaatatattgaaatttcatttanaaattttttagtttaaagcattggagaaaattgttaaataaatcaattagctaaaaaaaaacaaatttaaattacaaacatttaatttaattttttagaaaaattttccgtattccaactcggcaaagttgcgcgatttgaagtccaccgtcgatttgctcacctccatcacattttttcgaatgaaagttggttaattttttttttaatttttttttttttggtttttaaggttctcaagttgaacagcccccctcgggcgtcatatttggtcagagaatgtgccaaagcgtgcatcgaggtagccctggcagaatttataaaaaaaaaattcaattaccgtatttcctatattatagccccctgaaataaa

SEQ ID NO: 71341 - DNA, 225 bp, Heterodera glycines; identical to SEQ ID NO: 56422
  Genomic contig location: Contig_ID=SeqID_43735; Location=475..699; Strand=+
  SCN-specific regions: Sequence locations=1-225

SEQ ID NO: 71342 - DNA, 395 bp, Heterodera glycines
  Genomic contig location: Contig_ID=SeqID_43736; Location=284..678; Strand=-
  SCN-specific regions: Sequence locations=1-229,255-395
atgcgttcagtaaaacatggaggaaaaaaaggaatgcgattcagatacaaattgtcagcagttaagaggcaaaacaaaaaacagaagaaaaagcaaaggaacatagctggatggtaaaaatattgaagttttaaattgctaatttcctgttgttgtattcgatttgctgatggtctcacattattttaatttttttttgaaattcctctttcagaaatttggaattcgatttagaattttattttcatttcaaatacatagatcaacaagctcagcaaatagatacaattaattcatgtcgtttttttaatacttttagctctttgatcaaaaaagcatggcaaacccaactatcatcgcggcaaaatttaagtgcaatggggactggtctatga

SEQ ID NO: 71343 - DNA, 93 bp, Heterodera glycines; identical to SEQ ID NO: 60640
  Genomic contig location: Contig_ID=SeqID_43738; Location=92..184; Strand=+
  SCN-specific regions: Sequence locations=1-93

SEQ ID NO: 71344 - DNA, 735 bp, Heterodera glycines
  Genomic contig location: Contig_ID=SeqID_43739; Location=1..735; Strand=-
  SCN-specific regions: Sequence locations=1-126,175-175,197-322,345-735
  Gene Ontology: Mol. function=protein serine/threonine kinase activity; Biological process=protein kinase cascade
tactcgtttgaaggtttttaatacccaaatttaaaaagctttaaaaattcggagtcgcttataatgaatctgacactaattttgaccaattaagggacggcatttgaaaacgcaggcattagcagcaataaaaataatgaacataaacgaagacgaggaggaggagatcaaagcggaaataaacatgctcaaaaaggttgggagggagtcaaaaagaagggcccaaaaaagaggggaaatggctaaaaaggaggaaaatggccaaaaaagagaaaattgtcaaaaagtaagggaggaatgatcagaaaggaggaaaaattgccaaaaaggggaaagaaatggctaaataaaaggggattaaatggcagagaaaagggggccaataatcgcacattaagtgggctaatgggacggatgaacgtgcaactttttagtattcacatcacccaaacatcgccacttactacggtgccttcatcaagaagttgccctcctcaactggcaaacgatgaccaactttggctcggttttctcgccccctccggcgatttcgagtctttccgttaagtgatggaattttgcggcggcggatcggtgaccgatctgatcaaatcgttcgaaggcggttatttgaaggaggaatggatcgcttacgtttgcaaggaaatcctttcggtaggcccaattcttctcagaaggacatttccccctttaggggctaagcccatctccaca

SEQ ID NO: 71345 - DNA, 802 bp, Heterodera glycines
  Genomic contig location: Contig_ID=SeqID_43741; Location=127..928; Strand=-
  SCN-specific regions: Sequence locations=1-802
atggctcagttgtcgctttccgtgcagacgttgcgtctcagtgaagccgagctgtccgtactggtcatttccggtttcacggtactgggtgtgagaagtcaacccgccggacagcacaatatcgataccctgttctcactctaccgattccaccagtggattaacgcactgggtaacctcagctctgacacgctggatatgctgcgccagcaaacgctgacggcagacagactggcctcggtgatgggtctggacatcagtatggtgacacaggccatagcctgtgctgacgtgagcagtcttcaaagctggcagaatatcaacgccgtgctgcaatggatggatgtggcctcagaattgcacaccatgccatcggttatccgtaggctggtcaatatccgctacgtgactgtgccgaacaaagccgagtcggatctgccttcctgggatgaatggcagaccctggcagaaaatatggaagccgggctcagtacacaacaggctcaggcactggcagatcataccgcagagcgcctgagtagtgtgctgtgccattggtttctggccaatatccagcctgaagggatattcctgcaaagccgggatgacctgtacagctacttcctgattgataatcaggtctcttctgccataaaaactacccgactggcggaagcgattgccggtattcagctctacatcaaccgggcgctgaaccggatagaatcgaatgcccgtgccgatgtgtcaacccgtcagttctttaccgactgggcgatgaatatccgttacagcacctggg

SEQ ID NO: 71346 - DNA, 968 bp, Heterodera glycines
  Genomic contig location: Contig_ID=SeqID_9419; Location=1501..2468; Strand=+
  SCN-specific regions: Sequence locations=1-299,321-813,847-968
atgtccaactatgggcccgactatttgcaaatgttgaaaaagcgacgtgccaaagagtctctcggcatgccattccatggcattggcatcaaagtgcccgtgaacaacaaaggcattggctaccgaccgctgtcggacgacgccaaggaaaatggtaaaattttcttggtacgcccattttaacatcgtaaaatttacgggtttttttcaaaatttctcacagtaaatttagtcaacatttcagcacaactgaagcgaaacatcgaaacaatgggcacaactgacaatgaagagaagaaagctgagctgaaggagaagttctaccagatgtattcatgggttcaggtgcgttttatttttattcggaaaaaagttaccgaatttttgcttggggtgtaccacacccggcaacaaatcctttttttttgattttcacattatttttttgtcgcatatttttaaaaacaactttcggtgaatgtgtcgggtctggcgtagacgtcgccaagaaaaatttagaaaactacggcttttgtgacgatttttgtgattttttttttttgaaaaaggcgaagttttgttttcttttaagttcgcaaatgatgaaatggacttcggcatgggcctggaatttgggcacgacctgttcatgtccaattacgcgtgctttgacggaatggccaagtctgtgctgatgacttcgtacgaactgttgggccgcaaacagttcgccacactacttgagaagcacatggaagtgaggcgtcatgaaaaatgtttttgaatgatcgacggaccagaaaatgaccgacgaatttgtcacatttattcattcatttatttttaccaaatcgatctcacacacattcaatgaatgttctctgctttgtttgcccttttcattttgacatttatgcatttgtttaattaaactattttttttacagttcggagtgtgcttttggtaa

SEQ ID NO: 71347 - DNA, 72 bp, Heterodera glycines
  Genomic contig location: Contig_ID=SeqID_43742; Location=14..85; Strand=-
  SCN-specific regions: Sequence locations=1-72
atgactgcggaggacgctttcatcaccaacgcaaaagtggcggcgaccgatcgttttttatgcgacccgtcg

SEQ ID NO: 71348 - DNA, 1090 bp, Heterodera glycines
  Genomic contig location: Contig_ID=SeqID_43742; Location=345..1434; Strand=-
  SCN-specific regions: Sequence locations=1-23,67-155,178-309,331 -348,388-1090
atgatcgacgaatcgtgtcttttcgactcggaagaggaggaggatgaagaagcgaagaaaaagacgccggaggagcgcaaatatttgttcagaaaggagctgcggtcgatgctattcggttttggggacgaaagagtgcgaaaaaaatttagggatttttcacattttattcccctagttattaagaacccaaacgacgacactttggaggcacttgagcaaattgtggtcgaatatgtgaaggaggtgtgccgcaaagcgttggaggttggcaagccgaaccgagtgaacttggaggacattcattactgtgagacgggggcggtgttggcatggcaaacggaaagactgttctaaccttaaaaagaaaaagggggtgggtggtggtgtcacggaatatgataaaatagctgatttttacccagcatatcaaagagattatatttacaaaaaaatcgaaaaataatagtccgtatgtttgaaggattcgtttttcgttgctgtacatgtcaaattagtctgtttatattgcatttgctttatctctttggctgtgaccatttcattttccctaaattcagtgattcggagggaccagaaaaagttttcgcgcgtcaaagaactttttttctttcttttttatcagttaagaaatgcatcgaaatatgctgatgaacgtttgaattccaaagcactggcaattgaactgcaaaacgcgcggacatttttgacgattctactgccattcatcgtccccttgcttagtggacttatcattctactcaccatttaccattttttgacaactcaaattgcccaacttcgtacggagttttcgcaaacaaagtcggagttggctctgcagtttgccgatacaaagttggatttgacaacccaaattggccaagttcgtgcttagctcggtgaatcgaaaacggatttcgcattattttctgctcaggtcaatcgccggtttgagcacgagtttaccgacatgaagcaccaatttgccgaagtgtgcaaaaaaatggacgagattcttgtgcagactaagaagagcaagaagttttctgttttccgtcgcgagtag

SEQ ID NO: 71349 - DNA, 761 bp, Heterodera glycines
  Genomic contig location: Contig_ID=SeqID_43743; Location=212..972; Strand=+
  SCN-specific regions: Sequence locations=1-406,428-761
ccgcttccccaccaaaaaggcatcgtcgaccctcgtcttccctgcaaaattcaaattgtcggccgtgccaatgacgtcgcgaaacgtttcgaagtgaatcttttgtcacaaacaggcgaacaccttctccatttcaacccgcgcttcgatgttcgtaaaatccaaagatcgaccgaagaagtcccttcaggaacattgcgtggtgcgaagcagcacaaaagacggccaatggcaagcggaagaaaggggagggaccaatcccttcgtggccgggcgagcctttctcgctcgatctgctggttgagcaaggcctaattgaggtgggtgccggccgtttcggcccccaaattcgcccgtggcttcagtgttctgtgaatggcttccaattctgtgaatttgccgcgcgggatgacttctcccaattgggcgctgtttccgttggcggtgacattcagctgaactctttggaagtgtccaccgccgagggtcccgcgattgcccatgaaggcggcgataaggggccgcgcgaagctgacgaggaaaatgcgcaagaacagccgcccattgtgatgccggcccatcccgaaccgcaaccggtgccagccgaaccgactccccagcagccgcagcctccaccggcccaggggccgctggtcagtcacacaattaatccatttaggtatgctgtggacgagggtatattcgaatcattcgcagtcggtgccttaccaagctccgctccatgcgttgcttcagactaa

SEQ ID NO: 71350 - DNA, 478 bp, Heterodera glycines
  Genomic contig location: Contig_ID=SeqID_43745; Location=312..789; Strand=+
  SCN-specific regions: Sequence locations=1-121,148-396,418-478
atgtacgtgcagtacagtagcaattggtgggtcttcccgtgccgcagtctgtccggttctgttggatacgtgtgtggtgatctcgaatggatcgaaatggacaccatattcgtgatcatcgaaactcccaaaaacccaaaaaacttgtttctatagcaaaaaattttttgaaaatttttttttcaaaaaggggggtaccatcgacacagtattacccgagtgagaattgtaaggttaaaaatattaaatgttaattaggttatatatagtgattatcgaatgctgaggtgaaactttctatgcaaatgttaagctaagcctactttcgagttttataacctattttctaggctgaaaacaagtacccggagttttcgagatcgctgatcacgaatatgataattattttagcatattcagaaccatgaaccaaaattcgaacaaaaagtaataattttgtttttttgtttgaatctga

SEQ ID NO: 71351 - DNA, 769 bp, Heterodera glycines
  misc_feature (750)..(750): n is a, c, g, or t
  Genomic contig location: Contig_ID=SeqID_43748; Location=251..1019; Strand=+
  SCN-specific regions: Sequence locations=1-769
atgaacgctaaaattatcagagtgccgaaaatcgcatgtgatctaagcctagaaaaaaatggtgtaagtaaaaatcgtaattacgctcaaaaagcttctcaaacaattttagcgcatccaattccttctacaatcgcctttatacatcccattatgagcgctaaaattatcagagtgccgaaaatcgcatgtgatctacgcctagaaaaaaatggtgtaagtaaaaatcgtaactacgctcaaaaagcttctcaaccaattttagcgcatccaattccttctacaatcgcctttatacatcccattatgaacgctaaaattatcagagtgccgaaaatcgcatgtaatctaagcctagaaaaaaatggtgtaagtaaaaatcgtaattacgctcaaaaagcttctcaaacaattttagcgcatccaattcctttctacaatcgcctttatacatcccattatgagcgctaaaattatcagagtgccgaaaatcgcatgtgatctaagcctagcaaaaaatggtgtaagtaaaaatcgtaattacgctcaaaaagctcctcaaacaattttagcgcttccaattccttctacaatcgcctttatacatcccattatgaacgctaaaattatcagagtgccgaaaatcgcatgtgatctacgcctagaaaaaaatggtgtaagtaaaaatcgtaactacgctcaaaaagcttctcaaccaattttagcgcatccaattccttctacatcgcncttatacatcccattatga

SEQ ID NO: 71352 - DNA, 139 bp, Heterodera glycines
  Genomic contig location: Contig_ID=SeqID_43749; Location=748..886; Strand=+
  SCN-specific regions: Sequence locations=1-61,83-139
atggaatcaaatcatatgttcaatcagggaaggatgttacaatgtgtaagttttttgtaatttttaaagtcataaaaatttttaggtggttttctgggtcgctgatttcaaatatggtaccatttcggtcaatttctaa

SEQ ID NO: 71353 - DNA, 683 bp, Heterodera glycines
  Genomic contig location: Contig_ID=SeqID_43751; Location=316..998; Strand=-
  SCN-specific regions: Sequence locations=1-246,307-406,428-533,560-683
gtttcacgaaataccgccctgtaatctttcgccatatccgggaagaactgtcaggctcaacagaaatatctgcacccgcgcctacgaagacccagacgtttgtggccgatgggaaggtatcccagcgccctcggattagcgcaacccgtgcagcacctagcgtctttcgcgacctgtaggccaactcctaacaggctccccggaggttccgagtatcgcctcactcgtgcgcgtcggtagttagccgccgaggcatttggctaccttaagagagtcatagtttctcccgccgattacccgcgcttcctcaagtttccgtgacatgacattcggagcactgatcaggcatccccgcaaacccttggaaacatgttttcatgactatgaaacaaaaaaaaaaatttcgaaaaaaggggggtggacaaagcacagtatttagtaccaatatttctccccaaaaatgtgttcgggttccctcgcgtgtcccctctcctggttcacaatcagtagaatgatcttattttttctgaaacaaaaaaaaattttaattaatttttttcgcttccaggaagaataatcgagtcgactggaaaaaagaggtgagacgaagctgaatggttcaaataaaaaaaaacaaaattgctttttagcgaattacgaaccaggaaacatttggccaaatg

SEQ ID NO: 71354 - DNA, 912 bp, Heterodera glycines
  misc_feature (829)..(829): n is a, c, g, or t
  Genomic contig location: Contig_ID=SeqID_43752; Location=48..959; Strand=-
  SCN-specific regions: Sequence locations=1-325,347-393,415-739,761 -837,870-912
ggcaggacaagaaaagaatgaagttgatgcctcatgaaactcggaattggttatgtttagtcgaaaatatccttacataatactcataaaaaatacaaataattcaacccacctattctatgaccacattctgaaaaaaatcccagaaatacgaggaaagatatgcttggtcacaataaaataaaaaatggctagtatgtaaaaatttgcggtcacaaataaaataaaaattggctaatatgtaaaattggcgtccagaaatttttagactaatccgaagcaaagcacgaatgaattaaagaggcgcaagaattcacagtatcgtttctaatagggaaatattgacaggatattcggctaaaaacgggtttgatcatttttagcgcatttttatgtatacatttgagacaattgggcaggacaagaaaagaatgaagttgatgcctcatgaaactcggaattggttatgttttgtcgaaaatatccgtacataatactcataaaaaatacaaataattcaacccacctattctatgaccacattctgaaaaaaatcccagaaatacgaggaaagatatgcttggtcacaataaaataaaaaatggctagtatgtaaaaatttgcggtcactaataaaataaaaaatggctaatatgtaaaattggcgtccagaaatttttagactaatccgaagcaaagcacgaatgaattaaagaggcgaaagaattcacagtatcgtttctaatagggaaatattgacaggatattcggctaaaaacgggtttgatcatttttagcgcatttttaggtatacatttgagacaattgngcaggacaagaaaagaatgaagtgatgcctcatgaaactcggaattggttatgtttagtcgaaaatatccttacataatactc

SEQ ID NO: 71355 - DNA, 353 bp, Heterodera glycines
  Genomic contig location: Contig_ID=SeqID_43754; Location=17..369; Strand=-
  SCN-specific regions: Sequence locations=1-43,72-81,106-353
atgtcagaccgccgaaaagaaggagaggaaaagatggcaaaagcaatgtaaaattaaatttaaaatgccaattttcaatttgaattttgttttccccctttttcagtttcatctccgccgattgttggctttcggtgttcgatttgcttactccttctcaacttggcctcggaattgcgctgatcagccaccgttttgacttctacgtagacgaacacttcaaaactcgcaaatgggcgctgaaaattattcgtattgagagaaaaattggagagaatggcacaaagcaaatggaaattacaaatgacaatagaaaatcattgccaattccgaaaatgcaattgcctcgcaag

SEQ ID NO: 71356 - DNA, 485 bp, Heterodera glycines
  Genomic contig location: Contig_ID=SeqID_43757; Location=202..686; Strand=-
  SCN-specific regions: Sequence locations=1-370,392-407,429-485
ttattgccaatttaatttcttgcagatttaaagccatccattgcctgccggttctcggcacagcaaagcactaatagggtgtttgacacacttcaaaaaataatcattacccaaaagttgtttacaaccacttattgccaatttaatttcttgcagatttaaagccatccattgcctgccggttctcggcacagcaaagcactaatagggtgtttgactcacttcaaaaaataattcattacccaaaagtttttttacaaccacttattgccaatctaatttcttgcagatttaaagctatccattgcctgccggttctcggcacagcaaagcactaatagggtgtttgactcacttcaaaaaataattcattacccaaaagttttttacaaccacatattgccaatctaatttcttgcagattgaaagccatccattgcctgccggttctcggcacagcaaagcactaatagggtgtttgattc

SEQ ID NO: 71357 - DNA, 141 bp, Heterodera glycines
  Genomic contig location: Contig_ID=SeqID_43759; Location=734..874; Strand=+
  SCN-specific regions: Sequence locations=1-1,25-141
atggaggaagagaaacgagggaagcaacgagagaaggtgcagttttgcttcccatcctcgcctaatcagtaactcataactaatctcctttttcagtttaatgccactccaatgcaggacaattcgtgtttactttcttaa

SEQ ID NO: 71358 - DNA, 504 bp, Heterodera glycines
  Genomic contig location: Contig_ID=SeqID_9422; Location=1115..1618; Strand=-
  SCN-specific regions: Sequence locations=1-141,163-504
  Gene Ontology: Mol. function=N-acetylglucosaminylphosphatidylinositol deacetylase activity; Cellular component=endoplasmic reticulum; Biological process=GPI anchor biosynthesis
gatgttttttggaccaactctgttgttcctttcatctatcggtgttcaattgcatttgttgtgcattacgtcggggaattctgagggacttggaacgattaggcgaaatgaattgtattcgtctgcttctgtttatggcatccaacccaaatacatctcttttgtggatccagaagagcgaagattcccggatggttttcgcgattggaatatcaccagcctttctgcgctgatttactcttacattcgacggctgaaacccgatggactgatcacttttgacgaatggggcatcagtggacatccaaaccacagagacagtttcaaagctattttgaacttgaatactgaaggcaaacttaaagaactcggcctaaaaacggcattggcactgaagagcgttgcagttttaaggaaatacgtcggagctgttgacctttttttgaatgagttcgtaatgtctgatggaaatacatttgtcacatattcggctaacccactgag

SEQ ID NO: 71359 - DNA, 212 bp, Heterodera glycines
  Genomic contig location: Contig_ID=SeqID_9423; Location=1159..1370; Strand=+
  SCN-specific regions: Sequence locations=1-212
atggctggttgtttggatgcgctcccacatcaggcacacttcgactgggataccaaacggaacacatattcagccgttgcatctgggtttctggtagttttttttctggttgtttgttgccaattttataatattttcagttctttttggcttggtggcttatgattgacacagcggtcactgcgcaaaaagcacattggacaaattggtaa

SEQ ID NO: 71360 - DNA, 269 bp, Heterodera glycines
  Genomic contig location: Contig_ID=SeqID_9424; Location=146..414; Strand=+
  SCN-specific regions: Sequence locations=1-114,136-269
  Gene Ontology: Cellular component=integral to membrane
atgcgaaactcgtcacaattaggtgctcgcctttggcttatgttcggttttatcggatcgttcgcctgtattgtggccggcgtttgggtcatgtaagtccacttattattttaaataggtaattttctttctttaggttcggtgacttcgtacttaaagaaggacaaaatgacaattggccgggaatcgcgctttttctccacacattctttatttttgtggcttcattggtttacaaatttggacgcaccgaagaattgtgggagtga

SEQ ID NO: 71361 - DNA, 586 bp, Heterodera glycines
  Genomic contig location: Contig_ID=SeqID_9424; Location=989..1574; Strand=+
  SCN-specific regions: Sequence locations=1-350,372-586
  Gene Ontology: Mol. function=ATP-binding cassette (ABC) transporter activity; Cellular component=membrane; Biological process=iron ion homeostasis
atgccttttattggtgtagggcctcggtggcgcgacgcccagtggcttggaaatggccaaacgactcgcgcgccacgtttggcctaagggacagtggcgcgtgaagggccgtgtacttttcgccttttccttgctcatcgctgctaaggtcggtgatccatttagttattcaaaatacgttttctccagcttctgaatgcgaccgttccgttcgtccttcgcgacatcgttgacttttttaatgggaaactcccggcggagctgtcgctcggattcgcattgcctggcgaagccattctgtcggcgggaattgctctgataattgcctgttagtgtttttgacaatgaccaaaaattttttttttaattttcgatggcgccgcgaggggcggcacttcgctcttcaacgaagtgcgttttttcggtttgactccttcccgcaataggccgttttccagcttcgaaacgctgtttttgcgcgtgtcgcccagcggtcaatccgcgacatttcccgtaacattttcctgcatttgcacagcctcgacatgtcttttcatctcaatcggcagactggcgcattgtctaa

SEQ ID NO: 71362 - DNA, 387 bp, Heterodera glycines
  Genomic contig location: Contig_ID=SeqID_43763; Location=435..821; Strand=-
  SCN-specific regions: Sequence locations=22-211,236-338,360-387
gtttcaattgcctttgggcagtgcacaaattatgccgaactcgaacagacactgttcgaaatgtgccaagccaatggccaaatgcattaccgaatgaaagtgtggttccaagcggagaattggctttgtgtcaaacattcggtggtcgacacaattctgatggccaattcgaatttgaaacgccgtgggcgtaagcattttgaatttatctaaaataaacaaaataaatgttttaagctcgaagtgctggcgatctgtcactgatgacgccgcgtttgaaaaagcattcgtttcataacgaaacatttgaccgttatgaccgaagagaatgcatcgaagtggtttggatgaagctgatgcaagcggtgatcacgtggatgaaacagg

SEQ ID NO: 71363 - DNA, 760 bp, Heterodera glycines
  Genomic contig location: Contig_ID=SeqID_43766; Location=744..1503; Strand=-
  SCN-specific regions: Sequence locations=1-760
cgtgcccgatcagtaccaatccgtggcgggtccccaaccgcagttaaaagccgtgtccgatcagtaccaatccgtggcgggtccccaaccgcagttaaaagccgtgtccgatcagtaccaatccgtggcgggtccccaaccgcagttaaaagccgtgtccgatcagtaccaatccgtggagggtccccaaccgcagttaaaagccgtgcccgatcagtaccaatccgtggcgggtccccaaccgcagttaaaagccgtgtccgatcagtaccaatccgtggagggtccccaaccgcagttaaaagccgtgcccgatcagtaccaatccgtggcgggtccccaaccgcagttaaaagccgtgcccgatcagtaccaatccgtggcgggtccccaaccgcagttaaaagccgtgcccgatcagtaccaatccgtggcgggtccccaaccgcagttaaaagccgtgcccgatcagtaccaatccgtggcgggtccccaaccgcagttaaaagccgtgcccgatcagtaccaatccgtggcgggtccccaaccgcagttaaaagccgtgttcgatcagtaccaatccgtggcgggtccccaaccgcagttaaaagccgtgtccgatcagtaccaatccgtggcgggtccccaaccgcagttaaaagccgtgtccgatcagtaccaatccgtggagggtccccaaccgcagttaaaagccgtgcccgatcagtaccaatccgtggcgggtccccaaccgccggtg

SEQ ID NO: 71364 - DNA, 525 bp, Heterodera glycines
  Genomic contig location: Contig_ID=SeqID_43768; Location=344..868; Strand=-
  SCN-specific regions: Sequence locations=1-77,99-191,213-226,249 -384,406-525
atgccaaaaaaggcatttaaggtacgaaaatcccgaaaaaggcataataaaagtcaagtagaagcttcagaccaagcgtaaaatgcttttttatacttaatatatcttgattagtacgcataaaaaggcatatgccacaaaatctgttctctaattattaaggccgatgaagcgcttcgcggaacttcaattgaaaacaatttctttttggcaaaatgttatcagcatcttaatgaaaaagaaaaagcgattgaatattttggaaaactgttgacacttgagccaaacaatttgtatgaagcagaacgacaaaaattgactgttgaaattctgacgaaagaatttaaaatgaatccattgaaattatgattacacctcgatgatattccatggccctcaattttgatatgaatttgttgattgactaaacaattttggagagaatatttttttaatttcgtcgggatttattggagggggggattaaaaaaacattatttatggtgaggatttttgaacaataaa

SEQ ID NO: 71365 - DNA, 562 bp, Heterodera glycines
  Genomic contig location: Contig_ID=SeqID_43769; Location=316..877; Strand=-
  SCN-specific regions: Sequence locations=1-37,60-71,93-190,229 -377,407-528,550-562
atggcattggcaaaacttaaaacatcagtttttgccatttttgttgtgctttttgtttcaattgacaagtgccgatgtacaaacattctgttcacctttttccatgacacgggaagccatttccaatcggtgtttccattgatgcaaaagtacaaatattttacaaaattggaggggatttataagatagaatcaattaactagctaattaattaatattaattgatttaaattggatgtgtgttttgtttaggctggcgagtcggggcaataatgtgtccgttttggacacagtttatgagcaggaccatagccttgaaatccatcactttcgggcgcttttgcccaaacaccataacgatgaaacagttaatggcaattaaaaattgaaaataataataaaaatgttttttgttcagtctaaacgtcactttgccaatgacatttggtcacgccgtctttccgccactgatttggccctttattttgggacatgtgacaaggaactcggaattttgatgcaaaatcacagccaaaaagcaagcactaaagcattaataaa

SEQ ID NO: 71366 - DNA, 379 bp, Heterodera glycines
  Genomic contig location: Contig_ID=SeqID_43771; Location=524..902; Strand=-
  SCN-specific regions: Sequence locations=1-80,102-141,171-247,317-379
atggtaaggacgtccttgaaattgggcccttccgcttgaaaatttgaaagtatccttgaattcaagaagtaatttggattaaataaaattttccccggcggcgcctgtcggcaccgccggaccccccaccccccccctgttccccgaaaattttttgaaaaaagcgcgccgcaatttggccaagcccaaaaattcaaaaaagcccttttctcttttgctcgtaaactggtcaattctgttgtaaatcaaattaaaattaaaaatattacatttcatttccttaaatttatatatatattttttagttttttttaaacttggatctaatatggacgaaaacgtcaaaaataaaagattaatccgactttgtgaaaataaa

SEQ ID NO: 71367 - DNA, 1439 bp, Heterodera glycines
  Genomic contig location: Contig_ID=SeqID_9425; Location=1..1439; Strand=-
  SCN-specific regions: Sequence locations=1-32,64-217,240-1439
tgtgatgagaagcctttgtgggagtcgctgatgggccacggctttttggtgttgttttgtttcgcgctcattggcaattgcatcaatctgctcatttacaactcggatcaaattcgctttttcattgccattcgaatgctctgcacaaaattggtctgttttggcatgcaaatgattggcttctcactgattgaattgcccatcagctgatgaacacgtgcatgatggtggtgatggtgccgcaggcactacgcgtcattcgcttttgggacatcggtggctcaactgacattctctactggacattttggccatatcaggtagcggatatggacgtgaaccctccctaagtgatgttcaatttgcacaggcttacctgacaaatgttttcggcttctgtgcgatgtggctgaccgtactaatgacaggtgggcatggaacgcaccgaagggaattgaaaaaccatcataagccaattggcaaagccaaagtacatattattcaacccaacctgaaagccagagaaaatcaaattgaacattattttggagacgaaaacgccataataaactcaaattcaattaacggagattggcactatgaaaagtcatttctctcagaatttaaagtgcgctattaaaagcgaaattggctaatgatgatgatggccccagaagattcattctcctcattctgttcgactgaacctttttcccatttcagctgagtgttacatccacattttcttcccctccaagtcgaagactctctgcactaaacagaccgtttggcgcagttatttggtcattttcttcgccgcgtatgtcttttcccggggcaatttcatgaagccctccccctaattaggcttatcctcgcctccatttacccactcaatcgcaccgtttcgctgtccaaccgatgcaatcgcacaattgtcaaaataaacacttcccaaagtcagtccttccaaagtgttgccctttttctgttgtgccttccctttttagattttgtgatgggttttttcgagaaagtgcacactttggccgaccttctcctctccattttgcttccattaacacttttggtaagttttttaaattcaatttgccatactgtgccgttgctaccgtatccccaccccactcattcatttgtccttaatttgtaaggttttcatgaccgtaatgattgtgtggcgcctttgggtttggccaaacagacaccgtcgtcatcttttggccaatgagaaggcacaagtgcaggccaacagtctgctgagtgccgctgctcaccaagaaaggaagaagcgagagaatcatttcgcggcagaaaagcggggagtgactcggatcggtctgatcacttgcttcattcaggtgccctccccctgggggggggttcgtttgatccgcgctttcccttcagttgcttac

SEQ ID NO: 71368 - DNA, 904 bp, Heterodera glycines
  Genomic contig location: Contig_ID=SeqID_43773; Location=22..925; Strand=+
  SCN-specific regions: Sequence locations=1-149,185-443,465-525,547 -880,902-904
atgaataagttattctttccactagtgaatctttacaaggataatagccttcaactgatgcacgaaaagctgaaaaaccaacaattggacacttgggaacaactgcaaaatgccattttgaaagaaaaggaagcgaggtaaaaatggggaaaataattattctaattaaaaataataattttaagaaagcaaaaaatggaagaattaatgagccaacaaagaaacaaaagtagcacaaagatagtgaataaattgacgagaaaaagcatcaaaaaccattcgaagaaacaattggagacaaatttggaaaaaggaagcgaatcgtttgaaggtgtccaagttccaatacttaatttggcaaaagatggacaaaaatgccaaacttttctgacagaagggcccaacgacggtaagcaaattagacgagggcaattacatatcataaaatattatttttcagacattggcatggattctgatattgaatatggcaccgagtctaaaatgttgaagccaaatccgcaaaaagagagggtgaaaaagatatacgcatagtagttgtattaaaccctaattaaatgccatttcgttacagaaaatcgactaccattacttctaccggtttgatgccaatgcgatcatttgccgttactgtccgtattgccgaccgacccaaaagcggtttaagccgacgaacgcgttgaagagccacctgaagacgcaacatatgagtgtgctaaagcagtacagaaggagcaactacattttgaaggaggacagcggaaaagagcaaaaagaaggaggaaccatcaaaacaccagcaaaacaatgggagggcagcagcctcaaaaatttagaagacacaactgacgaggccaaattcagaaaatatttaaatttttag

SEQ ID NO: 71369 - DNA, 149 bp, Heterodera glycines
  Genomic contig location: Contig_ID=SeqID_43775; Location=1255..1403; Strand=+
  SCN-specific regions: Sequence locations=1-149
atgtgccgtagccggtcgtccagcttctgttcccgacgccgtttcagcaccaattcgggattggacagtgtacgagcaaatggtgccaatgtgccgcaaagcggagaaattggtggcaacaatgccgccgacggtaccgagtcgtacag

SEQ ID NO: 71370 - DNA, 999 bp, Heterodera glycines
  misc_feature (7)..(7): n is a, c, g, or t
  Genomic contig location: Contig_ID=SeqID_43776; Location=48..1046; Strand=-
  SCN-specific regions: Sequence locations=1-724,747-896,919-999
atgattntggatcgtctgccggatataaagggaaacgaaggcagcgatttgattcgcaatttctttaaaaagtacagtcaatacacgattgattggcctaacaagaagcgtatcgaatcattggaggcaaaattaagtggccgtgctgaaagagcctataatgccgctctggccagcgaaccgttcgcttacgaaaacatcaaaagaagtattttacaacaattggaggagacggactgcagagaaatgagtgcattcaatgatttgatgaatggggtactcagaaaatccagtgaaaacctggacgatttggccgatcgaatttcgagtcttgtacgcagggcgtatccaggactaacgcgaaatctggcagatgaatactcgatcaaacatctgattagaagtttgaataaccccgaactcgcactgagtttggagcttcatcgccgtaatggaatgtcatttgatgaatttatggcgttggcttcgcgcgcagaaacaacccaaaaagcggcaaagatacaaaacggggagcgctcaaaaccatattatgagcgaaacttccagcatacgcaccagggtgaaagaaattccgaaatgatttctaaaaatttttcgccacgccctatttgttacaattgtaacgagcccggccatatttcgagaaactgtaataaagcaggggtacagtcgaaccgaaatgcacccgcattttttccacggaatcagcaacaacaacagtttcataattcgccagctacgggagcgaaccgaattgttcaaaattccaaaaatggagtaaccccagcggtacgctcacaaaactttcttaagcaaaattgcataagaatggaagaggaagttaaaaccgacgcaaccgacgcaaccgtcgcgggtgttaaactggaaaaggaagttatagagtatttgagggatgagttggagaaaagcgaaactttttgtagtggattcgaaccgaatgcaatgattggaaaaatg

SEQ ID NO: 71371 - DNA, 138 bp, Heterodera glycines; identical to SEQ ID NO: 50950
  Genomic contig location: Contig_ID=SeqID_43777; Location=218..355; Strand=-
  SCN-specific regions: Sequence locations=1-138

SEQ ID NO: 71372 - DNA, 679 bp, Heterodera glycines
  Genomic contig location: Contig_ID=SeqID_43777; Location=357..1035; Strand=+
  SCN-specific regions: Sequence locations=1-60,82-679
tgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaac

SEQ ID NO: 71373 - DNA, 2715 bp, Heterodera glycines
  Genomic contig location: Contig_ID=SeqID_9427; Location=2468..5182; Strand=+
  SCN-specific regions: Sequence locations=1-79,102-117,140-612,763 -773,925-951,1031-1809,1832-2251,2273-2341,2363-2535,2558-2715
atggctgcaaaacgcaatggaacctctcaacaaagcggaccgtcgactaaaaaatgggatttccgatcaatcgggtaagtaatttttaataatatatttaagagacaattttaatcaataatttttcaggaacaattttactgaagaaatggaaacttttaaattagtggattatcgttcaacgatttgcgaaaaatttggatttacgaagaatattgtggaatttacgatcaacccggacgtgggacgccccgataaagcgatgcaggatgcggtcgacacaatgatacaggtggcttttaaaaatacggaagaaaggatgatgaggaaagtacgaatgtttggagtggccattacgggcgccgggcttgctttcccggtgtgggtgccgtacagggcgtacccgcagaacaatgcggaagttattatgcaggaaatcaacaagctgggacagagcggggatggagaggagaataagaaaatgctgttgctctcggagccaatcacgatgaaaataacgtgtgtgacaatgcccagtggagaggggccgaggaatgttcataaatttgactttggattcaaggaacaccagcggatagggtaagtgtttttaataaaataaaactaaaataaaaaaatcaataaataaaattaaaagaaatacattaaatttatttaatgaagcaaaaattctttaaagaaaaaatgaaaaaaaagcaacaaaaaaccgaaaaataaattaaaaatattaaaaaataataatttaatgagccaaaaaaaaaataaaaattaaattttaaaaaaatcaaaaaaataataaagtaaaaaataattaattaaaaaatattaaataaataaaaaataaaatttgaaaaatcaaaaaaaaataaattaaataataattaaagtaaagaaaaaaagaaataattatttttaattaagcaaagcagcaaaaaaaaaaacagaaaaaaaatttaaaaaataaattaaataataaagaaaaaataaatggaaataataataataataattttattaaggattacaaatgcggataaattatgtctgttttacgcgctcgtagcctcgaaattttatctggaattgcatgtggacagcttcaggagatttatgaaaaatattgtgagacagagggatgcagctattgagcttttacataattgtggaattgatattaacgaatatagctatggtgtggagcaattaccgaatgttcagaaatattgggtgggtttaaatgaaaaaaagcaaaattaataaatttttcaggatgagatttaccccggaaagtaccgggttgttgcatttgaaaagtcagctgatccacggaaatcaatccgtgttttgtggaagggccctatgggacgtgaaaatgtagtgccgatatttttggagaatggtcactgggatggtctgaagaattacgtctgcttttttaatcgtgggagaaaattttgtattgattgtgagtgcttttttgacaaggatgtcaaacatactttcgagtgccgggcaaggtgttattattgcaatagagtgaggggaatgccatgtgaaaaggagagtggagtgaagattgaatgcccaaagtgtcaccgttacttttacaattgggagtgttataattatcatcatggacatcagacttgcaaattatggaggcgttgcgttatctgtgacaagacttatcgatttaacccgaagaaggaacatgaatgtggtgagacttattgccaactttgtagtgtgagccatgaccccaagcgggggtgttatattatgccgatcgaggagaaggaggaaaaagatgtctacagaattgtagtttgggtaagatttaataaagaaaatcaacaaaaataagtctttaactccaggattcggagacttcgcaggattctatttacaagggggaccagaaggagcatgttattaattatatttcggtgagagtgacgtgtacggaatgctgtgatgacaaaaacaggacgaattgcaaaatttgtggggaggagaggatcaaggattggagcgaggcggagggacatgagccgaccaaggattttgtggagtggattttaactgcttttacgaattacgatacgtacatatttgcacataacgccggacgttttgacggtaatttcaaaatttaatttttaaatcctaaatttttaggtcattttgtttttaattacctctgccgtaccgggaagaacccgctaccgctcatcaatggattgaaaatttatgaatttaaagtgcaaaactcgaagaaacattcaaagctgatttggagagactcatgtttattgatgccggtgaagcttgagtcgctgaaggcgacatttaatttggactgtgaggacaagccctttttcccctattattacaacaagaaagaaaattatggaatacgattggaacatctgccaccgatggaggactattcgccgggatctatgaacaaggataaatttataaaattcgaaaaatggtaggaaaatagaaaaatttttgaataaaattcttttttcaggtacaatgagaacaagggggcgcccttttatttggatgaagaattgagaaattattgcagaaacgacacggagattttattgttgtcgattattgagtttcgaaggatattgattaacgacattactaagggatttgacccactaccgaggagtt

SEQ ID NO: 71374 - DNA, 302 bp, Heterodera glycines
  Genomic contig location: Contig_ID=SeqID_9427; Location=1338..1639; Strand=-
  SCN-specific regions: Sequence locations=1-302
caaaaaggaattaattggcaaaagaatttccttcacctgtcacttttggtgacaggtggatgattgatgaccttcccgcggcgctgcgcggcgcgggaaaaaaacacccgcaacaatttgggaaatcggatttggcaggcggcagcttcaaagtggtccaataggttttggttttgaaacaccccccatcgtggattttttatggggcggcaacttcaaagggctgcacccctcccataggcacgggctcgtgcgggaaacacccgcaaccaacccgcaaccttttgggactatatactact

SEQ ID NO: 71375 - DNA, 829 bp, Heterodera glycines
  Genomic contig location: Contig_ID=SeqID_43785; Location=380..1208; Strand=-
  SCN-specific regions: Sequence locations=1-17,39-321,359-415,437 -684,707-774,805-829
atgacacggtcgtcagtgagaagcaggggatgcccatcggttggtcaatgcattttcaacaatagtgttccaaccttgaaaagggtcggtacagtagaattgccgacttgcgtgccgattttgtgtcgatgacgcaaaattggcccgttttatacagtagcaacacactcttttacaattgcggacattgttcacaatttgttgtctctaatatatgttgttgttgttgttttgtttgtgtaattttgcagggatcaaacgaattggtctatcagctctcaaatctgcgaagaggaagagcggagaattaacgaggcgtgcataataaatatgattaaaaaaaataaaatcatttttaggtttgtaatatcaaaacgcaaggcattgaacttgttacagccgctttgccttcactgagcaatgaagcattccaacatttgcacaacgaattcaaattgttgcacaacaaaaacattgctgacagcatcattggttgtgaacagacttcagcggaggatggcacaacaacaacaacaacaccaaaatgttctttgggtgaaggtatggttcaacaccgcaactgcaaaatgaagaaatctgatcgggcatcttcgttttctgttgccggtggtggtggccgagcggcatcactttctggtaattttgtctgcattacctttacctccacctctcttcccctccctccaccttatcgtcccatccttccccgacccgaaaaatttattaaactgaaaagttcgtctcatacattcctattattaaaaaaaaaaaaaaatttttttagcaaaaattggaatttgaaattaaa

SEQ ID NO: 71376 - DNA, 882 bp, Heterodera glycines
  misc_feature (773)..(773): n is a, c, g, or t
  misc_feature (783)..(783): n is a, c, g, or t
  misc_feature (788)..(788): n is a, c, g, or t
  misc_feature (795)..(795): n is a, c, g, or t
  misc_feature (797)..(797): n is a, c, g, or t
  misc_feature (805)..(805): n is a, c, g, or t
  misc_feature (807)..(807): n is a, c, g, or t
  misc_feature (811)..(811): n is a, c, g, or t
  misc_feature (817)..(817): n is a, c, g, or t
  misc_feature (823)..(823): n is a, c, g, or t
  misc_feature (859)..(859): n is a, c, g, or t
  Genomic contig location: Contig_ID=SeqID_43790; Location=390..1271; Strand=+
  SCN-specific regions: Sequence locations=1-40,62-65,87-882
atgcagcaaaatacgggcgaaagagaggacagaaagaaacggggcggggaaggggaaggggcggcggaaggcgaagcaaatgcgcgaggtgacaagcggcgcgagaagggccgtgccgcgaaagacgcgccgactgaggtgagtcacccgcgagaaggggccaagaaaaggcccaattaccaagtgcccccgcccccattagcgtggaatcctccgtcggaagagccgatgccaattcgacgtcgcccaataacgaatcgccggagatggccgtggcatcggcacgctccaacacagcttcgcaacaatcattcggatctgttaacgaccttatgcccgcaacttacgacagctgttcagcccaaaacatgtctccgtcctcctcgcagtcgagcgaatcgccgacggaaacaaacgcatcgccgatggaacaggtcaattgggaagggaatgtaagggaaagcgaggggggggttaaatattgtaggtacagtaggaaagaggtcagtggataaaagaatggggcatcaggtactgtattttatgggcaatgggaaagggaatggaaaaaggtgaattaaatattgtaggggaaggagtcaatggggaagagagagagagtgaaagggagagcaaaagaaaactgtactaattacagtacaccgaaggaaattgaacccattatttttaaaacaatgcccttttcttcttaggatggcgaagtgccaatcgctgactcttttcaatgcctgtggcataaaagggacaaaatnttcaccaaanaaaanccttttntntacctatntnaatnaccatntccganccgaacttttgaaggaaaagaaaacccattaaaaancataattaatacttgtagggata

SEQ ID NO: 71377 - DNA, 2433 bp, Heterodera glycines
  Genomic contig location: Contig_ID=SeqID_9429; Location=74..2506; Strand=+
  SCN-specific regions: Sequence locations=1-13,35-544,574-799,821 -1387,1409-1522,1549-2038,2061-2117,2150-2406,2428-2433
atgatctcgcctggccatcaccaggaccacttctccaacccgtcctttggctctccgtcttataattcgagtccggacgaggaagagcagaaccgacgccaggaacagtcgtcgtcgccgtcattgagcgaaattgaagaaaaggaccacactttcctgaaaatcgacgttgagaccgaaaaggaaagttcgcctcaacaaatgcgaagtgcgggcggcggaatattccctcaaaactcggccaatttccaccgatacaacgtcaatgatcatcgcgcaacggtcaaaatggagacgaccgcggaaatgggcggagacggagagaaatgcggctgtattggcgaaatgccaccgacttcttgcgcagagaatgccatccccacgtcggcacatgcacctcccatctcaatcccatcgtccatgccgccttttccttccaatccgtcacagcaaccacaacacaccgtgagcaccaccatcttccaacaacaatggttcacccaatggctggccaacaatccgttctttgcctctgctcttgatgggtacttaaacaacaacaacagcaatatcagtgccattggtggaggcggtggcattaaagggctgctgacccacactcagcaacagcagcactcaaacgtcgcttcacacaaccacagcagcagtcagatggccatgctccaagcactgattgcggctgcaacttcgtccacttccgcttcgccatccttcgggaattactcctccgtcgttaatgcttcgacaccgatgagcaatggcgggttcaaattggcaccccaacagcagcaccaaccgccgcctaaaaaggcaaagacagcgaccggcggagggaagggaaaagcttctgcaaatgttgccgccgctgacgcttctcatcaccggcgtcagcagcaaaaggacacgaaaattgacggcggaattggagcaacgacggacaacgatctgctgagtgtgcatatccctcacaatcatttccattcgccgttcagcagcaacggatcggctaacagtccgacatcggtgagaaaagtgtaaaaagtaaaatggcggagggaatcatttgaatcccttttaaagaacgacggcagtaaaatgtgcgccctcatcgattcccttcttcacataaaaaaaagcagcggtcagaacagtccgattgatgagcagatcaaaacgaaaggaggacgaacgatccgagaggagacggaacggaggaacaacggaagacgcgagtgcccacacgagcgacggaaatggcggaaattgtttacggagacgagccggagacttatttcgaaaagtcggaaaagagcgagttggcacaggcgagtgaagacaaaattgaaacggtggtactgattttaaatgcattcccaaaatgggattagcattgatgggcactgtttatcgcaattccccttttaggctgcttctcccaacattttccccagcatccaaaggctaatgttggcccattccgccgaaaattgctcttcctcccttcattttccttcttcctcttctgctgatcatcaacaactttcgccagcggtctccgattctcagacgagcggaagcagcaacggaatgacgacgacgacaacggaagcgccgcgaggaatgaacagtccgccagcagcgacaaatccaacgaagtgccatccgacgggggaaagtgatgtgagtgatgagggaaccaattctgtggttatatcaaaatcgaatgggacaataatgactcaataattgcatattcggagactattcgcgttactaagaatggcttcagcaggacacaccgacaacagtgaccagcaaaggcagtggcgaattctcaggcaaaaagtcgcggggaaaggcggagagaattcgtcaaattgtcactcggatcaccacagcagcggaagaagtggcagaggaaaaggttcgggaagagctgatcgactgcgcccgtcaattgcaattggttacttcatctgccgaagaaaaggacgaagaagcgtaattattccgacaccaacattttgacacaaacaaatttatttcacataattgcagaatgtcatcccttttaaatactcattattttgcctgcgttttcccaaaaatctcatcttttttatgaaacgaaccatccaaaaataggcacaatttttttcgtcggatcgatcattcatccgtttatagttcaacacatttgatctataatactttgatttttttgcgttccattgttgttactttaaagaaacattgtatacttttccggcacaatatctcactagaaattttactgtcagcggatcgacccctggctcaggaaacattcaaatcacttttttttcttcattaatatttgtgactttaatatagaaaaatgctatcagattaatttacttctttttatgataa

SEQ ID NO: 71378 - DNA, 321 bp, Heterodera glycines
  Genomic contig location: Contig_ID=SeqID_9429; Location=3623..3943; Strand=-
  SCN-specific regions: Sequence locations=1-321
atccaaatgttttcccacccgcgccccttcttcggtcgaccgcggcattaccaagtctattaaatgtaacaccaacgcaatcagcaggtttctcccctttttttttgtcgtgcgtattaccttcatgcaaattttatcctgctaatttttgtgtcatcactaaaaggtctgttgccatcctcaaatcttcaatctttgctcggtgaagtgcccagcctcctcaaaaaccgaggccatcagctttttgccgtgcccccaaacattccgccacttcgcctctttgacgtgcatgagcaaaagcagcctttgccgaatggtttc

SEQ ID NO: 71379 - DNA, 814 bp, Heterodera glycines
  Genomic contig location: Contig_ID=SeqID_9429; Location=2749..3562; Strand=-
  SCN-specific regions: Sequence locations=1-216,241-437,460-814
cagcagagcatcgaaattgtcaatgcttttttggggaatcaccaaaaaaatccaaccgctcctctgaacaatactattctgagtcagctgacaaacaaacatagcgaaaatgtgccatcgctaacggcgaatttggcaccatcggcagaacaacagcagcctttgcccgtgccaccacttccatcagaaacttcttccatggacacatttatggtgccacctcctccaccgcctcctgtgagggtttgtccgtttcgcttttatgtgattgtggtggttaattaggacaacattcctttaatatgaaaaccaaataaattgtggactgtttaggcttgtcaaaattcccaatgtttggcggactctccgatggacatcgaagacgaccaagatgaagtcgaaacaagcgaaaaggaaagaaatgcaaaggaatgcgagaaaaaggggcgcaacaaaaaagtacaaatggccgatgaactaatgaagcgcgcattgaggccctattttaagtgaggaaaaaatcaaatgagttaaagaaaccgaatcataccgatttagaattatccctttaaacttacggtatctattgtcattcgaaagcaattttttgaatattatagttttgctgactgattttacttgtaacaattttaggcggcgacgaataacgaaggacgaatacaaagagattatgattaaaggagtcgcgaaactgaagaaacgccattcactgaaggccgaaaaagtcgagaaattcgtttctaaatatgtccaattagttgctgccaagcgcaagaatcaatttggctactga

SEQ ID NO: 71380 - DNA, 704 bp, Heterodera glycines
  Genomic contig location: Contig_ID=SeqID_43792; Location=375..1078; Strand=-
  SCN-specific regions: Sequence locations=1-167,208-535,557-559,595 -643,683-704
atgataaaactcaaatttcattcggttcataccaggaatgtgctgattgaccaggtaaggaaaaattattgcctaagaaactgatgatggatgatcactgaaacattttttttatatttggttgaatcgtgggatctgctggaggttgcagactgagtccacttgtgtttaatttttacatatacaaaataattaatttattaatttgttaagaatttgtcccaagcccaatcgcctgttgatcgtcgctcgtttatcgtacatgccaaaacttccgttacggtagctgatcaccagcaacaacgccatacgtttaatcagcttccacaaccgtggcgtgtgcacaatgatttgactgatgaagtgcttttgtttgagcatgtgatcaccaatcaacagcaacaacgagtgatttatttgttgcgcctgcggcgatgccatgccaatcaactgaaagatgccgacaaattttatgcaaaacattttgaagattttctttttttcaaagaccatccctgtaagggatttgttgagtcgccaaaattaattcttggctaattgttttcatgcaatttattattaattattgttatgtattcgcaaaaaaaaagaatttgttttttttattatttaaagattccgttgtgattttagccaaatcttttcttgaaattaaaattagcatttttgcgattaaaaataaa

SEQ ID NO: 71381 - DNA, 933 bp, Heterodera glycines
  Genomic contig location: Contig_ID=SeqID_43793; Location=1..933; Strand=-
  SCN-specific regions: Sequence locations=1-87,205-555,597-933
  Gene Ontology: Mol. function=dihydropyrimidine dehydrogenase activity; Cellular component=cytoplasm; Biological process =pyrimidine base catabolism
aaattcctcagtttcgtctgccttataatgtagtcgattttgaaattcaattggcaaaagacattggtgttaaggtaagaaggaatctttttttcaaattaaatttatttaaaagtaaaaatagtttaaaaatatattgaaaaactgaatatttttcataaaagaaatcaaatttaatcattaaattaaataattgtttttaaagattgaaactggccgttctctgcatcgtgatgatttgaccttagacagattgcaaaaacaaggcgttaaagcggtgtttattggcattggaatgccggagccgaaacgggcaccaatgtttgatggtctaacaccggaaaacggcttttacacgtctaaagattttttaccattggtggcaaaggccagtaaatcaggtcaagaccataaataaacaattaattttattgaaaattaatgccattaatgaaaaaaaatatttttttgttgttcctttttaaaggaatgtgccattgtgccaagactcaattacctcgtttatctggtcgtgtaattgtcttaggtcagtccaaatattaaaattaatttaaataaaatttaaaaatatatatgttagccaaccgaaaatattgaaagaaaatttgagtacaggtgccggtgacacagcgttcgattgcgctacttcggcacttcgatgcggtgcccttcgggtcactgttgtattcagaaaggtctacttattgagcgacaattatttagaactctgtttttattttttcaaaggatcgttcgaatgaatattttttttggtagtcattgagcaccaatttttttgagtccaaatttggacaatccaatggaatcggactctaaaatcgtaaaacatcaataaataaatatatctatagggatttacttcaatccgtgccgttccagaggaggtaaatt

SEQ ID NO: 71382 - DNA, 350 bp, Heterodera glycines
  Genomic contig location: Contig_ID=SeqID_43796; Location=396..745; Strand=+
  SCN-specific regions: Sequence locations=1-138,161-221,260-300,322-350
atgtattctaaggcatacgtcctttttatggattttatgcttatttgtaccaaaaagcccaatggtaaatgcatttttaggcccacaattggagagaaatttaaacaagtcttcgttattaatttgtagaagcgaaagataaatacgtgttttaatgaaaaattattaactatgttaaatataaactcaaaatagtaaagacaaaagaaaccaaaagtatcttatatatatacttagaaatatattttaaaaaataattgcagaggtacaagaaatttttaacaataaatgaccataaacataatattttttaaaatttttggtaatacatcaaattctaattttgaata

SEQ ID NO: 71383 - DNA, 331 bp, Heterodera glycines
  Genomic contig location: Contig_ID=SeqID_43797; Location=336..666; Strand=+
  SCN-specific regions: Sequence locations=1-127,150-297,319-331
tcttttgctgctccttattgctcaagcagtacagaataaaatgaattttcctggcaccgaaacgtttagagaaatgccaatcattcaccagcagaagaagcaggaagtggtggacagtgatgacgaaagcacaacctccttctcgtcctcatattcgtcctcctccagctcttcgagttcaacagagtgccaaagccctctgttgaaattgggcggccgcacgctgttcaacaagccgacaatttgcagaaaggttgccattacaaaacactcatggacaaagggcacggcggaggccaatttaaataaaaatgccgttcccattgtatga

SEQ ID NO: 71384 - DNA, 466 bp, Heterodera glycines
  Genomic contig location: Contig_ID=SeqID_43799; Location=503..968; Strand=-
  SCN-specific regions: Sequence locations=1-10,35-200,229-235,261-466
  Gene Ontology: Cellular component=cytoplasmic vesicle; Biological process=protein targeting
aaaatgtcaggttgtccaccatgaagtccactcttgtcgtctttggctgcactttcttcgaaatgttcgacataccggtgttttggccaattttggtgatgtactttatcgtgctcaccactctgacgatgaagcgacagattatggtccgtttttttggggttttcggtttatttttagacatacagtttttgaaaatgtttattttataataaaaacaatttttaaggaattttagaaaatttttaggttttcattgacaatttttttttcaaatttaaaaattccatggcaaattcgaagtcttggttttcagcatagtcaaaaatgtctcattttgaattttttgcttcattttcatccatttttcccattttagcatatgattcggtaccgttacattccgtttacgttcggcaaaccgcgcccccagggcaaggaggagaccggcaaataaacacacatc

SEQ ID NO: 71385 - DNA, 482 bp, Heterodera glycines
  Genomic contig location: Contig_ID=SeqID_43801; Location=326..807; Strand=-
  SCN-specific regions: Sequence locations=1-482
atgcctcagcaagcgcaattcccaattttacaacaaaggctcgacattgccttccaactcgtcgaattggaacgtcggcttggatggggagaagatgtgcaagatgagattaatgcgcttcaacaacaaatgcagcaattgctggagcaattgcaaaacctggtagcgagaggatcaacaggaagcgaaacgatacttttgatacgattatgaacattaatttcatccaaattccgaaatctctcccaaattttaaagttgtgtgctccgaatgtgttataaagacaattcatttttgatttaaatattttaaatttggcggcattttgttctcattatttttggttaattgttcactttccccgatgacatttttccgtaattttatgtaattggtaattttgtgctttttgcttctcatcttcaaattgtggtctcctaatttattttgatattattcatctgcttcggacttcaataaa

SEQ ID NO: 71386 - DNA, 674 bp, Heterodera glycines
  Genomic contig location: Contig_ID=SeqID_9430; Location=4487..5160; Strand=+
  SCN-specific regions: Sequence locations=1-89,142-431,453-521,543-674
atgctgcttatccaagcggcacttttctatctgccaaaatggacgcaggaaaaattgcttcaaaaatgtgagtgattttaagaaagggcaaaaaaaataaatctttgaatttaaaatatttaaatttaagtttataaaattcagcttgtttgttgacaaatgccgtggcacaatttgccgtggttaacgcattgaccggccgagggcaccgctggtggggcattgaagtgggaaaatcattgctcaatggtgatgaaataaaggtgaaaattgaaatatttcagcaaatttatgtattttcaaagcgcataattttatctaagtaaaatttcttataaatttcaaagataaatcgcgaaactttatcaagttttcagtagttttactctatatgcaattatttgccttggttcgaacactttcggcactttggtttaaattttaattagaaagttaattaaattcgtttttttgtcgaagacaccgaaagaaactctcttaatcactgcacttttgcccttttaaggatttgcccattttcccccgtctgatcacttgtgattctgtccttgctccgaacgtgttcgtccaatgccatctgcgcatcgcctggttcaacgagaagattttcttcctcatttggtaaattaataattccattttcactttttcta

SEQ ID NO: 71387 - DNA, 146 bp, Heterodera glycines
  Genomic contig location: Contig_ID=SeqID_43802; Location=251..396; Strand=-
  SCN-specific regions: Sequence locations=1-79,113-146
atggctatctatttttttgagaaattttctatgcaacaaacgctctcgaacatgaaacgaagtgcggtgcgccgtggccattttatttttcaaataatttttaaatttaatagatattccagaaaaatggctatctctttttttga

SEQ ID NO: 71388 - DNA, 146 bp, Heterodera glycines; identical to SEQ ID NO: 57274
  Genomic contig location: Contig_ID=SeqID_43802; Location=503..648; Strand=-
  SCN-specific regions: Sequence locations=1-79,113-146

SEQ ID NO: 71389 - DNA, 146 bp, Heterodera glycines; identical to SEQ ID NO: 62432
  Genomic contig location: Contig_ID=SeqID_43802; Location=755..900; Strand=-
  SCN-specific regions: Sequence locations=1-79,113-146

SEQ ID NO: 71390 - DNA, 905 bp, Heterodera glycines
  Genomic contig location: Contig_ID=SeqID_43805; Location=102..1006; Strand=-
  SCN-specific regions: Sequence locations=1-276,317-407,457-658,680 -708,745-803,825-833,855-905
  Gene Ontology: Mol. function=lipoprotein binding; Cellular component =integral to plasma membrane; Biological process=receptor mediated endocytosis
atgctaagccaaccatttttttggatgaattttcctttttttctaaaagatcatctaaaacatccgtgccttggccacaattgtgcacacttttgctttgccgtgccaagcagtgatcagtcggctccgttgaagaggaaatgtgcatgcaaacaaggtgaattttgaatccaaattgagagacttgagattcttgacatgcattaatgggtcaattaaaaaatccttacctttcaaaaaacaaaaaaatcatttaattttggggcgagatgaatgtaaaaaaaaaagaataatttattaaattataacaaaaaatggattatgcaatcatttacaaaaatgaaaaatcaggacacctttgaaaataaagaatcatttttggttggttaacaataagtcagaacacataattaggtaattaattaattaattaattttatcataattaattaattatatgccaaaaaaagacgtttaatttgctcattttttcaggctacaaagtgaatccgaacaacgagttggcctgcattcgcgatatcatggagcctgttgagccattgtgtccgcgcaatggaagccaattccaatgtgccaacgggcgatgcattccgttggaatggtagggatggattaaattcggaatttaatatagcaaaaattaattaatgattaatttgatcccatttatatggaatttcgttgttgtttttaattttcattacattttattttttaatttttctcttttttggcatttttctcaataatgaaaatttaactcgtgtcttaaattgttcaataaaaaattgttttacacttaatttaggcgttgtgatggagaggatgactgccttgacggatcagatgaaattgacgaaaacactcaagcatcttgttataag

SEQ ID NO: 71391 - DNA, 579 bp, Heterodera glycines
  Genomic contig location: Contig_ID=SeqID_43806; Location=346..924; Strand=+
  SCN-specific regions: Sequence locations=1-60,82-412,438-579
atggcgccaggagtacggtcgcagggttggttcaaccccaaaaagtgatgaaaattgaacaaatttattttattttaaaaacactgcatttttcaggactaaagcagaccgaaaccgtgccaacagcagatggagaggggacatcgacccaagccgccgaaagtggaccatcaacgtcagccttggaccttcgtaagtcaaaaaagtcactaattttagaagcaaaaattaaattaaggccctcgttcaagcccaaggccattgtcagcgactccgatcaggcgccatgagcgtgtacggccaacaactaccgaaaaagcaacacacatggatttgacaacgatggataaggcaacagacgtggatttggcttatgaggacgccgcgacacaaaccaagcaattggacaaacagctgaaagagcaggaacaagtgatcagctttcttcaacagcaggtccgcaacagagacgcactgatcgctgatctgcgccgtcgattggaacagcaggcgaaggaccagccaacacgtaaattctgcagaatttttagagccatttatcatccaaattgtttttag

SEQ ID NO: 71392 - DNA, 312 bp, Heterodera glycines
  Genomic contig location: Contig_ID=SeqID_43811; Location=75..386; Strand=-
  SCN-specific regions: Sequence locations=1-312
atgttaattagtaaaaccatccaaaaatttcaaaaccatgtcagtgagcatttcgccctggttcagctgtgccaacagtttggcacaatgctttcgaatgtcattccggcattccgtccgttggacaagccgttgggagtcggcggcattggcattttgagtttgttggtgctgtgctcctccggctgctggcagaggttgttgggccgcatttggctgctctattatttaaatattttgcgtattaaaggcaaatcatttttttatataaatcaaaaattctcatttttcagaattttcctgaatttttaa

SEQ ID NO: 71393 - DNA, 1424 bp, Heterodera glycines
  Genomic contig location: Contig_ID=SeqID_9431; Location=580..2003; Strand=-
  SCN-specific regions: Sequence locations=1-374,396-462,484-559,581 -1307,1329-1424
gaaggaaatgcgccgagtggacgaggaaatgcaggtgaattggaggggggggggagagaaatgccattgctatcatttgaacaatttgtgccattccgacgataagcaacggcccctttcatttcagcgtcttcgccacgagttcgaggggtaccgccccgccgcttcgcgttcttcgccttatacaacggcgggcactcagcccatttatggtaaattgactaaatattgtggtgggttgaaggtgggaggggggggggggggggaagcggatttcccaagtaaattcccgcgggcactaaacaacacagcccaaggagggcgaattgttgccccggggaaacagtggccgggagggagggcattcacttctctcccctcccccggccccttaacttggcatggcttttcgcctgtcccctcggggatttgctctgctcaaattcattcggccattccccgcattttaaaattaaccacaaacatttatttttggcggcttaaaaatgaaagcgaaattaaattttcgaatatttccgctcgtcaatcttcagaaatacttaaaaagaaccaaaagtggaaaaggaagggaagaaaatggcaattttggaacacagaaaagtcaccccgactcaacttgtgccccccaaggtggaggaagttcactgagcaatggcgcgggcggcggggcgatggcgcgccattcgccgacttacgacccgtacttggaaaacctaaagagcccactgatcaaagacgaaagtgacgggaaaacgttgaggctcaggtacaaataaaaatggacgtaatttgcaattaattacccttccctccccaaatggtcagattcgacgtcgcccaatacagacctgaggaagtgacggtgaaaacggtggacaaccgtttgttggtccatgccaaacacgaggagaaaacgccaagccgcacggtctatcgggagtacaatcaggtgaaagacggaagagataaagagggggggggggggggggaattgtggaggggacagaacgccatgaacagtccaaaatgaaacggagcgacggcgtgggagaggagaatcaatggcacccgtacaaagcctaggcctagcttaagcctacgtacaagatgcctttgtatgagttgtaatgaaaccgggaacggaacggggacaaagtaataggaaaataattggatttaacccgggaaaagcctatgagggagagtgggaaaacggaacgccaaaacaatttgcaggaatttatgctcccccgcggcaccaaccctgaacagatcaggtgggcagaatcatctccacaatctcatctggccacactttcccctccaattttttcagctcaactttgagtactgacggcgttctcaccgtcgaggcaccgcttccccaattggccatccaaaac

SEQ ID NO: 71394 - DNA, 717 bp, Heterodera glycines
  Genomic contig location: Contig_ID=SeqID_43813; Location=116..832; Strand=+
  SCN-specific regions: Sequence locations=1-4,26-576,600-609,631-717
atggtcgacgaagtcatcaaatggtggatccgaatcgcctgtgtctactcaaccttcttgttcctgcgtgacattgtccttccatgcacactcgcctacttgttcaaccctgttcgggtcacatttctcagcttaatgggagttcgacgtcagccgcttcaaccaatgctcggcaaaacgctacgacaggaggaagtgccgcttcgagaagttctccgatcacctcagccacgcacttcaccgcaccgttctctgtcacccgtccacctggacgtgatcgctcgcagtgcccgttaccaacaaactcgagcgcaaagcgatgcaaatctggcagaagtcgacaccccgttcggacgacgaacgcgacgaagagaggagcactgaggaccacgaggatcaaggaacagacgagcccaccgagaaggaacagattagcccccacgagaacgaatgatggatgaacccgatgcctcgggaatgtcgaaattttcgtaaaatcaaaatttgattttagcgttaaaatgatgtaaaaaagggggtgataaggggatggtatgactgatcgatttccctcccgtgtttgtttgtttttaatcccttccccgcccgttcctcatcctgttcctccccaaatctccctccgccgcaaatttgccccacttttttctcccgcaatcgcaactgtgcgaaattgtacgctcatttccccccccccca

SEQ ID NO: 71395 - DNA, 603 bp, Heterodera glycines
  misc_feature (593)..(593): n is a, c, g, or t
  Genomic contig location: Contig_ID=SeqID_43814; Location=42..644; Strand=+
  SCN-specific regions: Sequence locations=1-126,149-364,386-519,541-603
atggacaacaccgccccaaaaaaattcttgacttcctttgaccagcttcaaattccccccgaaattgacaacgacagcaccattcccgactacgcaaaactgcttattaagcaattgcagtcgctgttggccaccgcgtcgtctctggttcaatctcaagtgacggcgaatgacgcgattgaggaggaccgcagacaacggaccgttgtcatcaccaatgtgccggagttccaatccgggaaaggttcggaacgtggggaggcggacagagcactggtcaatttgattttggacacagtggacctcgatcaaaccccagtggtgttccgtgtcggcatgcgaacgcctaacagagcgagaccgctcaaaatggaatttcccacaaggcatgcggctcgacatgtgctcagaatgaaaggcaaggctctggctttgaatgctctacatggtgcgcggatcagggaaagcatgaccaaggagcaattggccgaacgtcggaaattaattgagcagtgcgcaaagaaaagaaaagaggacgcgggcgattggattatctacgcgaatcaggtcatcctgcgcagtgacattgacancaattcgtaa

SEQ ID NO: 71396 - DNA, 661 bp, Heterodera glycines
  Genomic contig location: Contig_ID=SeqID_43816; Location=328..988; Strand=-
  SCN-specific regions: Sequence locations=1-661
aacaaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggaatgccccgaaaacaaaaataaatcgattttttcaagtgtccgtttggggtactcaaacaattatggggagcaaaaatccaacgcagaattaaagtacaggctatagggaagctattccggaaggattcggtctccccattaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaac

SEQ ID NO: 71397 - DNA, 867 bp, Heterodera glycines
  Genomic contig location: Contig_ID=SeqID_43817; Location=146..1012; Strand=+
  SCN-specific regions: Sequence locations=1-637,660-867
  Gene Ontology: Mol. function=proteasome endopeptidase activity; Cellular component=26S proteasome; Biological process=proteolysis and peptidolysis
tacgtcaacatcgatcatacgacaggctctcgacacttacaaagatgtccaactttctcgcggaaaagtaccaagtggtcttgaggacttcgtcaatcggattttcaatcaaaacttggagctgaaagaatattctctggttgttggcttttcctcggacacgcgaagaattgatatgattgagagaactgttaacgctgtttcgaaggacggtgggagtacaacgacaattcttatggacacattgaacaagctgtacgagtctcatttggacgtcgaatttcatgaccaagttctcgggttgataatccgttttctggagtgccaaaaagagccgaattatttcgccttatcgcaggtaaatatatgtgtggtcggctgtttgttttatcccagtgattttagtgtttggttgaacttaaaaaagctcaatcagtggccgaattgttggaccgtcttcttgtccaggcaggcgtgcctttttttgaatttaatgccctaatcaaaaagatatttttgatgtttgcagaacaacgctctgatggcgtatcagttggcatttgatctttatgaaaatgcaccgcaggagtttttgaaccaaatgaagatgcatctctttccgagcagtccatccaccgaagaaccaaagacagagacaaaaacgcctgaaaaggaaaagttggaacgaattttgagcggcgtggagaccatcaaacatcacatgcaatttctcataaagaacaatcacaccgatatgttgatattgaggcagctcaaagacgcttcacgtgtgaattgcacacataatgctgtggtaattgccaatggattaatgcattgcgggaccacttgtgatgactttctgag

SEQ ID NO: 71398 - DNA, 497 bp, Heterodera glycines
  Genomic contig location: Contig_ID=SeqID_43819; Location=11..507; Strand=-
  SCN-specific regions: Sequence locations=1-497
atgaagctgctttcagcgacaccggactcatcgatctcgcacgacaactcttgtcaaaatgaacggttggcattatgcgataagattaattacttttcgaatgtatacattctttggtcagcagactctttcgccaattcgattatttttgatccatttacgcgtcccgttatgcgtttcacatcgcttatccaccccccccccccattaattgcttttggtttcccatttaaataccaaattgtcttcctccccctccccccgttttcacctgaacttcgtctcagtcccatcagagattcacccccgccgggcattggtccgttgcccaccgccatcactgggctaagcgatcgctggtgccaatggctttggttgtgctgctgctgttggacaacggcgcggtaaagatgcataaacagagggatggatggttaatggagtgtgtgattatgaccattattagagacatgattaattaattgaaaggaaataaa

SEQ ID NO: 71399 - DNA, 2464 bp, Heterodera glycines
  Genomic contig location: Contig_ID=SeqID_111; Location=230..2693; Strand=+
  SCN-specific regions: Sequence locations=1-274,303-574,598-759,781 -1535,1557-2048,2071-2248,2270-2464
atggccactgactggattcataatgcttatcctgaacaagcattaggaggaggaggaggagatgaacccgtcaatggcaatgtaaactggcttcaaattatggacgacgacgacgatcaaaatgagaaaagagagatgcaaagcgaggtggacgaggaaaacaaaatgaaaaaaggtttttgctaataaaaacgatttttttaacattttttattcagcggaaattgcaaaagtcataccaagaaaatgtagctgcggtgggaatgggcaatctcaacaacaacaacaaccgcaacaacaacgagaaaagaccgaaatgccattaattgagcatctgtgtgaacggtacaagtgttcaaccaaggaactggaagtgttgttccagaacctgaaatcgcggcgccaaatcttacaacacatgcgcttcaatgttcgtctccgtacaaactacttacatccggcaaatcgaaactttgtggtgcagtgtaacgatttgtcatccctttcggcaagtgaagcatttgcaatgcgtggatatttaggcattacggttggtcatataaattggattttgtatattaatattatattttattaggtccaaacctacttctatgttaaacatggagttcgtcttcgtcatccaaatcttccatgtgcgattcgttttggaggacgcgaccatcatgatttattcccgatggaatgcttgaacgtagttaaacagatctgagaaaaaatatgcaatcaaccgaatctataaaaacatattttgaaattgtatgcccattttttaagaaaaataataaattgatgcttgacattcaaaattgcacagttactttcaaagtacttaaacggccgttgaacaaaaccgagtttttggcaatcgcgcacaacggcgtgaatgttgaatggaatccgcgccgttttcatgccataattatgcgacttcgttacaccccgagaacagtggctgctctaatttttcaatctggacgtgtggttttaactggcgtgcaacacccggaccgtgccaagaaagaagcaaagcgcgttttgcgccgcctccgtgcttcacttcgatgcgccaacattgaaactacccttttgctgctgattttacgtgtggttaacattgttggctcacatacatttactcatcgaatacatattacgcatctcgtgccaatcatgcattcttcgactagcttctgctctgttcattatgacccaacaatatttccagctcttcggtgtaaaataaaattaaatgatgatgatgatgatgtttatgcaacatgtattatgtattattctggcaaaacaattctgacgggggtacgctcaataacatatatagacagtgcattttccattttgtcatcatttattagcggaaacaataaaaaattaccatgacctataaaactttttctcccattattactattatggttatgcgctttttgcttatctcactccccgcccatcgaagcacgtcattagcaagtaagcgattttttttttgattgattaaagtatgaatttttaagcatccgagaagtcatggaacagtattgcggaatcggttgatcgcaaagccagagataacaattttcaatggcctagcacacatgaaaaaggcacatgggcagcagttgcagcaactggagaagaatcaagggcgagagcgcagacaggagcgaatgtaagggatggtaatgaaatggtacaagcagaagcgataagcgaacgagaaggcggggttgcacttgctgctgcgacgaaaaatgcattatcggaacgcgggagtgaggttgaacaacaacatcagcaggtcgtagtgatggcccgtggaggagcaataagcaatggggatggtgcccgtgcaaaagcagaggccactggtggcgctaaaagtgttgttgaaacgaggattacggaacatcacggtgaagagaggctagctgcagctacagccgtcatacatagagaggaaaggagagaagaaagaagaagaaaaatacgcgtaagaaacagagaccgacaacaaggaggagaagagaggcagcgcggagaaggacataggcagtctcacccaaacgaaagacacaacgacaactttcacagttcgctacaattgaatttaccgcccaacagaatgaaccgaagggaacaggatgaacacatgcatcattcacgagatggtttgatgggacagtcgaacaatcaacaaggagaagagaggcagcaaggaggaggagggcataggcagtatcgcccaaccgaaagtcccaacgacaactttcacagttcgctgcaattgaatttgccgcctagcagattggaaggaagggaacaggaggaacgcatacatcattctcgagatggtttgatgggacagtcgaacaatcagcaaatgagaaaacgaattcaacgagaatgtttttgcacgtgctaa

SEQ ID NO: 71400 - DNA, 209 bp, Heterodera glycines
  Genomic contig location: Contig_ID=SeqID_111; Location=1..209; Strand=-
  SCN-specific regions: Sequence locations=1-209
taaaaattgaaccagaatatatataaatgtttagatttaagaaaaacaactttttttaatggagcaaaattttcaaatattcaatgtggatgacacaaaatttcgacacccatttacattgaccatatctggcagtacgggaagtggaaaatcagagtgggttatgcgctttttgaaaaatgttgatacgcttataccaatgggccaat

SEQ ID NO: 71401 - DNA, 520 bp, Heterodera glycines
  Genomic contig location: Contig_ID=SeqID_113; Location=825..1344; Strand=+
  SCN-specific regions: Sequence locations=1-2,24-249,275-278,300 -451,473-520
atgttgagacacaagttacaaatggaagacgatgttggggctattctgttttttttgaaggagttgacccaatatagtgcccgcataatagttgtatgccgcaatagtcaaaaagtcacctttttagcattatgtcccccaatggaatgccaaaagcaaggggaattatttcaatcaattaaacaaaatttaattgaaagtattgggccgtattcatttgtggggtaagtcttttcgtattatattcaaattattattattaatattattattaattatcttttttaattttagtttggacgagccgcctgcaattaaaaaatgaatgaagtaatctattgattgtttccatgttgtacccattctaatcaacgtatatgtggtaattgaatattttgtagttcactgaccatatcatttgcttcactctgggtaatatgccctaaacgtttcataaaatttacaattgaaatccagcagagcagtaggatgggaaatattataagataaaggccaaaaa

SEQ ID NO: 71402 - DNA, 740 bp, Heterodera glycines
  Genomic contig location: Contig_ID=SeqID_113; Location=8629..9368; Strand=+
  SCN-specific regions: Sequence locations=1-44,65-277,306-677,699-740
atggccactgactggattcataatgcttatcctgaacaagcattaggaggaggaggaggaggagatgaacccgtcaatggcaatgtaaactggcttcaaattatggacgacgacgacgatcaaaatgagaaaaagagagatgaaagcgaggtggacgaggaaaacaaaatgaaaaaaggtttttgctaataaaaacgatttttttaacattttttattcagcggaaattgcaaaagtcataccaagaaaatgtagctgcggtgggaatgggcaatctcaacaacaacaacaaccgcaacaacaacgagaaaagaccgaaatgccattaattgagcatctgtgtgaacggtacaagtgttcaaccaaggaactggaagtgttgttccagaacctgaaatcgcggcgccaaatcttacaacacatgcgcttcaatgttcgtctccgtacaaactacttacacccggcaaatcgaaactttgtggtgcagtgtaacgatttgtcatccctttcggcaagtgaagcatttgcaatgcgtggatatttaggcattacggttggtcatataaattggatttggtatcctcatattatcatactaaatacggtactgaagccattataatagttttcccaaaattattttacattaatttacctaatgttttgtgctcctcttgtgtgaggaaagatttggaaaattataaatattttgaaaaaaagattattgcaaaattctttta

SEQ ID NO: 71403 - DNA, 748 bp, Heterodera glycines
  Genomic contig location: Contig_ID=SeqID_113; Location=11603..12350; Strand=+
  SCN-specific regions: Sequence locations=1-26,48-66,89-196,245 -365,387-563,586-674,714-748
atgtttttagtagagttcgacctggacctggatccaggcctggatttttcctggatccaggtccaggggattttcctggatttttgtccagaaaatccaggtccaggcaaaacacgaaaaacctggattttcctggacaaaattttagaatttattatttcaagtgaccgatgttttttcacgttttcaaaaacagattaaataaatttaaaaacacattattattatttattagatatttttagatgcttctaagcaaataattaattttttcaaacattcttttgatttttaaaataaatttcaaaaaatccaggtccaggcctggatccaggtctcgaggagcctggatttttcctggacctggattttcctggatttttgtccaggaaatccaggtccaggtccaggcatttttcaaaatgtcgagctctagtttttagtagtatattcgcttgaaaaaattattcaattattttatcaaaatctctttttgtcatttttcattattttagaacattttgggaaaaggagtgactatttacacgttttttacagcgcgattttttcaaaaactttttgggaacttggaggagggtacggcggtgccgataggcgccgccgggaaaatttcacaaattttgaatgaaatttgcgatgaaaaatgagttaactttaattaaatttattatttaatttatttaaaaatatttggcattctgtcttagaaaaattttcaaaaaaatca

SEQ ID NO: 71404 - DNA, 1733 bp, Heterodera glycines
  Genomic contig location: Contig_ID=SeqID_1279; Location=3818..5550; Strand=+
  SCN-specific regions: Sequence locations=1-9,105-128,154-154,201 -243,287-995,1028-1441,1463-1677,1704-1733
  Gene Ontology: Mol. function=zinc ion binding; Cellular component =transcription factor complex; Biological process=regulation of transcription from Pol II promoter
atgacaaatagtgacccgagtttggccacttccgcttttctgactacgaatttcgactcaacaatggacccgctgttttctcctcccccggcaccgattgtgccgattttaacggcagaggagggcaacacattaatgagtgcgggcgactcaaatgacccaccggaactgcgccattgggccaacatcggagaaacaaagtggggggatgatgaatggagatggaataacgaccgatttaagtgccttccatttcttgcatcagctggagaatgagttgaggaggtcgcctccccgttcgcttctttcgcctgacaatttcactcctcgtccgtctgatagcaattggtttgactgtacacatttcaatattcattctcttgaaaattgcctcgtttacagccatcagcctaaacatttgtcaactcaaaagaaaacaaatgtcaaacggagggaccgtcgccgttcgtccgcttttgtgccgtccgctcgttccaaagaagaattggagagtttgctcaatggcaacatcgacccgaacaaaccggtggaaatgggggaaaaggcgaaataacggacacagagagttagttggaaagatgaacaaaacaatgcctgttcaggtgcgcaatgtgttggttgaggcgggcattggggcggagtttggacttcgtctaaagtcatcttcgactcttccgacgctattcgagcgaaattttgtgccggcaattgaagtgccaaagtgccggggaaacataagcaaaggacggaggtcgatggaattggcaaaagcaatgggacaggaggagggggagcgatcagggttcgaatctcattggaccaatttagagcttcttttaattcatttatttgaaaggctccgtccactgtcccacccttctgccgccacaattcttcccatttatttcactcccgctgaattaccaacaaatcatttgcccgtttttactaataagccacccagcgacaaaaggtaaaaataaaatttctttattttttaaaaatacaaccgcttcaaaatttgcctctctcaaattaaagatttacctggtcctgacattttcagttgtgtgccaagctctactcatctgctaaacaatttgggaccttcctcatcgatggaagaacagcggacaaagcgaaagaatcggacggaaagtgttcaaaagatggaccagccaatgttgagctcgcaactgttcacccagaagatcccttgttcttacaaaggatgtcaggtgacccaattaatcgggtgaatttggagtcaaatgaattttcatttcagaaaacatttgtgaaacaaagcgcaatgcgaaagcacttgcaaatccatgggccccgtcagcacatttgccaacagtgttcacgctcattcattgagcgttccaaattgaagcgccatttgttggtccattcgggcgagaaacgtttcgtttgtgactttgaggtgactgaccagtggggttgtaaaaaaggattccttttaggactgtggaaagcgtttctcgttggacttcaatcttaggacgcacattcgcacggtgcacaccggcgaacgcccttttcagtgtccattctgtcataaacaattcgcacaatccgccaatttgcgcatccatcgacgttctcacaactgtcgtcccacggtggacggaggaaaggagaaacagaaaaatggagcaaatcggcaaaaagtcacgtcgtgctga

SEQ ID NO: 71405 - DNA, 133 bp, Heterodera glycines
  Genomic contig location: Contig_ID=SeqID_1280; Location=563..695; Strand=-
  SCN-specific regions: Sequence locations=1-133
atgccgcaccgccaccaatcggtcggagatgacatttccttcaacaacaatcagtcgaaacacagcgaaattgttgaaaatgagctgttgacggttgctgaacgcaatggcgaggaactggagatggttccgg

SEQ ID NO: 71406 - DNA, 84 bp, Heterodera glycines
  Genomic contig location: Contig_ID=SeqID_1281; Location=241..324; Strand=-
  SCN-specific regions: Sequence locations=1-8,30-84
atgtcggctgaggaggctgcaagactttcttggatgtccgcttatgagagcggcaaagaatcgggcaaattacggatttctcgt

SEQ ID NO: 71407 - DNA, 849 bp, Heterodera glycines; identical to SEQ ID NO: 9433
  misc_feature (820)..(820): n is a, c, g, or t
  Genomic contig location: Contig_ID=SeqID_9433; Location=1..849; Strand=+
  SCN-specific regions: Sequence locations=1-849

SEQ ID NO: 71408 - DNA, 1248 bp, Heterodera glycines; identical to SEQ ID NO: 9434
  Genomic contig location: Contig_ID=SeqID_9434; Location=1..1248; Strand=+
  SCN-specific regions: Sequence locations=1-132,154-727,753-958,981 -1248

SEQ ID NO: 71409 - DNA, 368 bp, Heterodera glycines
  Genomic contig location: Contig_ID=SeqID_9435; Location=3..370; Strand=+
  SCN-specific regions: Sequence locations=1-13,36-156,178-204,228-368
atggccatagaacgggaaggaaatcaaaaagaaaaggataagccaggccaagttgggactgaatgcaagcacaggatggagacactaagcccaaaaaaggtaaaaaaaaactgaatttaaaattataaaaatggtaatttatggaggaaataatacgaaaatagaaaagcaaaaaatgaaagggttaaaagtaacagaaatttgataaaataaaatatatctactatacaattattaatcttaagactaaattaataatttgggtagcatattaggctcaaaaatcataaacacttaaaaacggcagagaaatagcaaaataagatataaaagggcataaaacgcttgaataggcacaaaaaaagcaa

SEQ ID NO: 71410 - DNA, 882 bp, Heterodera glycines
  misc_feature (763)..(764): n is a, c, g, or t
  misc_feature (780)..(780): n is a, c, g, or t
  Genomic contig location: Contig_ID=SeqID_9435; Location=1385..2266; Strand=+
  SCN-specific regions: Sequence locations=1-53,75-882
attacctcccctctcacagcaactccgttcctcgccgcaggttggccctggtggtggctgttgctgctccttctgctcctgcttctttgcctgctcctctgctgtctgctcgcgtggcttttagcaaagtgccgtcttagcctttgattgatcctctcactgtcccctcactaattacccccctaataatctttcacttttcctttcccaatttcccttttaatttttcttttgtttcattcacttctctcttcagaaaacgccgccagcgatatgtgaacggaagagaaagagaacgacttttgagggacgaaaagacggaacattacgaacgaagccgaggcgattttgaggacggatacgcacacgggtacagggcggcgagggcaggcggacgcgctgaagaggactaccggggcagggacgaggcattccgggtaggaacagcggatcggcacgcgtaacccaccaatccgatgtttaaggaggggtacgcaaaagggttgcgcgacgcgggagaacgcgggatgagcacatccatggccaacttggcacaacggcccacccagcgcctcggctactcctccggatacatgcagggcttccgggacggaaactcgggcgttttcggtgatcgcatcagcgagagtctgttgcgaaggttggaggagcagtatccggacaacgaggagttcagagccggttacattgacgggttcaaagacggagtcagcggaggacgcgtgagtgaatgagtggttannacgactgtccaacggngacatattttggccattataatcccccagtttggccatttcagacctttcgagactcccgccgcattcagcaaagtctgaccgaattgacagaacgactgac

SEQ ID NO: 71411 - DNA, 645 bp, Heterodera glycines
  Genomic contig location: Contig_ID=SeqID_9435; Location=515..1159; Strand=-
  SCN-specific regions: Sequence locations=1-9,32-199,224-257,285-645
atgccaattacaaaaacggaaacagcagcaacaacaacttacgacggaagtgcccagaagaccaaaccgagacaaaagaccagcacaatcaaaacgggaagaaccagcacaaagccatgccgaagggacaaacggtgcggagacggcggggacgaagcggcaacttctgtcggagagatcaaaggggacggaatggccggaggaatggggacaagaagaggaatgcccgaggggacaagaaaagatattgaaatgacaagaaaaagaagaagcacacagagagaagagggggtacagtaaaagaaatacgataaaaaggaaaagcaaatacgatagaatactgtaaagccaagggaatgcaaagagtgacattttggaccaactaacaaataagctccgtccccccccccccaattaacctttggcttaccgtcggctctgatctttttgttgtaagccatggattaaaagcgtgaatgagaaagaacgacaagagaacaaccaaaggatgagtggtggtgaaagagtggtcgtagtgaatggtcggtcggtcatccgttggatttggctcccaaattgcccccatttccccccccccccattttcaatatattttttagtgtccaggtcaacactaaggagtga

SEQ ID NO: 71412 - DNA, 343 bp, Heterodera glycines
  Genomic contig location: Contig_ID=SeqID_43827; Location=57..399; Strand=-
  SCN-specific regions: Sequence locations=1-149,247-343
atgtggagattgaagacagccgaacagaggaagaagtatgagaatttgaataaaatacttttaaattcctgctttcatcaaggtacttgttgacattccaaccacggatgaacctgtcaaacttgtaatacataaatcaattaatcctaatttatttttaattatatcggatatttatttatttagtcgaatatatatttaaagcggatataattaattatatatttgtttattaatttagttgttgcatgcagaagcgaccacaaaaccgggcaatggacaacaccaaggccaagtcgcagttgactccattcaatttgatgtaattacgccagtaattaaa

SEQ ID NO: 71413 - DNA, 279 bp, Heterodera glycines
  Genomic contig location: Contig_ID=SeqID_43827; Location=660..938; Strand=-
  SCN-specific regions: Sequence locations=1-169,191-279
atgtgccttaggaaattgtcctgtgatttttcaaagcgtgcaattggttgtaaatgggcaaaccctgaaggcttggctggcgatgttaatgcatgggaaattggtgtcagaaaaaagcaaaaagatgcagccaacacactctttggtaattaattaattaaacataggtttattgattgtcattaaatgcgctattttagatggtgatattgcattggcacagttgcacaaaaatgcgcccgcctatttggtgtccgaaacaattcaggcataaataaa

SEQ ID NO: 71414 - DNA, 156 bp, Heterodera glycines
  Genomic contig location: Contig_ID=SeqID_43831; Location=91..246; Strand=-
  SCN-specific regions: Sequence locations=1-156
atgcctcacgtcatcgaacacaaaatccgtctgctcggcagtccctcgtcccctcaccgttcgccacccccgtcggaattcggacggtacgtcgaactccaaaaggacaaaagttgggccgaaatgccatttgagcgaaatgatgccaaggaaaag

SEQ ID NO: 71415 - DNA, 1095 bp, Heterodera glycines
  Genomic contig location: Contig_ID=SeqID_9437; Location=1384..2478; Strand=-
  SCN-specific regions: Sequence locations=1-592,615-651,674-964,986 -1095
catttcaatcactggcactcaacccactaacatttcaatcactggcactcaacccaccaacatttcaatcactggcactcaacccaccaacatttcaatcactggcactcaattctcctgcatttcaatcactgggactcaacccaagagcattccaatcactggactcaacccaccaacatttcaatcactggcactcaacccaccaacatttcaatcactggcactcaacccaccaacatttcaatcactggcactcaacccaccaacatttcaatcactggcactcaacccaccaacatttcaatcactggcactcaacccaccaacatttcaatcactgggactcaacccaccaacatttcaatcactggcactcaatccaccaacatttcaatcactggcactcaacccaacagcatttcaatcactggcactcaacccaccaacatttcaatcactggcactcaacccaccaacatttcaatcactggcactcaacccaccaacatttcaatcactggcactcaacccaacagcatttcaatcactggcactcaacccaccaacatttcaatcactggcactcaacccacagcatttcaatcactggcactcaacccaccaacatttcaatcactggcactcaacccacagcatttcaatcactggcactcaacccaccaacatttcaatcactggcactcaacccaacagcattccaatcactgggactcaacccaccaacatttcaatcactgggactcaaccctccagcattcaatcactgtgactcaaccctccagcatttcaatcactgggactcaacccaccttaagatgttttaccgggcggggggagggctcggaagcggcgcctcacttcctaacatttcttattaacactttgtcttttttcttgctggaaggtacgggcttggccgcttcacggcctcgcacttatttttcttcctttttagcattttcatatggtcagacatttcttcttaatatttaatgacaaaaaaattttaaaacttacttggcaaacgttaatacaaaaataagtgtaaacaaatagtcatttattaataaa

SEQ ID NO: 71416 - DNA, 745 bp, Heterodera glycines
  Genomic contig location: Contig_ID=SeqID_9437; Location=1..745; Strand=-
  SCN-specific regions: Sequence locations=1-248,270-745
ataatactcataaaaatacaaataattcaacccacctattctatgaccacattctgaaaaaaatcccagaaatacgaggaaagatatgcttggtcacaataaaataaaaaatggctagtatgtaaaaatttgcggtcactaataaaataaaaaatggctaatatgtaaaattggcgtccagaaatttttagactaatccgaagcaaagcacgaatgaattaaagaggcgaaagaattcacagtatcgtttctaatagggaaatattgacaggatattcggctaaaaacgggtttgatcatttttagcgcatttttaggtatacatttgagacaattgggcaggacaagaaaagaatgaagttgatgcctcatgaaactcggaattggttatgttttgtcgaaaatatccttacataatactcataaaaaatacaaataattcaacccacctattctatgaccacattctgaaaaaaatcccagaaatacgaggaaagatatgcttggtcacaataaaataaaaaatggctagtatgtaaaaatttgcggtcactaataaaataaaaaatggctaatatgtaaaattggcgtccagaaatttttagactaatccgaagcaaagcacgaatgaattaaagaggcgaaagaattcacagtatcgtatgtaatagggaaatattgacaggatattcggctaaccatgtggagtgatcatttttagcgcatttttaggtatacatttgag

SEQ ID NO: 71417 - DNA, 664 bp, Heterodera glycines
  Genomic contig location: Contig_ID=SeqID_9437; Location=1827..2490; Strand=-
  SCN-specific regions: Sequence locations=1-604,627-664
tcaacccaacagcatttcaatcactggcactcaacccactaacatttcaatcactggcactcaacccaccaacatttcaatcactggcactcaacccaccaacatttcaatcactggcactcaattctcctgcatttcaatcactgggactcaacccaagagcattccaatcactggactcaacccaccaacatttcaatcactggcactcaacccaccaacatttcaatcactggcactcaacccaccaacatttcaatcactggcactcaacccaccaacatttcaatcactggcactcaacccaccaacatttcaatcactggcactcaacccaccaacatttcaatcactgggactcaacccaccaacatttcaatcactggcactcaatccaccaacatttcaatcactggcactcaacccaacagcatttcaatcactggcactcaacccaccaacatttcaatcactggcactcaacccaccaacatttcaatcactggcactcaacccaccaacatttcaatcactggcactcaacccaacagcatttcaatcactggcactcaacccaccaacatttcaatcactggcactcaacccacagcatttcaatcactggcactcaacccaccaacatttcaatcactggcactcaacc

SEQ ID NO: 71418 - DNA, 861 bp, Heterodera glycines
  Genomic contig location: Contig_ID=SeqID_9438; Location=1..861; Strand=-
  SCN-specific regions: Sequence locations=1-324,346-738,760-830,852-861
ggcaggacaagaaaagaatgaagttgatgcctcatgaaactcggaattggttatgtttagtcgaaaatatccttacataatactcataaaaatacaaataattcaacccacctattctatgaccacattctgaaaaaaatcccagaaatacgaggaaagatatgcttggtcacaataaaataaaaaatggctagtatgtaaaaatttgcggtcactaataaaataaaaaatggctaatatgtaaaattggcgtccagaaatttttagactaatccgaagcaaagcacgaatgaattaaagaggcgaaagaattcacagtatcgtttctaatagggaaatattgacaggatattcggctaaaaacgggtttgatcatttttagcgcatttttaggtatacatttgagacaattgggcaggacaagaaaagaatgaagttgatgcctcatgaaactcggaattggttatgttttgtcgaaaatatccgtacataatactcataaaaaatacaaataattcaacccacctattctatgaccacattctgaaaaaaatcccagaaatacgaggaaagatatgcttggtcacaataaaataaaaaatggctagtatgtaaaaatttgcggtcactaataaaataaaaaatggctaatatgtaaaattggcgtccagaaatttttagactaatccgaagcaaagcacgaatgaattaaagaggcgaaagaattcacagtatcgtttctaatagggaaatattgacaggatattcggctaaaaacggggtttgatcatttttagcgcatttttaggtatacatttgagacaattgggcaggaccagaaaagaatgaaagtgatgcctc

SEQ ID NO: 71419 - DNA, 629 bp, Heterodera glycines
  Genomic contig location: Contig_ID=SeqID_43836; Location=451..1079; Strand=-
  SCN-specific regions: Sequence locations=1-8,131-133,161-168,244 -315,383-518,554-629
agtcttccggttccgggggaagtatggttgcaaagctgaaacttaaaggaattgacggaagggcaccaccaggagtggagcctgcggcttaatttgactcaacacggggaaactcacccggcccggacaccgtaaggattgacagattgatagctttttcatgattcggtggatggtggtgcatggccgttcttagttcgtggagcgatttgtctggtttattccgataacgagcgagactctagcctactaaatagttggctcattgcttctgtgggcacaacttcttagagggattttcggtgttcagccgcacgaaattgagcaataacaggtctgtgatgcccttagatgtccggggctgcacgcgcgctacactggcaaaatcagcgtgcttgtccttccccgaaaggggttggtaaaccggtgaaaatttgccgtgattgggatcggacattgcaattattgtccgtgaacgaggaattccttgtaggggcgagtcatcaactcgctctgaatacgtccctgccctttgtacacaccgcccgtcgctgcccgggactgagccatttcgagaaattcggggacggttagtgttccggcttcggtcggtatgcagactggaaccg

SEQ ID NO: 71420 - DNA, 314 bp, Heterodera glycines
  Genomic contig location: Contig_ID=SeqID_43839; Location=1157..1470; Strand=+
  SCN-specific regions: Sequence locations=1-200,242-314
atgctaattggtctacgtgaaatgtcggctaaactccgttccgacatcaagcataatggtccgtgtagcattgatttatgcaaaccaattagtgtgctggtcggctcctccattagcatgcttttgtttggccacccgctgaaagaggtaaataattagcgattttctgaagcaaatatatacataactcataattgtggtttattaataaatttattaaattaataatatataattaatagagactggctggccgattcaaaagattcgatcttattgaaaaagccaaaaaaacttcaattaattcgtggtaa

SEQ ID NO: 71421 - DNA, 437 bp, Heterodera glycines
  Genomic contig location: Contig_ID=SeqID_9440; Location=1112..1548; Strand=+
  SCN-specific regions: Sequence locations=1-437
atgcgcgtgagttggagctttggtcagtgcactgtttggtcccgtgctcgtggaagtgccttttctcttacaagttccacgaacttttctatgctcattgtgcactttcctctcaacaaaatgcaattttttcgatggtcgcagcattttttgtgcgcttcgaattttgtcgctttcaatttaaccaatttcagaagaaggatggcaattcagcagaggatggcggcatcaaaattcttcgctatgatttaacttacgaaaagctatccgaattcgatttggacttcgattgtgtggacactttcgagggagtcactctcgaaagagtggcaatgggctgcggacagacggaaaatcggctgtttttgtacgaccggacaatggttaccggcgaaatccctttctggcaaatttcgctcgattggacaaaagtctga

SEQ ID NO: 71422 - DNA, 780 bp, Heterodera glycines
  misc_feature (40)..(40): n is a, c, g, or t
  Genomic contig location: Contig_ID=SeqID_43842; Location=44..823; Strand=-
  SCN-specific regions: Sequence locations=1-95,140-269,308-495,549-780
  Gene Ontology: Cellular component=mitochondrion
atggtgttttctttggaggtacattctttgtttttgaatntaagaaaaattaaaaaggcaatttaattaaatcgaattaattaattaaatggacgaaatattttttaagttttattaaaaatgaaataattaattaaaaggaattctcggctcgctgttctcatttctgcagtttctctcatcgcccatttttggctcattgtccgatttgcatggacgaaaatcgcttcttttggttgctgtgattggctcactgatttcatattgcgtaaaaataataaaattattaaaatttaattcattaattcttgaaatttagctttggtcactgtcatccgaaagtttttcaattttctttgtttctcgactgatcggaggcttaagcaaagcgtcggtttcggtagcgatcgcaattgtcactgacattatgccaacggaagagcggggcaaaggcatggtgagttaatgagcaaatgccaaaaagagagtcgaactttgaatttaatttacattatttaatttaatttaaattacaattatttaaatttttgctatttctagttaatctttgtttatttataggctttaattggtggctccttctccctggcttttttgattggcccttccattggcgcctttttctcgatcggtgcccgggaaagtggcgagttcaacccgtccccggctctactggcaattgcactcacactggcagaattggcacttttggtgttctttttgccggagacattggccaaggcaaaggcgcgtctctaa

SEQ ID NO: 71423 - DNA, 510 bp, Heterodera glycines
  Genomic contig location: Contig_ID=SeqID_43843; Location=257..766; Strand=-
  SCN-specific regions: Sequence locations=1-296,318-359,381-510
agtgatcgccgactgcgcaaatccgtgccgagttccccgcagacaattctcgttttggccggcctttttgtgtgcggcctcatccttctgatcagtggtcttattgttctaataacggtaaatagggaaggcataaaaaggggaggggaggggggagaatttcactttttttgttttggcattcagaattggcaaaacgcaaaagcaattcaaaacggatggtattaccacgtggctggctgtacaatgcttcttcttggcttttctgggctcggaatttgtgcacttttacagcgtaaaaacatcacaaaacttgcggaggacatgagcagagtcaaatttgggataattaaaaaaggattaaaataaataaatttaaaggatttgtttaatgttgctgcaaatgcggctgcttctgaagagaaaagggcgtcggaggaaatggcaatggttggagggaacaaaaagctgaagcgaatgttggcacaagtgccatcgacgatgatttga

SEQ ID NO: 71424 - DNA, 429 bp, Heterodera glycines
  Genomic contig location: Contig_ID=SeqID_43844; Location=330..758; Strand=+
  SCN-specific regions: Sequence locations=1-169,191-221,244-247,269 -292,315-429
aaacagacatcaccactcattcggataaaataaacaaattgaccaatgctgttgaccaaattgaggtttcaatgatgagtgcagcagaggtgaatttaaaattaaatttcgagaccaatgcttttcatgcttattaattagcccaatgccttttaacaaacaattggataatatatacttagggttatgaaatgtaacaacccttttcagcaaagagacatctttttcattgtcataatttttatgaaattttatgaaatttttactaattttgcaggctaaaagggaacagaatgataaaaaacctcaaaaactttttttctaaaatggtattttaaaattagtggtcacttacgggttccctctacgacctaaataggtatttaattccaaaattttaaaaaatcctggcaaaaaatcgcctaaaaa

SEQ ID NO: 71425 - DNA, 626 bp, Heterodera glycines
  misc_feature (560)..(560): n is a, c, g, or t
  Genomic contig location: Contig_ID=SeqID_43845; Location=1..626; Strand=-
  SCN-specific regions: Sequence locations=1-356,378-493,515-626
atctttatttatatttgagaatatgccaacaccaatttgcgatacgccttcgataagcggtgtaaagaaagaccaatttgaagcgacaaaaaaagtttgttactaatttaagtgttaacccttaatacaacattccttttcagtggaggaaggccctcaaaaattttcacgagagtatgccattgtccactcaccggcgccagttgcgaacattcacagaaacattcactgggaaagatgcgttggattttgccgaacaaatctttccatcagtttttcctttatgcaacaccaggtcctttaattttatttatgatttaattttccatttttagggataagtccagacaacttttggaaagattcttatgctttgggtacattacaaatgtgcgtgatgaaaattgcaaaagcttctcagacaatggccactttgtataagtagggactgtattattctacagtaaatttgcttatcgcataagtcgaattctgtttggttttttaggttttgcaacgaacgaattgcccaaatactctcgagtagtcaggaagacganatgaattggaggcgaaatgtttttttggcacggtcgtcttcagtgcgcgacaagacataactgatc

SEQ ID NO: 71426 - DNA, 861 bp, Heterodera glycines
  Genomic contig location: Contig_ID=SeqID_43846; Location=10..870; Strand=+
  SCN-specific regions: Sequence locations=1-615,643-750,828-861
ggatacgaaggcggtgttccggaggaatctctcgactttttccgctcgccaatgtttttgctcagtgaacgcgctgcgtccacagaagaacccttggcgagtgaagcggcgcgtccgtctgaaaatgaacggcagcggaaggcggcggtgatcgcctgtcattatcaggtgatcaaagggaccgaaaatggcgagagaaaggcgatggcatttgttgtgggagttaaaacaaaacctgatcaggtccaaatcttcttcaacgatttgattgtttgtgcctctgatcccgtgccgctccattggccttcgttttgtgtcccatttgcccgaattttcgatttacgtgtgtttgaaagacccgagaaggtccggtgatcaagattaaattaatgttacagactaaaggttggtcttttttagattcgaattcgcctgatggagcgtctgtcacgaatggcaaaatggcaggaaattggggaagttttcttgcctttgttagctgaccataaaaccggcacttctgctgacgataatcgtaaggaagaaggatcgctggttggacttcaatttgcctccaccgtacaccggggaaggtgggactgaaaaagccgggaccaaatgggggaatgggggtggggtcagccgagagcactttttgtttttttcagtttcaaggacagtttgggctgtggcgggcaagcgccatttatgcaaggacgattattctgtgcactcaaatcaaccagtggaaaaagaggcgaaaagaatgaggaaagaaagggacaaagagaaaaggtaggaaaagggaaaagcaatgaaagagaaaatgatcagaagtcaaagggagatcggaatgaatga

SEQ ID NO: 71427 - DNA, 309 bp, Heterodera glycines
  Genomic contig location: Contig_ID=SeqID_43848; Location=826..1134; Strand=+
  SCN-specific regions: Sequence locations=1-123,145-309
atggatcgaaaaaagactgaaattcttcaaaaatgtcgtaaacgcaaattcttggataacaatgacagcgaaaacgaagggaattctgagcaccgcgaacaaaacgccgaaaatgatggatgcgatgacgattttgaagaagaacgcgccatcatcaacttcgaactactcaaaatggaggcatttgtctttggtctgaaggtgggaaatttgctagaaaaggatgaaaatttgtcaaaggctttcggtacacacacgaaaaaaacgaccgatggaggtgcactgtgcgtggctgccatgcccgcgtga

SEQ ID NO: 71428 - DNA, 75 bp, Heterodera glycines
  Genomic contig location: Contig_ID=SeqID_43850; Location=348..422; Strand=-
  SCN-specific regions: Sequence locations=1-75
atgggcccacttggagctcaaacattcaacgcctgggttcagagtcaagcaaccctggcttcatacccatttaga

SEQ ID NO: 71429 - DNA, 1508 bp, Heterodera glycines
  Genomic contig location: Contig_ID=SeqID_9441; Location=1359..2866; Strand=+
  SCN-specific regions: Sequence locations=1-253,275-448,478-508,532 -852,874-1478,1500-1508
atgaccatcttttacgaaattaccaatggagaaaatccagcagagggaaacaatagaaaattgacattaaaatggcttcaaaatgatggtagtgcaattttatgcaacgaaaatttccaaaaaattcatgaaaatctcagaatcaaaaaaacaaatggagatgaagcattcattgagaaagcagaaaacaattggaacaatttttgcgcaatgtttaaaaatgggaaaagcatcagaaaaattgagacaaatttggtggaaagagcaaaagaatccgtgctaaatttggagacaatgccccctgcattggtgaaaaatatacgaaaaattgcgcaaaatgaaaattttaacgcggaaaataaacaaaaaatggccgaactattggaccaattcatcgttgggctgaacatcttccgaaaattggttggaggtcaaaagcatttaccaatttgtaaataaaaaataaatgcaaattttagacacattttggacagataaaatcgtgaagcaccagcagcagctgcagttggcacgacgaaagcgaagagcgaacttaataaagtcggcggagtgcctcttcagcattgggcttggggcccttgcggccactttgggcattgtcctcggcgcagacttgggccaaaagaggcacaacgacgtcgaatcctatttcgaactgaatgaacggctcgaagtggccggaatattcctttgtttcttccttttcgtgttctgtatcgtatacatttgcaaaacgtgccgttcgtgagagaagagacttttcgaaatgatgaaaggaattcaacacaatttgttggtctagaagggttttatgtaaattgttttttatctaagataaataaaatttatagattgtgaagaatgtatccgatgctcgaaacggccctcccgacccacctaaagtcacgataatctccaaaaaatcgactaaaaaggtcataaaaacccgccaaaagaaaaaaaacaccaaaaaaagcacaaaataaatgcaaaaaagtccagaaaaattaggtaaaagtgaggaaaaatgccaaaataatgacaaaaagtctgaaacagtgacgaatagtgatataattttcagccaaatattgagcaaaaataatttttattcacttcgaattctaaaacatccgactatcgctccgcccagcggaattggaggagcgcaggacaatgcaaaaggaatgcacggaacgaaggaaggccgaaccaaatgccgactggatcatctacgcgggaaacattgtcaagcgatcggagataccggcaacgcaactcccacaaacaaatgccccgcctcccgtcgagggaaatggacctgaacagaagaaggctaatgaaaacacatccaaatcgcaggttgacatcagtaccaaggaatttttaagcacccttaaccgcgaaatgcaagccattaaaaaacaatatcccgatcttgatcttttcaaaagacagttctgccaaacctccaacaattaaaaaaa

SEQ ID NO: 71430 - DNA, 117 bp, Heterodera glycines
  Genomic contig location: Contig_ID=SeqID_9441; Location=708..824; Strand=+
  SCN-specific regions: Sequence locations=1-117
ttatgatactagggctcggatttttaggcaaaagcctattttttttcctgagctccccgtggcctgaaacgcacgaaaaacatgtttttttgggctgttgttaagctacttttcgag

SEQ ID NO: 71431 - DNA, 641 bp, Heterodera glycines
  Genomic contig location: Contig_ID=SeqID_9442; Location=3389..4029; Strand=-
  SCN-specific regions: Sequence locations=1-184,206-641
agtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcggggggactgccccgaaaacaaaaaaatcgattttttcaagtgagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggactgccccgaaaac

SEQ ID NO: 71432 - DNA, 896 bp, Heterodera glycines
  misc_feature (242)..(242): n is a, c, g, or t
  misc_feature (306)..(306): n is a, c, g, or t
  misc_feature (350)..(350): n is a, c, g, or t
  Genomic contig location: Contig_ID=SeqID_43853; Location=1..896; Strand=-
  SCN-specific regions: Sequence locations=1-406,436-450,552-637,659-896
  Gene Ontology: Mol. function=calcium ion binding; Cellular component =endoplasmic reticulum lumen
tttaaagtttgttgcataaattcctaaataattaatatgacatttttcaatattttacgaacattttttaagaaattttcatttttgaagagtggcaaggaaaccgacccgaagcatgaccatgaacagttccttggcaaggacgaggccagacagtacgaggagttgacgccggagaagagcaaagaacgactcgcgtaattttcgaaaattacaacaaaaaaaaagtattaaatatttancagaaaattagtgccaaaaatggacctaaactcggacggtcaagtggatgagttggaactacgngagcacatcaatttcatgcagaagcgttatgtggtgcgtatatntaagaaaaaaaaattaattacttgagggaatttattttttttaacttagctgaaagattttaatttttttttttttgaaaaatttgactgtcttcttgggtttataatttttttattttaattaatttcggtgaaattttttaatttgaaatttttgattataaatttcgttttttatttttaaatttttcaatttattttcttatatctgactaatccttaaaaataaaataaagttttttttacagaacaatgatgttgagcggacatggaaaaattacaaggaggagcagctgaagaatggcttgctcgattggcaagactacaggtgaagaaaatctaacagagggcgagaagggtggaaaatttataaaattcttaaacttttcaggaatttgatttacggaaaaccacaggagggccaggagatttcaccggaatacgtcaaaatgattgagcgagacgaacgtcggtggaaggtcggaagcgggccgaaaagacctgctaatttatattaaatcgagaggctaacggccgaattttaat

SEQ ID NO: 71433 - DNA, 636 bp, Heterodera glycines
  Genomic contig location: Contig_ID=SeqID_43855; Location=212..847; Strand=+
  SCN-specific regions: Sequence locations=1-145,168-299,321-529,551 -554,576-579,601-636
tttttggttgctatttatagaaggggtatataaagggagtgaaaggaccatttgattgatacacaaaaatgcaaaaaccgataatcgtaaatataattgctctcgctaatctcggtaccggaattaaactaaactctctgacgatcaccgaatgcgaatttaagtataaccctagaaaattcaatgccgcggttatcaaatgtacaactcctatcaaagccacggcattattatgggaatccggaaaaatgatatgtctggggacgaaaagtctgatagactgtgaaaatgctattaaaaaatttatagaaataattaagggttcggggtgtccgggggcttcttacaccggacacacggttgaaaatattgtttcgacctttaaattcggacgtgaaattgaactgaacgagtttcgaaaaaatcgtcgtgcattttatgaaccggaaatattttgtggtttaaatttcaagcggggtaaaagcatgacagcgttaattttctggaccggtaaagtcgtaattacgggaactaaaaacaattctgaaattaaggaaatgtatcatcatattctcccctatttgaaaatggctcaaaagaagttagggagacgataaaaaaattttcatttatggg

SEQ ID NO: 71434 - DNA, 201 bp, Heterodera glycines
  Genomic contig location: Contig_ID=SeqID_43855; Location=974..1174; Strand=-
  SCN-specific regions: Sequence locations=1-39,61-74,97-201
ccgcgccgcgcagcgccgcggaaggtcatcaatcatccacctgtcaccaaagtgacaggtgaaggaaattcaattttttcttttgcaaatttaaatctttttgatcccaaaccttttgggccggttttattttctcaatcctgaatttttttatgatgatttttcggatcctgaaattaaaaattctttttgaaaattagc

SEQ ID NO: 71435 - DNA, 830 bp, Heterodera glycines
  misc_feature (11)..(11): n is a, c, g, or t
  Genomic contig location: Contig_ID=SeqID_43856; Location=214..1043; Strand=-
  SCN-specific regions: Sequence locations=1-53,76-830
atgagcgctanaattatcagagtgctgaaaatcgcatgtgatctaagcctagcaaaaaatggtgtaagtaataatcgtaattacgctcaaaaagctcctcaaacaattttagcgcttccaattccttctacaatcgcctttatacatctcattatgaacgctaaaattatcagagtgccgaaaatcgcatgtgatctacgcctagaaaaaaatggtgtaagtaaaaatcgtaactacgctcaaaaagcttctcaaccaattttagcgcatccaattccttctacaatcgcctttatacatcccattatgagcgctaaaattatcagagtgccgaaaatcgcatgtgatctaagccttaaaaaaatggtctaagtaaaaatcgtaattacgctcaaaaagcttctcaaacaattttagcgcatccaattccttctacaatcgcctttatacatcccattatgaacgctaaaattatcagagtgccgaaaatcgcatgtgatctaagcctagcaaaaaatggtgtaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaaatggtgtaagtaaaaatcgtaattacgctcaaaaagctcctcaaacaattttagcgcttccaattccttctacaatcgcctttatacatcccattatgaacgctaaaattatcagagtgccgaaaatcgcatgtgatctacgccttaaaaaaatggtctaa

SEQ ID NO: 71436 - DNA, 626 bp, Heterodera glycines
  Genomic contig location: Contig_ID=SeqID_43858; Location=301..926; Strand=-
  SCN-specific regions: Sequence locations=1-276,298-320,342-443,465-626
atgatttacaacagtgatagaagaggtgcaacagtgattaaaagaggtacaacagtgatcagaagaggtacaactgtgattagaagaggtacagcagtgattagaagaggtacaacagtattagaagaggtacaacagtgatgaaaaaagggccacagtgattaggagaggtacaactgtgattagaagagatacaactgtgattagacgaggtacaacagtgactaaaaaaggtacaacagtgatcagaccactttttcgccagaagaaaaatatgaaactcaaaataaatgttatattcatgatcagtggccaaaaatagcccagaaaaataattttcaggctatttttgaagaaaaattttgtccatctgaaaaccaaaagggtctccccttgggtcaggaaattcgaaacaacttttcgggtgataactttttttgaagaagtgatggataaatagtgaaaataacttttttgtagaactaaaaattacggatttttggatgattaaattttacctgtacccctaatatgaagggagttatgaatttttttctgaaaattcgaaattttttagaaaatttggaataacttttttcttattcgttattttaataccaaataaa

SEQ ID NO: 71437 - DNA, 85 bp, Heterodera glycines
  Genomic contig location: Contig_ID=SeqID_43858; Location=1..85; Strand=+
  SCN-specific regions: Sequence locations=1-85
taatcactgttgtccctcttctaatcacttttgtacctcttctaatcacttttgtacctcttctaatcactttttacctcttcta

SEQ ID NO: 71438 - DNA, 992 bp, Heterodera glycines
  Genomic contig location: Contig_ID=SeqID_43859; Location=116..1107; Strand=+
  SCN-specific regions: Sequence locations=1-192,216-992
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcacttcctgaaaaaaatatttatgaaacaaaaaaatcgattttttcaagtgtccgtttggggtactcaaacaattatggggagcaaaaatccaacgcagaattaaagtacaggctataggaaagctactcccgaaggattcggtctccccataaatctgggcgcatcggttcggggggactgccccgaaaacaaaaaaatcgattttttcaagtgtccgtttggagtactcaaacaattatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggactgccccgaaaacaaaaaaatcgatttttt

SEQ ID NO: 71439 - DNA, 263 bp, Heterodera glycines
  Genomic contig location: Contig_ID=SeqID_43860; Location=12..274; Strand=+
  SCN-specific regions: Sequence locations=1-158,180-263
cagtgccgatgattactacgcgctccgtttgctgtacaatttgcccgtcggatttgcaattgcgctgctcatttaccacttggcttggtaccggatcaacttcgccgactccattctgatcaacccgttctggaaggagttcgtcaaatggctgatgatcgtctctgccgccctgtcctattcgcttaatcccgttggtggtggtgatgttctccaacaactgatgcttgcttccacactaatggtcacttcgttttcagttg

SEQ ID NO: 71440 - DNA, 920 bp, Heterodera glycines
  Genomic contig location: Contig_ID=SeqID_43861; Location=48..967; Strand=-
  SCN-specific regions: Sequence locations=1-20,42-275,297-552,574 -807,829-920
atgccaaaacaaacggaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaa

SEQ ID NO: 71441 - DNA, 1157 bp, Heterodera glycines
  Genomic contig location: Contig_ID=SeqID_9443; Location=1691..2847; Strand=+
  SCN-specific regions: Sequence locations=1-98,143-585,625-815,839 -879,902-977,1002-1058,1082-1087,1109-1110
atgcttggagagcgcttgaagagctgcaccggatgcgagtgccgccgttgctgtacgcttagcggttgctgtgcaatgacggaaaattgcttgaaaaatatacatcagaaaaaaggaaataaaatcaggaatacactctcccgtatcgcctgtagacaaaccgaagggtatatggacgaacggcaagtggactgtttaaacgatgcatgtggatgctaaaatagttttgtttttttccttttccatctctgtttttagcgaagaaatttttattttaaaacaaatttaacccatattttacataagagtttttcgggcggggatataccataaattaggacaggtaaaggagaataaaattttatcttcaattcacagagttgaaaaaaatgggcacatattaaacaggaacagtagtcaataataaaaacattcaaatccatcgtccatccatggatctgagttgtcggaggaatcttaaaaaagaaggaattcgacaacaacaaaaaaagcctttgtcgggaatttggcatttaaaacacttttctgcaactgttcgaattttcaatcgttttcagcttcaaaaaattcccacaaaagtcaaattccaagcagtgagtcaaaaaattcaacttttaattgtgaattcgtaattttaacggtgtaccagggccaattcaaaagttaacagaataaagaaaaataaaatttcagtgcttccggatggttttccatcaagttaggaaatccttgaaaatgtgcaaaaataattataaatgatgatctgatcaggaaaccatttccaatcacaattcttaaataatttaattaaattttactcagtggcgcgggcggtggcgttgagtcttcacgcgggttgaatttctgttgggctgggttcattggtaacacaggttgtaatgctgcaattggatttgatgttgacatagcctgttgaccattcttaaatttttgatgcaattaattaattaattaaacacttttttaacatggtttattttttgattttattttttttggaaaaattttaatgggcgttttttaattaattttttattttggacttaaaaactaatcaaaaagtaatcgataaattaaaaaatgaattatgtaaaattaattaaactaattaaaaa

SEQ ID NO: 71442 - DNA, 1938 bp, Heterodera glycines
  Genomic contig location: Contig_ID=SeqID_9443; Location=1597..3534; Strand=-
  SCN-specific regions: Sequence locations=1-170,347-413,464-676,783 -943,966-1006,1030-1220,1260-1702,1747-1938
ctgaaagcagagggcaagtcggaaccacttgaggcggacaaagcgattgtggccaaaaacaaagccgatccaggacagccaagtgacccgtcagacatgatcactgccaaggacaagaatggtacaataatgaatttgatcatttattcctcattcaattatcaggaagcaaaattaaaatttttttaaattgcaagaattttacaatattttcacatattgaatttaaaaaagttttttaattttttaaaaatatttaattcatcattaaacaaaataaattattcttttaagttttttcaaattaaataattattgtattttcatataattttaaataaaatatggtttgagctgtggtgccgatagtcacatcagcaggagggaaattttggcaaatttaacgaaatttgttaaaaaaatttttagtgtttttattaaactcaaaaaattatatttatttgattgtttttccaaacaggctcaattactcgccgtgtgtcaaacgggacaacattggccaatgtgatcccacccgatcacttgcaaacattggtggagaatggcactgacgcattgctgccttcaacatcggatgcgccaaggaggtctcgtcggatcgcggccaaagtgagttttgggcgggtgggaaaaaaaaagaaatttgattttcaaaaattgatttattttttaattagtttaattaattttacataattcattttttaatttatcgattactttttgattagtttttaagtccaaaataaaaaattaattaaaaaacgcccattaaaatttttccaaaaaaaataaaatcaaaaaataaaccatgttaaaaaagtgtttaattaattaattaattgcatcaaaaatttaagaatggtcaacaggctatgtcaacatcaaatccaattgcagcattacaacctgtgttaccaatgaacccagcccaacagaaattcaacccgcgtgaagactcaacgccaccgcccgcgccactgagtaaaatttaattaaattatttaagaattgtgattggaaatggtttcctgatcagatcatcatttataattatttttgcacattttcaaggatttcctaacttgatggaaaaccatccggaagcactgaaattttatttttctttattctgttaacttttgaattggccctggtacaccgttaaaattacgaattcacaattaaaagttgaattttttgactcactgcttggaatttgacttttgtgggaattttttgaagctgaaaacgattgaaaattcgaacagttgcagaaaagtgttttaaatgccaaattcccgacaaaggctttttttgttgttgtcgaattccttcttttttaagattcctccgacaactcagatccatggatggacgatggatttgaatgtttttattattgactactgttcctgtttaatatgtgcccatttttttcaactctgtgaattgaagataaaattttattctcctttacctgtcctaatttatggtatatccccgcccgaaaaactcttatgtaaaatatgggttaaatttgttttaaaataaaaatttcttcgctaaaaacagagatggaaaaggaaaaaaacaaaactattttagcatccacatgcatcgtttaaacagtccacttgccgttcgtccatatacccttcggtttgtctacaggcgatacgggagagtgtattcctgattttatttccttttttctgatgtatatttttcaagcaattttccgtcattgcacagcaaccgctaagcgtacagcaacggcggcactcgcatccggtgcagctcttcaagcgctctccaagcatattgtttttttttctatctcaactatgaatggagttataacaaattttgttgacgtttttgcatttaacagatccattataaaaataatagttg

SEQ ID NO: 71443 - DNA, 388 bp, Heterodera glycines; identical to SEQ ID NO: 59955
  Genomic contig location: Contig_ID=SeqID_43862; Location=115..502; Strand=-
  SCN-specific regions: Sequence locations=1-273,295-388

SEQ ID NO: 71444 - DNA, 649 bp, Heterodera glycines
  Genomic contig location: Contig_ID=SeqID_43864; Location=249..897; Strand=-
  SCN-specific regions: Sequence locations=1-129,151-344,374-496,548-649
atgctcgacattaaccctgaaaaacgaatgagtgccacagcaattatcgactttttgaatgggggatgtgcgccaaatattggcatcggaaatgaagaaaaaatgccaatttttggcaaagtcgatgcagattttttaagcatttcattaagagccgaaatttatagagttaagggaatttatgaagaaaataaaaaaatccgtcttgaaaatttggaaaaaattcaagccctgttgacgacggtgacaaaacgccaaaaactgttgttttcaatgttggcaaaaaggaaacacatttgtgagggtcaaaagaattaaaaagtgaattttgggagattttagggaaatttattattatttttttatttaaaatctatgtaaagtgatcattactgtttttaccagataaagattaagaaacaaataattcacataatttaatcgtgatttaatacaaactttcgattgcaaaggcttattctgaattggcagattatcaatttccatttttaaaaagcattttgaatttctgtgcatttaaaatttggttattcaaagaattgtggttaattacaattaaagaaaatttaatgtgttcacagtgatataatcaaaatctcaaagtttggcgtgtaaattgattaataaa

SEQ ID NO: 71445 - DNA, 1024 bp, Heterodera glycines
  Genomic contig location: Contig_ID=SeqID_43866; Location=7..1030; Strand=-
  SCN-specific regions: Sequence locations=1-162,185-443,466-865,887 -915,945-1024
atgagacgaggtacacctattccgactcagccgcctacaagccgcacattggctctcatgactacgtgcatcctcggctttgtcgtcgttttccagcaacccaaataccacgctcggcatcgccaccattcttgacatacccaactggcacatggcaaaattattggtaaataatgatttaaactccggttttcaaccaaaaattcaattttataatatctaatttttgtaacatcaattacgttggaaaatgcattttaaggcgtcgtcctgatcaatggacatggactcaactgttcttttatgcagtgcagttttttgcaatttttgcctacaccgttgttcaatacgcgttagttcgaggtatgtttttggttctgaattaagtccgactcttttttttttgatttcacgatttaatgaatttttctttgattttaaaaattttgtatataagagaatttcttttcacgccgaaccatttttgagacggtgccaacaaaattttatacaaaaaatatcaactccttgcactatgtttcacaacgcatttattaatttggattcaactttaattaacccacaaatggttgtaaaatgggacgataaacggaaaaaaatagtacacctattacattgatttccgtttttaatttcagtttattacgccttccgctatctgaccactcgggctgcttggtatgccatcaaatacaccattctttggccaattttggcaccgtattatgccgcagtcagctactacaataaggcccgatttgtgcgttttatttttttaacggggggggggagacaatctaaggggactatgggtattttgggaatgaatgtgtcatattgtgggaaaattttttcctcataattttgttccttcaaagtttaaaagaaatttcctaaaaatcaaaaaaaaaaaaattttttttcagtgacttgaaaaatctttttttcaaaaataataatgcgacttaaaatttgaagaaaaaaaggctaaaatattattaaa

SEQ ID NO: 71446 - DNA, 54 bp, Heterodera glycines; identical to SEQ ID NO: 53113
  Genomic contig location: Contig_ID=SeqID_43867; Location=107..160; Strand=-
  SCN-specific regions: Sequence locations=1-54

SEQ ID NO: 71447 - DNA, 705 bp, Heterodera glycines
  Genomic contig location: Contig_ID=SeqID_43868; Location=42..746; Strand=-
  SCN-specific regions: Sequence locations=1-525,547-608,630-705
atgtctaaaggaaaggaccgggtcggaaaaattttggtgactaacgtagagacatacggcacccaaacggtagcaatgttagatgggggagcccaaatttcactgattggagcaggatttctgtatgaattgatcaaagaacgaggcttagacctcaagaaatcggacttctctcgaacgtcagcacgaattgccgatgtaaatgggcaacaattgaaatgttttggagtggtaacaattccgatcacacgaaaaggttgcagtcaaataccgatctgctttcacataacatccgcacaatttggctacgacttgcttcttggcaccaattcactttcaaaattaggatttcttctgtacgacacagcgaacaaagaaatgattgaatttgaggaaatatcccaaaatgatagcaattctgctcgggttattttttctacaaaaattcaaccccgctcaacccgcctcatcgaaattggtgttggtgatcagtggaatggaaaagatgtggtcatttctccccaaactgtgaaaggaaatgttaaagtggaagaatcagtgggaaaagttgaaaacggcaaagtggtcgcccaaatcacaaatttgtcggcatttttggcacaaatcgatgaaaaaacggaaattgcgaccgtagagtcagcagaaatcgttttcgacagtgaaaattcgattattcaggcggaa

SEQ ID NO: 71448 - DNA, 59 bp, Heterodera glycines
  Genomic contig location: Contig_ID=SeqID_43869; Location=395..453; Strand=+
  SCN-specific regions: Sequence locations=22-32,54-59
aaaaaaccaaataattttgtattattttcacttgatataaattaatatttgaatttttt

SEQ ID NO: 71449 - DNA, 125 bp, Heterodera glycines
  Genomic contig location: Contig_ID=SeqID_43870; Location=436..560; Strand=+
  SCN-specific regions: Sequence locations=1-51,73-125
atggatctgacacctgaacaagaacgcgagttgtataacgcctactatcgtcccaatgtcccggaggacctcaccgaagcagaactgtcgcatgaaactcatttggaggcgtttaatcgagcaat

SEQ ID NO: 71450 - DNA, 617 bp, Heterodera glycines
  Genomic contig location: Contig_ID=SeqID_9444; Location=460..1076; Strand=-
  SCN-specific regions: Sequence locations=1-117,139-580
atgcaaaaagtcaaaataagagttggccaaattatggacgaagaatatcttatccaattggacgaaatgtttcccgaaattttgcagattggtaaatttcttttccgaagttttttccgctccttccctctttttcagatttgctcctcccttggactcagacggtcctttataagcgtcttttggccaccaaatcgggcactgatcagcatttgcgaattgaatgtcgtttcgctttgcctgtgcttttccaccgactcaaatggctcattgttaaaacgcccaccttaaaagggaaagtgttggcccttttccgggaaaagctgcggaaagtccaacggattgccttccgcggacttcggagggaattggtcggaattcggcagacagaactgatgcgggaagagctgctcaaaagtgtgtgcattttgcaacgattttacgagtttgcatcagccatttcggcacttcccaacggagccaaggaaatgccaactgaggaagaaattcgaaattggaacacaggacgaaattgcatgacggaggagggactgatcagagcttatcaggtggataaaggatttattttataacaaaaataatgtaaaaataataaa

SEQ ID NO: 71451 - DNA, 1696 bp, Heterodera glycines
  Genomic contig location: Contig_ID=SeqID_9445; Location=186..1881; Strand=-
  SCN-specific regions: Sequence locations=1-201,278-293,347-673,696 -719,741-761,803-927,950-1016,1038-1455,1477-1696
atgtcaaaaattgtcagagcaaaaatgatttccttttctttatgctttctttttttgttatttttggcaaatttaaatgacggcggcaaaaataaaaagttaaaacaaaaaccgatgaaaagcgcacaaaaatttgaggaaaaaaaaatattttgggaaagaaacggcgaattttcaatggcaaaacaatggacagaaaaagcaaatgaatgtttaaaaaatgtggacactttggcagaaaaagaagaagaagaagaagaagaaaatggagaaaaaggtaaaaacaaacaaagaaataattaattatttaattatttttaatatttaaaataattaaataataaatcacttgaaaacgaatcgaaatttggcagatgaatgcaacaaattgatggccaattttgttctctttttcaaaaagtcggcttcaaacgatgcggcagcaaaagaaattgttccaacgcttaatgttaattcgatgctttggtttattcgtcgaaaaattattaatttgctaaatttttccaaaattttatttgctaatgacgaaaatgtggttggaattatcgaagaatttgtgcgcgaatggaaaaaaacatttgggaaaaattggagagaaaatgcgcagaaaaagcgggaaatttgcacgcagtacaaattcgggatttatttcatcaaattaatggtttattatgcgaagagttgcgaagcattggccgaatatttgagaaaagaaatttctttagaaatttttcgggtggaaaaataattttaatgaaatttaaaatgaattattatttaaggtcgatgaggccatttttttaaattgcgatataaatggacaaactgagcaaatgtacaacaatttattagaacaaattggccacataaatggacaaaactttatggaacttttggacatttatgaaaattttcgggaatttttcaacggattcgaaaatgaaaaaatgcgaaaaacgaaagaagcgatgaacaaattggtaaagagtgaatatgtgaccaaaattgaggacaaattcccgaacatattcagaattggtgaggattaattaagcttttcaattttattttgctaaatgtttagacataattctcaattcgtcactattcgaacgattgcaaagcttattgacaaacaaaagcttttcaacagcgtaccgaatggaattcagtcgactgacaatggcatttctgatcgatcgatcgtttaattcggatttgttactgatcggcggaggaaaaggcgcccattcgagcgatcgaattacagcgaattggagggaagcgatggccgaagcaattgcagcagcttataccgatttggggtctgaacaaaatctgtgcatgttaatcaaaatgaacgaattcgcccaacttatcagtaaaaaaaggaacgaaaaagggagcgaaaaattgccgtgggatttacggatggatgaattgtgtgaagatggcacggaaagggccaaaataatggataaatttgtcggtgccgaacttggcgaaatatacacggcagcgattgaacgcgtcgtggcctaccgacgcgaacatttcattggcattttgagaatacctggggcaaagacacggcttaagcaattggtggaatctgagcagagaatgaccgaattggcgagcaaaaacggattgggcgaagctttacgagaaatca

SEQ ID NO: 71452 - DNA, 760 bp, Heterodera glycines
  Genomic contig location: Contig_ID=SeqID_43873; Location=181..940; Strand=+
  SCN-specific regions: Sequence locations=1-76,104-238,266-738
atgctgggctttgtttacgcggacgatttgagcgaattgaacggagacaatgcaatggaagtgctttatgccggtgaatttattattttttaaaaatttaattgaaaattgtgttagccaaaaagtataacatcactggcctgatcggcccacctttacaaattcccatctccgaattgcgcaatgttttcttagcctatgcccaggctctcctcttcgaattagatgtgagaaggtcaaaataaatttaattttattatttttagattttctgaagatccaaatatttttttttgtataattttctgtaattaatacatttaaggattttgtcagcgaatgtttgcggtacatttgtcaaaatgcagccaaattgttcaaatcaactgattttttgcaaattgatcaggaaatgttgtgctatttttttgaacgcgatcagttgttgatcagcaatgaatgtgaactttggaaagctgtaattttaattaaattttgcattttattttgtttttcatttttgctttaggcacttcgttgggccgacgaaaaatgccgacaaaatggtgttgaatgctcaccggaaaatcttcgtgccgtcctcggcccggcattgttcaaaatacatttgccaaacttccatgaagcggatttttcaaaatacgttggtaaaaatgtttgaaatcggataattgaaagtttttaagctcggaattaatttccttttaatgtttgaaattaatccaacttttttaaaaaa

SEQ ID NO: 71453 - DNA, 585 bp, Heterodera glycines
  Genomic contig location: Contig_ID=SeqID_43874; Location=456..1040; Strand=+
  SCN-specific regions: Sequence locations=1-101,123-231,253-366,393-585
atgccacgcaaaatgaaaaggatcgtttccctcaattggcttaacgacgcaattgcaaagagacaagtgactgcgccaagtaaagcttgccatttgccgaggtaatcaattttttgtttatacaatttaccattttttttttttgttaatagcatttggagttcaacacgatacaatccaaaaacatttgcaaaagtaagtggatttcactagcatataactgtaagcaaaacaattggtgtggagaagtttccgaaacgtcgtcggctgaaacgtcatcgtgacaaaacgtcgttgtgccgaaaaattcccaaaaagttcgaatactttggttgaaagctctccatatgatttattagggttcgagccccgcccccgcccccgggggcgggacaggttttttgggctcacccccgcccccgtgactctgacccccgcaacccccgcccccgcgaccttcacccccgcgggggcacgggggtgaaaatacacccctaagaatggcatattcgtgggaaataaggcaaaaaatttagacaattttgaatttttttttagctatcttgagaaattttaagaactaaa

SEQ ID NO: 71454 - DNA, 468 bp, Heterodera glycines
  Genomic contig location: Contig_ID=SeqID_43876; Location=151..618; Strand=-
  SCN-specific regions: Sequence locations=1-468
gtttcaaatatcgtaagattgtttgatagggccagacaagagaaggcaactgttggtaccaagtttgcggtaaaaaaatgagaaaaaagagatagctattttttggtcaagaattttttttgtttgcgtttcaaatatcgtaagattgtttgatagggccagacaagagaaggcaactgttggtaccaattttgcggtaaaaaaatgagaaaaaagagataaccatttttggtcaagaattttttttgtttgcgtttcaaatatcgtaagattgtttgatagggccagacaagagaaggcaactgttggtaccaattttgcggtaaaaaaatgagaaaaaagagatagacattttttggtcaagaattttttttgtttgcgtttcaaatatcgtaagattgtttgatagggccagacaagagaaggcaactgttggtaccaagtttgtggtaaaaaaatgagaaaaaa

SEQ ID NO: 71455 - DNA, 637 bp, Heterodera glycines
  misc_feature (596)..(596): n is a, c, g, or t
  Genomic contig location: Contig_ID=SeqID_43880; Location=13..649; Strand=-
  SCN-specific regions: Sequence locations=1-444,466-637
atgggcactaattactccacttcaaattcggctccgtttgattacggaatgacgtcacggaagaaaggcaaaaatcgaagtgcgaaaaaataaaaatgcaaatgaaacagaaagtaatgttttgattttttcagcatacgaatccaatcactttgataagaattatctgatcgaaggcaccgaattttgggcagagaacgaatatcgcaaggacagttatttatttgagaggagaaaaggaagcgatcgggcaaattgtgagtttgaaaagggggaggaagccatcgatcagttcatcagcagaaaaggaaatccgatttaagttgccgaaatttacgtaaaaactccggcggagtacggaagtccgcgcgtctcctgctgggcattttcctgctcaccgtgcgcttcttcaaaagaaagtgccgttgccattccgtcccattccctccctccttcttccgccccgtggtcttcaccaattcaaccgaatggtgccaaaagtgctcatggctcccgcccggtgggcgtccgatcgaaatatttgccaacctttgggtgaatttggccaattattgtgtatcgctttttgtttgtanatttttaacaagttgttaattttaagtaaataacgaataaa

SEQ ID NO: 71456 - DNA, 3292 bp, Heterodera glycines
  Genomic contig location: Contig_ID=SeqID_9447; Location=372..3663; Strand=-
  SCN-specific regions: Sequence locations=1-61,83-206,237-317,340 -360,382-801,832-842,864-1040,1062-1142,1164-1226,1248-1321,1343 -1530,1563-1892,1914-2208,2315-2333,2406-2867,2889-2955,2983 -3106,3132-3179,3201-3292
atggattcttcatttttttattcaaataattcacatatttcaaattcttatccgaaaattgagaagaaaaaacaaaacgaaataggagatacattatttagaaataaacgatctactaactttttaattgaatgcattactggcggaataacactaaacataattaatcccgttgatattattggggtttgtagtcaaggttattgtataacaataaacaaaccaaatttaaaagaaacaattatttttccacaggaaattatcaaaaacaattatgaatttgagattaaattgattttgaataatacaataacagaagtaagtaaatcaaattgtaatgcctctccgatctgtgaaatgataaaatgtaaaatttgtattgaatatttacgagctccacaatgcatagaacactttcactttattataataatctcggtagtattatttaccatctatattctgtcaatttcaatgcaaataattaaattcatttactcaactttaaaatggatttttaaattcgtgtttttctgtaataagaaaaagaatttaaaaccaaaaacaaagtcaaaaagccgtagttatactctgaaatcaagaactgctattttgttactaatgattctaaattttattcacctgacaaaaagctgtgacgaaattaccaatttaattgctaattcaaccaattgccctcgagatgaaaatggaaaaatagaatgtacttttgatcaaaccattttaatatcgataaaacctgaacacaaaacttgtcttaagcttgaagataaaatacgaaatactacttttaaaacaattaaattttcaactgaagaattaattttaacctgtgaaagggagtcagaatattttatgcgtaattatgaaatactgtcagaatcggttaaacgatgtccaaccatgggacagtgtcaaggttcaacttgtgaaaagataaaaagtgattcatcgaatcctgaaatttctgacaaagcaaacaaaaaaccaggatattcgtattgcgtgccctcatgcggtggttggcattgccaatgctttattgcgactgatggatgtttattttatagaacatatatggaagaaaatggtaatgattattttgaagtaaccaaatgcaatcaatggccaatagaactgaacttcaaatatgaaatagaatctgatgacggatcaactgcagattcaacattattaaaaccaggaatactaaataaaaaagacaatatagaaatgactcttactactatgactattccacctacaccaatctttggttcgaaatttataatcaataaagttaataatgatgctattattgttaacaatgaagatttactaagaaatagcattcgatgtcctgatgaaaattccgctaaaacatttagctgtaaatttccacctgaagcatgtaaatgtaatggcggagacacacaagtaaattgcgaatgtacaaaagatcctttacccgaaatgttcgaacaacaaaacgagaaattaccaattgattttaaaggaagtcatttgttttttgagaataatcagataaaggctaaattaaaacagacaacagctttacaattgcaaattactttaaaaggttttaaaactactccattttatgataaaacgaaatgtactgtagaatcaatatccttaagtgggtgctacgcatgtaaaggtgcagactggaaatttaaatgtaaatcagaatttggatctgcattagcccaactagtttgtccaaatcaaaaggttgaaataaattgtgatactgaagacaaagaacagattatccaactaacttataatatagaagaaatcaatgaaaaatgctcgctaatatgtccaggaggtaatagtgaagtagaaataaaaggaaaattattttacgtacaacaacaggaagaacaaaaaacgaatttgaataatactattcaaaatcccgaaactggtataacctttgatgaaataatcaataatattaagaatttcggttctaaaattataaatttcttaaagtcaaatttatggattgcctggttcatactaccattaatagtcattttaatatttgcagtttttctgggtccaatagtatggcctctaatcataagaataatcttccgacggaagaccaaaactaaacctaaatcttcctctgttgggagtgtcggattaaatccgaaaaaatataaaactattaataaaaacaaaactaaattaaaataataagaattttacatgaaaatacaaaatattaataaaaataaatccaaaataaaataaacatttcataaaatttttatttttaaaattaaattaaataaataaatgaatataaaataaaagtaaaataaaataaataaataaaacaaaatgaattcataaaaaacgaagcgaatgcttctcgcaataaaaactaaaaaataatctaataaaacgccccaaataataaataaatttattccacaataaaacggttgaacgtaaaagcaattaaaattgtttatgaaaagttttcctttcttaaataaaagggaagaaaaaactaaaacgataaaaaataatttaaaaatgaaaaaaccataaaatgataatgtggaaattttgaatgctattaaataaccaaaaaattttggtataaaaaggggaagggttttcagtttaggcatgcttcaaccaattcactctgttagcctatcggttctcttcactcaacaagccggacaacaactcgctctgaatacatcacaactcgggcattcgaagcatcgcggatattgatcaattgtgatcagaaatctaccaaattttccactttgtgtcctttgtcgccccatcccaaataaaatattaaattaattgattggatcgaccagtgcatcccatcaattttggtgccaagacccgggaagtgcaaacgacaaagaccaacaacaacaacaacaacaacaacaaaagctgatcactgatctgagaactggaaaaagccggtcatctgtttaaatagaaaattgttgtgcctgttcttcatcaatcaaaagtctgatttagacgtttagttctaatcaagaccaaaatcacaaacaaacaaataaataaacaaaaaattcagtgaaacgaaaggctgagtcaaagcccgatacggagctaaaacacacaaagaaggacgaaaacaaaaccgacgagttcaaaatactctaggtgtattcaaaggcgatcagataacaatttttcaattaatcattgtgatcatactgttaataaa

SEQ ID NO: 71457 - DNA, 1787 bp, Heterodera glycines
  Genomic contig location: Contig_ID=SeqID_9448; Location=349..2135; Strand=-
  SCN-specific regions: Sequence locations=1-526,556-748,770-917,939 -1276,1302-1328,1350-1702,1724-1735,1762-1787
atgattactgaaattgaaagtttagttaattcaagacccttaacttttatttatgatgatattaattcatatcaaattttacggccaatcgattttcttttaccccatcaaaatatttgtattccaccaatattagaagaaaatgaatttggtgatccaacatataaacctaaatttaattcttatgaaaaaactgtagaattatggaagaaaacatcaaaacttctagatgactattggaaattatggacagaagaatatatacccagcttacgagaaagatatcagataaatcacaaaaatccaaaacaatgtgttaaagattttccaaagataaatgatatagtcttaattaaggaagaattaccaagagccttatggaaaactggaataataaaagaattaataattggatcagataatataattcggggagcaaaaattgaatttccaaataaatcaattatgaatcgaccccttaaattaatatacccacttgaactttcgaagaatattgatgaaaatgatgaaataaataaacaaataaataatctaattctaaactcaagagattctatccatactgaaatcaaaaaatgctctttttgtttcagcaatgaccatcttcaaattcattgtacaaaatataaaggttatagaatgagaaaaatgagagcaaaaaatttatcactctgttataaatgtcttaaacctggacaccgtattaaaaattgtaaaaatgaggaaaatttttgtgataaatgtaaaatacataaatctatttgcctaaattaccgagaacattacgatcaaaactcttcaaataatgatgatctaaataacttattatcaaagaaaagaaataacttatctcaaacaattaattcaactccctctacattacttcaaaaattactttttattgcattattattatttgtagtccccatgaatacttattctaattataattgtcctaaagaccttaaaaactatacaacaattttaaccagtttttgtgttgaagaaggaattattgttcgtaaaaatttacaaaataacgaattctgttctgacatgttatcatgtttaaatagacatttaatctataatcatacaccgtactgtggacctaaatgtgaatgttcaaaatgggcacaacaatgttcatttgtaccatatcaatcaattaaaaaatataacaagaaaattgtaaagaaacttattagacaagccggacccagtatatgcgcattcaaacaaaatcctaggtgtatgaacaaaaccaaaggaaaattccacgccattcgtctatatgacaatagcatatattttgtaaaaaatttacatatccgttatgcgcaaattgaatcaaaatacgattacctttgtctaggggagggcaatctaacgattggatctccaggttattgtgaactatttcattgtgataaaaaagggacaaaattttgctatcatgatcaaagagaaagaatttatcttatattaggtaaaattgaaattccaattaaagaatggggtataattgaaacagaatattacacggaagacaaccaaaaaagaaaaaagcataaacaaaaagaatcattggattctttgtttttcaattcgaattatacagagagccatcaaaaagcaaaaaaaaaaaaggattgatggattctttatttttttattcaaataattcacataatatttcaaattcttatccgaaaattaagaagaaaaaacaaaacgaaatagtagatacattatttagaaataaa

SEQ ID NO: 71458 - DNA, 421 bp, Heterodera glycines
  Genomic contig location: Contig_ID=SeqID_43882; Location=222..642; Strand=-
  SCN-specific regions: Sequence locations=1-144,170-421
atgctccgcctcgaagagcaccgccaattgggcgacagcgaagaaatcgccgacggattggcacgcgaacacgcggagtacggcacggaagcattggtcagtcgaagcaaagcgaaccgatgccaaccattaatgatgttaagcatttgtttatttaatgtttattatacttcaggatgacgtcatccgtccgtgccgcaccctccgaaaacgcggcatcgaactcagcgaaaagggcgacgaccttagcgaattgttgaacagcacaaagggaagcgacagtgttggaccaaagtgcgacgaactgaacagaatggcggaagtgttggggggagcggtggagaggaggggccaaatgttggagaaaagccgcaaaatgcacgcgcaaattgccaaagtgagcggagagaagaaactttaa

SEQ ID NO: 71459 - DNA, 664 bp, Heterodera glycines
  Genomic contig location: Contig_ID=SeqID_43887; Location=45..708; Strand=-
  SCN-specific regions: Sequence locations=1-272,294-664
gttttcggggcagtctccccgaaccgatgcgcccagatttatggggagaccgaatccttccggaatagcttccctatagcctgtactttaattctgcgttggatttttgctccccataattgtttgagtaccccaaacggacactcacttgaaaaaatcgatttttttgttttcggggcagtccccccgaaccgatgcgcccagatttatggggagaccgaatccttcgggaatagcttccctatagtctgtactttaattctgcgttggatttttgctccccataaatgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcgggggagtcccccccaaccgatgcgcccagatttatggggagaacgaatacttccggaataacttccctataggctggactttaattctgcggtggatttttgctccccataattgtttgagtaccccaaacggacacttgaaaaaatcgatttttttgttt

SEQ ID NO: 71460 - DNA, 80 bp, Heterodera glycines; identical to SEQ ID NO: 51817
  Genomic contig location: Contig_ID=SeqID_43888; Location=480..559; Strand=+
  SCN-specific regions: Sequence locations=69-80

SEQ ID NO: 71461 - DNA, 80 bp, Heterodera glycines; identical to SEQ ID NO: 51817
  Genomic contig location: Contig_ID=SeqID_43888; Location=1096..1175; Strand=+
  SCN-specific regions: Sequence locations=69-80

SEQ ID NO: 71462 - DNA, 369 bp, Heterodera glycines
  misc_feature (58)..(58): n is a, c, g, or t
  Genomic contig location: Contig_ID=SeqID_43891; Location=429..797; Strand=-
  SCN-specific regions: Sequence locations=1-369
atggtgccgtcgatccgcaagaccgccgacctggtacaggagatcgccgccgcctcgnccgaacagtcgaccgggctggagcagatcaacaatgccgtacaccagatggcgcagaccacccagatgacggcctcggcttcggaagagctgtcggccacctccgaggagatgagcgcccaggccatgcatctgcaggacctgatgcgcttcttccgggtgggcgagatgcacaagtccgcgccacgcagcgtcaaggcaggacccggttccggcggcaccggcaagcaggagcgcatgcgccgcctgtccatgctggacgccgccgaggatgaggcgtcggtggacgaatcgtcgttcaagcgtttctga

SEQ ID NO: 71463 - DNA, 2439 bp, Heterodera glycines
  Genomic contig location: Contig_ID=SeqID_9449; Location=1293..3731; Strand=+
  SCN-specific regions: Sequence locations=1-224,254-257,280-329,351 -567,593-594,648-951,973-1790,1819-1973,2027-2439
atgcacatttttccgtggcttaaccctgagcaagtctcgcggaaattggcactgctttctgcccgatttgatggccttgtggacacacatttcaaatcgcgaaaatgggcatttgtatggatgcttatttattacagcaacaacgtgaaccgtagcggtgtgagcggcgtcgatgtgtatgttcaacacaacagaaaaaggcaaaatttacttatcccttatagaaattttaaaaaaatttgaataaatatttcatagcataaattcagaaattctaaattttaactcttattataaaaatttggaaaaatagttgcttcttaaattatataaaagaaataaaatgctatttaatgtacttttttagaggtttcagaggtttacgaatcgatgaattgacgccgtccaaaaatttaattgattttaaatgcatcgagctccggtaaacagtgttatttttatattgtatagaaatttatttctactttaatcaaatctgttttcgttggtaaaaatgtacagcactctcccacccattcatcttttcagtcaaaaatttcttacgaagtataaacatttctttaaaaattacacattttaattttaattattttcttgaaattttcaaattatttttaataatttttctagaatttttctaaaattggggacattcgcaactttatgaaaatgtcagcacgagaaaaatcgctcaaagtttttgtaaattttattaaatgctaactaaataacggattttgaggcatagcctttttttctgcgcattagtttcgaggtactagtacggtttgtatcccctatttttcaaatttttttaattgtacgaattgctttaaatgacaaataaaagatgatttatgtgtttattgggtacaattcagcgatttgtgaccaaatccggtcccccaaattgcttacgccacaaaaaatccgaaatatatgtggaaaaaagtgatctgtgactgccaaatctttttttgaaaaatagaggatacaaaccgtactaataccagtttcgatataataagcgtgaaaacaccttttccacttggtttgaggcttctacgttgacttttattatgcctttttttgactttttctggattttcgtgccttaaatgcctttttttggcattttgccgttttggatgcctttttggcgtttttttgcgaaaaattccattaaaaatgtaataaaatagtgaaaatacacccctaagaaatgacaattttaaatttttttactttctaccaataatcgtttaagaatatttcgttaaacaatacgcaataaactcctccaaattattttagttactttgacagctctgtgctctcattgcttcatcgctttaagccacttttcctaatgggcatcactttacaactaatgggcaaagggatggaagccccgcggggttgggcactgcgcatccaccaacttcttcctctgatcggcatcaccaacatccacaagttgtatgttagcaccgggtacgtgagaacaaacatccaatcttaccattcatatactcacattttgtaaagtgatttaatattttattcaattttaaataccgaatatggttcaatcagtttaatattttagaatagtttaagaggttcccctacatttgcgcacctgctggacatttgcgcctatgttcaaaatcgggtttaaaacttgaatgttttcagtcccggctgatggcttaaacagcctttaataaaccatagaaagtgattgtatgcgataaattgatcataagaaaatttttgaaaaaaaattaaatatttctaacaagataaccctaatttaatatcagtttcatctgttggaattaggactacggtttttagcttctaaaaaatcacaaaataattactaaaaacaagaaaataagtgccaaaaagtttcagatttagggaactaaaatcgttaaatattgaccaatttttaacattattttttaaaattattttgacattttctttaaaattaaatctaagaaccgatcggtgattttcaatattttcttacaacaattttttccttattttagtggctatagtcgactgtgcggactgcttgtaagcatttcagcaacatttctgatcgattgtcccaatctccgactaatttattatgatgcgattatgactggccctgatcgtccctttgacaccgccaaaaaagtgcaggaatggctccagtggccacggggagatggccgtccaaaagtgttgtttcgttcataccagctaccaattgttgatgagttcaaacaggcgagaagggcacaagcaatcgggcgaaatgcatatgcaaaagcatctaatcactcttaattgactgtgatattagagaaagtgttttaaaacacaaaaagtatgtaacaggacaaaacccagccggga

SEQ ID NO: 71464 - DNA, 407 bp, Heterodera glycines
  Genomic contig location: Contig_ID=SeqID_9449; Location=4479..4885; Strand=+
  SCN-specific regions: Sequence locations=1-407
atgaaatttcttatttccaatttgcaaataatggataggaatgtgagacgaaatttttgatgaatccacagtttttggctcatttaacccccatttttgttcaggactttctgactgcaaccataccggcaaattacatcatctgttttatatcgtttggtattcatccggagaatgttgagcagtttcagctggacaacaaacgcaccaatgaacgattgaaaattgaacgaaaagtgttggatcagcaacagcagcagaagagcaaagtttgcatgacgagggcaccgatcggaagagacgagcgacagtgggcggaatggatgcgaaaagcgtggcaggaggaggaaaagcgaaatttgctcatattttggatatcggaagcgaacatggggccggacatttga

SEQ ID NO: 71465 - DNA, 818 bp, Heterodera glycines
  Genomic contig location: Contig_ID=SeqID_43896; Location=96..913; Strand=+
  SCN-specific regions: Sequence locations=1-194,216-818
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggacaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacaattatggggagcaaaaatccaacgcagaattaaagtacaggctataggaaagctactcccgaaggattcggtctccccataaatctgggcgcatcggttcggggggactgccccgaaaacaaaaaaatcgattttttcaagtgtccgtttggggtactcaaacaattatggggagtaaaaatccaacgcagaattaaagtacaggctatagggaagctattcccgaaggattcggtctccccataaatctgggcgcatcggttcggggggactgccccgaaaacaaaaaaatcgatttttttcagtgtcccgtttggggtactcaaacaattaatggggagcaaaaatccaacgcagaattaaagtacagggctatagggaaagctactcccgaaaagatttcgtctccccataaatctggggcgcatcgggttccggggggactgcccccaaaa

SEQ ID NO: 71466 - DNA, 1383 bp, Heterodera glycines
  Genomic contig location: Contig_ID=SeqID_43898; Location=156..1538; Strand=+
  SCN-specific regions: Sequence locations=1-451,482-914,936-1030,1052 -1135,1158-1383
atgaacgtggtcaaccgccagttgatgatcactgcggagaatcgacagtacaaaaagggacggttggcggagaaaaggaaggatcgcaacgcggcgttcaaatgcacttttggcgaggacattgcgaaggtggcgcaaaaagtggaagggttaaaacggagttatcgacatttgcaccccggacattgtgcctatgtccaaaaacgagtttaaacttaagttttatcagtccctacagcctaattagcatttttgagtgatgaaagtgattgtgtctgataatttgatagttaataagtattggaaaagtcaccgattattcaaaaagcagaattaattcttatacgcgctatcggggattgaaaaattttgtttgaatccgatttttgatataagcgtgatggcaaaatatacaaatagaatctaagagctcccctaatgaaggaaggcaaacaataatttcaaaaataatttgtgtattttaggttttgatcaatccgcgtcaattgctccaactgcttcagcttggcccagccgaatttgaacgggtcgtcgtcggattgtacgttgttcataaggtgcgtttggaacaacacgttgggagcatttgattaatttatggcccattttgcttcaagaggccgtggtcactcgaacggatcgaacgcgtcacgtgggatgccgtgccgacgtacaaagttaacggccactgcgggcctctgaacgttgtgctgtgcttcaaagagttcagctgcatactgctcaaaattgatcagtcaaggccgagctctaaccacctgatcgggcagaataaaacggcggtcggtcagcaaatcgccattatttttattgcatcttttgattcaatgaaaaaatcattcggaaatttattttatttttttactttccgtcggcgctgtccccacagaagacgtacaataacagtacagctttattatcattgcaatttcactttcaaaggttgccaaatttatcgctccatccgccgagcacattaagcgaaaggctcaagaattggaggaagcgctgcgcgagacccaacagatgaagcgcacggctgaagacttagcgggaccgatgcacaacaccaaacgaatcaaagacaacgagcaatatgatgaagaagaggaagacgacgacgaataaggagccaaagcgtgaaatttgatcatttgtttttcccattgaaatccgacaacgaggcggtttagcatttgcagaaggccccatttttgatgatttattgtaattggatagattatctaatttattccctttttgtaattgaaagatgtgtatgcagtatttaaaagcaattctgtacgttacctttttagtttaagatcctaaaagttgatatta

SEQ ID NO: 71467 - DNA, 884 bp, Heterodera glycines
  Genomic contig location: Contig_ID=SeqID_43901; Location=227..1110; Strand=-
  SCN-specific regions: Sequence locations=1-6,36-350,373-505,587 -640,662-884
  Gene Ontology: Mol. function=adenylate cyclase activity; Cellular component=integral to membrane; Biological process=grooming behavior
atgagcaatgacgtcacgctggccaaccacatggaaagctcaggggtgccggggtaagaaacaacaaatgaaatgctgatcgcaattgattagggcttctctgagagatggcatttaaatgtttggagttttggaaaattcaagaatgattaaatgctcgaaaatcgtttcatctctaagaaacccgcaagtggtgaattggtgattatccatgtaagatctaatcgattgcgtgttttgagcaggcgattaattatcgattaattggtgcaaaataaatgaacattttcaaaatagctttggaatacgattaaatagcccagtaataaatcataatcaaatttttaagtcgaattcacattactgacgcgacattgaacgcgttgaacggtacgtaccgtgtggaagtgggcaacgggcaggaacgttcacggcaccttgttgagaagggaatcaagcagacatggctggtcgtctccgaggagggcaaagaggtaaggtgatcaattaaaataatttattttaaaaaataaggtaaaatatatattccaaaataattattctttaattactgaattaattaaaagatttctttcacattaccatattaatagaatctcattattctctctaatatgatcattaattccaaaataaatagattcaaaataaattattaaaagtttagaacaaaattagactcagtttcattttcagaaagcagctgatcaccggaagctgcacagtgtcattaagtaagaaatgacaattacttgttggctgattgatccttcttttattataattaattcccgcttttttatgtaaatctgctaaaaatggctcaaaatcacaataatttttggacaaaattcgttaataaa

SEQ ID NO: 71468 - DNA, 521 bp, Heterodera glycines
  Genomic contig location: Contig_ID=SeqID_9450; Location=121..641; Strand=-
  SCN-specific regions: Sequence locations=1-139,164-334,356-384,431 -486,509-521
atggttgaccaaattaacaaagcgaaaagtgaagaaattgagaaaatgcgtgaacaaatcgggcaattacacaaagaaattgcaatgataaagcaaaacagtgaatgggtaatcatttgaaatttaaaaacacaaataatttatgaaaacttgaaaaaggagagaaacaaggggctagcagtgtttaatttttttaatgacccaaaaataggccgggaatcccggcaaaaccccgactggatgccggtcccatccagtactcatttctacatcaaagcgcatttatgccaccaaagtattttaattggtcagcgcatttgcttatattacgcgccctttgctgtttaaaattttatttaaattgtagccacaaaacataaaaggaaaataattaatttggttaaaaatttttaaaataaaaaaatatttagaaaatgcaggaaattttcacccaatttgggagaattcaaactggaattgatgaattgaagcatcaaaatgagaacgtattaattaaataa

SEQ ID NO: 71469 - DNA, 920 bp, Heterodera glycines
  Genomic contig location: Contig_ID=SeqID_9451; Location=1220..2139; Strand=-
  SCN-specific regions: Sequence locations=1-54,78-111,262-281,451 -488,511-643,738-920
atgaatgggttgaaagaacacattggagaagaagaatatgtgaaactcgagaaagtcttagaagaaaaaaggcaagcggaacagaagccgagcattattgagaaaaagcatgacaaagatggagagaatagtgaagaaggcatgggaaagagaattaaggacaaaagtaaggacaggcacagacacaagcgagagagagaaagagaagagagagatagtaataagagagagacagatagattgatagataagagagacagaatgataagtgatagatatatgagagagagagaaagagagaagagaagataagagagagagatagggtaagagacagaaagcagaaagagatagataagagagagaaagagagagagagagtgatagatagataagagagagattagacagagagagatagagaaagagagcgagaaagagagagagagattgaaagtgagggaggtcggtaggcaccagggatgtgtaccaatttccaaattttttgaaggcgaaggcacacttacttccctgctaacaataagcaccagtgtttcgaatcgaaaaataaaatgcgaaatacgaatactgaaaaaaccgcaaaattttttagtgaaaaattctaaaattttgaatcattctcaaaatttaattaatcaaaaattctaaatcaatttattttcatcgtttttttatcataatttcttaaaatttagaagtttattattatttttttactttgaaagttctcctaaaattccttaattatggtgtgatctgcttacgaattttcaattttttgccgcattatttttcccaaatttttagggtaggagggccggcggtgccgataggcgccgcttaatagattttgtccgtaaaatgagaaaattttgcaattttggcaatttttaaataaa

SEQ ID NO: 71470 - DNA, 1076 bp, Heterodera glycines
  Genomic contig location: Contig_ID=SeqID_9452; Location=491..1566; Strand=-
  SCN-specific regions: Sequence locations=1-19,41-374,413-434,456 -504,526-752,774-1076
atgatatgctccgttttgcatttattttatcactacaaaatgattctccttcttcttcaagaattgataaagcagctaattgtaagcaccatacagatgaaaatgatgaaaagttggaggaacttttgttgatattgaatgacaacaccataaagcgagatgtaaggcaaaaagattaatcggatcttacgaagaaaaaaaaaattcggcggaaagtgggcggggacggtgtacaacccaccccaaaacgtcgacgggacaaaacggcatcgaaaatgcaaaaaaattttcggcaacctagtctaattcttgagaaaactttttttaacaaataggaaaaagtaagatttttgaaatttcatgaaaatgaaatcaattaaaaatagtaaatgtttattttttaaatttaattctgtttaaaagatttcggctatgatgactagggctggcaattttatgtaaatacatattttatccagctggattctccatgctctaaatagtaggaaaaacactttcttttttatgtttgcaaacaaaaatcgggacttttatttacatatttttacatatttcggggttttatacataattatttacatatttcaggattttatacatatttggtacatattttggactttttagcattttttcctaatttttttttgagaatttataaaaattttcttgtgaaaattttaatttaaaatgtacccctaaaaatcggttttttcaaaaaaggagataccaaaaattaatatttaaatatacaaaaatgtgaatctaagattatttaggtaatttctatggtattttgtgcctatttcatcctttacgaaggatttttcccaaaaaaataaccatttaaaaatttttaattacatgtttggtgttttttcatacatatttcgggattttttttttacatatttatgtacatattctgacaactttttttacatgtttttgccagccctaatgatgacatgtgatttcatcaaataatcttttttacgaaaaaaaacattttagtgttccattaacacataaattcgttcggaatattaaataaa

SEQ ID NO: 71471 - DNA, 648 bp, Heterodera glycines
  Genomic contig location: Contig_ID=SeqID_43903; Location=1..648; Strand=+
  SCN-specific regions: Sequence locations=1-523,545-648
attttttcaagtgtcgttttggggtactcaacaaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgagaacaaaaaaatcgattttttcaagtgtccgtttggggtactcaaacatttatggggagcaaaactccaacgcagaattaaagtacagactatagggaagctattcccgaaggattcggtctccccataaatctgggcgcatcggttcagggggactgccccgaaaac

SEQ ID NO: 71472 - DNA, 311 bp, Heterodera glycines
  Genomic contig location: Contig_ID=SeqID_43909; Location=333..643; Strand=+
  SCN-specific regions: Sequence locations=1-46,222-226,248-273,295-311
atgggaaatgatggacaaaaaggaggggaaggacctgaatatggtggaaaatggaagaaagaaaagacgaaaagcaaaggaaagggaagaaaatcggaaaaaggaagagaaatttgggggaaagagaggcgaagagagaaaaagcgcattttgggggcaattggaaaatgggaaaaaggaaaagggaaaagagaggaaaagccaaaggaaaatgggaagaagcgattgttgggcttatgcttgttcacttttattgtttaatcagcttaaaccattgaattgaagaaaatatttgagggaaaacaaaacaa

SEQ ID NO: 71473 - DNA, 581 bp, Heterodera glycines
  Genomic contig location: Contig_ID=SeqID_43910; Location=143..723; Strand=-
  SCN-specific regions: Sequence locations=1-166,195-326,359-374,396 -411,434-581
atgcgcgaacaaattgagaagcggagcggatttgtgaccaaatggttcaacaaatggccaaatgtggccgaaattgaggactttgagcgtggtcttagagagaaaaagcgcaatttggccaaatggtcgacgcatttggaagtaaaagaaaaaaggaaaagcaaagaaaaaaaacaattaaatatttattttaaggaggttttggagaaggcggaaggaaaagtgacaacgaaagagcatttgaaggaagtgttttacgacgcggtgaaagtgaaacgaattacgaaggcgacggatgccaaagatttcataagcatttgtaaatcaattaattaattaataattattattattatatctgttctcattatgtatttgtcttttttctgcttattccaagcaattaattaatttttccattttcaggcgatttagcggtcgacgagcgaatggtaaagcgcaaattgagaaacaccgatttgacgaagaaatcggaaagtgccacactcagctgggcaagttgggccacaaaacaggcatgcaaagtgcaaattgggaagaaaagtggcaaaatgaaagag

SEQ ID NO: 71474 - DNA, 577 bp, Heterodera glycines
  Genomic contig location: Contig_ID=SeqID_9453; Location=235..811; Strand=+
  SCN-specific regions: Sequence locations=1-352,374-577
atgacccttgctaattgtcgtattccccaactttgctttattctgctctttgcccttctgctgctgatcaatttggcgcaaagtgaccaacaattgagcaaaggcattcttttaattacctttaatcatttcatttattactttgccatttttggcgaacaatcgccgatggacgccgaattagacacaaataatgagcatgagcaacattacggggacggagtgttcgtcgacgcggtgccaatgtgtggcggtggtgccaacatgccgaaaagggcattcgtcgagggacaaaagatcaacggggtaaaagcggcagataaagtgccaaaagagtaggaatgaattacttttcactaattttcagaaaaaagggcccatttccgacggcactttccgccctttcagtgtcgccatttggtcgcctcagtttttgccgcgacggaaatgaaactttttagggatgaaaatggacgaggaaataaggaaacgaacgaacggcgacagatctttcagcacatttttgtctgtccataaaacgcttaaaaattgggtggaaattgccatttgatttcaa

SEQ ID NO: 71475 - DNA, 158 bp, Heterodera glycines
  Genomic contig location: Contig_ID=SeqID_9454; Location=1532..1689; Strand=+
  SCN-specific regions: Sequence locations=1-158
atgtgctcattttgccccattcattgtgccgtggcacttcgtcccggtgggctggcaccgatggactctgaccccgacgcctcaaagattcatccgatgagcggggtcagcagcagctcaacgccaaacaccgcacaaacgatttggggaggaatacg

SEQ ID NO: 71476 - DNA, 796 bp, Heterodera glycines
  Genomic contig location: Contig_ID=SeqID_43913; Location=517..1312; Strand=+
  SCN-specific regions: Sequence locations=1-142,173-392,425-588,610 -695,719-796
  Gene Ontology: Cellular component=Arp2/3 protein complex; Biological process=actin cytoskeleton organization and biogenesis
agctgcattgggttatcgtaacttttcgcttttcagattgtgatcggaatatgcgcaatgcaacggaaggccaacagcaagccgatgcgttcgatcatgcttaaaatgaacgagttctacaaggtatttaccggcttacaatgaatgcccttcatctctatttaaatattttccaatattttataaaatgttttacccttttaggacttcctcgattttgtaatttttcccgaggaaaccattctcaatgaatcggtggagaattggcccctctgcgactgtctcatctcttttcattccaccgatttccctctcaaaaaggcaattgaatatgaaaaagcgagaagaccttacgtgttgaatgacttacaccgccaatttgatttggtaagttattattattttaatttagtaaaagtgaaaaatactgacgggattgaaaatgtatatctctaatgaaagaatctgaaagaatttttttggcggcagccactccctgaagagttacagacccgggactgaagtggcaaaatagctttgggactgaaccgtccaatgtctaaaaacacatgaatcttcaacaaaacatacagaaatagatttatttttgtctctaatgtaagaatatgtgaaaattttgacaaaatgtaaacaaggaatccctttttgggcaatctttcggttcattggtcccgatttttttttttttaataaaattctggaaacccattctaagtctaatttgagccgctgagtacgaatctgaccaccttttcgaccaatttcgaatcccgaa

SEQ ID NO: 71477 - DNA, 423 bp, Heterodera glycines; identical to SEQ ID NO: 65209
  Genomic contig location: Contig_ID=SeqID_43915; Location=105..527; Strand=-
  SCN-specific regions: Sequence locations=1-2,30-32,155-206,236 -236,320-325,358-423

SEQ ID NO: 71478 - DNA, 990 bp, Heterodera glycines
  Genomic contig location: Contig_ID=SeqID_43915; Location=1..990; Strand=+
  SCN-specific regions: Sequence locations=1-170,203-208,292-292,322 -373,496-498,526-533,609-680,748-882,918-990
cgtcggtgggctggcgagtttactttgaacaaatcagagtgcttcaacaggcgtttcgcttgaatgttcgtgcatggaataatagaagaggatttcggtccgattttattggttttgctgaccgagataatggttaacagagacaaacggggccattcgtattgctacgtgagaggtgaaattcttggaccgtagcaagacggactacagcgaaagcatttggcaagaatgtcttcattaatcaagaacgaaagtcagaggttcgaaggcgatcagataccgccctagttctgaccgtaaacgatgccaactagcgatccgccggcggatttattcgccctggtggggagcttcccggaaacgaaagtcttccggttccgggggaagtatggttgcaaagctgaaacttaaaggaattgacggaagggcaccaccaggagtggagcctgcggcttaatttgactcaacacggggaaactcacccggcccggacaccgtaaggattgacagattgatagctttttcatgattcggtggatggtggtgcatggccgttcttagttcgtggagcgatttgtctggtttattccgataacgagcgagactctagcctactaaatagttggctcattgcttctgtgggcacaacttcttagagggattttcggtgttcagccgcacgaaattgagcaataacaggtctgtgatgcccttagatgtccggggctgcacgcgcgctacactggcaaaatcagcgtgcttgtccttcccgaaaaggggttggtaaaccggtgaaatttgccgtgattgggatcggacattgcaattattgtccgtgaacgaggaattccttgtaggggcgagtcatcaactcgctctgaatacgtccctgccctttgtacacaccgcccgtcgctgccccgggactgagccatttcgagaaattcggggacggttagtgtttcggtttcggtcggtatgcagactgga

SEQ ID NO: 71479 - DNA, 601 bp, Heterodera glycines
  Genomic contig location: Contig_ID=SeqID_43917; Location=528..1128; Strand=-
  SCN-specific regions: Sequence locations=146-146,194-208,236-274,300 -329,355-368,393-411,434-601
agaatcgggccgagtccgcagagacgccgccaaaacgcaatcggcggggcaaacgcttcggggaattgcggaatggtcgggcgaagcggcgattgaacgagacgaagttaaaatatggcccaaattagtgccggtcacaagcaaaagcgaaccgagtccaattctttggccgcccgtgccaacgacaaaacggccacagacagtgccaaaggaagaaggaaagaaacgcatctcaggaggaaacgacgacgaacttcaaacgaacggagagagtagaaaggagaagaaaaaggaagaagtgtttcgggatttaccctcgggggtcgaagtagtctcttctttggtggaaaaagcggtcgaaaatggacagaaaagtcgaaacaaaacacagagacagaaaatcatggaaacattgggaaaggtgggaacggaaaatggaaggactgatcactcacacatttaccaccttccgatcaccttaaggcaacgaacagaggacgagttgggccaaaaaagcaaaatcgaccagcacaacaaatgccgcgaattttggatcgcgattcgcccgagccgacaaattcgggacgaacggctccaatga

SEQ ID NO: 71480 - DNA, 533 bp, Heterodera glycines
  Genomic contig location: Contig_ID=SeqID_43919; Location=501..1033; Strand=-
  SCN-specific regions: Sequence locations=1-533
gcttaaaagcattgtactgcataattaaaagctaaaataattttcgtatatttttcacaatttatttcaaacagccaaaaagtccggaatcaattataaaaactaaaatagtgcacaaaaggggagccgccgcacggcggggcttaaaagcattgtacagcataattaaaaccgaaaataattttcgtatatttttcacaatttatttcaaaagacaaaaaaaaaatgattcaattttgaaacgaaatagtgcacaaaagggagggatggttagacgaaaagaggaatttttagaaaagagcgcaccccatctgatattcccatttttccgttccacaactggccaaaggcgactgtgctcattgacacgtagttgtccaataaggtacttggactttccacagtaaaatgtggtacaaaattttggaactgtcccgcctcacggcggggcttaaaagtattgtacagcataattaaaaccgaaaataattttcgtatatttttcacaatttatttcaaaagacaaaaaaaaa

SEQ ID NO: 71481 - DNA, 518 bp, Heterodera glycines
  Genomic contig location: Contig_ID=SeqID_43920; Location=771..1288; Strand=-
  SCN-specific regions: Sequence locations=1-167,190-391,413-433,455-518
atgatgtcaaagattggacggattttcactggcgtattggcactgtcatccgtggcaccgggcgcggcaaacgcttcccaaaagggtggagaagttcaagcagttaaaaaacaacaatgtgcaccaccacctcaaatgccgggccgagatttggtaagattagcaagatgcattagttattctttaaaagattggtcaattaacgggaagaagttaaacaagaaaactattcttatcattaattttgtttttcaacagcatgaagttccatccgggcctaatcccacacagaacaaaaaagttaacttctgaggaaaaaagaatatgctttcttcgtttattcatgcttttccttctttttctgataacttttagtaatttattctttgggcatatttatcaatttattttaatcattttccactaaatatttatttcttttagtaaaattatattgttgcatgaaaatttgataaaaagaaatcattgaattgtttaatataggggaaacaaataaa

SEQ ID NO: 71482 - DNA, 434 bp, Heterodera glycines
  Genomic contig location: Contig_ID=SeqID_43921; Location=89..522; Strand=-
  SCN-specific regions: Sequence locations=1-298,320-434
atgggtgatggaattgttggacaagttcaggctggacaactgagtgaggttgacaaacgatttgggaaaactgaacaaagaaaattcactttaaaaaacggcgaaaattttggaaaaaacggaggcctacccggtcacaatgtttgtgcttatgtccaaataggccaaattgtggcagagaccgatttcttcagccacttcgacaatttctggggaaaaaaggattgggataaattagtggatggatttttgaaaaaattgaaaaactggaatcatgccaagtcgtgacgatttgaaaaaagatttggcccaaaattattcaatttttaacggatattttatttgattttacgatataagaaaattcactaatttacccattatacataaacctaaaaaaacatgttggctatgacattttagaatgtaataaa

SEQ ID NO: 71483 - DNA, 2169 bp, Heterodera glycines
  Genomic contig location: Contig_ID=SeqID_1282; Location=4472..6640; Strand=-
  SCN-specific regions: Sequence locations=1-450,486-636,658-873,897 -1595,1617-1720,1748-1836,1858-2169
atggatactgacgtaaatgaaattgctgaatttaaatcaaataatttgcttcattatctcccacataatccggtaataaaagagagctcaaatacaactaaaatacgaccagtttttgatgcgtccgcaaaacttaaaggaaataattcactaaatgatgaaattcaccaaggaccaaaattactaccagatttgtgtggattgattctccgatttagactcaaaaattacgtattaattggtgacttggaaaaagcatttttacgagttggattaaatgaattagacagagacacaacacgatttttatgggtaaacaaatcgtacttgaatgaaataagacaaaattatcgagaaattgaaatgagagacatcgaattgagacgattcacacggataccatttggagttaacgcttcaccatttttattaactgctgtagttaatctccacttgtcaaaaataaatgaaatgtttgaaaaattcaagacaattcaagttaacaaggaattatgtctaaatgataaagaagaagaatttaaaaatctttgcgtagaacttaaacaaaatgcatatgttgataatttcgtaatgatgtgcgatgatgaaaaggaaatacaattcaaacattattggagtaaagaaatatttaaactagcatcaatgaatctgagagagtttgtctctaatcatgaacaaagtaataaagaaattcaaaaattggaaggatcagagataccaaaagtaacaaaaatgttgggtataaaatggaatgtcgattcagatgaacttgaactccaaataaaaattccactaatgagtaaagacacaacaaaaagacaaattttgacgatgattgccaaaaatttcgatcccatgggatggatttcaccagtaatactgaaatataaactatttttccaaaaactatggcgattaaacaaagattgggacgataaattagatgatcaagaaattattgaatggaataatatttcaaacacagatatgataaccataccacgttcgcctttcacaagtcaatatttaaatcattcaatattacacattttttctgacgcttccgagttggcttatgccacttcagcttatttacatacaaacgaccaagtgaatctactattcgcaaaaacaaggcttactccattgaaaggcctaacaattcccaaactcgaattattggggttattgatagccgcaagagccgccaagtttataaaaacggaatccaaattgaaccttgaaaatacctatatttggtcggactcaaaatgtgtactcagttggttaaaatgtaaaaagaatttaccaatttttataaaaaatagagttgaggagataaaacaaattgccttggaattacatatcacttttcattatgtaaaatcagcagataatccggctgatttggcttcacgaggagcaaccatgagtgaattaaaatacaacaaattatggtggaatggaccaaaatggcttaaactggaagaggaaaattggccacctcacagcttttacagtcctgatcaagaagaggctccatatttagataatacagaggaaataattaacactcaaataaatttaataaaaaacgaatataacggaattatcgaatgggataaattcagttcatggcttaaaataactcgcatttgtcaaactttattaaaattcatatttttcaaattacagaactctaaaaaatttaaagaaaaatttatttactctaaattcgaaaatgcattacaattaaaaatcatggcacaaaaaatgctaattcgaattattcagagggaaatggaaccaaataaagaagaagaaagacagttaagaatttatctcgataatgatatgatactcaaatgtgaaggccgattaaaaaatgcacaaattcaaggtgtcaatccaatttttctaccaagaaaacactatggaactcatttgataatcatggattatcacacacgaaatttacacgcaggtacaatgacaacattatcggaaataagaaaaacttattggataccgaaaggaagaagaattgttgatcaaatacggagacaatgctaccattgtaggagatataatgctaaaccttttcaacaaccacaaatgcctccattacccaaatcacgagtgaaataa

SEQ ID NO: 71484 - DNA, 452 bp, Heterodera glycines
  Genomic contig location: Contig_ID=SeqID_1282; Location=6830..7281; Strand=+
  SCN-specific regions: Sequence locations=1-150,172-452
atggccgcatcttcattccgtcataggtggtgagtcgataattccaatgttttctaattcccaaaatttctgaagtatttggttcgtttcgtctttttttcttttttcggtcactgagttacaattggtgtcctcaatagttccttttccagataatatttttcctaattttgtatttattgagtaaaatcctgatggaagtaattgaatttgtgaatttggtagcatgaagtgccagtaatagtcgattccaattaaaatttgaggacgtgaattaatcagtaggatgctgacacaaccctgtatttgattttttggtccaggagttattcattcacttcaacttcagctttttgtcgagtctccaatgcagatggactgggggatgctaccttagattaattaatttgtggggaatataaattaaacaaatgtataatattatgctttaa

SEQ ID NO: 71485 - DNA, 931 bp, Heterodera glycines
  Genomic contig location: Contig_ID=SeqID_1283; Location=1211..2141; Strand=+
  SCN-specific regions: Sequence locations=1-150,175-472,494-621,669 -772,803-931
atgagccaaaaccgtgacgaaaactcgcagccacctgtactcgatggaccgtacccgctggcacaagagcgcaatgagtttgtggaagatgaagcaccggtgctgcttgagatgttggatcgtctgtcacaaggagtgggttttgttttgaattatttaaattttttaatttttccattttggcttatgctaattgttgattttgtttagggaatttgccaagccatgggcctgttttcgtttgcacttgccgactgtttggccacatttcatacatttgccatactgttcgactgtgagacacctgtgccatttgacgagcagcacaagcgatacgtgttcgaacacagggacaaaccgcggctaatctacgtttcggaagatggtagcgctatacaggttgacggtgtggtgaagcaaggggaatttgtgatgagcatcgagacgatgtatctcgataagcgaaacggagttgatcacttttgcacattcctgcgcacttttggcatttgtttcttgatgtgccattgaatgtgtttatttgttgcctattcagagcagtaaattgtttgcataattctgtttaattattttttgtttacaaccaaaatattgatccgcatttttatgttataattttaattcatttttgaaatttttatttaaatggcaaacgaagacttccgcttgtccgaatgcatccgttttattgagcgaactgcccaagagtatgattgtgttctgccggttccacggcttgggtttgtcacggaaaattttcttaataatttttttaaaaatagctcaaggcgcgatgagcacctggatgcctgtgttcttatggaatcagtgggctcaggccatcggctctacattttcgagtttgaggattgcctccaggtatttttaaaatatgaggtcaattaattaa

SEQ ID NO: 71486 - DNA, 2323 bp, Heterodera glycines
  Genomic contig location: Contig_ID=SeqID_9456; Location=50..2372; Strand=-
  SCN-specific regions: Sequence locations=1-151,173-692,740-758,781 -904,946-976,1012-1150,1173-1219,1242-1263,1326-1662,1694-2323
atggaagggaagggacctaaagggaaggggatttatccctttcaagagatatccatgaaacggataaaggcgggtattgcaaaaaagtgcaaaaattcccttgggagggggggttgctgtaaccccccgaaaactcccggagagccgggattgaggctggtcagctgacctgcgagagaaccatgctcctccctcgcacccccagagtcggttattaggccgaacactggtaactgtttgctacttgcccatcgggctttcgacaggaggctactccgccaagggggctcgaacttaccctcggtccatgccaggcaggtgggttcaccacttcgccaccaggcaggtgaaatgactattacatttctgacccaagtgatttcactttaatcttctctcaatttaacttgatatttccaaattgtgtttaaaagcggaaattatcgcatcgatttttttgcataatgttccttttttcacttatttttattctcaatcgagccaatttttttaatactttatttcctttcaaatttagaattttgcctgccattgtttattttacattgacgaaaatgccgacactttgatcgaatcggagggatttttgcaaattgaccaaaaaatgttgtgcgaaattttggaacgcgacgaattgcaaatccgtgaagaaatttcaatgtggaatgcagtaaatttttttaaatttaaaaatgttataaatttatttttaaaataagtccgaatctttttcggactattttataaaattattatattcaccagcctttccatatttacagttttcaactcgtcctcaaattggaactgttttggcccgtttcgaagcgctggtggacaaacattttgatgacatgacgaatttttttataatttcggcaagtttttttttgtttttttctgttcttttttttttttgtttttgggttatggtcccaaaagccttaacagccccaaattttcaaaattcaaaataaaataaaaatttttggaaattcaagaaaatttatttgtaaaagtgaatagtttttatgtgtttttttgaaggattttatgcataaaatatttaatggcctccaagtaggcaagttttttttgttttttttgtgtgtaaaaatgagaatgtttcaattttttaaattatttttttaggatttttttccaaaaaaacgaacttcacttttcagaatatcaaagtggtggacattctcccctttttgaccgtccatctcttaagagaacattttttcttaaaattaaaaaatcttttttttggaaattttacatttttaatttaattttttggccctttttattcattaaaaaatctttttttttggaaattttacatttttaatttagttttttggccctttttattcaattaagcctaaaaatgcattttctatgaacaaatttacatatttaactaacattttttcaaagtttcagctgggtttgcatggtgtttggatggacattctccccttttgaccgtcctcaactcggcctcaaattggcattgctttcgccccgtttcaatgctccagtggacaaacatttcaacggctgaaggcgtaagtttcagtttcaaattggctatgaaaatttttctaatctctacttttgtttggattcggcatttaaaaaatttaatttgaaaattttttttgagaaattttttcgatttatgacctcagaatccctgtgtgctttgtacctcttctaatcactgttgtacctcttctgatcactgttgtagctttttttccccattttttaaataactagagcgcaaaaaaccttttttttcagcgacgaatatcgattatattttattattcatttctcagtataaattttgttattgattcccccctcccttttgttaaataattaaaaacaccaaactaccaatgcttattaagtttttcctttgtatagaattttaatctatatttcaaacattttagataattctctctttactttttgttttttttcagctggttttttgcaacactttggatgggcatttctgaccatcttcaactcggcctcaaattggcattgctttcgccccgttttaatgctctggcggacaaacattttaatggcaaagcggattgctggcaagtttcaatttttctcaaagtaaccggtcaaatgttcaataagctttaaaattgtgattgcattcggcagttcaaaaattgaaaaaaggaaattgacgaaaatgccgacactttgatcgaatcggagggattgaagaatgaaaaaccgtctttaagttataaataaa

SEQ ID NO: 71487 - DNA, 712 bp, Heterodera glycines
  Genomic contig location: Contig_ID=SeqID_9457; Location=15..726; Strand=+
  SCN-specific regions: Sequence locations=1-712
aaaaaattccaagccaaggccaagccactatagcagtatagtgccaaaaattaattgaaaatattaatttgtattccggttattcttccgtcaaaaatgacgccaccttagccattaggcctagaaaaaagagctctttcgaatggtaccttcaaatcaaaaaacgactgtcagggagctgagctacagaaaaaaattccaagccaaggccaagccactatagcagtatagtgccaaaaattaattgaaaatattaatttgtattccggttattcttccgtcaaaaatgacgccaccttagccattaggcctagaaaaaagagctctttcgaatggtaccttcaaatcaagtgccaaaaagaagctgagatacagaaaaaaattccaagccaaggccaagccactatagcagtatagtgccaaaaattaattgaaaatattaatttgtattccggttattcttccgtcaaaaatgacgccaccttagccattaggcctagaaaaaagagctctttcgaatggtaccttcaaatcaaaaaacgactgtcagggagctgagctacagaaaaaaattccaagccaaggccaagccactatagcagtatagtgccaaaaattaattgaaaatattaatttgtattccggttattcttccgtcaaaaatgacgccaccttagccattaggcctagaaaaaagagctctttcgaatgg

SEQ ID NO: 71488 - DNA, 66 bp, Heterodera glycines; identical to SEQ ID NO: 53774
  Genomic contig location: Contig_ID=SeqID_9457; Location=1195..1260; Strand=-
  SCN-specific regions: Sequence locations=1-66

SEQ ID NO: 71489 - DNA, 77 bp, Heterodera glycines
  Genomic contig location: Contig_ID=SeqID_43922; Location=374..450; Strand=+
  SCN-specific regions: Sequence locations=1-77
atgattcttgaatacgctgacccacaaaatgtccaagtctcgaaattgagtttttttattattcggatgggcctaag

SEQ ID NO: 71490 - DNA, 127 bp, Heterodera glycines
  Genomic contig location: Contig_ID=SeqID_43922; Location=285..411; Strand=-
  SCN-specific regions: Sequence locations=1-127
acttggacattttgtgggtcagcgtattcaagaatcatttttgagagtttttgccaaccaaactggacaatcttggtatcattcgaaagctgctgatgaggagaatctttttctaagcaaatgctaa

SEQ ID NO: 71491 - DNA, 515 bp, Heterodera glycines
  misc_feature (502)..(502): n is a, c, g, or t
  Genomic contig location: Contig_ID=SeqID_43923; Location=73..587; Strand=-
  SCN-specific regions: Sequence locations=1-74,111-228,250-366,388-515
atggcacaaattttgtccaaattggcgttgcaagtggcggattatgtaacagtttatttggcacaagtaaaaacaaaaaaattatcaaaaatttcatttaaataaaaaatgttttttgaaaggcattttgaacatttattctcctctcgacggttgttggattgagaaaattgctgatgtccaatgcggcatttaattgattaaatttttctgttggcaatgtttgattttaatattttttgaatttcatgcatttacacatgaaaaaaaaaaatcaaaaacggatataatttcacaaagtttaacctgttaatttcgtagttgtcatgtcattactttagcttttcctaaaaaatgttttcggatgagcatagaaaataatgacaaattttacacgaccatctgaagcaaccttgtcagataaattaaatgttttgataattttcagttaaaaacttgctttcgtaaaaataagaaataaaaactgaattcttccaactanaaaaaacaataaa

SEQ ID NO: 71492 - DNA, 399 bp, Heterodera glycines
  Genomic contig location: Contig_ID=SeqID_43923; Location=676..1074; Strand=-
  SCN-specific regions: Sequence locations=1-146,231-399
atggataaagaagtcgaactttcatcaacaatttttccaatttgcattcattgcggggcccgtgaaaaatttgaagaaggaaaagcatatattgctggatggggatatttaaagagtaagcttagtcaattaattaattagcaagcttaaatattattaaaaaaaaatccaaaattgaatcatatttattaatatttgaataaattaaatttaaaataaaattaataaatgagtaagttatttagatagttgtactcaaaagtcccaaaaaagtccattaacgctaatgggtcgcagtgctcaattagtgaaatgcaagaaatcattctttaatgatggacaggaacgaatttgcattgagaagaataccattgagcaagttggcaaattttaattaaa

SEQ ID NO: 71493 - DNA, 49 bp, Heterodera glycines; identical to SEQ ID NO: 60106
  Genomic contig location: Contig_ID=SeqID_43925; Location=56..104; Strand=+
  SCN-specific regions: Sequence locations=1-49

SEQ ID NO: 71494 - DNA, 296 bp, Heterodera glycines
  Genomic contig location: Contig_ID=SeqID_43925; Location=667..962; Strand=+
  SCN-specific regions: Sequence locations=1-126,155-296
caaaagttttttacaaccacatattgccaatctaatttcttgcagatttaaagccatccattgcctgccggttctcggcacagcaaagcactaatagggtgtttgactcacttcaaaaaataattcattacccaaaagttttttacaaccacttattgccaatctaatttcttgcagatttaaagctatccattgcctgccggttctcggcacagcaaagcactaatagggtgtttagctacttcaaaaataattccatacccaaaagtttttttactaccacatattgccaatct

SEQ ID NO: 71495 - DNA, 243 bp, Heterodera glycines
  Genomic contig location: Contig_ID=SeqID_43926; Location=696..938; Strand=+
  SCN-specific regions: Sequence locations=1-45,71-150,180-243
atggctcaaatgtccgcccatggacaaatggccaaacttttgtctaacaattttttaaaatttgatttggccatttgccactgtgccgaacagcttcgacttgccaacaaagtagggtagcgagcactaaaccattccgaagcctatctctaaatttaaaattttttttgaaattttttcagttttccgtcaacccaaaaaatgtcaatcccatccgcttggagttggccaatctgcatttga

SEQ ID NO: 71496 - DNA, 835 bp, Heterodera glycines
  Genomic contig location: Contig_ID=SeqID_43929; Location=19..853; Strand=-
  SCN-specific regions: Sequence locations=1-289,311-595,617-646,668 -755,777-835
  Gene Ontology: Mol. function=structural constituent of muscle; Cellular component=striated muscle thick filament; Biological process=striated muscle contraction
atgctacacagacaatttgaaccgtgccaacatcgaggcacagaagaccatcaagaagcagagcgagcagctcaaggtgttgcaggccagcctggaggacacgcagcgccagttgcagcaaacgctggaccaggtcagcttgagtgcgagcgtgtgactcattgtatttgtttttgtcacctgcagtacgcgcttgcccaacgcaaagtgtccgcactggcggcagagctggaggagtgcaagactgcgctggacaatgcggtgcgcgcacgcaagcaggccgagttggacctggaagaggcgcacggacggtaagtaaaatttgtacacgcctcgtgcattgagtgcaagttgatcattgcgctacaacaattgcagcatcaacgacctgcaatccatcaacaacaacctgactgcaatcaagaacaagctggagaccgagctgtctactgcacaagcggacttggacgaggcaaccaaggaactgcacgcagcggacgaacggtaagtgtggtcgttattcgagttacgcgttatatctttgtacagtgccaaccgtgcgttggcggacgcagcgcgtgctgtggagcaactgcacgaggagcaggaacactcgatgaagattgacgctctgcgcaagtcgcttgaggagcaggtgaagcagctgcaggtgcaaatccaagaggcggaggccgctgcactgttgggcggcaagcgcgtgattgccaagctggagacgcgcattcgcgacctggagaccgcacttgacgaggagacgcgccgccacaaggagacgcagaacgcgctgcgcaagaaggaccgtcgcatcaagtaa

SEQ ID NO: 71497 - DNA, 57 bp, Heterodera glycines
  Genomic contig location: Contig_ID=SeqID_9459; Location=704..760; Strand=-
  SCN-specific regions: Sequence locations=1-57
atggaaggcacaaccaccaggccaccgacgctcacattggctttacattctttgaaa

SEQ ID NO: 71498 - DNA, 545 bp, Heterodera glycines
  Genomic contig location: Contig_ID=SeqID_9459; Location=1032..1576; Strand=+
  SCN-specific regions: Sequence locations=1-545
atgccaataaatccaacaaacgttattcttttattgcaagaacattatcatggtaaagccccccctcccacccaattaacaccagaggaaaagcaactggcaaaggattttttgaacacattggaattttgtgcaaaacaagggtcagaaattgagactttggaagaccttattgtggatgaattggccgtttttgatcaaaaagatcagcaagattctgacgagcagtttgaccttgaagatgatgaaagtgaagatagtgaagggagtttttcctctccagcaagtacagtattccttttttccttggatcagtttttgcattagaatcatcttcatcgagttatgctccctccccaaagaaattgtgttccccgcatgttggatttgccgaaaaaatcagtgccctacgacatttttttcctgatcactgtcaaatcactttttgttcggaatttataatgattagatgtgcatggtgtgacaaattcctttgcttcactcatttctaccaaaattatcacatgtgccaaaattaatgtcga

SEQ ID NO: 71499 - DNA, 456 bp, Heterodera glycines
  Genomic contig location: Contig_ID=SeqID_9459; Location=1606..2061; Strand=-
  SCN-specific regions: Sequence locations=1-215,240-267,290-349,371-456
atgttactgatgaacacaaacaaactgtgccgtcaacagcatcggatagcttatctcattcaactaatgaagcgaactattgcaaaaaacggtgagttttgccagtgaatatgtcggatgccctttggcattcgttgcttacaaaggagaggtacccaagtgaccatgggacttccgaatgaaactttcagggtaggtagattaccccccctttgtattataaatttttttttatttttgctaaatgaagcttctggccgagatatgaagcttttcctttttgccttttcaatatcattttcaaagaatgtaaagccaatgtgagcgtcggtggcctggtggttgtgccttccatacttttttcttcttctaaagttcaattccccaaccctgtaaataattattttgttttttttcatatccaaattagtttttaagctttttaatattaataaa

SEQ ID NO: 71500 - DNA, 435 bp, Heterodera glycines
  Genomic contig location: Contig_ID=SeqID_43934; Location=440..874; Strand=-
  SCN-specific regions: Sequence locations=1-22,44-55,82-163,209 -209,235-390,416-435
ggttcgataaaacttttaaaatatacgcctaaactttttggcctgtttaaaaaggaattaaaaatttttaaaatttttattcatctcccttttgatagaaaaagcatcagagagccttatttaacttttaattaacatttggtgcgtttcagagcacgttctgaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcttatttaaaaagcaattaaaatttttaaaaattttattcatctcccttttgatagaaa

SEQ ID NO: 71501 - DNA, 1147 bp, Heterodera glycines
  Genomic contig location: Contig_ID=SeqID_9460; Location=802..1948; Strand=+
  SCN-specific regions: Sequence locations=1-234,310-310,332-463,485 -1147
atgatgcgcaacggcacagtgacaattcccaggccggacacagccccaaaatgtgttggcaaagaatgcaaagcagcgaaaaaggagcgcaaagacaaaccgacaaaagtgcggaaggacaccgtagtggtaccgtacggaggatacaccgtaatcaggtggaaaataggggatacggtaggggagcgacgcgattcgatcatcagacgaaacaaaggagggaatgtgaaatttggaaagggagggagagagagagaacgaatagggaagagagtggggagggggaggaggggaaagaaaggagaaggggaaaaatgttttttaaggttttacgcagaaaatccgggctggtggatggccgaaacgaatcaatatggacggacaagttttgcatttgccatcggcgaagatgaccaaatgcccaaagcacccaaaaaacacccttccgattgcaacagtttcgacccgggcaccgacatttacgaaaaattctaatatgagaatatctgacttaaaatctaattgatggagtaagtgaaatttatataaatcaagcaaaaaaaaacaagttatatatgcaacgaaataaaagggtaaagtgaagaatcaatggaataagtactgttttgaggtgaaaggcagtcgtttatgctacacattaaataaaatcggaaaatgcgtcgtctgtcattcgtttatattgcccaaaatggtgctcctcttaaaactgggaatacgcgaaattctcaagtgaagttgggagacgctcctcctaagctgggaccgtctgcgatggatcgtgcccgtcgaactgaattcagccgcgattgaacttaaaattcgtcgttaagacgtcttcgcccttcggggtcactgcctaacttttgctcatcattttcagtgagtctaaaaaggcgtaacttacagcgctttgaggatgccgtccacttcttcgggtcggttctcgcgttgctcacggatttgctgctcagtgatttcttccatcacaatgtcacgggtcgacgtcgttttgatctgaagatcagtcaaaaagagaatcggacggaaagggtagaaaaacgaacgcgttggatgagattctcgaaaaagtcgaaggcaatgtcaaatgtatagctaaagaaaagca

SEQ ID NO: 71502 - DNA, 562 bp, Heterodera glycines
  misc_feature (10)..(10): n is a, c, g, or t
  Genomic contig location: Contig_ID=SeqID_9460; Location=1..562; Strand=+
  SCN-specific regions: Sequence locations=1-366,388-490,512-562
agcagtttcntggcagaaacagaagaacccatttacgggttggccaacttagactatcattggcacggagaaactgccgacccaaattgggacggtggcgaaaaaggtgaagcgaacgacccgaccaaagtttgtctctattttgcgcccgatttgcagttgattttctgctgaatcgatgcactgctcgccaatgtgtgctgctgggctgtcccttcagaacagaaaatggcacattcgccgcattcgacggacgcaaatttaaatgccattccatagacgaactgagaaacaatggcaaattgaacaattatccctccgggcatgggtatgattaataaaagcgaatttgattgattatcacttccaaatgctcacacacaaaaagaaatgatgatgatgaagtgattgaaagccatcacattttgttggactccgaccagaaaactgtcgatggtttccgtttcaaaatgcccgcggcggttgggcccttttccacacgaaacggcgtggaaatcgcagaagcattgcgacgggacaactgctcgcgctgcgaaagcaa

SEQ ID NO: 71503 - DNA, 1295 bp, Heterodera glycines
  Genomic contig location: Contig_ID=SeqID_9461; Location=1023..2317; Strand=-
  SCN-specific regions: Sequence locations=1-76,98-338,360-692,715-1295
atgcctgtgtcgataattcctgatccaaatgatccgtatttcattccttctgtgcccatgtatcgcgactttcgaaaggagatcgatttgaatgactccatttgtgaccgattctttgaaggtcaactgacttttaattgaatttcctaataaaaataagagagtaactttagagcagcagtcccctaaagctggacatcccgttgaacagccggttcccaaggtccaggccaaacagcgcccagtcagtcgtcgttcgttgtcgcaagtgcgcgagcaaacagcgatcgctcaaccaacgatgcgttttggtaacacttctcgacgatccgtcatcaccaaagggttaatggattttgaaataatattttgtttgttgaaatctcgcattcgccacgcggtagggggggacaatatacgtgattctttaaatgtgtaggaccagcaacgaaggcatgcccatcagcagcggccccgttacccgcagcaccttttcgtctgccaaggcttcggacgtttctcatgcggttcgttcgacggttcccgaagtccaggccaaacaacgcccggtcagccgtcgttcgttgtcacaagtgcccgagcaaaccccgacgttcgttcagccaccaatgcgcacttctcgccgatccgtcttcaccaaagggttaatgaacttgcttggaataaataatattttgttttttgaaatctgtcgcattcaccgcgcgggaaagggagggggggggacggcaaaatggacgaatgaaccaatcgactttaaatctaggatcaatagcgaaggcatgcccgtcaacagcggtcccgttacttgtagcaccgtttcggcttcaaaagctccggatgtttctcatgcggttcgtttgacggttcccgaagtccaggccaaacagcgtccagtcagtcgtcgttcgttgtcgcaagtgcgcgagcaaacctcagcgatcgttcagccaccgatgcgttttggaaacacttcgcgccgaaccgtcatctcaaaagggtgaatgtttcttttaataaatacttttgaaatttgtcgcgttcactgcgcgggagggcggtgggggggggacagaatggacgtgatgaagcaatcagttctttaaatatgtaggaccagcaacgaaggcatgactgtcagcagcggtcccgttactcgtagcaccgtttcggctgccaaggcttcgggtgtttctcatgcggttcgtgggatttgcgtggtgcgcaatatgccgactaacaataagaagcaacagacgaaagataagcagtga

SEQ ID NO: 71504 - DNA, 646 bp, Heterodera glycines
  Genomic contig location: Contig_ID=SeqID_43942; Location=279..924; Strand=-
  SCN-specific regions: Sequence locations=1-646
  Gene Ontology: Mol. function=ATP binding; Cellular component =extracellular space; Biological process=growth
cgcccgagggcatttacgaggggggtggccgatgcgtggaatgccaagtgaagccgagtcaacagcacgcgcaccattaacccccccccccccccgttccccgccattagcacaacacagtgggagtcaactgtgaaaaatgcctccccggcttctaccgtcccaccaacgtgtcccactaccgtaccgacgcgtgccgtccgtgcgactgcgatttggtgggagctgaaagcaaccaatgcataagagatgagacagaagtgactgagcagatggtgagcaaagattggctctgccgatgcttgcgaatgcttttcgtactttccctcccttttcagcgacccggcgactgtcgctgtaagctcggctttggcggccgccgctgcgagcattgcgcgcttggctttcgtaatcatccgatttgcgagccgtgcccttgcgacagcgccggctcactcaacttcgacacgtgcgaggaggaccaatgcgtgtgcaagcgcaacgtggagggcgagcgatgcgaccgatgcaaatccggcacaatttatttggacagagagaaccccgaggggtgccagccgtgcttctgctttggcaaaagcactgaatgtcgcgagttcgactgggacacagcgaaagtgggaaa

SEQ ID NO: 71505 - DNA, 627 bp, Heterodera glycines
  Genomic contig location: Contig_ID=SeqID_43943; Location=538..1164; Strand=-
  SCN-specific regions: Sequence locations=1-214,237-327,349-443,465-627
atgtatattaaaatttataaaccacaacctatttgttttacattggccgaaaaagacggaaataattgcgacttgcgactgttcgctatcgtcggtcagtcgcatgtgctcggcacggaacccaacgcaaaagcagcggcagtgacggaggtcggcagaaatttgagggaaatgggcacggaaaattgttgggatttcgcagaaatcactgcaaaatgcaaattttgcctttgtttgttaactgagcaaaacaaatttagaacgagttgccgcagtcgtattccgcgacattgccaccgccccatttggatgccactgccgactttttctccacctccaacagtgacaacgacgttttgcccccgtttgatttggtggcatccgtcgcgcttccgcccgcggtgcaatgtcgcaaattttttgccgaccttcgcccagtccgtgtttgttggttttgtggtgttagagaaaatgacatataaatttttttttgcattttcatttgtttatgtgtaggccctttttttctctgtctgtgttttctcttatcatccaacgagaagagactacggtattgtcagtttgccctcccatggacggtaaaaaagaaaaaaaagcgacaataaa

SEQ ID NO: 71506 - DNA, 529 bp, Heterodera glycines
  Genomic contig location: Contig_ID=SeqID_43943; Location=957..1485; Strand=+
  SCN-specific regions: Sequence locations=1-187,242-529
tgatttctgcgaaatcccaacaattttccgtgcccatttccctcaaatttctgccgacctccgtcactgccgctgcttttgcgttgggttccgtgccgagcacatgcgactgaccgacgatagcgaacagtcgcaagtcgcaattatttccgtctttttcggccaatgtaaaacaaataggttgtggtttataaattttaatatacatatactgtatataattaaatttctaattaataaagtacattcatgggtaattatacagtttgacccacataaaattttttgcttttaatgataaaaagtgtttccaggggttttcggggccgctgatcatgaatatgaactctatttgacgaatttccggacccctaacccggaattcaaacattcttgaaaaaaaaaaatttcagaccaagcattaatgccaattttatttgtttttttgatgaattacgtggcatcagtgcttggtctgaatcaatatattatgagcatcacaccggagaatcatggagcacatattttg

SEQ ID NO: 71507 - DNA, 204 bp, Heterodera glycines
  Genomic contig location: Contig_ID=SeqID_43945; Location=772..975; Strand=+
  SCN-specific regions: Sequence locations=1-204
atggaaagtgattcgaatccgcaacaacagtctgtgcctgtgcagcaattgccgtccgacgcttcgccccaaccgcagcaaaacggcggcggagattcggcggacaaaattgggccggaccaaatgcgtttgttgagcgcacagatcgccgcatacaaaatgttggcccgtaatgagccggtccctcgtgcactgctcagagag

SEQ ID NO: 71508 - DNA, 978 bp, Heterodera glycines; identical to SEQ ID NO: 43946
  misc_feature (959)..(959): n is a, c, g, or t
  Genomic contig location: Contig_ID=SeqID_43946; Location=1..978; Strand=+
  SCN-specific regions: Sequence locations=1-598,629-695,740-869,900 -912,934-978

SEQ ID NO: 71509 - DNA, 56 bp, Heterodera glycines; identical to SEQ ID NO: 58360
  Genomic contig location: Contig_ID=SeqID_9462; Location=65..120; Strand=-
  SCN-specific regions: Sequence locations=1-8

SEQ ID NO: 71510 - DNA, 1422 bp, Heterodera glycines
  misc_feature (1387)..(1387): n is a, c, g, or t
  Genomic contig location: Contig_ID=SeqID_9463; Location=179..1600; Strand=+
  SCN-specific regions: Sequence locations=1-34,56-792,831-1398,1420 -1422
atgactgctcatgtcccaaaggttgctggccgagaatcatataaattatggggaaaattcacaccgcaaatagaggttattattaatggttttgctgcacgaattgagattctgtatataattaaggtcgggtacttcaacgcctttctcgaagcaatgcagacgttccaaggaggtaccgaagaccaattttttgtgaacaaccgcgtgacactgcgaatcgaaccgcctaacgacgacattgttcatggaccgtctggttcagcggccgtgttttgcgctgtatttggattggcttgcaatcgcctctgctcatcagacaccgtcgtcagtgcaacactcgagcgtggccaactatttggagtcggaagtttgctgttcaaaattcgcgcagcaaaagcaaaaagaatgaagacgttagtcctgtcggtcgataaccaattagaatgggaagagatcgcagcaagcgcgccacatgaaatcggaacaactcggaaagtcgccgcctatggtctccatgcctccggtcgcaccccaaccgccctccttgacggtgatgtccgcctcggcctcaccctcggtgccctccttctcctgctcttgcgggtcacggaagaagtacaggtcgggcatgatcagcttgtcgtccaccacaaagcccgtctgacgactgattttgccgcgcaacagcaaaacttcacgagccaacagccaccaaatcagtccgacggagtgcttttgctgtgaggggagggggttggaattgggacagtatttaggtattaaaacgatcaatcaatatggtaccaaaacattttttgttctatagatccgattcgagtaataccaagaccgtatatgtaccaagttttcatggcccggtggtatcagaaatttaccaatccaatcagtgacatataattgagatagcttttagcaattttggttgggtatgggctcattattcgggcatccggccactatcaactctttgaaagacacaaattcaatacaaccttcgggatagttttgctaaaaaaacaaaaccttgttgtttgccgggatggcaatgtccacaaatttcaacggcgagtccgtgttggccaccgcaatcaccggcgtgttcacgtaggacgcctcacggaccgcctggtggtccaactacgggtcggacaccacgagcagacgcggttcctgcaaaacaacaaaatgttgagtttcgtcttccatgtacttaaacaaagtttaaaaatgtaaagtttcgactttttgttcgaattcggacccggagtttggaattgttcgaaatggatcccggattcgtgagtagaaaccgcaaaaacccttaaaaaagaaccttaggggctaggctatcaaatggtaccanattttattttggttgactttagaaaaattatgata

SEQ ID NO: 71511 - DNA, 998 bp, Heterodera glycines
  Genomic contig location: Contig_ID=SeqID_9464; Location=391..1388; Strand=+
  SCN-specific regions: Sequence locations=1-114,140-382,405-467,493 -904,938-965
atgcgttttcatcgtgaagcaacgaaacggtccccgcgacaccgacccgaaaaggcaggagaatgtttaggggtacaagtgatcgaggacgataatggaaatgtgatagacggtaattattttcattttaagcaaaaaacggtacttattggtaatttttgtgcagatttcaaaaaagtttatgtttttggatataacttttttctttggcatctaaatccaatattgttggtatcattcgagagcttaacatgtttcgaagctattactgtgctatcgcttcgcgatcagacaattaccaaaaaagttataaatgaaaattgcgaagaagtcgaaattagtcaaaattttgaagtttttccttaataaaatttttccaggctaaataattttttttattttttgtaaagctaatagagtatctgaagagctttcgaatgataccaacaatgttagctttggatgcaaataaaaaagttataaccaaaaaatgttttttaaatctgcacacagatacctaaccaacaagtacccaaaaaacatagttcgcatttatttcaggggaattgtttattatgactgctaatgttccaaaggttgctggccgagagccgtatatcttgtggggaaaattcgcaccgcaaaccgaggttattaatggttttgctgcacgaattaagattctgtatgtaattaaggacgggtactacaacgcatttctcgaagcaatgcagacgttccaaggtggtaccgacgaccaattctttgagaacaaccgagtgacgctgcgaattgaaccgggttagagaggcaaataattcaaatatttgcaattccctctcttgggctctttgaccccatattgattttccccattcatgcatgcccttcccttcgtccatcctctttcattctgttattttccttcttattgtgtgctcccaaatttgctccgtccctccgacaaatatttgtttatttattttccatttggttta

SEQ ID NO: 71512 - DNA, 253 bp, Heterodera glycines
  Genomic contig location: Contig_ID=SeqID_9464; Location=219..471; Strand=-
  SCN-specific regions: Sequence locations=1-253
cacttgtacccctaaacattctcctgccttttcgggtcggtgtcgcggggaccgtttcgttgcttcacgatgaaaacgcataaggtgttcactaaattggcgctgaccggcgaattgccgattacaatctgtgcgacttaaatgaaagatgttataatcaaacctatatccgcttatattatccgcattacttccaagtaatttgccctcctctattgacgacgaacatttcaataaattgacacaaaagaaa

SEQ ID NO: 71513 - DNA, 941 bp, Heterodera glycines; identical to SEQ ID NO: 43952
  Genomic contig location: Contig_ID=SeqID_43952; Location=1..941; Strand=+
  SCN-specific regions: Sequence locations=1-751,774-941
  Gene Ontology: Mol. function=structural molecule activity; Cellular component=focal adhesion; Biological process=cell adhesion

SEQ ID NO: 71514 - DNA, 946 bp, Heterodera glycines
  misc_feature (22)..(22): n is a, c, g, or t
  Genomic contig location: Contig_ID=SeqID_43953; Location=1..946; Strand=+
  SCN-specific regions: Sequence locations=1-25,47-631,653-880,902-946
attgattctggtgctctattcnccgatggaattgctgatgatgggccaaatgcaactgctggccaagcgttgtccaaatggttgcacactccgagcaaaaatggccaaccgaagcaattgcatcgcaataattattttggtccaccaaagctggaatgggtcaacaacttcaaagaggtgtgtctagccatattttctataaattgtttagttttttccaattttttatttagacatttcgccgtgccaccacttctgtcagttacacaattcaactttatattattgtggaaccaatgccaattgaaccatttgaattggtgaacgaagtgacaaatgagaagctgacactgaaacatagcgaagaattagactataattgcctgtataattggctgttgaaacggtgcccaattggggagacggcgccagttaagtggaaaaaccgcgaaaattcgggtgctaatttgaactatatcagatttgagctgcgatatgccaattattcgggtgccaatttgaacaatatccgatttgaggtgtggggtggaaatagttgcattgggtgagcagcaaaagcaatttttgattgttgaaaaaataaaaataattttaggccattgtcgctgccagcggaagaagaagaagcggatgaaagcaatgaaaattaattatatctgagaaatgatcgatctcaatttgttgtgcttattttctctcagaaatgcttttttaattgtttcgttccaattatataaaaatatgcttttttgttgagcaatttattaataattagggtttgtaattatatggatataaaaacgcgaaatatggccataaaatatggaccaaaaatcgcaaaatatggacagaaaatggcaagaatatggacataaattttccgaatttatgggtaaattttcaaaaaaaaattttttcaaattta

SEQ ID NO: 71515 - DNA, 629 bp, Heterodera glycines
  Genomic contig location: Contig_ID=SeqID_43956; Location=40..668; Strand=-
  SCN-specific regions: Sequence locations=1-208,230-340,378-488,510-629
atgttattcgttgaaaaggaatttgcattaatcgatgaattggaattattaaatcaatttgtttatcaaagtcagagtcaatcatcggaaacgcaaaagtatgtctttactgtaatttgcaatttgcatatcagaaataacattattgataaaatttagccagcaaaaaccgcgtaatgaattctatcaaatttggacaccgttttacatggattcgcaattaaaaaagttatcaagtgatgcagaaaagacgacaaatactcgtaaacggagaaggaaagctcatcattccatggaagaaagaagcgatggtcgggactttctcctttcggtagaatgcatttttaaaattatcaaaaaataattattattttttagaattgtcgaattgttcagaatttgttcactaaattccaaaattcttgcaaaggtttcatggaattcgatgcaaatgttcctcggtaattcacaattgctttctaatatatcaaattaaacttttaacaaaatttgcacattcacaaaatatattcattttcagcaacaacgaaattgctcgcaattgtgtgaaaatggcgcccttattttgtccctttgtgccgtcaattgccaacggttttaacaataaa

SEQ ID NO: 71516 - DNA, 303 bp, Heterodera glycines
  Genomic contig location: Contig_ID=SeqID_43956; Location=755..1057; Strand=+
  SCN-specific regions: Sequence locations=1-64,118-303
atgactgatcggttgaaagaattatcagaaactcgcctgcatttaaaagcaactaagacaaggcattaataatttagaaattttaaaacatattgtttacttttttaaattttaattcgatttagggttacacgcgaagatggctcagtgatcgaagaagagaaaactgaaaatggcgagtttgttgtaatttttgagcgagccaatggaaatggaaatccgagtggatttaaacaatccaagcgaatgcaaaagggtcgtggctatgtcattgacctctcgcccgacttgcaagtggccaat

SEQ ID NO: 71517 - DNA, 410 bp, Heterodera glycines
  Genomic contig location: Contig_ID=SeqID_43957; Location=350..759; Strand=-
  SCN-specific regions: Sequence locations=1-293,316-410
catttcaatcactgggactcaacccaccagcatttcaatcactgggactcaacccaccagcatttcaatcactgggactcaacccaccagcatttcaatcactggaactcaacccaccagcatttcaatcactggtactcaacccaccagcatttcaatcactggtactcaacccaccagcatttcaatcactggtactcaacccaccagcatttcaatcactgggactcaacccaccagcatttcaatcactggaactcaatccaccaacatttcaatcactggtactcaacccaccagcattccaatcactgggactcaacccaacagaaacccaacagcattccaatcactgggacaattctcctgcatttcaatcactggcactcaacccaccagcattcgaatga

SEQ ID NO: 71518 - DNA, 655 bp, Heterodera glycines
  Genomic contig location: Contig_ID=SeqID_43958; Location=338..992; Strand=-
  SCN-specific regions: Sequence locations=1-122,147-196,218-286,311 -601,624-655
cttcgaaacgaaatgaaggcattggtggaaaagcacacgacggaatcggagcaacagagaatggacaaagcgcagttggaagagagaattggggaggtggggagaaaaaatacaaaactcggaaatttctaacccaaaaacaaaaacagtttttttgaattttggaattttttttcttttttgaaattctgatgcttcttcagttgttttgttacatcttttttttctttccttagcattttcgtcagcgcggtgaacagttggacaaattggagacgaaattggcggaaatgaaacgacaaaagcaaaaggaagtggccgaattgagagagaaaaacggggagcaatcggaccgaatttggcagctcgagcagagactcgaactgtacagaaacacctcgaaatacgaattcgaaaaggttaaaatgttggcactataaaatgatagaattttttattttttgcttaaagaaaactgaatttttaattttcgaaaaaattccatttttaatgtgtttttacagaaatttatttgcattttaatttgcaggtaaacaacgtgttgattcgccagcaaagggacgcggaagagtaccctcactacctgcagcacatggtgcagcaatgttcgcagtcaatggccgacctcagagag

SEQ ID NO: 71519 - DNA, 494 bp, Heterodera glycines
  Genomic contig location: Contig_ID=SeqID_43959; Location=784..1277; Strand=+
  SCN-specific regions: Sequence locations=1-219,241-253,275-494
atgtttggccgttgcagaagcgaaatggcaaaaacaaattcatgggatgacataagggttcgtaaagtatcaaatcttatttttcaaattttactaatagactaattgtaagatggaaatattttttaatgatggctattttcctgtaaaaaatttgaatttatgagcaataagtcaaaaatttccgattcattttcgaattcttttgtgaaagatcaattgaaattataaatgcataaataattttgtgtcgcattttccattttggaattttatgcaaaaaataaaaatctaattaaatttggaaaaaaatatacgtgcagttcataggtttgaactttcaaccgatagagacactgggaaaggcgcttaaccgactgcgccatttgcacgcacatactatcgctttcatttttcacttttagctttattttttcatgggatggcataagggttcgtaaagtatcaaatcttatttttcaagaaaggtcaga

SEQ ID NO: 71520 - DNA, 695 bp, Heterodera glycines
  misc_feature (637)..(637): n is a, c, g, or t
  misc_feature (640)..(640): n is a, c, g, or t
  misc_feature (656)..(656): n is a, c, g, or t
  Genomic contig location: Contig_ID=SeqID_43960; Location=1..695; Strand=-
  SCN-specific regions: Sequence locations=1-355,378-382,405-695
atgcacgcgttttgcgctcgagctattcatcatcgggcttgtcaatctaaagcgaaacaacaaagatggtgttttgaacgaataaagggcataggttattttgaagaagtgtcaaagaacatgcagcaataagcctgcaaaatctaataagtggaaaatacctgagtatagaatttattttcagaaagtgtcaacagacttttggaaaaatatatttgcaatttatcaacaattttgagaagtgagttagaaatgataaacttcacgattcaaaccagttttcggtgctctaattaaccgcgataaaaacatccgaatcaattaaatagcttctgagataataaggtttatcataaaatttcatttaaaaataaaccctcaattattggtatgaacgatactttccaaacatgcacgcgttttgcgctcgagctatttatcatcgggcttgtcaatccaaagcgaaacaacaaagatgctgttttgaacgaataaagggcataggttattttgaagaagtgtcaaagaacatgcagcaataagcctgcaaaatctaataagtggaaaatacatgagtatagaatttattttcagaaagtgtcaacagacttttggaatatatatttgcaatttatcnaancattttgagaagtgangtagaaacttcacgattcaaccaattttcgttgctctaa

SEQ ID NO: 71521 - DNA, 1078 bp, Heterodera glycines
  Genomic contig location: Contig_ID=SeqID_9465; Location=4..1081; Strand=-
  SCN-specific regions: Sequence locations=1-198,222-240,272-652,702 -713,736-774,797-825,875-935,958-1078
atggcacatccgccaactcttttcccagtacggcacaatttgttccgtcacggaattccctaaggcatttcgtgtcgaattcgcggccaaacgaatggcggcgtttgcgatttggtcgatgaacggcaaatattggccaaatacgttcagaaggatcatttgcgattggtggaaatggaaaaatgacaaaacggaggcaattaaaataaatttaaaaaatagaaaaaaggaaaattcaccaaaatttaatttaatttgtaaaaatgaattttctattttggattaattattctatcatttttatttgaggtcaataattagcatataaaagccatttgcggtgataattaaaaacgggttttaaaatgattgataaaatatttgaatcagaattttaaattttaaatgaattaacaattctgattatattaatttttagaatcattctccggttggacgattcactccaaatccatttgaggtgattttcccatttaatttgaaaaaatgaattcttatttttatttagaatcattcccagacaaaacaattgaccccaaatccatcgatggtaaaattttagaatttccaataaaaacgaaacggattttataaaatcattatgattaaactttaaaagtcatttgtgttgaaaattaaaaaacaaattttaaattttggaataaaaaaaacattttaaacgatttaaaagacattaattatttcaaatcattcccagagaaaataacaattgacacaaatcaatcgacggtgataattataattttaattatttggagtcaaacgacataaaactttgatcagaatattaatttaaaatgaattaataattttgattacaattaattttttagaatcatactcaggttggaccaactccaaataaacaattgacaccaaatccatcgacggtgataattataattttaattatttggagtctataaagaatgataaaacaattaattttgatgtttaaaatgcttcatttttaggattgtgcccaaattgaacaattggtcccaaatggacgattggtcccaagatggaccgattg

SEQ ID NO: 71522 - DNA, 243 bp, Heterodera glycines
  Genomic contig location: Contig_ID=SeqID_9466; Location=650..892; Strand=+
  SCN-specific regions: Sequence locations=1-113,143-200
atgcccttggtatttatattggtattttcgtgcatattaacgccccctttttttgcattttcaaaaaatcctctgttagaatggccctttctcttttgttccctaaagaatagaaaattaaaaaaatattatataaattttagggccttttctcaagaatatacataaaaatttgacttacagtcaggtgcaaaatattgcagcaaatttttgtaatcctatgcctatataacaatatataaa

SEQ ID NO: 71523 - DNA, 96 bp, Heterodera glycines
  Genomic contig location: Contig_ID=SeqID_9466; Location=2866..2961; Strand=-
  SCN-specific regions: Sequence locations=1-96
tggaatgtcccggacggagagcgacgcgagttgaagctgtacacggaggagggactgttccgtttggtcaccacatttgccaccaaagaagctgaa

SEQ ID NO: 71524 - DNA, 368 bp, Heterodera glycines
  Genomic contig location: Contig_ID=SeqID_43962; Location=127..494; Strand=+
  SCN-specific regions: Sequence locations=1-240,262-316,349-368
atgtcaccaattgcacttaaaatgtgaattacaaaaaggattaataatattccatcagtgagttaattgattcaccaattttgtattttatgagaaagaattggcactgtgacaaaataccagatgaatttgaagaatatgaacggacagaatgccaaaaatatcgcaaatatttggacattttgtacgaatatttgtacagagaatacgtcggaattccaacagtgaagccaaaatttgtgtttaaaaaggaaattgaaattgaagggccaataatttatgcgtagatttggataatcctacttatggtcaatccaattttttaaatattttatttaatataataatcaaattacgcagccctctga

SEQ ID NO: 71525 - DNA, 851 bp, Heterodera glycines
  Genomic contig location: Contig_ID=SeqID_43963; Location=83..933; Strand=+
  SCN-specific regions: Sequence locations=1-751,778-797,823-851
ctacattgaccattccgtgatcaaatttttccgctccaagaagcgattctttgacaaaagtggcaccaaattggaagtgtttgtgcattcaattgatacgtatgtccaaccgatttgggatgtttttacccgcgaaatttggcctatttttgcgaaaagcattcgtcatttgggtcttcataatgccaatgctttggacaatttgcgcagtcgcatttcaccgacacttctcactgatcttgatcaattttcaatcgattccggttatctgtgccccgatggaattgctgacgatgggccaaatggaaatgctggtcaagcgttgaccaaatggcttcacactccgacaaaaaatggacaaccaaagcaattacgtttccgtgcttatgtgagtccaccaaatttcgaatgggtcaacaacttcaaagaggtcgtctcgccagaattttcgtcaaattgtttttattttaccaattttgtttagacatttcgccgtgccaccacttctgtcagttacaaaattcaactttatttttgggtggaaccaatgccaattgaaccatttgaattgatgaacgaagtgacgaaagaaaagctgacactgaaacaggagatcgacgaattcgacttaaatgtgtataatttgggaaaaccgcgaaaatccgagtgccaatttgaacaatgtcagatttgatctgtggagtttcgataaatccattgggtgagcagcaacagcatttgaattttatcgaaaaataaaatatttaattaattttaggccattggcgccaccagcggaagaaaaagaaggagaagaagaagcggatcaaagcaacaaaaatgtcgtctga

SEQ ID NO: 71526 - DNA, 836 bp, Heterodera glycines
  Genomic contig location: Contig_ID=SeqID_43964; Location=369..1204; Strand=+
  SCN-specific regions: Sequence locations=1-56,79-120,160-210,232 -269,296-589,611-678,700-836
atgagaaaagttattaccaacttcgccgaactgaatggttctcatcgatagacacttttaaattcttatttatttattccatttaaccggatatttaagaagataatttatgtaaaatttcgaaagataatatttttgaaaaatcaaaataactattaatttttgcaagtttaagggcctaatgcccaaataatcaaatttacaaaagagaatatgacgtcatgaaaaaattcctcttttaaaactcaaattaaattcaattactccaattaaatgtaataatatttaaccaacaggcacaaaccatagaaatctgatcattttttgcatagaatccggtcattttttgataaaacttctgcatccaaatgttcgttctcattcaatttgctccgctccgtctctgtcttcagttcactcaccagttactatggcagcatttactatggcagcatttagtataaaaaacataaaaaatttgtaaagttgattattttgaagaaccatgggggtaatgaaccttttaagcgcccaaaaataaaatcaaagggagacggtaattaaatcagataaaaacgtaaaaatattcaactaaaatgtcaaaataatacagcgaccaattattaattctggcaaaaatccactttatattcccttagaaaatgatttaatttggaaatttattccattttaggaaaatgggtaacgaaatggccatttttgtggcaatataattgtcccttgaaggcattttcggaaattcaaagcaaggacgatcaattgccgtgcccaaacaagggacgatcaattgcagtgtgccaaataagctaaaatga

SEQ ID NO: 71527 - DNA, 501 bp, Heterodera glycines
  Genomic contig location: Contig_ID=SeqID_43966; Location=501..1001; Strand=+
  SCN-specific regions: Sequence locations=1-501
atgatggtgctgctgctactgttcgaattggacggtgagcgatcgcgcgggtgccgcagggatttcccctcgggcgctgccgcagacattttagtcgctaattgcgttaattggtcgccaattacgctgcttttcgaatgacgccgaaggttcaaagtgtcgcaattgacacaaaagggaaatgaaaatgggtatttagactccgattttccctcactttttcatttgtcttcgcttggcattcggccgtccgcaacattcgcagcaaaaatgccgaaaaatattttcacattttccatcgttctcttttccactgcttttctcattttcattttcgttgtttttttgctgtttaaaactgccatttctgtgcacttttcgtccgtctttcatttgctgaatattcaaaaaattttaaaaatttcagatgaattttccgttcaatgaatgccatttcaaatgtttttttttaccttttgctgttccctccacttttattga

SEQ ID NO: 71528 - DNA, 662 bp, Heterodera glycines
  Genomic contig location: Contig_ID=SeqID_43967; Location=307..968; Strand=-
  SCN-specific regions: Sequence locations=1-483,505-619,641-662
aaaaaatttttctccatctccctttttgatagaaaaagcatcagagtgcctaaactaacatgtaaatacaatttggtgcgctttagagcactttctgaaaaaatatttatgaaataaaaaaatcgatttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgatttattcaagtgtccgtttggggtactcaaacaattatggggagcaaaaatccaacgcagaattaaagtacaggctatagggaagctattcccgaaggattcggtctccacataaatctgggcgcatcggttcggggggactgccccgaaaacaaaaaaatcgattttttcaagtgtccgtttggggtactcaaacatttatggggagcaaaactccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatat

SEQ ID NO: 71529 - DNA, 381 bp, Heterodera glycines
  Genomic contig location: Contig_ID=SeqID_43969; Location=814..1194; Strand=-
  SCN-specific regions: Sequence locations=1-381
atgtacgggtacaagtgagttgtgctgtatttaacaaatctatgtttttctgtctacatttttacttactctctcccatagttggggccggtaggcgggggaagccgacataaaagcaacgaatatttgtaacttttacgccacaatttttcaaaagtttttgcgtcactgtccccttcctgcccgattttccaatagttttacttgtatttttttttgatttcacaacggattctgtagccctaccctccctcaaaaaaagggtaaaaaagttccatttcccattttgtttttttttcagacttgaagcgccaaaagggtacgatttatcgaagaaaaagatgaggacaatcggcgagtgaatgaatttacgggaataaa

SEQ ID NO: 71530 - DNA, 965 bp, Heterodera glycines
  Genomic contig location: Contig_ID=SeqID_43970; Location=31..995; Strand=-
  SCN-specific regions: Sequence locations=1-358,380-392,417-785,844 -844,867-965
  Gene Ontology: Mol. function=acetylcholine receptor activity; Cellular component=nicotinic acetylcholine-gated receptor-channel complex; Biological process=synaptic transmission
atgccaactataactgaactaggacaatatgtgtgtgtgttccgcacgaattccaccgagtttgacctgctgttcttcaccgccgagcggacactgatccgttttccgacagacgcgcgtgccagctggccaatgattgttgcgaccattcgcatgcgacgccggccgttgttctacgtgttcaaccacattctgccctgtgtgctgatctcgtccatggcattgctgggattttgcatgccgccagagaccggcgaaaagatcaacatgctgaacacggtcagatgcgtgactatgttccggacccgatttttgtcaaaaattctgacgccatgccggaccagagttgcactccatttccctctcccccctccctgtcgtttccccatccgaatttttttttttaaatttataaacatagaaatttcggcgattttatcaaaattttaacaactttgtgtcagggtcggaaggaattccatgcgaaagggtctaatcccatttcaacaatccctgcaggtgattctgtcgatgggcgtctacctgcaatcaatcaccgaatcaattccgcccacttccgaggcggtgccactaatcggcatgtactacgtcgcttcacttgcaattggtgggtgtgggtgctttatccccgtttttttggcgattttattttttgctaattttaaaaatttcagtttgcctggcaactgcgatgaatgtgtacacgctgaacattcacagacgtggcaccaccaaccagggcagacgcgtaatgccctgctccgttttaaaaaataactaaataatttttattctaaattctttaaaaataaataaataaaaccgcgccctcacttattttttggctcaattttaaggtgccctggtggatgcgcaagtacattctcggctacttggccacatttttgttaatccgtgtgcatgagcctgactcgatcacatga

SEQ ID NO: 71531 - DNA, 2844 bp, Heterodera glycines
  Genomic contig location: Contig_ID=SeqID_9467; Location=21..2864; Strand=-
  SCN-specific regions: Sequence locations=1-1944,1966-2381,2403-2844
atggaacatgtgatcctcgccgacatcgaaaaggcatttctgcaacttggcattcgacacgcggacagagatgcctgcagattcatttggctcaacaatcccgagacagcagagctcaatccaatcagccactccgaattgcgcatctaccgattctgccgtgtcagtttcggtttgacggtgtcaccattcctgctcaatgccacattacgagaacacctcgcgctattcgactccgacctagcaaggcggatcgaagagaatctgtacgtcgacaacatcatgttcgacgccaagccaacggaaaagcttcaagatttggtgacgcaagccaagacaatcttcgaagcagcgggcatgaaactccgagaattctacggaagcaacatcgaagagctaaaaaagctgcaaccagacgacttggcaaaggacctcgaagacaacaaagtactcggcattcgatggaaaccaaaacacaatcggctcatcttcaaattgccaatcttcgaaggaaaaatcacaaaacggacaattctgtcgcaaattgccaaagtctatgacccgctcggactcatgtcacccgtactactgccagccaagctcattcttcaagaagtgcaaaacttgaacccaaaatgggacgacgaattgccagcaaacatcaacaaggactggctcaaattgatggcacagtggctcgacagaggcgaagcaatcacaatcgaatttccacggcacatcaaagacatcgactcagtggaattccactgcttctgcgacgccagcaaatacggcatgagaattgccgtgtaccaaaaagcaaaaacgacgatcatgaaggatgaatgtaacctcatctacgcgaaaagccttgtcaaaccaatcaaagtggcagcacacgacggtacaatcccaaagctggaacttcaagcactgactctcggagtcaaagcagtcaaattcatccaagcccaaatcaaattcgccgatcatcaagtcatcatgtggacagacagtcaatgctcagtcgaacgacttcgagaaaacaagcgccaagatcgatttgtggcaaatcgattacaaaaaatccgagaagcgaattttcaagtcagacacgtcagaaccgactcaaacccggcggatatggcatccagaggcgcagatccccaatgccttcgaacagcactgctttggcgctttggcccgatttggctttcaaaagcagacaaatggccagaatccaacgtcatctaccgacccggagatgaattcaaagaagtggaaaagccaccaatcgttgatattccagagcaaccaattcaagcagtgcacagcttcatcgcatcagtcatggacgattcagtttctcttgccggcagcgacgacgaaagtcaacaaccacgaccaaagaagaagttcaaaattccgaaacgacgctcagcactgttacgacccatcggccagcagcaaagtccattgcaaggacaacacaaacgccgcaagcaattacaagactcaggcttacgcaagttatttcaagccatctcggaccaacaaggaagcagcaaggccaccacaaaggccatcgaggaaagccgagaagtgcagaaggcaccacgtcatgaacagatcgagcacgaacaacgaatggtgaggaaaagtcaacaagaagcaaatcgacatcttcaaccgaaaaagcggcagcaaaaagaaattcaagaagtgccacattcaacaacagaagagcaacaacgagaaaccaaacgccaacaaatcgaaagacaacaaaatgacgaacagcgtgccatcaatcaacaaacacgcagtaaggcttggcaagaattggcacgacaatttgactacgatctgatggatcagccggatccaacagagaaacaaccggaagaaacggatcaaccaacgaaatcaaagcagcaatcaacaaaggacaaagaggacaaagagctggaacgacatcgcatcggcagaaaaaagacaatcgacatgcaagaaaaacggcaacggtcaagagacgaatggccagaggaaaacgaaacgctgctcagctacgttcaacgtatttacggaccggagaattggacgtcagcatggcaaagaggacgtgttctccgagagctccatgaactggaagatcaagggcgatggatgattcatcacaaatccgatcgcctacaactcagcgtctcgcgaatgtatggaggaaaacgaccatttgccgagttccgcttcgtggaaggcagatactactcacacatggtgccagaagatgtgatctttctccaagcagtaccaaccgaagaacagctggagatcataacaatcaacgacacaacggcaccggcaacaaatacggaacaaacgaagcacccaacaaaaccacaacgaccacaatcgccaaaactcgaagaataccgcatggccgactccaaaccgaacacacacagccaattcaacctgttcgagccatgcgacaacacgcacacaacttgcgccaaaacagcgacttacggttccacagcgggcaaccgatttcaaatggaagaattccaaaacttccgtgccaacaatttcttcgaggcattgctctttaactggttaacacgcaacatgaacttgccagccgaagagatttgggcggcacacgaaggctacattcagtcagacacaacagtggaagaagtggcgcaaatgttctaccaacaaaaagttgcagacaacggacgacaaatcgcacgagaccagcatttgaacgaggtcatcaatgtctggcgtaactcctgtgaccgatttggcgaactttacaatcaaccggcacacaagcaa

SEQ ID NO: 71532 - DNA, 669 bp, Heterodera glycines
  Genomic contig location: Contig_ID=SeqID_9467; Location=1944..2612; Strand=+
  SCN-specific regions: Sequence locations=1-669
cagctttgggattgtaccgtcgtgtgctgccactttgattggtttgacaaggcttttcgcgtagatgaggttacattcatccttcatgatcgtcgtttttgctttttggtacacggcaattctcatgccgtatttgctggcgtcgcagaagcagtggaattccactgagtcgatgtctttgatgtgccgtggaaattcgattgtgattgcttcgcctctgtcgagccactgtgccatcaatttgagccagtccttgttgatgtttgctggcaattcgtcgtcccattttgggttcaagttttgcacttcttgaagaatgagcttggctggcagtagtacgggtgacatgagtccgagcgggtcatagactttggcaatttgcgacagaattgtccgttttgtgatttttccttcgaagattggcaatttgaagatgagccgattgtgttttggtttccatcgaatgccgagtactttgttgtcttcgaggtcctttgccaagtcgtctggttgcagcttttttagctcttcgatgttgcttccgtagaattctcggagtttcatgcccgctgcttcgaagattgtcttggcttgcgtcaccaaatcttgaagcttttccgttggcttggcgtcgaacatgatgttgtcgacgtacagattctcttcgat

SEQ ID NO: 71533 - DNA, 513 bp, Heterodera glycines
  Genomic contig location: Contig_ID=SeqID_43972; Location=39..551; Strand=-
  SCN-specific regions: Sequence locations=1-57,79-513
atgcgacaccaaatttcctggtccgatgaggctgtccttcatgtactgttccccgttctgctgccgctgctgttgctcaccggtgtggtcagaagtggacaacccatctcgggattgccggacgatggcggattcgacatgccggagaggtcggacggggccaaagtgggccatttgagacacgcattcagcattttggagccggagttggcccagtcagtttggagccgagagggcctgaaaaatccgatcagacggaccacaaccattccaatgaatgatcggttggacattggaaacaccggcgaattgcaaccgaaaggtcgtttttctgatcagagattaagagcaattaccttcttgatcactcactcactgtcagcaggcgccaataagccgatgaagcgaaggccgagaaaagctgagactgtcagcgaatacgacacactgaacgacgactttctgacggagtacgacctgctgaatttggacttcagtttggacgaaccgtag

SEQ ID NO: 71534 - DNA, 792 bp, Heterodera glycines
  misc_feature (86)..(86): n is a, c, g, or t
  misc_feature (112)..(112): n is a, c, g, or t
  Genomic contig location: Contig_ID=SeqID_43973; Location=269..1060; Strand=-
  SCN-specific regions: Sequence locations=1-195,220-229,251-747,771-792
cagcacattcgaactgcccacggcgtgccactgattcggtatttgaacaaatgcaccaaatttcatcccttttcgtcatcaaaatntaagtaccttctgaccaacatttacnctggaaataatatacacaaagggaccacgcgaattgtgagttgcacgaccaatatttatgaatttcaactggtttcaaaatgcaattatttatttattttaattaatgaatccacaacctttgtttcccctttttgtcagatggtccaggaagtattgaagcgtttcgcgcggattcgttttgaacaatggagaaatgttagacaaatcaaaacgaagttggggtcgatgaaacggaactgttcctttcctcctgttgacgaccactcgtggaaacgaaaaaaagtgggaaacgaaggcggaaaggtggcggaggaggacggttcgatgtcattttatgtgatttttagactgttacctttttaagttatcgacagaattttgttttctccgtcacaaattcctcaaaaccttagcgagcgttttcaccgtctgaaaaaggtgatttgcaactctcccctcctcatttttttaaattttgcttacccagatggaccgcatttcgcggcatcaaatgatcgtgccaatttgcgggatgtcgtcgttcgtcggtttgtccaatgtgcgcattgccaaaatggccaagagttgcagcacccacaaatgatgctttttattcggatattttacacattaaatcttttgcctttcttttcttacaattaatttgattaaattaac

SEQ ID NO: 71535 - DNA, 372 bp, Heterodera glycines
  Genomic contig location: Contig_ID=SeqID_43974; Location=18..389; Strand=-
  SCN-specific regions: Sequence locations=1-372
tatacatcccattatgagcgctaaaattatcagagtgccgaaaatcgcatgtgatctaagcctagaaaaaaatggtgtaagtaaaatcgtaatacgctcaaaaagcttctcaaacaattttagcgcttccaattccttctacaatcgcctttatacatcccattatgagcgctaaaattatcagagtgccgaaaatcgcatgtgatctaagcctagcaaaaaatggtgtaagtaaaatcgtaattacgctcaaaaagctcctcaaacaattttagagcttccaattccttctacaatcgcctttatacatcccattatgagcgctaaaattatcagagtgccgaaaatcgcatgtgatctaagcctagcaaa

SEQ ID NO: 71536 - DNA, 372 bp, Heterodera glycines
  misc_feature (285)..(285): n is a, c, g, or t
  Genomic contig location: Contig_ID=SeqID_43976; Location=730..1101; Strand=+
  SCN-specific regions: Sequence locations=1-118,140-372
atgttatataacttggaaaattatgtcattttcggcggatttcttccaattttggcactttcgctatttttggctttccgtttgtcccacagtgattttgtgcacccgccgagtccacttttttctgctgctgctgctgatcaacgcaggcgaaaagatgacgcgtccgatcaatttgtgctggcctccgtccacgtgttctcccccctccccgccgacgatgcaccgttatcaccgacaaaacaccgacaatttaatttgggagttgttgcgaatttgctcgcncaacttcttcccgtcccccccccccttccactatttatgggtaacgtcgaaccagccaatgcaattgccgacgaccgcggttattaa

SEQ ID NO: 71537 - DNA, 839 bp, Heterodera glycines
  Genomic contig location: Contig_ID=SeqID_43981; Location=255..1093; Strand=-
  SCN-specific regions: Sequence locations=1-93,194-225,247-379,401 -429,497-708,737-812,834-839
atggcctccgtttcaaacgattatcgacaaatgaaaacagtcccaccaccatcaagttcaatcagcagcagaaaacccaatgtttgtgatttgttatttaaataaaaaaatttataaatttatagaatatttttttgacaaaattaattcatttataaagacattttattaatttgtaattcattttaatttagcaacataatagtaaatcaatattattttaaattcataaagaaatttcataaaagcagagaactgctaatgttaacttttaattacgaaatttttttgagtttagttgaaaatgatttatttttttagccaaaaaccaaaaaattaatgaaaaattcgatttttatgcgttcttgcttcaatgatctttttaaatgccataacagagtattttttaaaaggacgtccttagcttacaaaaattcaatttttcttatattttattaataatcaatttttaactgttttctatttaaattttaaactcaaaattttgctaaggcagaatatcagccaagcaatcagacgggccaaggcaagcgaattgtggacagtttatgggatttgcgattggattcaattcttggcgatcaacaaatcacagaagcagtgcatcaattaattgtggcaattatcattattgcactcatttcagctgttttggtcagtttcttttttttctttttgtttttttggaatattttaaaagttttatttaaataatcattatccaatcaataaaatttacagtatttagaagtctaattttagtcttgagaaaagaatctttattagcttaaaatataattaattttgcaaaaaataaa

SEQ ID NO: 71538 - DNA, 344 bp, Heterodera glycines
  Genomic contig location: Contig_ID=SeqID_43984; Location=232..575; Strand=-
  SCN-specific regions: Sequence locations=1-299,321-344
cttcggcttcttccgattcgtctttgacttcttcgaccgcctcgtccactttgaattccacgaataacacaaccgaaagcgaggaaccttttcacggccaaagccgcaagggaacgtcgcaggaagagagccgaaatgaggcgagtgataaaacatttatgcaaaaaaaggaattgcatttaccaatatcagacacatgcttctcgcctggacgattccatcctcaaccgtttgttgcacatcgaaccgccaaatgggaacaagcaaaagtcgttgaacaacacgtgccatacatttgtgacgaacagccgaaacgaaagcccaagcgatttccgttggattga

SEQ ID NO: 71539 - DNA, 166 bp, Heterodera glycines
  Genomic contig location: Contig_ID=SeqID_43985; Location=807..972; Strand=+
  SCN-specific regions: Sequence locations=1-38,86-166
atggcgccaattaatatgagctcagaagatccggtatgaattaatatgatataaaataatatataaatatatttttatttattttcagctttatttggcctaccgttctgtcggtccgtccgccgatttaattgtgccggccgttgcgctgaatttggttgttttg

SEQ ID NO: 71540 - DNA, 1157 bp, Heterodera glycines
  Genomic contig location: Contig_ID=SeqID_43986; Location=149..1305; Strand=+
  SCN-specific regions: Sequence locations=1-880,911-981,1003-1157
atgtccaattttgctgcactgaaagcttcacagaatttgctcggccaattccagcaacatcaacagatgttgaataattgtcacgcatcgcccgctattcagcgtcaaagatccatcgattatgacacggagcgggagaagaacagcgaaatgggaccaatgacgggcggagttgggacagcgatgtcaactgccgatttggtcaccgcacttgggacaatcaaagcgcagaacaacagcagcaatatcggaacggacaaatgtgaggataatgaaaaaacaagaaggaatttgaggaatttcgttaagtaaattctgacatggaacacctcaagcgggacaacgaattccccgtttattcgccctctcaattggccaattccatcatttcgcaatgcaaaactgaccaaccgcatcagtcttcggcatccgttgacttctccaacggatggagaatttcatcagacgcacggagggatagcagtgagccggacggagaaattggctcggacatagccgaatcatttggtgggtttgttactttgggtctcgatatttgccaccatccccaaaaccgaattcaaaacataccgagaagcattatgtcgttaaataagtaacaggaagtaataacattcgaattcattgttagaaatattattgccacagtatgacgtataatgaacttaccgtctcaacaggtcgatgcattgttcaacaactgcaaacagtctcaagaaagaatccgatgctcgcagtgcaaatgcgccgggaattgatggacgtgtgcttcaaatacgaaatgcaagcatgcgtcatcgacggtggccatggttgactcgccattacttcatgtgatttttttcccttcaataatctcgaaacttttgtttgtttgttttgcgtttgtcagggaaaatttcctatgtggtacttcttcctcggctttttcttgataagtatcacaacaaatattatttgtctcttcaattcattttcctatggagaagtcaacagattaaacatactgaaccattttggcaaaattcatacccctgcatttgattttgcatattcccggttgttatttgattattggtcactgatcacctcttccgatttcaagtcatccaaataccaaaatttttgattctcta

SEQ ID NO: 71541 - DNA, 304 bp, Heterodera glycines; identical to SEQ ID NO: 51570
  Genomic contig location: Contig_ID=SeqID_43987; Location=77..380; Strand=-
  SCN-specific regions: Sequence locations=1-304

SEQ ID NO: 71542 - DNA, 355 bp, Heterodera glycines
  Genomic contig location: Contig_ID=SeqID_43987; Location=583..937; Strand=-
  SCN-specific regions: Sequence locations=1-169,194-355
aatttatcaaataaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagcgtctaaatttaaaaattctctcaaaaataaaatggctattgtgcacagccctccgtatcatgctcgagcgcttttgtgtgtgtataaaatttctcaaaaaaagagatagccatttttctgggatagagtataaatttaaaaattccctcaaaaataaaaggtatattgcgcaccgccctccctatcatg

SEQ ID NO: 71543 - DNA, 274 bp, Heterodera glycines
  Genomic contig location: Contig_ID=SeqID_43988; Location=1..274; Strand=-
  SCN-specific regions: Sequence locations=1-274
aaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgagatagagtataaatttaaaaattccctcaaaaataaaa

SEQ ID NO: 71544 - DNA, 1329 bp, Heterodera glycines; identical to SEQ ID NO: 43988
  Genomic contig location: Contig_ID=SeqID_43988; Location=1..1329; Strand=+
  SCN-specific regions: Sequence locations=1-901,927-955,987-1085,1133 -1265,1288-1329
  Gene Ontology: Mol. function=dihydropyrimidine dehydrogenase activity; Cellular component=cytoplasm; Biological process=uracil catabolism

SEQ ID NO: 71545 - DNA, 228 bp, Heterodera glycines; identical to SEQ ID NO: 65316
  Genomic contig location: Contig_ID=SeqID_43988; Location=605..832; Strand=-
  SCN-specific regions: Sequence locations=1-228

SEQ ID NO: 71546 - DNA, 49 bp, Heterodera glycines; identical to SEQ ID NO: 51181
  Genomic contig location: Contig_ID=SeqID_43990; Location=752..800; Strand=-
  SCN-specific regions: Sequence locations=1-49

SEQ ID NO: 71547 - DNA, 561 bp, Heterodera glycines
  Genomic contig location: Contig_ID=SeqID_43991; Location=362..922; Strand=+
  SCN-specific regions: Sequence locations=1-305,327-386,426-465,489-561
atggcatgccatcccgaataccagcaaaaagtacatgccgaaattgttgaacattttggcgcaattgatggtgaggaggaagacgatgagcagctgctgcaattgactgcctctgatgtgaacaaattgccgtatttggaccgttgcattcgcgaaaccatgcgcatgttcccggtaatgatgagaatttggtgccacaaattattaaattgccacatttgtactggggatttcaaatgtttcattaaacaaacaaagctagagctccccataaaaatatagatttttaacaaaaaaaaaatgggataaaaattaaaattgataatcattatttgtctatttttaaagcaattaaaaaaaacattttaattcctaaacgtaatgggaattaaaataaaattaaaaataatcataattcaattttagctgattcccatattggagcgtgagcttcaggccgacttgcgcatctgtgacaaaactttgccccgcggggcaatcgtcgccattatgccactggtcattcaccacaacgaaaaagtgggggaaggataaaaaaaa

SEQ ID NO: 71548 - DNA, 782 bp, Heterodera glycines
  Genomic contig location: Contig_ID=SeqID_9472; Location=305..1086; Strand=+
  SCN-specific regions: Sequence locations=1-218,243-782
atgactgggcttccgttttcaccttcgattgactcatcaaatcataaaaccaccaaactttttcctttggtggttcgttacttcaatccaaaaaaaggaatttccgtcaaattgatcgacttagaggaattgggtggagagacttcggccgaagtttgaatcatactttattttttggcgaatcagctcatttgcgtgactcattccgggtttttaacgggaaattttcaaaattttccccatttttcagaattttctgaaatcaacacttaactatgtcgataaatggttccgtgttgaacgttttccaacgaatctaaaatggatttctctcaaggaaatgaaagtcactagcgccgaagtgatgagtttggctgaacagattgctccggaagtgaacgacaatgagctttttgacgaaattacgacgctgaatgaaatacttgaaagtatttctgacgagaaatttggtgaaatgaacgcagaacagaagtggatgaaggttttcgaggcggaattacccaatcttgtgttgctcgtcagcaaaattctttcaattcccgtgtccaatgcatgcgtggagcgcgtcttctctttgttcagctcagtggactgatgtgcgcaatttattgaaagttgaaaccgtgaaaagtctggcccaaatcaaatcgaattatgatctcacttgcactgaaatgtacgatttgctcatttcctcaccaaaattgttaaaaatgatcatgggaggtgaaatatataatatttgatacatttttgattga

SEQ ID NO: 71549 - DNA, 3367 bp, Heterodera glycines
  Genomic contig location: Contig_ID=SeqID_9473; Location=722..4088; Strand=+
  SCN-specific regions: Sequence locations=1-858,880-1333,1357 -1643,1665-1676,1702-2007,2029-2674,2704-3033,3055-3367
  Gene Ontology: Mol. function=chaperone activity; Cellular component =mitochondrion; Biological process=embryonic cleavage
atggctgttgcagctgctgtgattgtcggactgcaatacttcatcaatcgggtaacatcttttgtaggtgatggcaaagttggtgcttgagagaggcagcgatttgagaaacgattgggggagggtaagtttttgtaaacaaaaaaagtccaattccgagagtgatgagacaaattttcaatgttgttgacccattttcctttttttctcaacttttgattatcatttattccaactaaaattcacttagcgtttcttgcgctgtttttcataagaccacagtgttgccattgccttttttgttgatttgctattactccttctgtttagctcgcttacacagaaatatcatggaaacagttctacacggactttttggaaaagaacaatgtgtgctaatgatttggcgttacacttaacggattccccgaaccattcgtttaggttgaacgcctcgaagttattgacaataaatgggtccgtgtcattaccagggagccaacgcaggtgacgaagcgaaacaaataaacggttgtatttttcatttgagaatttagaccgttttttacttcaacatcggaagcgtagacacttttgagcgcagtttaacccaggcacagcaacatttgggcatggagacgagtcagcagcaggtgccggtgttgtacaaaagcgaaacggacatgtgaggaggctggcaggccattgccaaataaaaaatgaattcttttttttcagagtcggaatgattccccatatggttaactttcttatcacgggcatcttcctgttttacatgttcagaatgtttcgagggttcggaggtgatctttcgaattattcacatcatactttctcaaaaacccaggaaaaaagcccggccaacgtggcggcggcggaggttttccggggatgggcaatctcttcggtgttgggcagtcgactgcacgggtcatcaacagagaggacgtgaaaacggcgtttgcggatgtggcggggtgtgaagaggcgaaaatcgaaatcatggaatttgtcaactttctgaagaaccccgcacaatacaaagcactgggcgcaaaaattcccaaggtcattttgttgattcattcgaattttcatcttaattagccatccttatcttctttttttgcagggtgctcttctgactggccctccgggcactggtaaaactcttctcgccaaagcaactgctggcgaagcaaatgtgccatttatcactgtgtccggttccgagtttttggagatgttcgtcggtgttgggcctagccgagttcgggacatgtttgaaatggcgcggaaaaaggcaccatgcattctgttcattgacgaaattgacgctgttggacggaaacggggcggaaagggcgccatgggaggccactccgagcaggagaacacactgaatcaattgctggtcgaaatggacggtcggagcggggatttgtactacgggcatagaaaaatcaccccttggcaaaacacaaattttcgcgagggggggacaaactgcaccctcttcgcattgggaggggtggactaattgtaagagagtttggagtgggggaatcgttaccaagtctatcctccgcgagggtgcaccccaaaatttcgccggccgaaatttcgccaaaaatattttttaatttggaaattttcaagaaaattcttagaaatttttatatggaaattccaaggaaaaattttggaaaaaaaaattttattggaaaaaaaaattttagcttatttcttgaaaaattgacccaaaattggtcttttttttgcccgctggctattcatccatccctttattggactgaatgccaaagttaagggttttcaactgatgaatcgaacgttgtggtcatcgctgccacaaaccgcgtggacattctcgaccccgcgttgatgcgtccgggccgatttgatcgacaaatattcatccccgttcccgacatcaaaggccgtgcttccatcttccgcgttcatttgacaccaatcaaaacaaccttggacaaaatcgagctttcccgcaaacttgctgcgcacacgcccggattttccggttgcgttagtcacatgtcaatttattactgtttcttttcaggcgcagacattgccaatgtttgcaatgaatcggcactaattgcggcccgaggttccttttttatggatgcgatttcaatctcgctcctctcctggagcattcccccgtagtcttcgaaatttttaaaaacaaacatttttcgtttttaatgttatttttttctatgaaaaatgtaaaaaaacttttagtttaggaaaacccctctaattgtaagaaaattagaaaatttgccgttgttttagatgcacacgatgaggtgacttccaaggactttgagaatgccatcgagcgggtcatcgccgggatggagaagaaaagtcaggtcctgcagccggacgagaagaaaacggtggcgtaccacgaggcgggccatgccgtggccgggtggtttttggagtttgccgacccattgttaaaggcaactacttattttccaaaactgatatcaattatttattttcccattgttttgggtgtcaatcattccgcgtggaaagggcctcggctacgcgcaatatatgcccaaggatcaatacctttactcgaaggagcagctgctggacagaatgtgcatgactttgggtgtgtaacctgtgaattttgtgtcacttaatagcgcttaaatttctaattttaggtggcagagtgtcagaggaaattttcttcgggcgaattaccactggcgcccaagacgatttacggaagatcacacagatcgcctactctcaggtgggcatttgcattagtaatcagttttaaatttcaccaataattaaaatcattgttgtttttgtcttacgttggtttcaggtggtcaaattcggaatgagcgagaaagtcggtccggtgtccttcgacactccggagcctggcgaaatggcattcgataagccctattcggaggctaccgctcagctgattgaccaggaggtgcgcgacatggtcagcgcggcactgcggcgaacgcgcgaacttttgatgtcgaaggtggaacagatcgaacgggttcgtgaaacaatcagaaataattaggagagaccataagcatttacaaaaacggagaaaaatttgaccttcgtataaaaaatcgggcccgagacacccccccccccctgtcccaatcgtccgttgtatggcccttgggctgagtcaccccttggcatgtatgattcatttttcttatttgtaggtcgctcttcgactgttggagaaggaaatcttggcaagggaggacatgatcga

SEQ ID NO: 71550 - DNA, 434 bp, Heterodera glycines
  Genomic contig location: Contig_ID=SeqID_43994; Location=365..798; Strand=+
  SCN-specific regions: Sequence locations=1-434
atgcgacgattcgtcaactcagccaaatgtcaacgattcgtcaactcaatgattcgtcaactcagccaaaatgcgacgattcgtcaactcagtcaaatgtcaacgattcgtcaactcaatgattcgtcaactcagccaaatgtcaacgattcgtcaactcaatgattcgtcaactcagccaaatgtcaacgattcgtcaactcaatgattcgtcaactcagccaaatgtcaacgattcgtcaactcaatgattcgtcaactcagccaaatgtcaacgattcgtcaactcaatgattcgtcaactcagccaaaatgcgacgattcgtcaactcagccaaatgtcaacgattcgtcaactcaatgattcgtcaactcagccaaaatgcgacgattcgtcaactcagccaaatgtcaacgattcgtcaactcaatga

SEQ ID NO: 71551 - DNA, 120 bp, Heterodera glycines
  Genomic contig location: Contig_ID=SeqID_43995; Location=939..1058; Strand=+
  SCN-specific regions: Sequence locations=1-120
tgtccgtttggggtactcaaacaattatggggagcaaaaatccaacgcagaattaagtacaggctataagggagctattcccgcaggattcagtctccccataaatctggggggcatcgg

SEQ ID NO: 71552 - DNA, 660 bp, Heterodera glycines
  Genomic contig location: Contig_ID=SeqID_43995; Location=94..753; Strand=+
  SCN-specific regions: Sequence locations=1-660
aaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaac

SEQ ID NO: 71553 - DNA, 921 bp, Heterodera glycines
  misc_feature (25)..(25): n is a, c, g, or t
  Genomic contig location: Contig_ID=SeqID_43996; Location=255..1175; Strand=-
  SCN-specific regions: Sequence locations=1-276,298-553,575-808,830-921
atgccaaaacaaaacgaaatcgttntaaaatattcctttctggacttgacttggtttcttgatatcgaagctgttttctacgctatttctaaaacggttataccaaacccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttctttatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaa

SEQ ID NO: 71554 - DNA, 392 bp, Heterodera glycines
  Genomic contig location: Contig_ID=SeqID_43998; Location=285..676; Strand=+
  SCN-specific regions: Sequence locations=1-61,83-149,179-392
atgctttccgtgctgttcgccggtgtcattgcgttctgtcgccagtcccgtaaaggtgccatcattttctctggccttggcttggtcatttttctcgtcacatggcttctcttttctgcggcatttccgctcactgtggtaaggccaacaaaaaattaatttaaaatttaaaaaaatagttggaaataatttttagcgggtattttgtaatcgtctatcggatttatgcatttaaaactgtaaaatttagttcatttaaaaaaattgctaaaattttaatgggaattactaaactttttttgaatttttagttacaaatttcaaatttctccaatgaactctcaactatttcacttggattttcaaaatttgtcaaaaaaaaactccaaaaa

SEQ ID NO: 71555 - DNA, 324 bp, Heterodera glycines
  Genomic contig location: Contig_ID=SeqID_43998; Location=896..1219; Strand=+
  SCN-specific regions: Sequence locations=1-46,68-324
atgcaggagccgaacacaagccctggggcaacatcaaaggcattggggtaattaattattaaaaaatactgtagtcggcttactgtcgggaatactgtgtttcccttgtcatggaaggcatggcggaattaattaattaaaataccgtatcctgggtattttcgtgaataccatatttcccctgccatttaatgaattttcagtgataaattagtgcccggggcactgccgctggcaatgattcgtcaacttagcatggaacagaatgaagctgaacacaaattggaggcactgcttgcacgtctgttcaacggttcagcggag

SEQ ID NO: 71556 - DNA, 916 bp, Heterodera glycines
  Genomic contig location: Contig_ID=SeqID_9474; Location=12..927; Strand=+
  SCN-specific regions: Sequence locations=1-454,476-523,545-769,791 -858,880-916
atgaatgccatcagcggattggacctgccatatacgcgcatggaaatgtttgctgctgccactaaaccacttatcggaacccagggaattgtcgaaaatttgagcgcattggctgactttgatttgagcaaggtttggaaaatcacgatagcatttaatctttctttaattttagctgcagtttccatctgaagcgaattcaaatgacccgaaccaaggggcgaacatcttttcccgacagtacattgaggaatggtttcgttacagcgccagaaatgtgctcaaattaaattacgaccagtcaagcgcggataacaaagcaacggctgcgaattattcatctattgaaacgcaacaacagcaactttattcgacaacagcgtccgtaggaacaaacgagcaggaggtcacaaaattggaactgtttggttggtaaataaatggatattttcttcagatccagttcagcgaagctgccgctcttggagttatccaattaaactgtcttaatgctcgtaacattcagcagaaagtggcagagtttgtggaaacattggaatcccatcccaatttgtaattgttttatttttttcaaatgaatacgatcaatttcagtcgtgaccttcggacttgcattgaccgcctcctttcattgagcgctgatgatgagaattttacgaatcctgaggacactgtttcggttgtcagtgtcagcgaaacttccgtcagaggtgcatttgagggaccagtttatcccccctccctccaaagaatttaagcatttttatttattactacattttgggaaggggcagttcaccctctccatacaaaaaataggggggggggtcggggtggatttaatataattctgtatatatgatctgagcacgtaacaacatgttcctgttcagca

SEQ ID NO: 71557 - DNA, 1329 bp, Heterodera glycines
  Genomic contig location: Contig_ID=SeqID_9475; Location=530..1858; Strand=+
  SCN-specific regions: Sequence locations=1-41,63-281,309-1329
atggacaatgaaaagatttttaggaaggcatcagcggaccaagaaataatcaaaaagaatatcggagaatgggagagcaaacgggaggaagtcacgtcattgattgcccaagcgaagaatgacttctctggccatattcaatcgataaagaatgggaaacagctctcacaattgccaaaaatccaagtgccaaaaccgccgcccggaccaaaaatcatgccattggcacccattcaaccccactcgtcgtctacttcactggttaacaaaataaatgcagtaattgcttttctttataattgtataaatttcacgaaattcagcttcaaaacaatggcgggggagcaccgcaacaaatgccaccctcaccgcttccattggaccgtaaagtcattactccgcctgggcggtctcacattggtgcttccgctccacaacagcagggccttgccggcgcgggacttggccaggtgcgaattgcctccctaaactccccattggtgagcaaatgaacttaccattttcttgcttgggaaggggtggttattgttttactgaatactttctttttttaagaatccgaacatgaccaacgccgcttccgccggtcgccagtccatttcgtcttcggccaacgttactccggtcaaattccacagtcaaccgactgcgattgctgcactttcgcaaccgccgcctcaggcacaccctcctggacattttactacaattgcgccgattggtgtccgtccgcaaaattaccaaaatggcatcaccgttccgtccgcatcatcttcctcgacaacgattcaacatcagaaaatgagtggagcacaacgtcattctcctcagctgagtggagcctcaatgattggcggggctcaattccatgccaacgcccctccgcctccaatacaacaattccatgtggttggaaattcattgtcttcggttgggcagcctaatgccaccttgcaacaaaaacagcagcaggcaaacgctggtggtggtggctcatttcaaacatggggcggtggatggggtgatcagctcaacaacatcagcgagttgttcggtcaggggaggtcgtttggtccgttgggcagtgaatttggcggcagtggtgggggtgtcgtcgatggaatgcgctcggccagtgtcatccatccgccagctgccggcgtgatcggtgcgccctcttcgacggtttcgaccgggaacaatgtcagcagcaacaatcccccgtcttcgcaaccgatcggtgctggccgcaatttgcagaatatgtcaccttcacagcagcgcaacggatggccatcttttggatag

SEQ ID NO: 71558 - DNA, 804 bp, Heterodera glycines
  Genomic contig location: Contig_ID=SeqID_9475; Location=2166..2969; Strand=-
  SCN-specific regions: Sequence locations=1-804
atgcctccctccgtgaaaggctatgatgaacaaattgatggcccgctcaaaacttttttggatttgtccaagaaaattggcggcgatgtggccacaatggtttgttttttgtctttgattttttggtaatactaccgatggtaggaccccttttttgaaaaaaatatttaactttttaaaagtcactgaaaatatttttctaagggttttcggggtcgctgaacacgaatctgacattcatttgaccaatttcgaatcccggacccgaattcgaacaaaaaatcgaaaatctaaaattttcaaaattctcaattttgttcctaaacgaataaaacatgcaaaatttagtctaaaactattctaacaattaaaataattcattctatgtaggatctaacgaaattgagaattttgaaaattttagattttcgactttttgttcgagttcggatccgggtttcgaaattggtcaaatgaatgtcagattcgagttcagcgaccccgaaaacctttagaaaaatattttcagtgacttttaaagttaaaatatttttttcaaaaaggggtcctaccatcggtagtattaccctctattcttccgccgatctcttttatccaaatgaaatcgctaggctccaaccacacatttcttttccttttttcctctttttttttgttgtattctgacgtttcatcaccgaatgtatttctccgtctttcccctctccccttcttttcccacatatccctcaagggaaaccacccaaattcatcattttttgagtatacaaaaaagcaaataaa

SEQ ID NO: 71559 - DNA, 1142 bp, Heterodera glycines
  misc_feature (1107)..(1107): n is a, c, g, or t
  Genomic contig location: Contig_ID=SeqID_9477; Location=14..1155; Strand=-
  SCN-specific regions: Sequence locations=1-662,685-1142
atgctcctctattatttagccgccatcttcaaagggcttcatcctcgggtagacgatgattttgtggataaattgaattaccattacacatccgccattattttcgcgtttgccataattgtctctgccaagcaatacgtcggtcggtgcgctttggcattttgccaatactttggcccattccctcccccccccccctttaggatatcccattcagtgttgggtgcccgcgcagttcaccgatgcctgggaacagtacacggagaattattgttgggtggagaatgtgagtaacccgggccaaccaaccactgatcaatcagtcccaaatttagacttactatttgcctttgaccaacgcttttccgttggactacggcgacagacggtaaatgcgcctttggggccgaccgatccattggctgatcaatcgtagcaaaaatgctttacctaaaggtacagggcgcgtcagatctcttattaccaatgggtgccttttgtgttggcgttggaggctctgatgttttacattccgtgcataatgtggcgcggccttctccattggcacagcggttggtcaagcattgcatttcacaactcagaaatgccaactctcggccacttttgcaggaatcaacgtccaaaatctcactcaaatggcatgcgatgcgcggatgatggatgtgaggagaggggtgggcaggtgaattgactgggatgagtgatcggccaaatcaggtggacgcacggcatgccacagtcaggacaattgcaggacacatggaggacacgttggaactgcagcgagaggtcggccaatggcgggggaagtgatcatacagttgttgattgatcgatcaatgggatggggggaggtgatcacacagtgatcgatcgatcagtggccaatgttggatagggggaaggcgggggggatgtccaatttgccatccccttaaatgatgggtcagctagctgatcagtgctttcttatcaattgtcctaccattattttatctctttccccttcccttttttttagatttacgacgtgtccaatttttgcatgggccgtcgttggagttcttacgtcacttttctttatgntgtcatcaaaatgctttacctgggcaatgtcatga

SEQ ID NO: 71560 - DNA, 644 bp, Heterodera glycines
  Genomic contig location: Contig_ID=SeqID_44003; Location=157..800; Strand=-
  SCN-specific regions: Sequence locations=1-566,591-644
  Gene Ontology: Mol. function=protein transporter activity; Cellular component=clathrin adaptor; Biological process=neurotransmitter secretion
atgatcaattacatgctgctgttctcgcgccagggcaagctccgtctgcagaagtggtacgtcgcatatccggacaaggtgggcaacacacacagcgggagcagaccattgacagtggggtcgggagcggttaattgcttagatggctgctctcacattggatttgactactaattgtttgtgatggcaaaattgcactagcccgttgtgattaattatctgattgtttagtttaatttttgtcccggtttatttagagattaaacaagtggtgagcggcacggtaaaatttaccggccttttttgtgaccggtagatttaccgaccgactatctctgaaaaaccggttgtttttaccgttaccggaaaaatgcatttgccgttcaatattagctagcatactttagctcttacaaaattgttaaaaaagactgcattttcaggcaaaaaagaaaatcacccgtgagttggtaaccaccattttgtcacggaagcccaaaatgtgcgcattcctcgagtataaggacacgaaagttgtgtacaaacggtgtgccatattgaaaaccaattttaaataaataatttaatttctcagttacgcttcgctttacttttgctgcgccattgagcagacggacaatgag

SEQ ID NO: 71561 - DNA, 913 bp, Heterodera glycines
  Genomic contig location: Contig_ID=SeqID_44005; Location=57..969; Strand=-
  SCN-specific regions: Sequence locations=1-195,217-352,374-385,428 -488,526-596,698-846,884-913
gctttcaccttcaatccgactcaaagctcaagcggaaacggcgacggaagcccaaaagaatttggcgctgccggcacaacatcgccaccacaaagtgccggcctcgttaaacaccattcgtccaccaattgcaacggtaataaataaaatgggtaattaagatggacatttaaaaaattcaattttgcattttaagggcgtttaagcagcgattcgcgcccttcctccccgccggcggaagcctgcacggaaaagcagcagcacaaaattgcagcaaaagttgcaggacaatcggcgggtgatggtgaagatgatcagggagaggaagaacacgtgtgcagccttcagttcatcaactcaccggcgatcagaaggggtgggtcagaaaaattcttaaaaatttaatttttttttgtaaaaataatttgaagcatgtcgttcccccccccccccccctcgtcatttccacccgctcatttcttccctcgaaaattaaaaaaaaaattcttaataattttttaaaaagaacttaaaaaaagatttagcgttatttatgatgcattacagtttttttcagtccaaaaaatcgctgatacatttttaatttattttttttgaatttttctcataaaaattttttaagattttttcttgaaaaatttaaaatttaaaaatccaaaaatctaatttttcaaaaaatttagtgccaaaattgggcttgtgcctttggcttggcacttccgctggcgccgttgtggccttccaactccaagtgccaacaaatcgtaccggtgcttcgcttacggtcactccgtcgggtagggaccaatattttgttgattttccaaattttcaatttttataaaattaaaaatttaaatttgtgttacagcaatgtttaatgggccaaaag

SEQ ID NO: 71562 - DNA, 65 bp, Heterodera glycines; identical to SEQ ID NO: 54797
  Genomic contig location: Contig_ID=SeqID_44006; Location=482..546; Strand=+
  SCN-specific regions: Sequence locations=1-65

SEQ ID NO: 71563 - DNA, 353 bp, Heterodera glycines
  Genomic contig location: Contig_ID=SeqID_44008; Location=560..912; Strand=-
  SCN-specific regions: Sequence locations=1-353
acacgccgtccacaccattcaatcaaaaccaaccaaatccccactcattagctcattatgaaatttgcccctctggctttgcttgtgatccttttggtaggcacttttataagcattcattgaacaccggtcaaaagtgccatgcttcaggtgtctttggtcgctgccgtctctgctaattccaacaacccttttgatgcggacgcggccgacaacggtggcatggtgcgccatgctttggcttctaatttccgtttttggcatttttgcctttgactcattaagaagcgcgtcaaacggcagcaacagcaatggcgttggagtccgcaacagcagcgctgggtgccaataaa

SEQ ID NO: 71564 - DNA, 897 bp, Heterodera glycines
  Genomic contig location: Contig_ID=SeqID_9478; Location=2474..3370; Strand=-
  SCN-specific regions: Sequence locations=1-96,132-212,242-480,655 -656,689-791,828-897
atggcaacagcccccgcggcattgtccggccatcgtttgacacccaattttatgtttccgcccactgcttccagtacgccaattcaacgcgatccgtaattttattttttatgaaaaaattaaaaaaaaatgttttctcttggtatgttatgttcatttctcatcataattgccatatttgtatggacaaataaaatcgcaaaatttttagggatgaaattttgaaaattttaagtttttcaatccttatgagatacatttttccacaaaaaatattgaataaaaacccctacaaacatcagtccatccctactcatttctatcccaaattttcttgttttatttaaaaaaacaacaaaaatactgtatttggattattgtaatttaccttcattaattatttgtaattcaatttaaatcctattgtcctgattcactgtcgcattttctaaggaccaaaagtttacattattaaaaaaaaatttaatttaattcattttcaatttttattttatttcccaaatttttataatataaaaaaattaatttcaatttcaatttaatttttctttttcttttttgtttttacttctaaattttacataatattaattatattacaattttatattatttttttttccaattttacttacaaaattaaattaaatttcaatttattttatttgcaggtcaatggactttgagcacccggtgtttatgcaaaatcaattgccgatgacaaatgccaagcagcgcatgcccaactacatgaagcagcaaccaaatgtacagcaacaacaacaacaacagcagcaccaccaacagacgagcagcgacgactttgaccgggcagtggccgattcaatgcctgagttgcacaacagaagctttcag

SEQ ID NO: 71565 - DNA, 132 bp, Heterodera glycines
  Genomic contig location: Contig_ID=SeqID_9478; Location=5705..5836; Strand=+
  SCN-specific regions: Sequence locations=1-42,74-132
atgcagaggctcggtcagtgttgcataactaaatgcattgacaaaatttaattcaaataaatttttaaattatcagaaaattttcggcatggatcactttgtcctcatatggcacaattattatgtgcatag

SEQ ID NO: 71566 - DNA, 113 bp, Heterodera glycines
  Genomic contig location: Contig_ID=SeqID_44013; Location=1..113; Strand=-
  SCN-specific regions: Sequence locations=1-113
ggattatttttcaaaacacctcgtagacagactggggaataattggagactgcgggattaatagagactgggctataattagagcatatacggtaattaaacatccattaggt

SEQ ID NO: 71567 - DNA, 53 bp, Heterodera glycines
  Genomic contig location: Contig_ID=SeqID_44013; Location=248..300; Strand=-
  SCN-specific regions: Sequence locations=1-53
ccaaattttcaattttaggacttccaggcgccttcttaaggtgctgattgacc

SEQ ID NO: 71568 - DNA, 431 bp, Heterodera glycines
  misc_feature (71)..(71): n is a, c, g, or t
  Genomic contig location: Contig_ID=SeqID_44014; Location=51..481; Strand=-
  SCN-specific regions: Sequence locations=1-107,134-263,294-322,347 -405,427-431
atggagaaggcctgcaaaatttggagagattatatcgattttagtgcgctaggttcgatgaaactttttanaatataagcctaaactttttggcctgtttaaaaaggaattaaaaatttttaaaaattttattcatctcccttttgatagaaaaagcatcagagagccttatttaacttttaattaacatttggtgcgtttcaaagcagtttctgaaaaaatatttatgaatggattttgctaaaaaaataaaatagtgaagcttttaaaaattaataaaaaattttaaaattcagaaatacttggagttagcatcatagcagtgctttttctttgtctttttgatgctctccgcaaaatctggttcgcttctgaccagttataaaaaaaaagtaaacctaaaatttttcccatatttaaaaagcaataaa

SEQ ID NO: 71569 - DNA, 155 bp, Heterodera glycines
  Genomic contig location: Contig_ID=SeqID_44014; Location=1235..1389; Strand=-
  SCN-specific regions: Sequence locations=1-31,58-155
aagcctaaactttttggcctgtttaaaaaggaattaaaaatttttaaaaattttattcatctcccttttgatagaaaaagcatcagagagccttatttaacttttaattaacatttggtgcgtttcagagcagtttctgaaaaaatatttatgaa

SEQ ID NO: 71570 - DNA, 81 bp, Heterodera glycines; identical to SEQ ID NO: 58971
  Genomic contig location: Contig_ID=SeqID_44017; Location=1679..1759; Strand=+
  SCN-specific regions: Sequence locations=1-13,47-81

SEQ ID NO: 71571 - DNA, 923 bp, Heterodera glycines
  Genomic contig location: Contig_ID=SeqID_44020; Location=219..1141; Strand=-
  SCN-specific regions: Sequence locations=1-165,187-514,535-577,599 -836,859-923
atggtcgttcagtgtgtcgtagttgtcccagtcttccgctctcgcctcagccgactgctggttcgtgttgaagttgttgcggcctcgtttggcctaaaaagccaaaacattattgtatgtgaagcacataaaaaacaatcaaaatgatgacgatgatgtcatgcgaaaatatagctaaaaagtatcgttttcttttttttgattggtaccactcccttcaatacctcgtccacccgtttttcaaaaaaaaaaaaaatttttggtgcaaaatctattttaaaaaagtaaaaatttcagattttttcaggcggcgacgtaccccttgcgttccccagaattttgttccaaaagtgcatcgcaaaaaaaggactggaaaagcaaaaaaaaaaaaaaaaaatcgtcgcccgggtgtggtaccccgtccaagccgaaatcctgggaccgtccctgggaaatgactgtcagaaatttagggtggtctcctctttgggaaacagaaataatgtccaagagaatatatatatatatatatattacacatacgtattccagtgcaatgtacacctgtgtgaaaggaaaaatgggaaaattggatggacaaatatttaaaatgcaaatgaaaattaaagtccaactgaccggcgcagggagagaaatggacgaagagacaatttggtgtccaaaacagagggcctttaaaaagaaatggccaaatcaatcaaacatttatttggacatacgaatgtgaactgttggattttgtccattgaatattcgttgtcgtccaccaaaatggcgtagcgcggcacgcgagcagttccctgggggaaagcgcaatttaatttaatttgatttaaaaccccaaaaatggtgtatacatcatttcaagacagtcctttattcagaaaaaaaacataaataaa

SEQ ID NO: 71572 - DNA, 452 bp, Heterodera glycines
  Genomic contig location: Contig_ID=SeqID_44021; Location=22..473; Strand=-
  SCN-specific regions: Sequence locations=1-38,60-285,308-452
gctcttggtcaacttgggcttgcacgaacggcgtatgagactgccatctctttccaaccggggcacatcgacgcacggattaacctctcaacaattcttcagcaattggaccagtccgaacttgcactcgaaaccctcaaagacctcaactatgattcttgctcccacatccctgtaaagccgtgcccattctttcccacccctcccaatatacaaggcgtagtctagccatgaaactttttttgctagttggtctaatttaacctaaaaatattaaaattccagaaaaattaaattttattttaatgaagcacgggaagtgaccttctccgactgtacatcctttctttttatcccgttgaaaataatgcactgaatgcttttttattttaggatgaacggcttctttgtcgtcaagcggaggtgcttttggagcaacggaaggccgacca

SEQ ID NO: 71573 - DNA, 1401 bp, Heterodera glycines
  Genomic contig location: Contig_ID=SeqID_1284; Location=126..1526; Strand=-
  SCN-specific regions: Sequence locations=1-154,179-664,715-1082,1104 -1153,1175-1299,1326-1401
atgactcatcactcgccgtcctttttggacattcgaacacggaacgaacttttggcacatcgtctcgcactttgtgaccgagaagatgaaattctgagacacttctacacatttatgagcccaaatgaacgtcgtccaatggaaaatcaacaatttaatgctcaattagaagatgaaattgaggcggaaccaatcgacctaaatttggcaattatttcttatggacgccaatttaacaaaagtcagaggggacagcaagagggactcagcggtgatcaggtggcacaaagcagaggcgaatcaatgcccgttaataagggtcatttgcttgattaggttgagaaggcaattacggcattggcatggcttcatgcttcgtccatgggatcgcctcaatttttcgggccaaattctgtccttccgcacttttctcagccaaaacatgaaaaatgttttgtgaatcgaattaattattaataaggaaatttctcaaggaattagccattaaaaattggcttcttaatctgctgctgacacttccaaattgcgaatattttcgaaaaaatgaaccaccgttgcgcaactttcttcaaaacgtcaaatttgaattgattgatgagaaagaaaaaacaaacgcagaaaaaggcgagataaaaagaaattgaatttaaataaaagattttaatcaaatattaataattaatattttttattctcatagatttgccaattgttttatgccatggcaatttttgtggcgataatattattatctgcccaaaaggcgaaacacagcacagagaaggggtgccatcttctgacaattggccaaacattcgcggctgggaattggcttatttaggtaataaaatgtcattagatttatttagaatattaaaatttgtccactgaactcctttaggttaattaatttgtttattaactctttagggtatggcatttccgatttggcacatcttctgttgtccagcgtcaactcgagcttgcgcattcactttctggaccaatgggtcgcactttacgtgcacaaatttgagcaatttcgccaaattcagcgaaacggaaaaggaggaggaaacacaatgccaaaagttttcgccaagttggaaaaaacatgaaaatgctattgagaaataaaatatttagcaaaaataaattggaacgcatcgtaaaacgacaaaagcaacaattccaagcatcgcttcccggccaattcctccgagttttgcccaaattagcgactgattatcgaaagttggccgaagcgaaagcaaatccgatggaaagtgaacaaaaccaatggaaagggtgcgaattgctgggccgaatgatcggaggatttgaaatgatccgtaaggatttcgaacgaagaaaatcgat

SEQ ID NO: 71574 - DNA, 2584 bp, Heterodera glycines
  Genomic contig location: Contig_ID=SeqID_1285; Location=458..3041; Strand=+
  SCN-specific regions: Sequence locations=1-879,913-1361,1383 -1425,1448-2003,2025-2197,2222-2325,2375-2584
atgccttcaaattcgacgcctttcgatgagggaaaacaaaaaatggcagagaaaaagtaacaaaaagcaattacataaatgttcaaaataacatcctaattaaatatttaattgcttttttgaaattaaagcaaaagcattccgtcgtcgtcgtccatttcgaaatttgcccctttttcttcgtctgctgctgctgaaattccccccgaaattgccgcactttctcaactttcgatcagtgattctccgaaagagccttcggtcgtcgtcgccgccaattggactttgtggcgttacgaatgccgcgatttgccggagcacagatgccaagcgaagccgtgccaattctgcgtataattgggggggggggggagaagcatttaatgaatctatttttgaaaaggctttaggagcaagtgagcaaattgaaaggggtggccaaagggaaactcagcgaaagcaccgaccgatgggacagttatttgaagcgggaaaagagctacgatgacgagcacattctgatcaaagtgatggaaggcttttcgcccagcaaattggcaaaggacgtgtgtaagtcacgtcgtcccattatatcccaccattttagcggctaattggcataattgaatttagtctttaacaaaaaattgggcgtcgcattattccgtggggacattgagccgaaaagtgaaagtgccgaaaacgccaacggcatcgtctttcaattgcttctcctcgccacttccgggcgcagaagtgccgcactcgtcagcaaatttgacacaatcttttcgcaaacgcttcgcctgacgctcgatctgccgagttcagtcgggcgccatgtcaacggcattttcttacggtgatttggcgattaagatattttaaaaataataattcaaaaatataaaacaggtgcgagatgaacccgggcaaaaacttggaaaaagaagcaaatgcctatggaaacctgatggatttgccgttcatggcaaagattgaggtggacgaaatgcatacgatagcattcactttgtgatactgtaccaattgaaggtgtggatcagagacagagccgacaaagcattggtgtgggaaaaactgatcacgaagattcaagcgaaggtggacgaattggcacttccgtccaccgcttgtcgaaacttctttccgatgaatcgactcgaaaattgggcgaagaaaaaaggggtcattattagcaattaattaaaaagcgatagagtaaaaaggcgggttaatgtgttcgtctgctcttttggtgacggacggaggacaaaaagttggaaaatcgggtttcagggaagagacggcggggcacagaatttgtccgcacctcgcggaggcaatggcattttggtatttgggctaaacggagaagcgcgagagttggacgaggaggaggagaacgaatgggcgggagggattttcgaatatccgccgataacggcaccgatcgccggaagaggcaaaaagaaaggcgccaaacagaggaaaaaatggcacttctaacaaattaactccccacaattttggcaatttccacaatcgctatttggcagcctttctcaacattatcaggaaacttaccagcaatcattcattttttgatcaattcaaacccagacttatttccgatcagacttgtaatcagagagggaaacggaatttagagaaaggaaaacttttgactccgatggaccaccaatctcctaagatttttctaagatttaaaacaaaagtcctcataatttagtcattttttggaaaataatattgtaaaaaattgggccgacgagcaaaaaaaaggcccacagattgccaagccgaaattattttcttattacgggtctttccaattcttattttgaaaaaacattctcattttgtcatcatttcttgtttaaaatccgtctttttgctcactttttctcccaattctcaaatgtcccttttctccactgtttgttattaacgtttaattgttttttatttctcttcatctttctccatttcaaaattaatcatttcttcgaattcggtgttcgcaatttttgggtcgtttagaacattttatttattttccctattaattttcgcaacttctcactttatacatatttttaaattcttttttttaatttccagaaattcgttggaactgctcaattcggaatcaaaaagcccttccgaaaggtgtgggaattccaagttcttctgatgggtatttattggacaattcatccattttcagaatcacattgttgaacaccgaaacgaaaactgaactaattattcatttgacagatttaatttatttttaaatgttgaaatttttcttttgaaaattaatattcgtattagagaccggacgagggatctcgcgggattaaattcgggacccgaccttgggagccatctcgagccttttttaaattcattgagattgatcgggatttcatcggcatcctaacttgggtccctctcgaccatcgccaatcccgcggattggagtcaaaattttacgacaattttcattttcttattaagatcttgcaacactaaa

SEQ ID NO: 71575 - DNA, 1428 bp, Heterodera glycines
  Genomic contig location: Contig_ID=SeqID_1285; Location=3683..5110; Strand=+
  SCN-specific regions: Sequence locations=1-82,107-648,671-982,1004 -1053,1076-1355,1377-1428
  Gene Ontology: Mol. function=nucleoside-diphosphate kinase activity; Cellular component=cytosol; Biological process=DNA metabolism
atgtcaaaaaaaaatatcttaaatgggactgagattggcgagatcagtcgatttcgactggtaggataaagtaaatttccgcaaaaattggaaaaaagggatttttggccgagctactgacaacggacgagcctatccgaccctcggcatgcttttcctcaactaaagacagtcgcgccccggccgaggggttaaaatgccgcccatttggaaaagttaaagcaataattttgctattatcgattccctttcatttgtccattctttcgtttttaatttggtactttgttcacaatcttttgtgtgcaaattcggtcccaattggtggcagtttgtgtttgccctcccccattttccataaaccacccaaatttgtccacgacatctgacattaacggcgttcatttgcctcggcccaatttcgtcgtcccatttctcgatgtcaccgataggttgatcaccactttccaatccttatcagcactgaattcctttctcattagtggaaaaatcataaggccgaagttaattgagttaattgccgttggtcggctcatcagaaagtggggcttatcgtttaattatcgcgtttggatatgttgggcccaagaacagtcaaatgacatcagatgagcaagtatttggcaattttgggcctttttaaggggccgaatggaacgggtggcattcattcactcattttgaaacaaagccacccatttaccaattacacctttcaccttctactcccaccaagtccaaaaaccaaaaacaagtcatggaacgcactttcgtctgcattaaacccgaatccgtccgaaggtgcctcgtaggaaagatcattgaacgctttgaagccaacggctttcggctaattgccataaaaatggtacaaatttatggtgtcttttagctgcttattctcatttttcagatcgttgcaactcgcaaacaagcgatggaccattacgtcgcttgtgccggccaaccctttttccccaaagtgatcagttatatgacctcgggtccggtggtggcaatgatctgggaaggtaataaaaaccaatatgaaaaacaaactcagctgtttttgattgccttttcaggtgtcggtgttgtgagaggaatccgcaaaattttgggtgccacccccgacaaagttcctccgcccggcaccctccgtgccgattaccgtaacaacagcgacgtgggcaaataccatgacacggtttgccacggatcggactccgcggaggacgcacagcgcgagtttggcatttggttcgacaaaagtgagatgccggcacctctctcgagggtatcgggctgatgtgatgggccgaccgatcgaacagaaatggacaaaatatttgcaaattcgaaatgctattcattgtttttttgtaattattttttaaagaatattaa

SEQ ID NO: 71576 - DNA, 375 bp, Heterodera glycines
  Genomic contig location: Contig_ID=SeqID_1286; Location=2356..2730; Strand=-
  SCN-specific regions: Sequence locations=1-253,293-375
atggcctctgagccatgggtaagcaaaggaaaatcagattattatctaatattattattcaaatttagccacgggttggataagttgagtatgcgaattttcatttgatttcaggagcagcaagccaagctaagcgaaaagtactacccgaacacgccaatgctccattacctcgtcaaaatgctgaaactgcacggcctgtacttcgacgagcatctcgtttggcgcgaagttcaggtgaaatgtgatgggcaaaaagaagtttattttctcatacaaaagaattattttcagaatgaaattcgtatttcaaagggtaaaatcatttacccgccaatcggtgcaggaaaacagaagatgaaagccaaaatataa

SEQ ID NO: 71577 - DNA, 254 bp, Heterodera glycines
  Genomic contig location: Contig_ID=SeqID_1287; Location=72..325; Strand=+
  SCN-specific regions: Sequence locations=1-254
atggcaccggcaactcagctcccacagacaaatgccccgactcccgttgtcgaagatggaccaaaccagaagaagaccagtgatgacattcccaaacaaccggaggtttttgacgaaacaatcctcgtctgttatgaagcactaaactcatttccacccaccgacaaaattgttcaccaaattcaatcgctcaaaaaacaataccctcatcttttcaacaaatagttctaccagacctccaacaatttcttcaa

SEQ ID NO: 71578 - DNA, 1647 bp, Heterodera glycines
  Genomic contig location: Contig_ID=SeqID_9481; Location=748..2394; Strand=-
  SCN-specific regions: Sequence locations=1-39,61-412,455-921,994 -1106,1128-1516,1538-1647
atgagcacgatcaaggaaaaagcgcactcgcaagcaatggagaagtgggagaaggagaaggcccacggcacagtgcgggaacaaatgcagaaaaaaattgagaggaacagtttccggattcggaaccgtgggagtatggcggtgattacgacgatggactcgtgagaattgccaattggccttccgaatttaatccgttttttaaaggcccacagagtttgacacaatcaccgaatatatttccgaacaaattgttgtgctgaatgagagaaatcgaacttcaacgaaaaaaaagttgccaaattttttgcaccgatcaaattgttttctgcactttttcagttctgtgcttatcgatcaaattcatttgtttgtgttgaacatagcaacggaatccagcaaaatgttttccaaggaaaaggtgaaaataaattttcaaaaatgagtttaaaaatgtttagcatcgttccaatttccatgcgcggctcatttctgtcagtgccgggccggcttctgttgtcggcatgcacaaaattttgcaggacatttacggacttgtgtcgacaacggtctgcggaataccaatgaagttgagtaaagggagttaatgacagcggtgaccattcttataccattttttgtgttgattaggatgtaatttaccgtttattgtacaaatggttgccgacatttcaggaagaggcccaatccggacagtccatcaattacgacgtcgaaatgctccacccacgctccgctcacttcgccctcacctcactcggccttttaatgggtgagaccaaaatgctggacagcgccagcgcccacgagaatctgttcacctccgtacggctcaaatggtgcaccgcctcgccgaaactgaagtcggacaaagtgcgaatatcctttgtcgtttttcccctctctctctcgctctctctctctcttccgtctctgggctttctccctttctctctcctctctgtccctctcggctttctctcatcccctttcttcattcagttcccaattcttcaacgctcttttcccattacgcctgcccacgtgtctctccgtcagtccgtttgtctgacctccttcataaccaatggcaaatcagtgctgttggaagtgttcccagacgtttaccaagggcgtgccgagcattgcaaattgagcccaaatttgcatcaaaaactcatttcccattatctgtcgcgcgatgtgaacggcgcccttcttttgcattgtgtggcgatgggaaagaagggtttcacccactcacttttgactgattattccaatttggcaaagctttcagcaaattttggcggaaaactcagcagtgaaaatgtttatggcccgaagggaagttcagcggaattggccaatggactgaaccgaacggcgatggcacaactcatccaagccgctcaaattgtgccgtgtccaaacgaacagtttgagctggtcgatgacgagagcgattgtgacgacggggaggaaaggaacagcggggaagaagggactgaaaaagcgaggtgccaaacagtcgaccaaatttggcagaatttgcttgttcagcgtgagactttcgctgttggggacattgaaaaggaaacggcggcggagagagcgccaaaatga

SEQ ID NO: 71579 - DNA, 890 bp, Heterodera glycines
  Genomic contig location: Contig_ID=SeqID_44022; Location=1..890; Strand=-
  SCN-specific regions: Sequence locations=1-89,111-156,179-331,361 -384,412-837,859-890
  Gene Ontology: Mol. function=phospholipase C activity; Biological process=intracellular signaling cascade
ttggatctcattgcgcttaatgcgggtgatgccaatgtgtgggtcaccggattaatggcattggccagcggaacggtgcccggcaccaatggcaccaccgcgagcggaagcatctcaccagtgccgccaaatttgcgtgagagatggttggccacggcatttcgggaggctgacgcggacaaaaagggaacaatcagcgaaaaagcggcgatgcgactgatccgatctctgaacacgcgactattgacaaatcgaatcagcaaaaaaatgaaggtccgcaaatttcggaacaaatattgggagaccgaaacggcgaaatgccaatatttttcaaaaagcggcattttgaaaacaaaagttggcaaaatttaggaaattgggacgagcgcggcacagcagcagcagaacaacggcggggaagcgcaactgcagcaaaagggacgcttagacgaggcgcaattcatcgaagcttacaaagacatgtccacacggcccgaaatttactttttgatggtacgctacgccaacaaagactatttgaacacaaatgtgagttgatttgaccatcctcaccatctaaacattctgctgactttgacaggacctgcaactgttcctggagactgagcagggcctttccggcgtcggcgtcgatttttgcgagaatctcatcgatcagtgcgaaccatccgcggaagcacgggagctgaatgtgatgacggtcggttggacggtgatcactctgagcaaagggaaagggcactccttttgaaacggcatttccaaccaatcgtttcacttagcaattgctgtttagcattccaattccgatcaccactttaaaatgcatttcccaatccaatcggttcatcccaaccattcttcgttgt

SEQ ID NO: 71580 - DNA, 1176 bp, Heterodera glycines
  Genomic contig location: Contig_ID=SeqID_44024; Location=1..1176; Strand=-
  SCN-specific regions: Sequence locations=1-26,48-114,136-240,262 -580,604-750,772-779,811-1176
  Gene Ontology: Mol. function=protein binding
ttaattccctagaaattcattggtctgtctttattaggatgattttccaggtcgttgtcctcctcatggacacacaaggcattttcgacagtgtcagcactttcaaaaattgcgccaccgttttcgcgttgtccacgatggtttcctctgttcaggttttaaactgaaaagaatttttgaataaaatttaaggaattccatccgttttccattcatttgcttcccagattttcaacatcaacaagaacatccaggaggaccatctgcagcacttgcaactgttcacagagtacgcccgactggcgctggacgaggacaaaaagagcaaaccgttccaggcaatgctcttttttgttggttgaccctttctctcatcaatttcagtcgcttttgttccttgtccgtgactggagtgtgcctcatgtcgcggagtacggctcaatcggtggccaacgcattcttgacaaacgattggaggtactcaatttgactagtatataaaatcggatgcgtaaacggatgtactacatccccaggatcagttcccccgtattttattcacggcttgtcgatggatttgttaaaaaatatgtttaattttgccaggttacgtcccgtcaacacccggaacttcggcagctgcgccgtcacattcgctcgtctttcgacaacattcgctgctttttgatgcctcaccccggccgctacgttgccacaaatccacactaccgaggcgaacttgacagtgtgtttattgttttatctttttgtctgtccactgaattcaaagcattttggttttccctttaggaatggaactcgacttcaaggcacagctcagttcacttgcgaactatgtgttctaccccaacaatttggtcgtcaaacaaattggcggtcagcccatcacttgccgagagcttgccggctacataaatgtgccctttttcgcgtcgaattgaaatatttaagttcaaatttttaggcttatttcgaggtgttcagcaaggctgaaatgcccgaaccgaagacaattctaaatgtaagcattttgatgctttccctccttatgaatgccaattgcttttatttttattaggccaccgctgaagccaatcatctcgcggccgtggtgagagcaaaagcggtgtatatgagggagatggaagaagtgag

SEQ ID NO: 71581 - DNA, 774 bp, Heterodera glycines
  Genomic contig location: Contig_ID=SeqID_44026; Location=49..822; Strand=-
  SCN-specific regions: Sequence locations=1-301,323-417,439-613,639-774
atggaagaggaagcccaaaaggacatcgaagagcgcgacgcactgtccaaaaggataagggaaagggagaagcacaacacgcggcacgtcatgtcaaagtcggaagcgaggagcaaagcggaggcgacgaaacgcctgaacatttcagaaaaggacgacgaagccaacgatatgatgggcaaattgagatacgaaagtcggaagagttatttggcgaagcgcaaggaggacaaacgcatggaattggaggcgaaggttcacgatgatgagactatttttgcgaatgaaaagtaagtgcaattcaacaaataatttatttatgggtgcatttctactcattaaaaaaatctaggttttatttcgaacgaatgacaaaataattaaatgaaaaggacatattttccattttactaaaacataagtgaaattttaataagtttcaaactcaattttcaggcttaccaaacgagagcaattggatgccaagtacagaaaggaagtgcttcactatgtgaagcaatatgacgaggcggggaatgtgcttaaggtgccgaggtgaattggcactgttttgccatgttttacaatgatttccaaaggtatcatgtccccgatgcgagcagcaaaattattccaacggaatatgtggaggagaacgaattgcctggcggggacggacgtcgctgggaggatgagaaactcgggtccgccgtttttcattacggggcaaaggacgcgaaggctaagccaatggaaaagggacagataccctaa

SEQ ID NO: 71582 - DNA, 208 bp, Heterodera glycines
  Genomic contig location: Contig_ID=SeqID_44030; Location=1160..1367; Strand=+
  SCN-specific regions: Sequence locations=1-104,138-163,198-208
atggctgactttgacaaacacgctgcccagcgcgaggcggagtctctccgcactttggccttcttcggcgtgtgcctgtccaccgtggccacggttatcgctgtgctttccgtgccgttcgcctaccagcacttccagcagatcggcgccctaatgcatgaacgaagtggacttctgcaaaatgcgctccggcaacatgtggcgcgag

SEQ ID NO: 71583 - DNA, 377 bp, Heterodera glycines
  Genomic contig location: Contig_ID=SeqID_44031; Location=773..1149; Strand=+
  SCN-specific regions: Sequence locations=1-46,89-131,159-171,206 -222,330-330,362-377
atgagcgggcactttggcaccttaactccacgtttggttcatcccacatcgccagttctgcttaccaaaaatggcccacttggagctcaacattcaacgcctgggttcagagtcaagcaaccctggcttcatacccatttagagtttgagaataggttaaggacatttcgtccccaagtcctctaatcattcgctttaccgagtataactgcttaacgagctccagctatcctgggggaaacttcggagggaaccagctactagatggttcgattagtctttcgcccctatacccaagtcagacgatcgatttgcacgtcagaatcgcttcggacttccaccagagtttcctctggcttcatcctgctcaggaatag

SEQ ID NO: 71584 - DNA, 805 bp, Heterodera glycines
  Genomic contig location: Contig_ID=SeqID_9483; Location=305..1109; Strand=-
  SCN-specific regions: Sequence locations=1-58,91-170,211-303,326 -374,426-459,490-617,673-730,759-805
atgagcatgtaatttatgcaattttgagtctgggacctatgatggatattttccattgttattaaaataaataaaaagaaaaataatatactatatcgacaaatgtagattacgatgcatgatatggtacttgcagtgaaacgcataaaactacaaggtaaaaacaacccataaatataaataatgatcaaataatttaaaataattaaagaacagtagtgaagtatttaaaattaattttacatctgacgaatgtaatttggataaaaatgaacgttaagtatagcatttaatctgagaaggatataaattaattaattttattcattatctccacattataaataaaaatgaatacttccgaccccgttaagatattaataaatattaaaatatttttttaaatgcttattaataaataaaatggttacattttgtcaataaaactctttaatcaatcacataaatgaaacataattctatgtattttaaaacatttcataagataaattttaaatattacatcaaaaaaatttgacgatagaaaaatattaagcaaattaaaattcaaaagtgataatgattaagtcgaaaaagattcaaaaaaaatgtgaaacaattaaaataaattaaaaatcaaaaaaatattttatgattatattataatatatagttaaaagattttcagtttattaccgttatatttggcatttaatgaagataatatgtgattttaaattttcttattttttttaatagcaaaaaaccttggtgagataattaatgtaccaaataatataataaa

SEQ ID NO: 71585 - DNA, 819 bp, Heterodera glycines
  misc_feature (17)..(17): n is a, c, g, or t
  misc_feature (41)..(41): n is a, c, g, or t
  misc_feature (109)..(110): n is a, c, g, or t
  misc_feature (115)..(115): n is a, c, g, or t
  Genomic contig location: Contig_ID=SeqID_44033; Location=640..1458; Strand=-
  SCN-specific regions: Sequence locations=1-164,186-262,284-414,437 -619,646-756,778-819
atggatgatgctcattntaatgtgctgcggggcataccacntcatttaccaagcatcattacccactcatttgaatcgtaggggagtaaaaagcagaatttaattgaannaaatntaaaaaatcatataaaaatggaatgtttccacgtataaatcaataatggaaaaaagtttcaataaaatccaataaatatagaattaaaacaaataaatttttagttgagcccatcggcactgcttattggcattatgtcgacgataatgagcttcagttatttgctcagtgccccaatttggggccttatgatcgaaaagcaagtgaagcactcatccaaattgatcactttgatgggctcactgatggcgatcagtggcgtttcgttaatggggccgcttccattcattccaatcattaagtaattttccaattttcattagaaacataattagccttatttataagtttaaacatttcagtttgtagcaccattttttgtaaaatttctgagtcacaataggccgtgaaaacatatttatgagttttctgagtcactgatcaataatgtgacatccattacggtcaattctgaaaaccctggtccgatttggcttaaagtcgagaatttgaatttttaaaaaatcaggtttatggtctaaatatataaagtaatcattaatagttagttattaagttcagaatctagtccaagattattgaaatgggttgttatcatatcatattcatgattcattgagactccgaaaacgatctgaaatgcgtttgcacagcttttcaaaatgtaaattttttttaataaa

SEQ ID NO: 71586 - DNA, 108 bp, Heterodera glycines
  Genomic contig location: Contig_ID=SeqID_44034; Location=760..867; Strand=+
  SCN-specific regions: Sequence locations=1-108
aacccatgggtgctctatccacccaccaaatttcatttggaaatcccacggacacctggggaccttcctttgtcagtcgaattccgtcaaaccaaatactcaacatcg

SEQ ID NO: 71587 - DNA, 584 bp, Heterodera glycines
  Genomic contig location: Contig_ID=SeqID_44035; Location=441..1024; Strand=-
  SCN-specific regions: Sequence locations=1-584
aacaaactaaggtcgcatttcatagtttcaggaaacaccagtgagaaaattgataatgttttcgggattcacattggcattggcataattgtgatcattttgggggaggtgaatgttattgatgtcgttatagagtgcgccgtcatgttctaactaactttgtttcgttttgttttaattttttgctgctggtccatattatataatttaaatagctttaatttagtttataaactcattaatagggttggtaattatatgcacatgcatatttttttcctagactgtgggaggcatgaaacgcacgaaaaacatgtttttagcttggtttgaagcttctaggacgtatttccatatgcatattttgcatatttgtgcatatttcgcgatttatgtgcatatttgcatatttgtgcatattttggcatttcgtgcatattttatgtccatattttggcatttttcaaaaaaaacctctattagaacggcccccagcagctaaattagcctttttgagcccaaaacccgaaaaatttttcaaaaaatcattttttcgccaaaatttctcgagaatattgaataaa

SEQ ID NO: 71588 - DNA, 63 bp, Heterodera glycines
  misc_feature (40)..(40): n is a, c, g, or t
  Genomic contig location: Contig_ID=SeqID_44035; Location=1..63; Strand=+
  SCN-specific regions: Sequence locations=1-63
ttttcgcgtggccattttcgcgtggttgcatataaaaganaattcataactcacattatattt

SEQ ID NO: 71589 - DNA, 304 bp, Heterodera glycines; identical to SEQ ID NO: 67235
  Genomic contig location: Contig_ID=SeqID_44037; Location=271..574; Strand=-
  SCN-specific regions: Sequence locations=1-304

SEQ ID NO: 71590 - DNA, 304 bp, Heterodera glycines; identical to SEQ ID NO: 53844
  Genomic contig location: Contig_ID=SeqID_44037; Location=651..954; Strand=-
  SCN-specific regions: Sequence locations=1-304

SEQ ID NO: 71591 - DNA, 205 bp, Heterodera glycines
  Genomic contig location: Contig_ID=SeqID_44039; Location=1351..1555; Strand=+
  SCN-specific regions: Sequence locations=1-205
atgaaagccctaagtctaccgaatttttatttaactaaattatggacaaaaggtaaaagacaaaaaattatcttgaataaaaaaattatcttgaatatactcttaaattaaattccaggttttctcattgaaatttttacgaagcaagaaaaaaattgatggcctaagaaactgagggtagtcactgacttggacgcacgcttaa

SEQ ID NO: 71592 - DNA, 111 bp, Heterodera glycines
  Genomic contig location: Contig_ID=SeqID_9485; Location=596..706; Strand=+
  SCN-specific regions: Sequence locations=1-75,97-111
atgcggaaactgtcgtgcacagtttggaactcgatggtcggctggggaatgccagtcacgctgcattccaacaccacctggccaccgatctgcgcttcctggtccgacaga

SEQ ID NO: 71593 - DNA, 563 bp, Heterodera glycines
  Genomic contig location: Contig_ID=SeqID_44042; Location=598..1160; Strand=-
  SCN-specific regions: Sequence locations=1-437,479-563
tggaaacattggaaaagctgagtccatcgtcagacaatggcgattcggaagcgaattctgatcagattttggctcgtcttttgtccgttcaccaaacggacaaagcggcaaaggcgaagcccaccaaatcgactcaaatcactttctccgattcgttgatcgatctgtgccctcctccaacgattggtcaggagcctttgtcatttgcacttggcgaggacgacccttttgcttacgaaccggcggagttgggcgaattggccgacttcgatttgcccgaggatttgccgggtgaattataatttataaaacaaagttttatttgaaatatcacatcgaaggatttattagaagagataatacttccaaaatctgctgatatgagattataaataggaagccaaaaatagcaaaaatttaatgaaaatatgatgagcaaaaataatttttcaaattattgtttaaatataaatattttctagggttgagcggtaccggtaccggtaccggttttttcaaaaatgaaattaccgttaccggtttgtctagtaccggtaccgccg

SEQ ID NO: 71594 - DNA, 75 bp, Heterodera glycines; identical to SEQ ID NO: 54636
  Genomic contig location: Contig_ID=SeqID_44042; Location=404..478; Strand=+
  SCN-specific regions: Sequence locations=1-75

SEQ ID NO: 71595 - DNA, 287 bp, Heterodera glycines
  Genomic contig location: Contig_ID=SeqID_44046; Location=84..370; Strand=+
  SCN-specific regions: Sequence locations=1-287
catttaaatcactgggactcaatccaccagcatttcaatcactgggactcaacccaccagcatttaaatcactgggactcaatccaccagcatttcaatcaccgggactcaacccaccaacatttcaatcaccgggactcaattcttcagcatttcaatcactgggactcaacccaccaacatttcaatcactgggactcaatccaccaacattccaatcaacgggactcaaccctccaggatttcaatcactgggactcaatccttctgcatttcaatcactgtga

SEQ ID NO: 71596 - DNA, 56 bp, Heterodera glycines
  Genomic contig location: Contig_ID=SeqID_44049; Location=848..903; Strand=+
  SCN-specific regions: Sequence locations=1-56
atgactagttactatttgaataggttatttcgcgtccgttcaatgtccctgcaaag

SEQ ID NO: 71597 - DNA, 439 bp, Heterodera glycines
  Genomic contig location: Contig_ID=SeqID_44050; Location=130..568; Strand=-
  SCN-specific regions: Sequence locations=1-439
aaaatggtgtaagtaaaaatcgtaattacgctcaaaaagcttctcaaacaattttagcgcatccaattccttctacaatcgcctttatacatcccattatgagcgctaaaattatcagagtgccgaaaatcgcgtgtgatctacgcctagaaaaaaatggtgtaagtaaaaatcgtaattacgctcaaaaagcttctcaaccaattttagcgcttccaattccttctacaatcgcctttatacatcccattatgaacgctaaaattatcagagtgccgaaaatcgcatgtgatctaagcctagaaaaaaatggtctaagtaaaaatcgcaattacgctcaaaaagcttctcaaacaattttagcgcttccaattccttctacaatcgcctttatacatcccattatgagcgctaaaattatcagagtgccgaaaatcgc

SEQ ID NO: 71598 - DNA, 412 bp, Heterodera glycines
  Genomic contig location: Contig_ID=SeqID_44051; Location=195..606; Strand=-
  SCN-specific regions: Sequence locations=1-221,251-349,372-412
atgccagtaatcaccggactcacacaattaatggctttcaacagagaaaaggaaatgatgcgcgagattatgaaaaatggaccaatccacgcatctcacatcatgtacactgggtacggaagttgctgtaaaaacaacgaaatatacgaggtgggttaatcctgtgccggctcgttagtaaaatctaccaatttgaacgtttttagggacgtttttctgacatattttcttaaaatttaaataattttttgaaatttcaagacaatgggatcacttataagacaatagaaaatagttataggatggctctactttagcgcgaatggttctcggaaatgatcaaactcccaaaaatggagtgtctctattttaagaccaaatatatttgattaattttcacaatttcattaaa

SEQ ID NO: 71599 - DNA, 185 bp, Heterodera glycines
  Genomic contig location: Contig_ID=SeqID_9486; Location=990..1174; Strand=+
  SCN-specific regions: Sequence locations=1-185
atgggtgccattgttcgtctgatacttcgcgctttttgcgattttgtgcgtgtgcagaaattttcacgacacggttttgagcagctccaagttgactttgcttatgtccgtcaaaagctttggtatttcgtggccgatgagcacatgttgaacacgtgcattgaggacattgtcacggctgcggg

SEQ ID NO: 71600 - DNA, 1261 bp, Heterodera glycines
  Genomic contig location: Contig_ID=SeqID_9487; Location=182..1442; Strand=-
  SCN-specific regions: Sequence locations=1-104,126-456,478-1010,1034 -1261
atgtccactccgccgggacgcgaaatgccgcacaaagttttgttcggattgacgtgcagaaacctaaacgaagcaaaggccatggccaatgccaatcaatgccttcttttggtcacccacctcatctcttcagctgtggacgaactggcgagcagcaaattgttgcgcaagacgaccatttgctcgacgcccatcagaaagggcgtctccatacgttcgcggatgttcccaaattggccattgctgaacacttcaatgtgtccatcggccgctccgacgtaagtgaatctgacaatcagtgatggacagaaatgccttttcgcaaattgaaaaccgacgaaacctttcagtcaccgccaaactgagcaattcgctgtgcattgtctccgactgaattcgcactttgcctttgtgcgtgtcgtaaacggccaaagtgccgtcgccactcgcggccagcaaattattgcgccaaatgtgcaacgcatctgaggaaattcaatgggccagattaagaaacttcgctaaattccgctggggaggggacaaaaaaggggcacacccaactgattatgtccgcctgctcgccaaatgtgtgcacgttcggcttgggctgtccaaagtcccatgcttttatctatgttaaaatgtgacattgtctcattggacttcttcccgacagacttcgccgttttcggcacccgttgcaaaatgccgtctttcgcccggcagcagtgccatcgcactgggccgacttttgtgcccttcgcgaatacagcgcactctcttccccgtctcaacgtcatacaaacagacggcccttcaaaactgacaattggggagggggcgagggggaatgggcaacctgttcgaactggtcgcataaagcgaagtgccatcctcagaaatttgcattgccctgacggaccgtttcatccgtttgcgccacattccaccgagttttaccgaactttccatcgatggagtgatccctcgctgtgtgtcaaaggaaaaacattggatggacccatccaaaaagccaagacaaatggtgtttcgtgtgcaatttgatgtgttcgtagaaagggaggaaatcggggtattgaacaatctctccataaaaaagtcaaagcaaaaattcacaaggcgaaggaactttaaaatcagaaaaaatactaaaaatataaaaaatggttggtaatccattcaattattttggcaaaaatttataaatccttgtcaactttaatgtaagcaaaataaa

SEQ ID NO: 71601 - DNA, 161 bp, Heterodera glycines
  Genomic contig location: Contig_ID=SeqID_9487; Location=60..220; Strand=+
  SCN-specific regions: Sequence locations=1-86,131-161
tgaaccaatgtgcccagcccaaattgttggatccatcggtagttaggagaatttgtgaagaaatgcagtgatctatttgtatgtacaattaaaattaaattaattaattgttcactttgttttttattttgcttacattaaagttgacaaggatttataaa

SEQ ID NO: 71602 - DNA, 114 bp, Heterodera glycines
  Genomic contig location: Contig_ID=SeqID_44052; Location=279..392; Strand=-
  SCN-specific regions: Sequence locations=1-114
ggatgtgccgagccagacaaaatccgattccgattaaatcgccgattccgattatggccaaaaatccgatacggttttaaaaccgattacgattatggcccaaaatccgattaa

SEQ ID NO: 71603 - DNA, 1018 bp, Heterodera glycines; identical to SEQ ID NO: 44055
  Genomic contig location: Contig_ID=SeqID_44055; Location=1..1018; Strand=+
  SCN-specific regions: Sequence locations=1-201,285-353,376-435,481 -906,929-1018
  Gene Ontology: Mol. function=structural molecule activity; Cellular component=cell-cell adherens junction; Biological process =carbohydrate metabolism

SEQ ID NO: 71604 - DNA, 351 bp, Heterodera glycines
  Genomic contig location: Contig_ID=SeqID_44058; Location=652..1002; Strand=+
  SCN-specific regions: Sequence locations=1-20,51-351
atgacttgcgcatacgctaaactccttggtccgtgtttcaagacgggtcgaacagatgaccggcttttacaccgagaacgtacaactgagagcccgagctggaccgaactggttgctggtacgtgtcgcacgcgaccgccaccgacccccagctcgagtcaacacggacccgaaaccattgcacaattcacccagagtaaacagcactcccccgatccgggtaccagaccccgaaaggctggcctcaagaccgagctcacgcagctactccgagcatctcagcgcactccgcctgcaaatgccccattcgccactgaacagaaggacagcaaaccccagtctggaggctag

SEQ ID NO: 71605 - DNA, 447 bp, Heterodera glycines
  Genomic contig location: Contig_ID=SeqID_44059; Location=263..709; Strand=-
  SCN-specific regions: Sequence locations=1-58,91-99,143-447
tcacgcaacagcccggctgacccgacctttagagccaattcttttcccgaagttacgaatctaatttgccgacttcccttacctacattattctatcgactagaggctgttcaccttggagacctgctgcggatatcggtacgatcaggcaggagattcaaatagcttccctcgcattttcaagggccgtgtggagcgcacgagacaccacaggaaccgcggtgctttacgggcgcaacatccctatctcaggctgagccacttccaggcacgcacaccctaaaccagaaaagagaactctggctcggactccacacgacgtctgcgagttcatttgcgttaccgcgcaaaacagctcttgcgaaccgtcatttccctagcctggcgtgggaatgttaacccacttccctttcggcaaccggatggaccaactgcgcaagcacagaa

SEQ ID NO: 71606 - DNA, 449 bp, Heterodera glycines
  Genomic contig location: Contig_ID=SeqID_44060; Location=86..534; Strand=+
  SCN-specific regions: Sequence locations=1-63,85-238,261-338,360-449
atgtacttccctgaggacgtggacttcactgctcgcattcgttccattgttcgcacgctgcccaaggaaattggtgacttcaaagcgatcactctcaaagagttggagggcggctctgacccgcaggtaaaaaacaaaacaaaaaaaaacatatcatataacataaacccaaaaattggccccaagtgacgagagatccgtagactgttttttttttttttttgctttttacccctcaaaattttttctaatataaattttctaaattagaggctctatgggtggaaataccttacatttttgcagattttaatatggctaatttgtgcatttttgggtcacattttaaataatgtttaaacataaaaaaagcgccgaaaacccatcaataccacgaaacaggcaaaacacagccgccgaaacacagccgagacataacacagccggga

SEQ ID NO: 71607 - DNA, 386 bp, Heterodera glycines
  Genomic contig location: Contig_ID=SeqID_9488; Location=642..1027; Strand=-
  SCN-specific regions: Sequence locations=1-29,96-386
atgtatttacataaaaaaggaatccctggtaattaataaatttgaaaaatatatttttaaaaatttaattttaagaaactctcaaaagatttaaaccgcgcaaccaaaaggacgaagtcataattcgcctaatccgtgacgaagacattgacgaaacggccgagatcattcaggaatcctatctgcaggattgtctaaagataaagcatgccacgccggagcaatgtaagcaaatgaaaaaagtgccgttggaaaggacgcggatggcactgagcaaattcaaagcggaggaggacggggcgctgatagttgccgaaacgacggcactaacagatgcagggtaaagcgtcaaccgttgcattttggacacaatgcgaaaaaataaa

SEQ ID NO: 71608 - DNA, 1004 bp, Heterodera glycines
  Genomic contig location: Contig_ID=SeqID_9489; Location=1288..2291; Strand=-
  SCN-specific regions: Sequence locations=1-5,35-40,65-65,95-95,248 -368,390-865,889-969,996-1004
  Gene Ontology: Mol. function=structural constituent of cuticle; Cellular component=collagen; Biological process=negative regulation of cell proliferation
cactaaaacgcccggaccgcctggacccagcactaaaactcccggaccgcctggacccagcactaaaacgcccggaccgcctggacccagcactaaaacgcccggaccgcctggacccagcactgaaacgcccggaccgcctggacccagcactgaaacgcccggaccgcctggacccagcactgaaacgcccggaccgcctggacccagcactgaaacgcccggaccgcctggacccagcactgccggaacttcctctacaaagacctacactgttccaacaactccaaaacgtttgttttagcttgtacaatttgtaagattttttctagcacctccgtgttgttatggctgtgactaccctgtcgactgccacacttctgggaaggattgcgactattccccgcttcagccgccttatcaaagcgacccttacccggttgggaagtgcgtcttcaaaaatgtcacgtgcgccgctccaaacaccggcaaagtgctcttcatgaaggtgggtaataatgaaattccaacccatgaatcacatacataattaattatgattatgatgattacctggaccgtattattcactttttcaagctcaacaatgaccccaactccgtcgtttcgtcttccgtctcaccgttcaacaaagtcacagtcattttgcagtgcacctgcaaaccgtacttcgcaccttattgggtccaagtgggcgttgacggcaacccggccaagcaggtcaacgtcaaatcggtcagtgtttcgctttaaatttgcatttattgaatcctcaaacacaggcaacctgcggacgtcactgttactagaaaatggtaattaatggttattgtttatattatcatttatcaattaaaaatcaaatttagatgaccactcattgtccaacaaaagaattaagcaaaaaggaaattaattagaaaatcaattagagaaaaatttccttgcgcattttttaaattgtaattttctttattaataaa

SEQ ID NO: 71609 - DNA, 664 bp, Heterodera glycines
  misc_feature (52)..(52): n is a, c, g, or t
  misc_feature (109)..(109): n is a, c, g, or t
  misc_feature (127)..(127): n is a, c, g, or t
  Genomic contig location: Contig_ID=SeqID_44062; Location=1..664; Strand=+
  SCN-specific regions: Sequence locations=1-212,234-664
aaacaaaaaaaatcggattttttcaagtgtccgttttggggtactcaaacanttatggggagcaaaaatccaacgcagaattaaagtacaggctatagggaagctattncggaaggattcggtctcnccataaatctgggcgcatcggattcggggggactgccccgaaaacaaaaaaaatcgattttttcaagtgtccatttggggtactcaaacatttatggggagcaaaaatccaacgcagaattaaagtacaggctatagggaagctactccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcgggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaac

SEQ ID NO: 71610 - DNA, 283 bp, Heterodera glycines
  Genomic contig location: Contig_ID=SeqID_44065; Location=1075..1357; Strand=+
  SCN-specific regions: Sequence locations=1-192,216-283
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaatttttttaaaaattttttctccatcttcctttttgatactaaagcatcagagtgctaaaattaagttgtaaataaaatttggtgcg

SEQ ID NO: 71611 - DNA, 798 bp, Heterodera glycines
  Genomic contig location: Contig_ID=SeqID_44066; Location=486..1283; Strand=+
  SCN-specific regions: Sequence locations=1-21,45-114,138-222,246 -640,662-798
  Gene Ontology: Mol. function=steroid dehydrogenase activity; Cellular component=mitochondrion; Biological process=steroid metabolism
atgggtcctgctgctttgctgcttctcctcccctccctccttctgctttttctgctcatccgtgctcttcttgagcttatccccgtctcgcggttggataagcgttctgtgctaatcaccggctgcgattcgggctttggcttcgacttggcactgcgatgtttgggtgccgggatgcgcgtttttgccggctgtttgactcagacagtgcgccaattttgcataaaattttaaaaaaattatttcaaatgaatttttggcaacaattttcagggaattcagtctctaaagaaaagtgcccaagaaaagggaattgccgtggaacttttggaaccaattgaattggacgtcacaagtgacgaatctgtggcaaaggcattggaattcgtggaacgaaaattaggaccgggaaaaggtaaccaaaaatggagaaaagcatttgaatgtttcgaaagggcttcacgctttggtcaacaacgcgggaatcagtggcaacgaggcaaatgccgaagtcggaagtgaattttgcataatttgttcaatttcagagttgggacgattggctgattccaaaggactacgaagatgttttccagggtatggtcagacaaaacccagtgaatgaaatctctgcttttaccaaatgccatttcagtgaacactctcggcacaattcgcgtcactcacgcattcaaacgactcgtaaaggtcaattcgaataattatggctaattaggggaccattacgactctcgaaaaaaattaagctctttggttaagaaatccctccctatctga

SEQ ID NO: 71612 - DNA, 537 bp, Heterodera glycines
  Genomic contig location: Contig_ID=SeqID_44069; Location=875..1411; Strand=-
  SCN-specific regions: Sequence locations=1-31,55-182,211-285,308-513
atgtcagcaaaggacgcgcttaagccgattcaatgtaaaagacgcaatgtggaccttttgaagaaattttgcttcggattaatgcacttatgccttaaagtagtggcatgcactaaatgccttcaggccgccctttattgacatttttttaaatttgtggtatatgcacaaaaccgaaaagggcatgattttgtgaggaatttgtttattctacatcaaaatcctacaaaatttgcctctatttactcatttctgttgtgcccagacaaaaagtgcctttgaaactattttaaataattatttttttgcagcgatattgtcccagaaatcatttgtctcctcatactttatctgctggtgcccaattactatttccgattagaatacttaaagaattgcttccccattttatctcgaatttcacttatgcaaaccgatcatttctttccatcttttccatatattaaattccattccaagatgtgagtgtatcagagatatccaccccatatgtttattttatattattaaaataaa

SEQ ID NO: 71613 - DNA, 530 bp, Heterodera glycines
  Genomic contig location: Contig_ID=SeqID_9490; Location=156..685; Strand=-
  SCN-specific regions: Sequence locations=1-21,58-74,96-403,425 -479,509-530
atgaatgaatggaatggtcacgggaaagaaagaaagtggtggtggtggtgttgctggacgttgggtgttgttgggctggctaacttttcttttctgttggctgatctggctgtcagtaagtgttaagtgcaccaaatttttacaccgcccaacagatcaccaccaccaatcccatcctattcacacactttgattttcttagggtaaaagcggcttaaacaatgttttttgtgtggaaaaaatcgaacaattttaatgtgaattctgtttgcgaaatattgaaaaataaaataaaaaatgggtttatagaacttatttttttattggtatattaaattgttgccaaaacgacactttttgaccaaaaaaaaacaaacaaaaaaatgatgggatttcatttagctaacttaatagaaaattaagtctacctttttttacaaatatttcaaaaaatggaaataaaaagattcaaaaaatggaaattttattattttttattgaatttttagaggacatttgaagtaaataaa

SEQ ID NO: 71614 - DNA, 66 bp, Heterodera glycines; identical to SEQ ID NO: 53774
  Genomic contig location: Contig_ID=SeqID_9490; Location=2409..2474; Strand=+
  SCN-specific regions: Sequence locations=1-66

SEQ ID NO: 71615 - DNA, 1194 bp, Heterodera glycines
  Genomic contig location: Contig_ID=SeqID_9490; Location=1686..2879; Strand=-
  SCN-specific regions: Sequence locations=1-268,290-666,688-697,746 -889,933-1006,1029-1194
atgctgatcaaaaaaggtagcaacaccaagttgatcagatcactccttcatggtgatctgatcagcccattttggctgggaacgaggggtaaatttcaaaaaaaaatttctagggggttgggaaaatttttctggaaattttgagtaggcccattttatagagcacaaaattctctacaatattcaaaaaaccgcatgtctctattacttataccggctgaggtatgggcacttcaattttgacgtagtgtaaaatgcactattttcttaagaaatacagtactttttataggcaccgaaataaaagtcgacgtatctcagcgggcctaaagcttacctgaatttttttagatttttttaatgctgatccagagaagcaatattttaaaaatgaaatgggacaacacttttgaccacctatattttgatcaaattgtgaatatggtaaaataaatcaaataaatgtttatgtcacaaatgcaaatatggtatcattggaaagcccataaaaaatgctatccaatggtatgctacttatctgttgaaattggaaaatgacaattttatacgcaattatttttttcaaagcatgatgggacaacacttatgaccatggcctgtgtattcttaaaaaaattatgttaaaaaactgtgaccaactcttaggttttatcaaatcaatgtattttttgtattgtaaaaaataaaaaataattttatatatctatttttaatctaatttaatcataatcaatatttgttcctaaattacataattttatttcaaaaaataactcttcctgatacttgtattcaaccaaatacttgtcgagaatttcaaaatgccgagctctaataaattaatctaacggtccctaataatcaaatcaaaaaattataatttttttttacagtttaatttgataaatttctaaaacaaaattcaatttaactctctttcttctgtgagccgccgctgttaattttttcggtgtttgtttaaagaccaaaaagtgcaaataggaaaaatgtacgctgtttttgtcatcacattcacatcaaatcacacaattttcacaatgattgcgcgaaatgttttgcctattctcacaaatttcaccacttttccatcacaatcgatattctctctaatttcctttaatttcctcaagttaatgttaattttttaataaa

SEQ ID NO: 71616 - DNA, 66 bp, Heterodera glycines; identical to SEQ ID NO: 53774
  Genomic contig location: Contig_ID=SeqID_9490; Location=2963..3028; Strand=-
  SCN-specific regions: Sequence locations=1-66

SEQ ID NO: 71617 - DNA, 485 bp, Heterodera glycines
  Genomic contig location: Contig_ID=SeqID_44077; Location=392..876; Strand=-
  SCN-specific regions: Sequence locations=1-4,31-338,365-408,430 -450,472-485
aaggaattaaaaatttttaaaatatttattcatctcccttttgatagaaaaagcatcagagagccttaattaacctgtaaataaagttttgtgtgtttcagagcactttctgaaaaaatacttatgaattaattttgcaaaaaataaataattaatgaaaaagtcagaatttcgaaaaattttaaaagcaacaagcgttggcattttttcaagttaagttagtcctttacaatggagaaggcctgcaacatttggagagattttatcgattttagtgcgctaggttcgatgaaactttttaaaatataagcctaaactttttggcctgtttaaaaaggaattataaatttttaaaatatttattcatctccctttttgatagtgaaagcatcagagagccttatttaacttttaaataacagttttgtgcgtttcagagcacgttctgaaaaaatatttatgaattaattttgcaaaataataaa

SEQ ID NO: 71618 - DNA, 236 bp, Heterodera glycines
  Genomic contig location: Contig_ID=SeqID_44079; Location=299..534; Strand=-
  SCN-specific regions: Sequence locations=1-236
gtgcggtggaggaaatcctttttatgcgtggaaatattaccgtaatctgacagtatccggaaccaaccatacgatgaacacgggctgcaaaccgtataaaatgccttcacagtcaaattgcgtgttttcgtgcaacaaagaatggctgcaacaacaatatccgaataaagcaaaaacaccaaaaacgcctggggggataccattgtttggaaccacctgggaagtattcctagctg

SEQ ID NO: 71619 - DNA, 358 bp, Heterodera glycines
  Genomic contig location: Contig_ID=SeqID_44080; Location=183..540; Strand=+
  SCN-specific regions: Sequence locations=1-358
atgacaattccacgtttccacagagaccgactgagtgccaccgaaatgttgcagttgcgaaaagtgatggagcacgtgtgggagaaaatcctttacccggcggagacggcgaccgacgactgcggtggaggcgcaagcgcagcgcattcgctggcaacgcaattaccggaaaacattgaagaacgtattgagttgttctgcaacgaacaggtggacttcccatgtacaaattgatgtgattgtaaatgctttcgtcgcttttcagaagttggactcggatatggaccttaggacggtcaaacatttgatttggaagcagggcggcgatttgcttattttttaccgtcccgttaaatga

SEQ ID NO: 71620 - DNA, 422 bp, Heterodera glycines
  Genomic contig location: Contig_ID=SeqID_9492; Location=369..790; Strand=-
  SCN-specific regions: Sequence locations=1-64,86-422
atgcaaggatcatcggcacgttcatttttaaatcctttgaaaaaattgcaacgaaaagaagacttggagaaggaatttgtggagagtggtgagaaagaccgggtccaagaggttgtggaacgacgacttcacgagtcggggtgggcgaaacgagtggagagcatgtgcgaggagtacatcgcgaagaaggtagcgaaggtgaataaggccgcgtgggttattgttttaaataaactttcctgttttggaaattacacctacgaataaatggtttcttattagggctatgaacgcgttgaactgcaagcgatggttgacgagctgaaggatgcctcgcgtcgaattgtgccggatgaagtgaagagagaactcatgcagctgattcaggaatttgtgaacagccgaacatcgacgggcgaagg

SEQ ID NO: 71621 - DNA, 2308 bp, Heterodera glycines
  Genomic contig location: Contig_ID=SeqID_9492; Location=1487..3794; Strand=-
  SCN-specific regions: Sequence locations=1-149,172-290,314-565,588 -855,877-916,938-1009,1031-1121,1153-1192,1214-1340,1362-1408,1430 -1641,1663-2014,2036-2058,2152-2308
cgcattatgcttacaatgctggcgacccaaatgttcagggcgcaacatcgtttgacccacaggtaactgaacactgacatttgaatcatcagaatggtagttggttaagctggcacagaaacaatatgaggcatggcagcagtattatgcacagactggggctggacaacaaccggtgcagaacattcaacaacataccggacaagaggcacaattactttgttcaaacattgtccatttccataatcgtttttaggttggtgggacatataaagcctattttgaccagccggtccccggcacggtgccgcccgctgctgcgcctcaaccgctcgccagtgcttatgttggccgtcccgcttcgaatgcgcctgtctttccaccgcctcaaccaccgcaagtgcaacaaatggccgccccagttggtggagcatgggccgccagtggaggccctccccaacagcgcggaccaccagcgccattgaattcgttcatgggcgggccaccgccgtacgggcaacaaacgccgcgcggtgggggctttcaacgcggcgggggcagtcaaagtcgctggagcggcggtgggagtgaacggcaattcagcagaaggtgaaaactgcgcaaaaatttggggaattgagtgataaaaatagaccaaacgagtacaattatatgttggtctatttaatttctctaagttacaaaggaagcgaaacactaacatttcgattgggaaaaggacattgtgcagaatgaacgccctgtattatgttttaagtattaattataacaaaacctctgaatttgttgaatgcattggttctcaattatagcgatggtttcttatctttgaaaatctcattggttccaacaaaattaattattcaaattttctgcttgaatatattaaaaatatttgatttctctctttttctttgggttatttgtcgtaataaacttaaactaattggtctttctgcacaattgaaatgttgaagtagtcatttttatttttgcagaaatggtataagaatttttctaattgaacattcccaattaatgaacggtttgctcctctttcgaggagggcaagttttatttcgaaggatttttacggtggtatcaaagaaggagtggaggaaagggaggagggtggaggagacaattgtgctatgtgtgtaatgactgaatgattcatctgtccattcagacccggtgattataatagcggtccaccgggcggtcaagctggttatcgaggtatttgcaactcaacgctttgcttgtctcgtaacttacaaacttttatctaatgaggactggtggagattatttattatcttttaaaaaatttccctggtccaatacgtcggtgttttggcggacattttattcgcttttattgcgtggattttattatattttagcagaacaattgactgtgtattttaaataaagtacagggattggtaataagcatgaatattgacatttaacggtccaataaaaaggaaaataaattgggaaaatttgaaaacgagttatatgtgtcttgcttttttgtttgaaaaacttgttcaactactagcccttcaggtggcggtgacggtgggtttgaccggcgatcgtccggcggaggcccaatgagacaggagagaagccgtggaggtgggtgaaagaaggtggcttcgagagcaaaaacatcctcttcttctcgggacttccgcaacagtcagtgaagaaaggaatgtttgcctttatttgtctcttgacagtgtcaacgaacaattcattcatgatgtgttcagtatgcagcaaggagatgttgaaactgaccagaatggtggcccaaagatacgaatttacaaggaagggggacagtcaaaaggcgagtgcaccatcactttccgcgatacggcggttgcacagcgcgtgatggacacatacaatggtgagacagcggctaattgtaagcctttctcacatttgtgcaacgaattgcataggacaaccctttcctggcacggacaatgtgatggacatttcttttgccaaattcggtggcggtggtggaggccgcgggggaggtggtcgaggcggaggcgggtcacgcttcggagggggcggaggacgaggaggaggcggcggcggtacttttcgatgatttgtcctttcctatttagtctcaggtttcggtggtggtcgtgacttccgtcgtgatggcggtggcggaagcggaggtcgtgggccgccgcgagacggtggtggatttgaaggtgaactgtggaaatctaatgacggtgtttaa

SEQ ID NO: 71622 - DNA, 1392 bp, Heterodera glycines
  Genomic contig location: Contig_ID=SeqID_9493; Location=760..2151; Strand=+
  SCN-specific regions: Sequence locations=1-28,50-153,185-192,214 -249,275-679,710-1392
atgaaatccgctattaatcgagtcatgttaaatattttttccaagaaaatggcttcatgttcaagtgacaagtctgtgcgtctttgggaccttcgaaatccgagtagtcacaccaaactctcaacgccaggtataaacaaacaatatgattgcctaaaatttcaaataaatctttaaagttaacacgttttctttttaaatttagttgaaaaagctaacatcatacaaaagggttttagtaaaacgtataaataaaacattcaaacaaaacaaatatcttcgcaaattgcttctaaaagaaattacgaagatggcaaagcaataaaaagtccatttttatcagcttaatatttgacctgaactttttacaggcgcaaatctttttgtgacgtggtcctactgcgataatttcattatctttggcgacaaatctgataatttgggcgttattgatgcgcgcgctatgaagacactggaactattcacattcaaaggtcaattactccataccaaattgttccaaacaattttaaactcaaaaattctgaaggggaagttttttggctcttgtcgatgttttgcgtccaatcgaattacttttatgtaaaaaagaaaagaaacaaaatgtttgtatattaatataaaatacctattgggacacataatatcgacaagagcttttataaattttctattttttattgttagcttaaaaactggcttttccagatgaaattaacgagttcgtttgtcacccaaatgggcagctgattttcgtggccaccgacctcggaaaattggaagttcttaggtggattttgttgccgtttcaacccttccataattttcaaaattgtccattttccgcttgccgaagctgaaacgcgttcgaactgtccaggcccacccgcccctttcgacttgcattagtgtcgccctttcccccaacgaaaggtttttggtggtcggtgcttcggacgcctgctgttccgtgtgggacattaacgatttaatatgcgtccaaacactgaccaggtaattagcactgccaaaaaagtttaactgaattaattaaggctcgattatccggtgcgcagtgtttccttcagtcattgcagcaatttgatcgcttcgggcagtgaagaccgagtgatcgacatttcgtggactccgactggcgaaaagtgcgcactttcgaaaaacgcttatacattttcaaatattcaaattagagtcgccgaagttccgatcgccaccgaatgttatgacgtcgcctggcatcctcggctttatcttttagcatatgcaatcagtggaggattgaatgacaacagaagtgatcggagtgatcagtcaaccctcagagtttttggttactctggaggcatttaa

SEQ ID NO: 71623 - DNA, 766 bp, Heterodera glycines
  Genomic contig location: Contig_ID=SeqID_44084; Location=1..766; Strand=-
  SCN-specific regions: Sequence locations=1-263,321-532,554-576,610 -616,641-766
atccattggcacgcctggttcagggtcgttaccataaaatgcactgcttgtgcgttgcttcgtgggatcatgtacttgtacgtgttcttacgttacttgcttagctcggctgtggggttttggtgtgctggcgcgaacttgtggttctaattcgcgttttacggaccgtaactcgggcgcaccaatgctttgcatgctgtggcggagtgcctggattactggcattcctgctttgatttttcgacctgaactcagacgtgaacacccgctgaacttaagcatatcagtaagcggaggaaaagaaactaacgaggattcccgtagtaacggcgagtgaactgggaagagtccagcgctgaatcgcagctcctctgggttgcgaggtgtagcgtatagaccgtgagcttgggttggcccgcttgttcaagtttcccttgaccggggctccagagaaggtgcaagacctgtccaactggcggtgcctatccatctttacgtgtcttggagtcgggttgtttgggatcgcagcccaaatcaggtggtaaacttcatctaagactaaatacggccacgagtccgatagcgaacaagtaccgtgagggaaagttgcaaagcactctgcagagagagttaaagaggacgtgaaattcgatgaggtggaaacggacagaactggtgtatctggtctgcattcccgccgcttgttgctgtacgttggcctgctaacctccaggctggggttcgctgtccttctgttcagtggcga

SEQ ID NO: 71624 - DNA, 60 bp, Heterodera glycines
  Genomic contig location: Contig_ID=SeqID_44085; Location=94..153; Strand=-
  SCN-specific regions: Sequence locations=1-60
gcgcccgtccaaggccaacaaatttaaaaacgggcgcgaagcgcccgtcttgagcctcga

SEQ ID NO: 71625 - DNA, 1505 bp, Heterodera glycines
  Genomic contig location: Contig_ID=SeqID_44087; Location=1..1505; Strand=-
  SCN-specific regions: Sequence locations=1-532,555-665,688-982,1040 -1252,1274-1296,1330-1505
ttacccaagtgattcctattcaccacctacctgctcccttgatgggctagcgttggcaccaccaaatgcccccgtccgctgatgggcacaggtcgttcgagatgacttgtggacgctgcccaacattacggggcagctgcctcacgagccatgcttttggggtgcttccatacgttggagctgtggtataccgctcagtgctgcacgtgtgaaagcctgtgtatggctgctgcgtggcaatgtgtcggtggcgggccgcctcgcttggctggttcgctgcgccaatgtgggatgcacgctcgtggggcgacctaacggctgtgctggcgtctgtgcgtcgttgagcggttgttgtggcaggcacataacacactgactggggatggtggtttcgttcccggtcttacgtgccgtaactagcggtgtgtttgagcttgctgctacgtccgagggcgtgatgagatgacgaggatactgaccgtgcttggtctagcacgtggatttccactcaatgagtgtcagatcgggaaccgccagctatatctttgattttcatgattattattcacacctccgtcgaacaatgaattctaccctcatccgggcactccctcctctcgagtaccgctgaaaaacacacacatgtgcgataattatggcgaccctgcagaaaccttgaacacaaaacattcgaatgcacattgcgccattggagttacatccattggcacgcctggttcagggtcgttaccataaaatgcactgcttgtgcgttgcttcgtgggatcatgtacttgtacgtgttcttacgttacttgctcagctcggctgtggggttttggtgtgctggcgcgaacttgtggttctaattcgcgttttacggaccgtaactcaagcgcaccaatgctttgcatgctgtggcggagtgcctggattactggcattcctgctttgatttttcgacctgaactcagacgtgaacacccgctgaacttaagcatatcagtaagcggaggaaaagaaactaacgaggattcccgtagtaacggcgagtgaactgggaagagtccagcgctgaatcgcagctcctctggggttgcgaggtgtagcgtatagaccgtgagcttgggttggcccgcttgttcaagtttcccttgaccggggctccagagaaggtgcaagacctgtccaactggcggtgcctacccatctttacgtgtcttggagtcgggttgtttgggatcgcagcccaaatcaggtggtaaacttcatctaagactaaatacggccacgagtccgatagcgaacaagtaccgtgagggaaagttgcaaagcactttgaagagagagttaaagaggacgtgaaaccgatgaggtggaaacggacagagctggcgtatctggtctgcattcacccgtttgttgctgtacgttggcctgctagcctccagactggggtttgctgtccttctgttcagtggcgaatggggcatttgcaggcggag

SEQ ID NO: 71626 - DNA, 1719 bp, Heterodera glycines
  misc_feature (1704)..(1704): n is a, c, g, or t
  misc_feature (1713)..(1713): n is a, c, g, or t
  Genomic contig location: Contig_ID=SeqID_44088; Location=52..1770; Strand=-
  SCN-specific regions: Sequence locations=1-41,63-68,119-285,497 -646,669-716,846-861,912-930,957-959,999-1068,1131-1349,1393 -1525,1547-1570,1593-1719
  Gene Ontology: Mol. function=UDP-galactose beta-N-acetylglucosamine beta-13-galactosyltransferase activity; Cellular component=Golgi membrane; Biological process=protein amino acid glycosylation
atgaccaggcgaaatgcattctttcagcgtaattcgatacgtaaaacatgggccagcgatgccgtaagatatatttattaatttttataaaaaaaaatatttaaatttatttatataacttttagttaaacgacacggtgattcgttttttaattggtgatgcaccaaaaagtgatgcaagaaatcaaaaagcccgagatgaacaaattaaattggagcttgaatttaagaaatttggcgatttgatttttttgaatggcatcaccgacaactatcaaaatttgcatttaaaagtaataaataaattatttttagaataagatttttaaatttgatatgaatgaaagcacaataatatttatattttattaataaaataaaaaataaataatgcaaaattattgaaaaaactaaatttataaacaaattaaaaataataaatagaaaaaatcacttttttaataattgattatttttaaattaattaatttattttgttcatgtttcagtggcatgccgccttggaatggcaacaaaatttttgcaaaaatgccgaatttttgatgaaaacggatgatgacacaattgtgcatttgccacggttggaccgttggattgagcacaaatttcggccagcattaaaacaaaatgtggccacatattttggatggatcatttccggcgtaaagccaatccgagacaaagggcaccgatggtaatttataaaatggataaaaataaacaaataaaatttataaatttattccaatttttgtaaaagtttgaattccattaataaaattactaataaaatttttattaaaagaattattctaaataataaaccagaaatgaccatggattataaaaaaaaaatattaactcttttattatttatatttttttattttggttttgagctattttcggtataaaaataattatatttaatatatcggaaataacaaaaaaaataaaataaataaataaacgaataattttttgtataatgaaactgaggatcttgagattataaaataagattaaagtatagaagttatacttatgtttttttaaattattttttttataataaaaaataaataaaaatgtaaaaaaaaaataatttaggttcgtgccaaagagtgcctatccgtacgagtggtatccggcttatatgcaaggtgccacatatttggcgtcggcacaagcaatttcagctgttatgcgtcatgtccatgaggtgaacggcttcaacatggacgacattgttttcacgggcattttggccaaattggccaatgtcacactgtttgacgcgggcgcacattttcgtgtgggaaatgcggtaaaaaaatataattatattattaacaaaaaatagatttttaagcgcgatttcctcttctttccgagcttttgaggtctaaaaatacgaaagaatatgtttttagctgcttcttaaattttaaggaatatattttggcattttttcccaaaatttcatagctaaaaatcggataactaaaaaataaaaataaattttccaatttgttttaggtatttcatggtaaaattgttctttagcttcatgcaaatgaaaaatgcgttgatcgtattcctgaagctgttgcattgtatggagctgacagtttggcacaatttgaagaaatttatgataaattagattcaattgaatgtgcncagagcaangcgtaa

SEQ ID NO: 71627 - DNA, 660 bp, Heterodera glycines
  Genomic contig location: Contig_ID=SeqID_44089; Location=7..666; Strand=+
  SCN-specific regions: Sequence locations=1-660
aaacaaaaaatcgatttttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaaagcagaattaaagtacaggctatagggaagctattcccgaaggattcggcctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaaagcagaattaaagtacaggctatagggaagctattcccgaaggattcggcctccccataaatctgggcgcatcggttcggggggactgccccgaaaac

SEQ ID NO: 71628 - DNA, 3537 bp, Heterodera glycines
  Genomic contig location: Contig_ID=SeqID_9494; Location=248..3784; Strand=+
  SCN-specific regions: Sequence locations=1-130,195-347,372-406,428 -446,484-524,546-759,783-1539,1561-1581,1603-2171,2193-2436,2458 -2459,2613-2624,2819-2961,2983-3387,3410-3537
  Gene Ontology: Mol. function=DNA binding; Cellular component=nucleus; Biological process=torso signaling pathway
gctttcatccgcgtcaaatctgacagtgactggcatttgatcagtgagtgttgttgaaaggtgtcggaaaaaaaaacaaatgtatttgttaatgacagggaggataccctaaaatgacgacacaaataagtaaatttatcaaaacatttttaaatttaaaatattttactgttttttattttaatgaaaaaattcacaaatatattgtaaaggttatgaactcattttttcaatggattatgcaattcgacagctccgcctcgcactgatcacttcgcttgggggggggggcgatgggacggcggataatccggggacaatccgccacaatctccagcaaaacaattaaaatggtggtaaaacaactcaaagggtcgcaattgtctcctcgttgcgagtgtttatgggcacattttgcaaattgcattttggccaaatttagtggcaattaaatatttttgttgaattttttaaaaatattttcattattccaccaaaaatgcttttcttcccaccgccgacttcagcagcagcggcggatttgctggttgacccggcgattgacggattattacttaacggagtgataatgccaaagccaagcgaattggaacaagcgcagagaaatcatcaggtcagagtggccaaaagaggaaaacaattcaaaaggggctaatcaattttaaaaattgttaattggcgattaatatttgcaaatgttgaggctgaacagctccaacgccaattagccatcatgggacagcaacttcagcagcaaatgccaatgcgcggaagagaactgtcgccgacgcagccaaatgtgccaagtttaatcggcccattcagcggactgttaacaaccgcgcaaattgatgaaattgaacaaatcggaagcgacaaaggcaccgacatgcaaatgctgaccccggcaaattgcctaatgccggtgagattgtccacttattaaattggttcgaatgtttgccctgattaagccaatcgtcggtctttcgccaatcccttcggtgtcatttggcaacacattcactcaattaactccgccgatcggactacagcagcgtcaacaaccgattgaccacattcagccgaatttgctgcttcattcaccaggcaaaataatttattttgtgaatattccgtttcgttttctgagcttttcccccttttcggctttctctgttccgcgtgccatcggccaattttggatcagagttttttgctggtggatgaccaaaagtggcactctgagtgctgtgtttgtgtgatttgtggccaaaatttggaaaaggatgggcccacctgtttcgtgcgcgatggctttttgttttgtcaccgcgattactttgcgtaagtaactcaaatattttaaaaattgaatcgctttttaagtaaatatggtaaaccctgcgatcggtgcggcattccaatcgcaaggggagaattggtgatgaaagtgccccaaaatggaaactccgaccaaaaatcgctgttattccacgtccattgtgagtgaattcttttttatctttgatcatttttgaattgtttgcttttcgttaggcttctcctgtgtttgttgtggccaaatgctttctcctggccaacaatttaccgttggaatttcgggtcaaccgagcggggctttgttctgtgatggtgagaacgatttggatattggaattttataatccatcctcattttagcacatttccatttgaatccttcgctttcccttggccaattttcgcataaaatgagcgacgaagaacaagtaactctgaagaacttcgaatttttgaataattttttcggaatcagctccattttttgaccgatctttgctcttccaatttggggggccacggccaacaaacgaatcgcaaagttttcgagcaactttcgactggcgtaatttcgccgaataatagccaaaccgacagccgatattcttttgcggaatcgagcaaggaaaacccaggtaaattgcaaaaaatttgattaaggaatatttgaaatccttaatgcaccttgaaatttgatctttgcggaataatgagattgtgatcataaatacggtggcgaaagaacaaataaatcggagagagaagcgggggaggggggggggggggtgttgaatggcacggcacaatgtttgatttgcataaataagggggaaagggataaatattgggaaaaagcaatgcccgaaatccatcaaattactaatagcccaacaaaataaaaatttaattactctttatttaaaccaaaagtttcgcttgaccaattcgttattttatcgtacctcggttaattggcattgtttgtcatcccatttcacatgaggcaaaagcgggaaaatggcgcggatggcattggcatgggaaaggaagaaaaatgagagaatgtgaaatggggagaaaaggggaagggaatggagagaaagggatagaaaatggaagagaaggaagagaacgggggaaagagggaaagggagagaaaacggaaggagagagatagagaaaagggaaagaaagagaaataaaatgagagagaaagagagggaaaagggaaaggagagaaaaagggataaaagaatgaaagagagagaaaagggaaagagagagaaagagagagaaaaggagagagaaagcgaggaaaaaggaaaggagagaaaaaggaaaaaagaaggaaagggagtgaaaagggaaagagagagagaaaaggggagagaaagagagaggaaagagggagaaaaggaagagaaggggagaggagagaaaaggagaaaaaggaagtcgcaatttacaaaagccaatgccattttaggagcaattcaaaaagggaaaatattgtactatatataaatgatcaaatgtgaagtctttccatccactcttctcttaagtgtgccctttttgctttttctcagattcgcttcatctttcttctccttcagtgactccgaatggcaccgacgcattttgcgccgggcgaaacggagggggcagctctaatggaggcgaaacgccgggcgcaatgggcgcaaatgggcggcaaaaacggatgaggacaagcttcaaacatcaccaggcaaatgaatgaatggccaattggccactcgtcaatttggccaattaatttggccaatgaaagatctttggctattttttacttaccaaattcaaggaaatattgaaaatgcaaagcctttagcttcggacgatgaaaaactatttcgcctgtaaccacaacccggacgcgaaggatttgaagcagctttcccaaaagacggggctcaccaaaagggtactccaagtttggtttcaggtcaaactcatcccattggcgttgttttcacctttcttcttcagaatgcccgtgccaaacatcggcggaatcagcaaattcgcggggaagtggcggcggcaatgaacggcacaaatccgtcgctgaccacggcaatgtccggggtgcatgtccacgcttctctatccacctctgtcgagtgtggc

SEQ ID NO: 71629 - DNA, 799 bp, Heterodera glycines
  Genomic contig location: Contig_ID=SeqID_9495; Location=69..867; Strand=+
  SCN-specific regions: Sequence locations=1-420,443-529,554-563,585 -640,662-799
atggtcaattttgtgacgacagtggccacctttttctgtggaatgtaccaaattaggggctttccaactttttcattattttccagtggcatttgccgtcaaatttggaagcgcggcgaaacggccgacatcaaagcgtactcctttctgcttggtgttttgggcagcagctattggttcacgtacggagtgctgttgcagcacccgttgattcagtacgtcaacgcgtgccaattcgtaatttactcggcttacaccgccttttattggacaatgagcacgaaaaaggttggaacattcgcaaaatctgctgcattttttttttattattttcaaaacacagcgtccggaaactgagctcctgtaccaaaaaagatttgcatgtgtggctcagtggtttttgtaagatagtaaagggacaaaggcagggggttcgagtccgttgtgcaacatgaatatttttatttatttttgtccaaaaaatttaaaaacacaattttcggaaattatttttggaggtttttgccaaccaaattgcacattcttggtatctttcgaaagttcttgatgagtagaagcttttcccaagcaaatgctaagcatttttataagtttgaaaaaagatataagcgtttgaaattttattttttgaataattttagatcggagcgtaaaaaattaaaactcgagcgttaaaaatattcataatatttttctctatcgatatgcaaaatttggtgtaattgtatggttagaaaaaaggttatatggagagaagtaaatgttgtttttgctaata

SEQ ID NO: 71630 - DNA, 175 bp, Heterodera glycines
  Genomic contig location: Contig_ID=SeqID_44093; Location=334..508; Strand=-
  SCN-specific regions: Sequence locations=1-175
  Gene Ontology: Mol. function=ATP dependent helicase activity; Biological process=ribosome biogenesis
atgactgcctttgatgagttgggcgttttgcccgaattggcaacggcactcaatgatttggaatggacgtccgtctctccctttttccgacttaattttcatagctttcagcttgcctactgacattcaatccgaagcgatccccgccattctcgggggtggcgacgtttgcatg

SEQ ID NO: 71631 - DNA, 839 bp, Heterodera glycines
  misc_feature (51)..(51): n is a, c, g, or t
  misc_feature (87)..(87): n is a, c, g, or t
  misc_feature (167)..(167): n is a, c, g, or t
  Genomic contig location: Contig_ID=SeqID_44093; Location=795..1633; Strand=-
  SCN-specific regions: Sequence locations=1-352,375-473,525-839
  Gene Ontology: Mol. function=oxidoreductase activity, acting on the aldehyde or oxo group of donors, NAD or NADP as acceptor; Cellular component=cytosol; Biological process=carnitine metabolism
cccgctgtgctcaccgatttggacgatgagatggaaattgtgaaagaaganatattcggggctgtgatgttgattttgcgtttcaanactgacaaagaagcgattgcacgtgcaaatgccacacaatttggattggcgtcgggattatgcaccacgtgagaggggtntaataataaatattgatgagattaggtcgtaaacaattaaaggacatcgtttgatttttagctattatgaatagtaagttatgtagattttgtttggattggagatgcataattatttaaaatgttttcattgtacccttccttaggcataaattaaaaatcgtcaccctgatgtcctaattaccacttattttttaaaatattatccgatttattctcttgttggtcaaatcactaaaaaaatctttggtttacttttagtttaattgggccttaccgcaaaacgacgaataagcttttgctaacaaaaaataaaagtaaaaatatttatttacaagtaatgaaaatttaaattttggttttattgcattttaattccaattttttaaggaatttagcacgagcccatcgcgttgctgctcaattgaaagttggcactgtttttgtcaacacttacaatgatgctgaggtaacaattttgaataattatttgcgaacgattgggtttactgttttgttgtaagatggtcgtttaaggtgcacatcccattcggcggcttcaaaaattctggtcacggacgcgaaaactgtgttgaatgtttacacgaatattcacaagtgaaatcggtgtacgtgaacatcgacgaaggattgcaacacaatttgggatga

SEQ ID NO: 71632 - DNA, 743 bp, Heterodera glycines
  Genomic contig location: Contig_ID=SeqID_44097; Location=30..772; Strand=-
  SCN-specific regions: Sequence locations=1-271,293-460,508-518,549-743
atgtgctttccacttgatgaactgctgggtgagaagcacaacggaactgtccgtgctggccaagtctgtccagcttcaaaccaatattggtattacagctgttgtggacgatacgggaacatttgctgcttacaacttcaacccaaggttaaaatgaatttgatttaaatgaaaaatttttaaaaaccgaaatttatattttttattagtcaatgttttgaatttgtttgttgcatatgaaaaataattaacaaaattattttttgttaggtttattaaatgtcaatttaaaaatcgctttgcgtcagtgaaatatttttttcaaataaaattctgaggcattattttccattacccttttctggccccaatgattttaaatatctcaattgttttaactaccctatcaataaccaaaatacaaatttttaccaaaaaaatttcgctaattcgaaaaaagaaaaattaataaaaaacaaatatattcattttttattaaaaatataacggataagcacaaaataattaaatttttttaatgtaattttccaagagttggctcatcctcggctttttcgtccccgttgcgatcggtctgcttgcgcttcagcttctctgtggcttgtttacacactttttcaaattatgtttttgcagctgttgccgccataaaaaagagaacattggcttaaaatgatccgcttttatttatatttcatagatcatttttacatttaaataaa

SEQ ID NO: 71633 - DNA, 808 bp, Heterodera glycines
  Genomic contig location: Contig_ID=SeqID_44098; Location=180..987; Strand=-
  SCN-specific regions: Sequence locations=43-61,109-126,333-374,409 -443,517-630,654-685,742-742
cgttcagtcataatccctcagatggtagcttcgcaccattggtctatcgaccaagcacatgaaccaaatgtctgaacctgcggttcctctcgtactaagcaggattactatcatagcaacaggtctttagtagggtaaaactaacctgtctcacgacggtctaaacccagctcacgttccctattggtgggtgaacaatccaacgcttggcgaattctgcttcgcaatgataggaagagccgacatcgaaggatcaaaaagcgacgtcgctatggacgcttggccgccacaagccagttatccctgtggtaacttttctgacacctcttgctggaaactttacacattcaaaaggatcgataagccacgctttcgcggtccgtattcgtactgaaaatcaggatcaagtaagcatttgcctttttgctctacgagaggtttccgtcctctctgagctcgccttaggacacctgcgttacgctttgacagatgtaccgccccagtcaaactccccgcctgacactgtcatcggcgcgggtcgccgggccaccgggtggcccgacttaacaccaaaatggacaccctttcgggcgcactcccgttttaccgattaagtaaggaatcgatgaaagtagtggtatttcactggcgccttgcggctcccacttatgctacacctctcatgattcttcacaaagtcagactagagtcaagctcaacagggtcttctttccccgctaaatttgccaagcccgttcccttggctgtggtttcgctagatagtagatagggacagtgggaatctcgt

SEQ ID NO: 71634 - DNA, 1589 bp, Heterodera glycines
  Genomic contig location: Contig_ID=SeqID_44099; Location=35..1623; Strand=+
  SCN-specific regions: Sequence locations=22-33,57-109,135-178,200 -1429,1474-1589
  Gene Ontology: Mol. function=RNA binding; Cellular component =cytoplasm; Biological process=pole plasm RNA localization
atggctgaagcctggaatgggggaaatgacaatttgggtggaggaagaggtggtggtcgtggagcattgccaccaatggctgaagcctggaatgtgggaaatgacaatttgggtggagggagaggtggtcgtggtcgtggagcactgccaccgatggactccgggaccgattttggtaaatatttccataacttcacataataaacctattatttatttatcgtgcgattatgttttattaggtccagacaacagtggtgtgggtgcacgcggcggtcgtggtcgtggagcaccaccgctggtggacttaggactcgatttcggtcagccacataacttatcaaatcaccgtacaaatcacggtttatcaggtcccgaaaccaatggtgtgagtgcacgcggcggtcgtggtcgtggagcactgatgccaatggatgatgctttcaatgtgagaaatgacaattttggtggagcagaaggtcatggagcacagccaccgatggattccggatgcaacttaggttgtatttctcaatcttaaaagtaaaactgaaagattctaggaggagaaggatttgttccgacaaagcgttcaattgctgaacttttcgaggaggatgcccgcgtaaaggacaaatatattacaattcgcgatgaagacgaaaacgtgataatcgctggtccgcacgcagacgaatataaggccattgagtacaaatccagttttgaaacatgttaatttttgttttttatgcgttggtccgagttcgaatttgagccagctttgctgacaaatattcagaaggcgaactacacagtgccacgcaagattcagtcgcttacctttccgttgatcaaagctggtaggtcataacattattcgacggatgcgaattgaaacaaatttaggacacgacttgaaggggcatgcagagacggggagtggcaaaagtgcagccttcctgcttccgatcatcgatgccgtcatgaaacttaaaaaaggtggccattacaaatcgcggcgctgctgtccgtttgcccttatcgtggaaccaactcgtgagctgaccgttcaggtgtacgaccaggcgaggaaattggcagaaggttagtgctcatttcatgaattaaaccaggcaggctttactgttttctttgaagagtgtgatgtgtctgtgtctcgcgcctacggaatgtttctgcgtcatgttaaccttcgtcaaatttctacggatggttgtgatattttggttggcactccgggacgtctttgtgactttttccaatcaaaaaatgtaaaaaaaaactatattattgtctatctcataattttagcttttgtgcgaccaaatcaaagttcttgtctttgacgaggctgaccaattgctggaggacggttttcaggctgttctgcgtcagcttaacaacgttaacaattggccccaggttttgtgtattttatttcttaaaaaatctattttttgttttttatttagcctgaaaatcgacagactctgttgttcagtgccacttttccgttagttgtccaaaactgggcagatgagtggatgcgtaaagactcgatgatg

SEQ ID NO: 71635 - DNA, 703 bp, Heterodera glycines
  Genomic contig location: Contig_ID=SeqID_44100; Location=685..1387; Strand=+
  SCN-specific regions: Sequence locations=1-412,434-703
tttggtgcgtttcagaaccctttctgaaaaaaatatttatgaaacaaaaaaatcgattttttcaagtgtccatttggggtactcgaacatttatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatctattttttcaagtgtccgtttggggtactcaaacatttatggggagcaaaaatccaacgcagaattaaagtacagactatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaac

SEQ ID NO: 71636 - DNA, 308 bp, Heterodera glycines
  Genomic contig location: Contig_ID=SeqID_44101; Location=659..966; Strand=-
  SCN-specific regions: Sequence locations=1-308
attgtcgcgaaaacgttcgccgattattccgtaattccaatttcaatcgctggcactttgccgttaaaggcgcatatttccgtggcaacaaatgaaattctttcggttggaaaagataaagattcgcaaagcatattgaaggtttttcaacattggcactgattttcctcatatatttgtcgttttctcagtgcattgaaagggatgccacgttccgctacaacgtgctgaccgtcgattctgaggaggctgtcccctgcctcaatgtcaacaaccacctcatctttcggctcgaccttaatgagccc

SEQ ID NO: 71637 - DNA, 102 bp, Heterodera glycines
  Genomic contig location: Contig_ID=SeqID_44101; Location=1..102; Strand=+
  SCN-specific regions: Sequence locations=1-102
attctctcattttgacacttacatttgaaccctaaaactctttcaaaagcccgctgtaaaattgtgcatttttaaaggagatgaatcgacattggcaatgca

SEQ ID NO: 71638 - DNA, 1623 bp, Heterodera glycines
  misc_feature (21)..(21): n is a, c, g, or t
  Genomic contig location: Contig_ID=SeqID_9496; Location=651..2273; Strand=-
  SCN-specific regions: Sequence locations=1-313,335-383,405-858,935 -1272,1324-1623
agccttcgccacatttggacntcgagacaatttacaagaaaatcaaagagaaaatgttggcacagtttgagggctggtggaagcgcgtgccggaacagaaggagccgctgtacgagttcttcaaacagctcgaggacatttcaatgcgttacgtcatggcaattgttgacgcatttttcgacggcatttccattgagagttttcggcaggaatattcactgggcgtcaaaggtggggctgtgagcggaatgatcagaattggatttgacactttggcactaatccaaacttcgaaatttgtttattttaatgaacattgggaaaaatgccaacttaatctatcagttttaattagagaccggacaactggggtcggaggatcccgagtcttgatcccgaccgaatcccgatcaatcccgacgattttgaaagaacgatcgggacgaatcccaaatttaatcccgctggattccgaaaaaatccagcggtatcccaatcccgtccggtctctagttttaatttaaaaatgcgacccataccaattaaaaatgggttcatgattttaaaagcatttgcctatattacaaattcgaagttcgtttcatcatcattagggctcggaattatatgcaccaaaaattgcaaaatatgcacataaaaagtgaaaaatatgcacataaatttctccaaattgagggtataatttcttaaaatttcttcaaattcgctaaatgtaaggtaaaacttttaaaagtggtcaaatatggtattaaaaatcattttagatgaaaaaaacattataaagctaagattgacgaatttttagctaaaaatcaacccaaaaagcgaaattttcgctttttttaaatttttgacataaatttacaaatttttaagaaaaatttaatttttgcaatttttttttagaaaatttggctaaaaaatgatttttcggaaaattttccaggctttagaggtaaaaaaaggctaatttagctgatgggggccgttctaatagaggttttttaatgctcaaatatgcacaaaaaatatgcatgaaatgccaaaatatgcataaatcgtgaaatatgcacaaatatgcaaaatatgcatatggaaagtcatcctagaagctttaagccgagctaaaaacatgtttttcgtacgtttcaggcctcctgcagttcaggaaaaaaaaatatgcatgtgcatataattccaggccataatcatcattaggccggctgcacatttggaatttatttccatctgtaattaatttaaattttaaaaatatagtaataataatttaattttaaaattcagatgtcaaagttatcaagacaaaggaccaacaacgtcccatcgccaaaaatgaccggacaatccatccaaatcaaagagttggcagtgaaactgagcaaattgccaaaatttcggcgaatgacaaaacgccaactggcgtcattggggagacaaatgcattttttgatcactttttcgctgatcagcacaacaacaatttgttcgacaaagagtcccaccactttaatttgaacatttttattcaaacatttgacaaaagtctgcaaatcaccaaattcctcaccattggactggcga

SEQ ID NO: 71639 - DNA, 487 bp, Heterodera glycines
  misc_feature (389)..(389): n is a, c, g, or t
  Genomic contig location: Contig_ID=SeqID_9497; Location=50..536; Strand=-
  SCN-specific regions: Sequence locations=1-487
atgtatgtaaatatccgtcgattcccaactgatcagttcgccgatcaagtggatatctaccgggatgatcccagggaggatgtgcatgaattgtggcgcaaattcacggaaagcatcgattggatccatcggctgaactgcggacgaaaattgctccaattcattcagctgctgcaccgattgttgccaaagtacacggagatgaaccgattgaaagcggaagatcaaagggagcaattggaggaggaaatgttttgggcggcggaagaggaagaaactgtgccaacaccaccggcggaaggggcggcgcggggagacgatgagggaaacagtgccaaaaacagaggtaaaaattgggaaaagatttcaaaaaaattattattgtttanattttcaaattatgctccataacaaaattataaactcaagaaaaaatttttttgccacttcaataatatctcacgaaaaaaattttccagccccctag

SEQ ID NO: 71640 - DNA, 66 bp, Heterodera glycines
  Genomic contig location: Contig_ID=SeqID_9497; Location=1834..1899; Strand=-
  SCN-specific regions: Sequence locations=1-66
attttcgaactttagcacatattttggcctttttccataaatttcatagcaaaagtgcaataaaaa

SEQ ID NO: 71641 - DNA, 479 bp, Heterodera glycines
  Genomic contig location: Contig_ID=SeqID_9497; Location=985..1463; Strand=-
  SCN-specific regions: Sequence locations=1-448
catttgttaacgtgttggacatatttggaatgaaccaattgtcctttcgacttgcaaatgtttctgtgaaaccgtcgatggttggagaggcgagaatactcttccgggcaacgagaaaagccgtggcggacagtaagcacgaagtccatggcggcatttgggacccaaggcaaagccgaaagttcgaaatggccgaggcaaaaatcaataaatcgttggaataaaattgatattttataggcaattagcgaatttgtgaaagcgaaagactcaaatgggtcgatggaccgcttgttgggctttttggacgagttcaacagaacgaatcgttttgacatggtcagaaaggtatgtatggatcataattaatttatgttgatttctcaatgatcagtttatatgaaacaaaaatttacgaagattttgaatctgtcctgtttttttagtcttttaaaataattattattttattaaataaa

SEQ ID NO: 71642 - DNA, 2323 bp, Heterodera glycines
  Genomic contig location: Contig_ID=SeqID_9498; Location=265..2587; Strand=-
  SCN-specific regions: Sequence locations=1-181,203-472,494-568,590 -1117,1171-1718,1754-1862,1932-2125,2148-2253,2278-2323
atgcaagaacatttatcacttcgatcaccgaacatcggtcaaagaagtccgtcgattcgatcgccaatgcaagcgctaaaaatcagtccccgaggggaaattgttgcgaatgattcagcagcggcaaatgagcataatgtgtcatcatccgaccattcaaaatatggttaatttttttattccatttattaatattatttctactttatactagagaccggacggagtcgggttctgcaggattttttagagatcccgcgggattaaattcgggatcccgacctcgggatccgtcccgattacttttccaaaatcttctggatttggtcgggatcccgactcggggttcctccgaccccagtcgtccggtcactactttatataaagaatttgttgatttcaaaatttcggcaagcttattttgggctagtaagaatgatagccattttcagcgtggtttgaagcttatagtaagaagttttcttattttccattttagcattatttgctatataagaacccatttttataatttcgaaactgcattagcataaaatttttttgaatccaaaatttaattttaaaatttcaagtatttcgagcatttcttagaatatcgaaatttaggcctcaaatttcgaatcttatatcaatttaatttgagaaatttacgccgtattttgccatttttgttaatatttgtccataggttaacaccaattcatattgtaattttgaattatgaaattattatacatatccgtgctctaagtaataatgaaatatttcgtcagattgccaaattgcggaacaattgctaaagcattggttggctctaaaagagccgaacagaaacaaacgaattcaaatgtatctaagccaaacttttatggacagaaattcgaacggacgaaatgtgctcaaaaaaatgggaacaaaaaatcacaaaaaaattaatgaaactattgaaaaattggaaataattgtaaaggaaaccccaaagaatgaacgattattcttgcggaaaatgagtgaacaatttgacaaatttattactttaatggaacaaataatgaatgaaaagtgcaattatttgccagaaccaccaattgaaggcaaaaaaaaaaaacaaacaaattatttaatttttaaattatttatttataaaatcatttggctcatggaaaatacgacagtagaaagtttcaaattaagctactgtaacttatgtacaaaagcttcaataagaaaaaaataaacaaatccgtaaattatgaacatactataattgtttactgtaaatttgtttaatttagaaaaaagtgctaaaactccacgtggagaactgattgaaatgtattgggatgatgaaataatggaaacaaaaagccaagaaaaggttggcggcgaagtgtccaacgaaaagtcattccaaaagatttcgaaacagttgattaatcagctgagtaaattgagagagcgattcaatgcaaaaccgaaaaaagggcgcggatttattgtactgcttgaagacatttattttgaagtcggatcgccgggtctgagatcgaaaatcaacaaaatttcggaggccatgaaggtagaaatgtatcagttttttttaattaagagaagattgaaaaaaatatattgcgaaataatggtgtccttttcttcttccgtttacgtaatccttttttaaatttcgaacttaattgaaatattattaatttgtatatttcattatatttatgtaaatacaattagaaatcaattaatttgagagttcatttttataaggtaatagtatttttccttctttatggcattcttgtggaaaataataaatcataactttcttgaaatttaaaaaacatgaatttttctaaaacaaaaatagaaattttatttactaaatatatttttattaagaacaataaatagggcttccttttttaggcaaatgcttaaaattttgcgcactttaaacgttcagataagcacgaaaaatgcattttccgcttggtttgggaggctacgatgatttttataatgcttatttttgcctcttccgggatttttatgcctaatgtgcctatttgcaggattttcaaaaaatccttaacaaatgtattgaaaacgaaaaacagaccgctaagaaatgacccaaaaaaatttcagaaaattcccctaaagaaacgaataaatttaatgtaaaaggggggggggaatacatttcgacgtatttttggcaattaatttttaatttaataatttcagaaataaaatcccgaaaaatctcgagttcataagtgggattaaa

SEQ ID NO: 71643 - DNA, 86 bp, Heterodera glycines
  Genomic contig location: Contig_ID=SeqID_44104; Location=1530..1615; Strand=-
  SCN-specific regions: Sequence locations=1-18,40-86
ataactctaaagttggccttatttttgtattaaatttccttattaatcgattcagaatttttttctctatcgatatgcaaaatatg

SEQ ID NO: 71644 - DNA, 608 bp, Heterodera glycines
  Genomic contig location: Contig_ID=SeqID_44105; Location=115..722; Strand=+
  SCN-specific regions: Sequence locations=1-311,333-568,590-608
atgccaaatcaattaacgcggctcaaaatatggtatgtcaatattaatcaacaactacggtatgttactcatcaaatatatacagtatgcccttgagttaacgatgccaaatgaatgccaaatttaaatattccgccaaccatctgctggcgcgttgcaaatggcacacagactgttggagtagtcaagccgtgacttttttgagcgcctcgaaggcggcggttgtgccatgttggtggcgacaacattggcacaattgctgccagccggctcaaatgccattggtgtttgtggcgaaccgaacggcgtcatcatcatcaccgttgttgcaagcattcgatggttggaaatggcggatggtgaaagcatttggtagttatgtgcagctagatgtctgactgctgatcagttaacagagtgatcggagctatgtttttatgtcgtttgatacacctttaaggataatctcatttttgggtcatttgatcctaatcaaattttatcactggtcacaatgatccgtttggataagaaaatggtgtcagaatcagtgttttagaaaagagctgatcattttggcaatcacagtaataatcacagatatatga

SEQ ID NO: 71645 - DNA, 681 bp, Heterodera glycines
  Genomic contig location: Contig_ID=SeqID_44107; Location=177..857; Strand=+
  SCN-specific regions: Sequence locations=1-681
atgaacgctaaaattatcagagtgccgaaaatcacatgtgatttaatcctagaaaaaaatggtctaagtaaaaatcgtaagtacgctcaaaaagcttctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaatttttttagcgcttccaattccttctacaatcgcctttgtacatcccattatgagcgctaaaattatcagagtgccgaaaatcgcatgtgatctaagcctagcaaaaaatggtgtaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaatggtctaa

SEQ ID NO: 71646 - DNA, 997 bp, Heterodera glycines
  Genomic contig location: Contig_ID=SeqID_9499; Location=949..1945; Strand=-
  SCN-specific regions: Sequence locations=1-26,48-51,137-345,484 -725,750-857,879-997
atgtcaaaagaagccgaaaacaaattttgtattatttcatgggcattgaggtaataaataattagttaattaatatatgaatctgaaaaaatattgttaaacattttttaaataatatatttttagtaaaattttacaaaaccatttactatatttcctaaaatagagcccccgggggctttatttttcaagccccctcaaaaggggggctttatttcaagggggttctgatttagggaggggggggggggctgtattttagaaaatacggtatgttcgtttaatattataaattttctgcttaagaaaaatttttctggccaatgaaaaagatttaagctttccaatattagaaataaaataaaatttatgaaaatgaatgtgattattttttttattacattttttaatagtttaactaagcgattaaaattttaaaattccataatttatattaataatttaaaagtaaatttttaatttgtggcaatgacggcaccaaattgtcaattattttcttttcagacttccccagcagaataaaacatcaacatcagagcgtattcggcatttggcgtacgcgcgtcgtcatagtgccgagttggcacttgcattatcattgcttggcattatgttcatggtgttggccatggagttcggtttggccaaatggcaaaaaatggatgaagcgatgcgatggacattagcagtaactactgtaacgctgctgctggttactgtacgctaccatgtgctacaggcaaaagtaaacgcatataaaatagagttggcacttaaacaaattactttaaaaaaaatcattcattttagacaagatatttaaaataccgtaatactttttagaattttaaattttttaccattgttcctatagacagacagtgtgacacaataattaatttcttgaaattttcaaattttctatagctaaaaattggtaattttttggcatcaaactttttataagtcgaataaa

SEQ ID NO: 71647 - DNA, 1471 bp, Heterodera glycines
  Genomic contig location: Contig_ID=SeqID_9499; Location=2658..4128; Strand=-
  SCN-specific regions: Sequence locations=1-518,544-662,698-937,960 -1187,1210-1308,1348-1412,1434-1471
atgaatagccttaaaacagactatgtaagtttattgatggtcggtttcaatgattgtggaccaaaacatcgacacgaaaaaaaggtccaaacaaaatttattgaaacttgacgccgtttgagcatacgtttgagtaccagaaattttagggcattaattttttatcttaatacgatagtttttttttttttaatttttcattttgtcccccattcttaaggcaatcaacaacacattgctaacatcaggcttaatggaggaccatcatcttgagcaaggaactgcaacaattaagcctgtcgatgtgctaatgaatgcttggagtgttgcggaacgattgtacaatgacggcaaagtcaaagcattgggtgtaagccgaacagacatagagatggtcaagctgttgtgtgaacgtgccaaaactcgacctcactgttggcaggtggtaacagacagcatagataaatccactcaaaacaattgaatagaaaccgtaaagcaattagtttatgtctttgatttaataatattttaattttatttccagaaaaaagaaatcattttcttaactcaaacttaatcaaattttaactaactaatagagaacattcgtttatctaatcatataatgaaatttactaagttataatttattattctgcaaataaattaaaattacaattaaatttaaatattactatcattgagacttttgaggtttggttcaatacgaaattatcgataaagcttattgaatgagtaaggacagcttataagggaacactctcaactgtaactgctgttcaaattgctttaaatcactttttgtttaatcgatgctgattaattgttacaaaatgatttcaaattaagaaaattagtaattggaaacagaaaaaatcccaaattgctctatctccgaaatgcaaccaaattattttaccaaataaattaaaatgaccaagtaagtatgtatctatgactttacgaaatacatatacggtaccatattacattattatttgagtcctataacaatacagtacaccaaaaaagccccttaaatttccattattttttagatagatttggccccgttgatggccaattttgatgatgttttgtcactgtgcagtcaccataaagtggtgccaattgttcgcgcaaatgcgatgggtgcaagcagcaaatttggctcacagcaacagcgcggtttctaccacacactgttgcgcgaaatggccaacaaatatggcaaatcggcaacacaggtggcaacaggcactcactgattgccaattaagaaacaaatttaaaaaattttaaatttgatattcaaatatttttctttttctaattgttaagaagagaatttgtattacaataccaaatgtatgaaaagcatattgttttcttgtttttaaagcttctatggcatagttttttgtgcttttttattgatcaaattaaa

SEQ ID NO: 71648 - DNA, 1224 bp, Heterodera glycines
  Genomic contig location: Contig_ID=SeqID_9500; Location=630..1853; Strand=-
  SCN-specific regions: Sequence locations=1-186,213-265,288-520,560 -564,598-601,634-658,687-883,907-933,977-1002,1039-1224
atgagggtgtcatggtcgtcagttcatcattctgagcacacatacattatttgtttaacttctctaacaccaatcaattccttcatctcaacaatgaatgatgagtgtgagtagtgttcagggcggggggcctttgcgaagaatgagggaaatttgttggcgcccccacaaaatgtccaagccacgaaatgtccaaaatttttcaaaatttataaaaacaaaatgagtctaatttggggtttttagggttttcggggtcgctgaatacgaatatagcctttatattactcctttgcctaaccttaggcccatccgaataataaaaaactcaatttcgagacttggacatttcgtggcctggacattttgtgggtcagcgaattttttgactcaaaataaatgtggtgaaatcaaattgttgattgtgaaatttttaacagcagcttttaattcttttgaaaaatgggccgtttatttaagaaaattagacgcaaagaatttgacttgtttttatcaatttatttgattgatgaataaattgttaattaaaaagaaaagtggatgtaaaaattttaattaatttttcaatttttttttgcggaataaatgttaattttaaaaaattgttggaccttcaatttaagaaaattggatgtagaaatttttattttatctaatttttttttgctgaataaatgttaatttatcaatttaagaaaaatggatgtgaatttattttatcaaagtttttttttgctacaataaatgttatgctagtaaaaaaaatgttgaaaagtttctcacacaccacttaacacaaaatccgtttttataacacttcattcattgaaaacaaatattgggaatattgctaaattgctatgtaaacaaatttttaaaaattttatctccgctttttacatttcttcaggcttttattatgtataatatttttaattctaattagtaataatttcagcgctaattaaaaagtattctctcaaataaaatttatttattatttagatttatttaaaacataatcatgatgaatattaagcattaaaattataattatggcgaagaaaatcacagaagaaggcattaattatagttcttcctttttgcttcaattgagcccataatcattaatattcaattattaaataacgtaaaatgcatagcagtaaaaaagtagtaaactattaactattccacaataaa

SEQ ID NO: 71649 - DNA, 840 bp, Heterodera glycines
  Genomic contig location: Contig_ID=SeqID_9501; Location=771..1610; Strand=+
  SCN-specific regions: Sequence locations=1-11,33-70,111-136,158 -593,616-840
atggttgtcgctcaatccgtccgtgcagtacgcgttgttttggacgcggacatgggcgtgatcaatccggaccatttgttggagcattttttggcaaaatttgacaccgaattgccacacggaggaacaattgacatggttttctatgagcgcattttcaacggcgaaataatggccggaagttattgggcacggaacacacgttttgccattgaaatgttgcatttttgggccaatttcactgtgccgtcgcgcaccccttttcgcggaggcaccgacaacggggcaatccatgtaattttgttgggggatcgcaattagggattttttatgggcgcaaaatagggaaaaaatgccagattgcagcaaaagttttttttgggccggatatcccggctctattgcagttcacacaccataaaagagacgacaatacatttttttgtaactttaatgcaccataactttttctaaaaggatccaaattaaactttcttggtatcattcaatagtccaacgaattctttattagtctgctaaatttcaaaaaatttcattatgtttcaataaagctatggccaaaaatgtttagaaaaccaaatttttgaaattttctggccataaattttttgaaacaacgaatttttttttttgaaattttgcaggataatagaggatattaaatgctaccgtatgataatcaaaaaagtttaatttggatgcttctagaaaaagttatgatgcattaaatttgcaaaaaaatttatgtcgtgtcttttttttatcgtcgtatgaactgcaatagagccgatatccctccatctattaaatgtttagcga

SEQ ID NO: 71650 - DNA, 828 bp, Heterodera glycines
  Genomic contig location: Contig_ID=SeqID_44115; Location=151..978; Strand=+
  SCN-specific regions: Sequence locations=1-828
atgaacgctaaaattatcagagtgccgaaaatcgcatgtgatctaagcctagcaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaattttagcgcttccaattccttctacaatcgcctttatacatcccattatgaacgctaaaattatcagagtgccgaaaatcgcatgtgatctaagcctagaaaaaaatggtctaagtaaaaatcgtaattacgctcaaaaagcttctcaaacaattttagcgcatccaattccttctacaatcgcctttatacatcccattatgaacgctaaaattatcagagtgccgaaaatcgcatgtgatctaagcctagaaaaaaatggtgtaagtaaaaatcgtaactacgctcaaaaagcttctcaaccaattttagcgcatccaatgccttctacaatcgcctttatacatcccattatgaacgctaaaattatcagagtgccgaaaatcgcatgtgatctaagcctagcaaaaaatggtgtaagtaaaaatcgtaactacgctcaaaaagcttctcaaccaattttagcgcatccaattccttctacaatcgcctttatacatcccattatgagcgctaaaattatcagagtgccgaaaatcgcatgtgatctaagcctagcaaaaaatggt

SEQ ID NO: 71651 - DNA, 1040 bp, Heterodera glycines; identical to SEQ ID NO: 44116
  misc_feature (152)..(152): n is a, c, g, or t
  Genomic contig location: Contig_ID=SeqID_44116; Location=1..1040; Strand=+
  SCN-specific regions: Sequence locations=1-115,137-579,616-847,869 -1040

SEQ ID NO: 71652 - DNA, 1223 bp, Heterodera glycines
  Genomic contig location: Contig_ID=SeqID_44117; Location=166..1388; Strand=-
  SCN-specific regions: Sequence locations=1-30,52-261,283-340,378-1223
atgtccaagtgagagggagaaagtgaaaattactactgtaattagacaatatccatgtgaagggagggtgtgctgtagcgtttcttaaatccgccaatgtgtccgaaaacaaaaaattatacatataaatgcataacttagctcaacttcatccaaattaattcgactgattgaattttgaaaaaatatctgttaatttaattacccagttcaattttggctggacaattggcactgtgctggacctattagtcacctattcggacgaattggcgttgagcactgatactactgtctactgcttggaacaaaaaattgaggaggagccaaatgaatttccaaataattttgtaaataattaaaaaaaattaaaataacgaaattaattttcatgtttttttaagtcggagtacagagcagagaggctaacagccgcacagaaggaagttgatatgatgaacacatcatgggtatgaaatttggcgtcataatggccgggatttggggcagcttcttcccccctcccccgaaaatttaaaataaaatttcaaacaaaaagagcttacaaagaaaaattggaaaatttcaaccgttttttaattttgtgaagaaatattttttataaaaattccagaaaatttgaaaatttttttgcacccgtaatttttagggtctaaagcccgcaaaagaagcttaatattgaaaaatatgtattgtatacatagtaagtattaaaatcacaaagaaaatttgttttgccaatttattttactttcagattaaacactcattttcaggccgttgtcgttgaaagatttgcactgatgaaagatgaggatttcttgaatttttttggcactcctgtcgatgagactgttgaggaggacaaaaatgagaacaacaacatccatttgcgatctgagctgaaggcagccgatggagaggaagacaaaaatgatcttccaactgaatttgacgcacgcgaagcatggaaagattgtgccgaaatcatccaaagtggatatgcacaaggtggattggaggatgatttgtagtgctgttcgagactctcgagtctcgaagagtcgtgggaaattttcggtcccgaacagcattataaaacttaggctggtaccgaaacggcgggcaccgaaccgtcctgttccgaattatttcaactattgtgacgttttgccaaaatatgttaacaaaaatgcaataaa

SEQ ID NO: 71653 - DNA, 527 bp, Heterodera glycines
  Genomic contig location: Contig_ID=SeqID_44119; Location=737..1263; Strand=-
  SCN-specific regions: Sequence locations=1-256,278-443,480-527
atgggatgcagagctttagaggacccccttgtagagaatgcgaacggtggaaggaatggtcagagaagttcaagggtaagtggggaaagacaatggaaacagtcaacggacggagaacattgatcagtcccattaacaaagcttgatagaaggtcagccattggtcagatcgctatctgatcagttcagtagggggcattgacccgtgatgtctaccgtactgatcaatctgttcagattccaaatgctttgtgccgactcccaccaaacagcagcagagttttgggatatgttcgatgtaacagctcctcaattcactccatttgattataatttccaattttaaggccactttgtacgattggcttcgtgctcgttacgaatgcaaaagcgcttttctgaatgtttatgagaaaatttgcatggacaatagagaaattgtgtttaaataaataattacacaaatatttatttaatttgatcaaatgattattcttaaaggtggcacatataattatgccaataaa

SEQ ID NO: 71654 - DNA, 624 bp, Heterodera glycines
  Genomic contig location: Contig_ID=SeqID_44120; Location=161..784; Strand=-
  SCN-specific regions: Sequence locations=1-284,306-400,422-624
  Gene Ontology: Mol. function=oxysterol binding; Cellular component =cytosol; Biological process=Golgi to plasma membrane transport
atgcaagcgccagattggggcaactacgacaccaacggaaccgactacgactacatctacaacaactcggacgaacgggacaactggaacagcgagcaggccggcgtgttcagacatttagtgacccaggtagacgacgcgttgttcgatgaattgttttaatagaaattctcttttcagctcggcaccggtcagactctgcagaatttggcgctgcccaccttcgtgctcggaacgacgctctctcctcgaaatgtaagccgaattcttcggtgaacacagcttttttaaatttttccaagttcaatcttacctcatttcagcttgatgaactgatcgccggcgcctacgagaacactgctgagaagcggtgtttatttcccgattggttgacaacaacgcttttgaatcaacaattttttcagattccttgccgtcctcaaatactacttgaactccttctaccctgcacgcaaaaccgacgacgcgaagaagccgtacaatccgatcctgggcgaagtgttccgttgccgttggaccctgcctggcgtgccgttgtccgcaagccgaaccgccggtggaccgttcccgggctcagcaaccaaccaggtccagtttaagtga

SEQ ID NO: 71655 - DNA, 2313 bp, Heterodera glycines
  Genomic contig location: Contig_ID=SeqID_1288; Location=1055..3367; Strand=+
  SCN-specific regions: Sequence locations=1-171,194-555,577-728,750 -1050,1077-1450,1472-1741,1763-1952,1974-2101,2151-2313
atgaccacgggctcggaccgaacacaactccaaatgcaattacattttaacgcaaataattcttccgaggcatcccaatcacaaaattcctccgaacaaatgcaaaattgttcaagtatgcatttcctaatctttcataataatctgttgaccattgtttagccaatgaaagagtcgctggagaagattcggtgccattcatcgacagagagacttttggagacgcggagaatgacataggaaggcgaccgccgcccgatcggtttcgactggtctatctgatcgtgcttctccatggaatgggcatgttgctgccgtggaacactttcattacgatcgcaggggatgtaaggcaaaaaaatttcgaaaaacaaacttcaattaaatgttttaatgggctttaaggcacttttataactgcttttttaagtattatttgcaattcaaattcgctaatgtgagcaatgaagacaattacaaagtgtacttcttcaattatctgacggtttgtgcccaaattcccgtgagtttattcatgtttatctgattgtgagcatttttctgcctttttcctattttagaatttgctgctaacttttctgaatttatttggcgtcataagaggcggcttttaccgtcgcatttacttcactttggccgtcatttttggcatatgtctcgtcacaattgcgatggtttacgttccaaccgataactgtgccttgccattccttatcttttcttttcttagggactttcggctttttcctcttcacaatgctttccgttgtgcttctgaatagcgccagtggtgtttatcaaaacagtatttggggattgttcgctgattttcccggggaattcgccggtgccattattattggcaacaatttgtgcgggattctgatggcagtgctagacatcctcatcattgtgttaggtttgcgattcgtccacttcgcttttgttcggttcgcttttagtcggtgccaatgccgcactcgccgcaacagtttacttcggtctcgctctgtttaccgtcgtcctttgcattttttctttccattttcttcaaaaattggttctattctatttattttcaaactttcatctctttaaacattaagaatttctacaattactatgtccaaaaagcggcgaaagctcgcgcgaacaatggaatgaatattctgcacgaggaaacgggcgaagcgaaggccaatagaaaagtgacgcatccgcccgtaaaaacatacatcgcagttttctctgaggtaagcaccaattaaagcatgatatgctgtgaaaatatcattttggcaacttataggtccgtcgccagttgctcgatttttggcttgtcttttttgtcactttggctctgtttccgaccgttttgttgaaagtgtctttaattagtccgttcaacgaccagaaaacttccggtgacattttacacattaattgctttttgacatttctcttaagaatcgctctacaagcagctgacagttttcctcaatttcaaactgccgatttgcctccgtctgctctttcttccgttgatttggttttgcgattaccaatatgacaatttgactccgcgtcgcttcgtgttcatccacaaccaatgggtgttcactgttctgatcactcttatggcactcagtcacggctattgcagttcgttggcgatggtttacgcgccgaagtaacataattcattttaatacttttctcagaaagaaatttatgcagaaaagtcaatgaatccaagtcccaagttgttggcatgatgtccggctttttcctcgttctcggcattgcatctggcattctgttcactttcgttgagcctagccttgtcgatgcggcggaagactttttcggcattttttattaatgggactttaactagtcgactttccatctaacttttcgtcctctccctaatttcctgtcatttttgtgccattatttttgaaattataaattcgttcatttattcttgtaaaatttattgttttcacatacctaactttaataaaaccgattaattttcttagaaattaccagaattcgtttgtttcgtgcgataagcataaaaatacaattttataaactaaaaaatttttctatttttttaaaaacacccttcctcatcaaaataaacatataaattagtttattccagggctcgcagatctgaggctttagcctcattttgtggttttttgatataggtcaatgaggctaaattttcaaaatgagtcgatttttcatagtcagattttcacaaaatgcttatttcaa

SEQ ID NO: 71656 - DNA, 502 bp, Heterodera glycines
  Genomic contig location: Contig_ID=SeqID_1288; Location=3475..3976; Strand=+
  SCN-specific regions: Sequence locations=1-502
ggcttttttgcttgccgaatgaggcttttgaaaattttcatctgcgagccctgggcatatatatacataattatttacacaatctgttgaatatcgttgttgtatgcataatatcgtccatctgattggtcagtcagttcggcactttcttctcaggccgtcttggtgtggctgccgccctccggtgtccacaattccatgttttccctcatcatgcgcaagttgagcgaggcgtcatcagccaatggcaccgtcaatgtggcaatctccgcctgggccaagtcaattgcctaaaaatccggggagaatttagccacattatacaatgaaagaaaaagcatgatgaaaatcatcaaattggtcccactttttgggccaatttgcgcgcctcgtccaccgattttaagatttcgaagttgaacacggagaagttgagtgcaaggccaagacgagtcggattgatcgctgcaattttggaggtggcgatgtccatggcttcttg

SEQ ID NO: 71657 - DNA, 973 bp, Heterodera glycines
  Genomic contig location: Contig_ID=SeqID_9502; Location=277..1249; Strand=+
  SCN-specific regions: Sequence locations=1-250,272-973
atgaagcacaatcaggtggagggaagtgccgtggcctgcaaagtcgtgccaattcgttcagattgagcaattggacgatggccatctccgcaatctgagcagcctttcgttgctcactctcacgggcaacaaaatttctcaaatctctccgaattttgcccaaaatactccgaatttgcgttacatttatttgggcgacaacaaattggaacggatcgacccgagctcaattaagcaattttctgcagccgaaatcattgacctcagcttcaataatttggctgaaataagcgcggaattgttcaacggaatggaaaacctgcaggtgacggaattgggggagaagcggcgccttggagaacagctgtttcatgctttagcatctgaacttggagtcgaatgccatcaaaggcgtcgccgccggcgccttcgccaccactccgctgctccttctgtggctgccccacaactgcttggactccgtgtcgcccaacatgttccaaggcgcgcccttcctcaagcaagtgtcccttgcccacaacaacatccgcactgtgcaggtcagcaaaacaactcgcggttgttttaacctctgcccatctgccaaaaaacccaccaaatactttctactacttttagccgttcagtttcgcccatttggccaatttgcacactttggatttgtcccataacaaaatccaaagcattcagccttcctccattatgggctcagatttcctcacagtccgagtgcaaggcaagtgacaaagagcagcagatgaggcgaccaaacggacttttcttcagagaatccgctcgtctgcacccaagacggtttccacgtgatgaacggacgagaagcgatcaatttgacaacagaagcaaacctcatttgcaagacgaactacggaaacgaagtggaggacaaatgtccacgaaaaccggaaagtgtgccatggaagggatgttgtga

SEQ ID NO: 71658 - DNA, 380 bp, Heterodera glycines
  Genomic contig location: Contig_ID=SeqID_9503; Location=354..733; Strand=+
  SCN-specific regions: Sequence locations=1-261,283-380
atggccaagcaaatgctaactacggacattcggaagaattctttgccgtctccggaatttgctgattcattagaaacaaaaatggccaaacgccctcttcaggagaacggcgagttcagcagggacgaggaggcagcccacgtggaggttgaagagaagaagccgagccaaaaggaagtggtggccaaacagtgagtgaccggccggcacccatacgatgcttactcactcactcatactgtatttaacattgaattcccaaatatttatttttcataaataacagtacaactccagttcatcctccccatcccgtaattcagaaagaaacaaacaaaaaaaacaaaacaaaaaatatggcccaaaaactgccaaaatag

SEQ ID NO: 71659 - DNA, 4162 bp, Heterodera glycines
  misc_feature (53)..(53): n is a, c, g, or t
  misc_feature (58)..(58): n is a, c, g, or t
  Genomic contig location: Contig_ID=SeqID_9503; Location=799..4960; Strand=-
  SCN-specific regions: Sequence locations=1-341,365-968,991-1062,1084 -1201,1223-3444,3466-3637,3659-4162
tctttgaggtcccttcgggtcgctttgtccgcgagggtcttttttgcgctggntttgnctcttcagcttcgcttgaccgtcctttggccgaaatggtccttctccactcgacttccgacttttgtctgctcggcgttcgcggagggggcaaatcgctggtggtcaacgaatttgccaaaaggttgggctatcccgtcgaaacgatcgtcctttaccaggtaatcgcttaaaaccgacaaacactcaactgatttttgcaggacatgagcagcagagagttgcttcagcgcaggaaaattcttccaaacggcgacacgcaatgggaggacaaccaattggtcagggcggccaaacgcggggcgttgtgtgtgttggacggagtcgacaggggtgggaaacccgagcatttattcttgaacttttatgcattgttgcctaatgattgttgccatttcagtccattggagcaccgccgagtcaatcgcttccctcgtccatcaccgctttttggcactgcctaatggcactcgcttagtcggcaattcacactttgaacttttgaagcatcgcagcggattgagcgaacaaatgcttaacgatcggtgggtacgttttaaagcgtggataataatctgttaatttctgaatggcttactttttcatttcctttctcattttcaatttcttttttcatagaaatgtcttccgaatcccggattccttccgaattgtcgccctcggcgactccgaatccgctccaaaatggctgaatgctcagcttctgtcccagttcctattctgctctctccctagtctctccatcgatgaccgattgcgcatcattcagcagcgtgttcctaatgcatcggttggccatgcgaagcgattgttgcgactaatcgatcggctgtccaattcgcacgacgcttcggtcgtgacttttatgggctatttatttaaatctcattcttgtgtttgttttcctcttcagattcggaccatcgcctcctccctttcgctgcgtcgtctcattcacatcctccgtcgccattccgctcaccccgaagagggcattttcgacgccgttcaacgcgccgctttgacccgtttcgttccgccaattgttcgacgcgcatttgacgcgacactcgccgaaattggcattgtgcccgacgggaagaagaagcacgccgaatttgagaaagaagaattggaaaagatgaggaagagggcggaagtgccggatggaatgtcatcggtcggagagagtgaaacaaaagttgggggccgaccggcggacgaagcaatgatcccatcaactctgttcttcgacaatccccaagtaggaagtgaaggttttcacaccacaataccccacgaatagcatctcattgttatggcgaacatggcacgcgatttccatctcggagcgcatcttttgctgatcgggaaccaaggggtgggcaagaacaaagtcactgaccgactgctcgaacttttggatcgaccgcgcaaatacatgcaattgcacaggtaagggagaaagcggtggtgggtaaaggccatttccaatggcatttctcctcagagacaccaccgtccaatcgttgacagtccaatcgaccgtcgttgacggagtgctcacttatgaggactcccccctggtgcaggccatctgcgacggacttgtgctggtcattgacgaagctgacaaagtgcccactcatttttgtcattttatcttttcactttgcgaaggcgcctctgcacgtcgtcgccattttaaagtcgctgttggacgaggagcctttttatctttcggatggccgaagggtttgccctggaaaacggaaaaagggagatgaaagcgaaaagggcgatggcaacgatatttgtacgtttgagcacaatggagtttgtccaatttgtttgttccgctagttgtccatcccgaattccgtgccattctcctcgccaatcggcccggctttcccttcctcggcaacgatctttacgctctgttgggtgaccttttggccgtacacgcattggacaacccctccaaagagtccgagttggccatgctttccaaatacggaccaggcgagtggacgacggcctttttgcttacctttcgacagatgttccacaggaagtgctcgaactgctcgtttccgtgtttggcgacttacgttctttggtcgaccagcaactgataagttacccctattccacgcgagaattggtcaacattgtcaaacacttgcaaaagtgagtttcaaattcattgtcctgaatctgttgtcccattactaattcactcattttgagatttcccgacgaccctttgcctgaagtgatcagaaatgtgtttgattttgacgcttattccgtggacactgcccaattgatcggtgaagtttttcagcgcaaaggcatttccattggttagaaaaagacagacaatgtaaagttgttttattaattattctctcaaaaaggtgtcggtctttcgtcgtccattggtccgtctgatgcttatgggaattggggtcgaattctcgggatgaaacgtgttcaaggagaagaagaagaacgcgtccaaattgaaagggacggctccgtttttgacttgtccaaaattgacgagcccaaattcggaaaggtttcttcttcaaatgcaatttaagaatttattattcaacagatcgatccgaataatgtgccacatgtcggcggaaacacttgggcgggtggcaccggtaatgtcttatgattttttggctccgattttttttttcaggggggtacaacacggccggacttggaggagtcggtggtccgtttcggtaattgcaattaatcattgacttaaattctgccaaagtttggatgccggccatgcggttcatcaattgccggatagtgccaaggagcaagtgccagaacacattcggaaaagggcgagggaaatcgccagagaggaatatgcgaagcgactaaaagtaggcaaatgaagcgcactcacaatcagcttttgattggcgtctaatgaatgggcctttaaaaggaaattgacatgggcgaatacgacgcggcggcatacgaagaattggccactcgcgtgggccgacaagtgcgggtgctgcgcagtgtgatcgactcgttagagcagcggaagcacgaaagacagtgggccaagcaccagacgagcggagacttggacgatgccaaactgatcgaagggatggccggcgaaagaaacatttaccggtgagggggggggaccgacccaaccctaacacaacgtaaaaggaagcgaattgagcaaccgcccgatccctcaaaccaacaacaaccgaaacgaattcgtctgtgcttcgacgtgtccggctccatgtacaggtcagtcgatgatgagccatgacttactggtgctgcactcacaaactgttcatttgaattctttgcttgttttttataaaattacctacctatatcttaattttactaaataattattgacagattcaatggctacgaccagcgtttacaacgttcgcttgaggcggcgttgttggtgatggaaggactcgacgggaaggaggacaaagtgaaagtgggcgagtgaccgcctcctcttttcttttgccctttttagtacgaaatttatggacattcgggcgaaagtgccagcattcccttcgttacgttggaccaacgacccgccaatgagaaggagcggctgaacgtgctgaaacggatgttggcccattcccaattttgcaccagcggtgattacaccgtcgaggccctttcgctggcggttcgcgagttggacacgggcggagggaatgacttcgatgaaaaatttgtcgtgctgctctccgacgcgaatttggaccgttacggaattcgaccgtcagaagtgagccgtgcgctgcaaatgggcgacagtgtcaacgctttcattgtgctcatcggatcgttgggagaacaggcgaaaaagtttgtcactagttgcaaaccgttcacaagcagaacaaatgtcttcatttttagtcttcaaaggcatcttcccgccgggaaaacttttattgcaatggacgctgctcaaatccctgagattatgcaacaaattttcgcatccactgttgtcaga

SEQ ID NO: 71660 - DNA, 81 bp, Heterodera glycines; identical to SEQ ID NO: 58971
  Genomic contig location: Contig_ID=SeqID_44125; Location=1203..1283; Strand=+
  SCN-specific regions: Sequence locations=1-13,47-81

SEQ ID NO: 71661 - DNA, 464 bp, Heterodera glycines
  Genomic contig location: Contig_ID=SeqID_44131; Location=1..464; Strand=-
  SCN-specific regions: Sequence locations=1-179,201-426,450-464
gtatggtcatttttcgggaatcaatcgcaaagttcagctgaagtatttgaagacgagtgccgaaaaggcgaacacggctggcaaaacgtcgtttgtgcttgagtccgacaaaaccttgctgcaaaatgcgcgcggtagagagagaagcgaccaatgccaaaatgcttcttctgtgcctactttgtttctcatcctcaaatggggcggagaggtgctcagggaaaagcaaagcaaaggcattgttaactttttaagcttacaacggccggcattctacaggcggaagcgttgggacgtctctttcgaacactttacccggggattcgccggacggacggcaaagactcaccggaggacacgcagggacttggctttttacggttgcatagcacgtacagacacgatttgaagatttatgcgtcagacgaaggacgagtgcaaatgacagccgcagcctttgctag

SEQ ID NO: 71662 - DNA, 1741 bp, Heterodera glycines
  Genomic contig location: Contig_ID=SeqID_9504; Location=579..2319; Strand=-
  SCN-specific regions: Sequence locations=1-209,256-358,394-845,867 -1114,1154-1296,1602-1612,1634-1662,1687-1741
atgatggcttcacccggcactgatttggaagctaagtttcggcttcgtgtgttcgccttgctcagctcggcaccggccttacaccagctcatccaatccaagtcaaacacggccagctcagcacgcatagacttagccaggtaataatagattggtttcaacgcagttccttaattagccaatttatgaatcaattaaatttttcggtgaaaatttcaataaattttattttaaaacaaataaaatttaaaaaatcttctaattactcaatttatcacagattccttgccgcttattatctcggcattgacttggcccgcctttttgaacagctgaaccggtgccatcatgttgaagcagtagtgcctggaggagtggcaacatcaacagtgttgccaaatctgatggtgtgcgcagagttggatgatggggaggaaaattttgaggtaattttctttttttttaattttttttcatccttgaaaattctatgagatggtttgaataattttgatcaatgttgtagagtaactgtcatatctttttttaaacacatccaaaccaataatcttagaatcttttagcatagaaattttcattcaattttcagaaagttataaaaaaaatatccaaaaaattgccaccaacattttgaaactgaatgaaattatctgaagtttttcatgctaataaataaatcaacagctatcatattataccacaacattatttaatttggagaaaaattaagacgaatttctctcgaaaaatctataaatttggctatttttacgaaacgatctagaccgtataattacagtatgacccaacaaacaaatattcaaatttatttttgcttaatttatctaattagtgcgatgccgatcgtccttcatcttcctccgctgtttgggatcgctctcgacttggccaactattgccatccgaatgtagcccaaattttgcgctaaggctactgcttcgagaacaacgctgcttggaagccatatttttttccgatcactttcacgactcgcgcacatcgatggcactgcgatttctcgtcgatcggcacattccggggtgccatttatataattttgcttttaattggattttttttaattaaaaaaattactttataaaaaaatttgcattaaatcatgttaatttttgtaaacagtttaagccttttggcacaatattttcgtgtcacattaattgatcagttgttggatacaatcgaatttgatgaatttgacgggaacgaaaaacggactcatcaatttatcgaggtaatatattaatgaattaaattaaaattatatttaaataacttcatagaattattaatttgaatacaaatttaaaagatataaaaaatatttataaataatatacaaatataaatcagccaactacaacaaaattaaattcaaattatatttttaatagcttcaaagaattatttacgttgaatataattaaaaaaaataatttaacttatataataacaatatatttttttaataatataaaatgaatcaagaaaataatacaatgaatatttattatatttcttttaatttaactataaaaaacatgaaaaaatacgggaaattttttaaattttcactttttaggctgttatccaagcagatgttttattttcggaagaatttggcccctttggactgttaaatgagtgcataaaggcactttcctccagaatggttgcaca

SEQ ID NO: 71663 - DNA, 2196 bp, Heterodera glycines
  Genomic contig location: Contig_ID=SeqID_9505; Location=1830..4025; Strand=+
  SCN-specific regions: Sequence locations=1-257,284-298,323-400,423 -691,713-1034,1068-1124,1146-1452,1475-1602,1654-1791,1817-2099,2142 -2196
atggacccggaccagatccgggtctcaagtgtcggcatgttaaaagttggcactcgtgtccattccacaaaattcagaccatttcccgaggagaccacgttgccaagtgtgttggacactgcggaggaggaggacaacaccatttacagcaacttgcgcgacgaagtggagcagtgcaagcaacatgacgttgtggtgaattactctcggcttaaccttggtaatagtggcacatcggcgaccggcgacggcacaaatgctgctgcttctactgctgctgctcaagatgaacaccaacggcacaaggaagaggaggatgggcaaaagatttacgacacaatttgtggtcaagcggtcgtgccacagaagggcagcaaaacattgccaattgtaaataaggcggggccaaatttggggccgggctggctggtgggagactgacccttccttcaaaaacaacaacctatttcggcttttaatgcgataatttaataaaatgaattaaatccgaatcgggctaattctgggtaattaatgggttaaattattactaatgagtttactacaaatgtgccgttttatttgaacattcgcgcagagttatgccgagttcaagccaacaacgaagcgggaattttgcctcaaggagcttcttgacaaggacatcaattacacgaatgccctgaggaggttcaaaaatatttttaaaaaacatcttttttttggctatttgacgagtgatttatatgaattttttggctctatgttatggagaaaggctgaaaaagctcaaaaaattatttctgcatcaaaattttgaatttatgaggtccatataaatccatattttgtgggttttcggggaacaactccgcttaatttgatatttttggggttttcgccattaaaatttccaaaaaaaaactgggggtctagcggtgccgttagacgtagggctcagccttttaccattttttttggatttctaatccatatttcgggtgttttaatccatgttttatgccctcttttgatatttattttttagtccatattaataaacactcgccctaattagacacataattcgtaatttccatcggctttaaaaaagcgatttaaacaaaaacaatttttcccattcagaattgaaaacattttctacgctcgaatgcattttcatttgaatgccgaagatttggcaacaattttcattaacattcgcgaaattttgcggctgagcatcagttttgtggccaaattggagccagccgttttgcatgcgcttaaccttgctgacagtcgccgaaatacggccaattttggcactggcgttgctgacatgccgcccctcagtgtggccgagctgttcataatgtgaacaattaatttttaaatcatttgctaaatttcaaatgccaatttgaattccaacaaatttcgattccttccaaattaaaaaaaaaaatttaatgcaaaacgtttatttaaaatacttaaattcgacatacatttattaattataaactagggttgagcccccgatcctgagccacgattgaaccaatgtttccaaattttgcattttcgtctcgcttatcgaaataataaaatttttaataaaaataattgttgatgttttaaattttaatagatataaggagcgcttcacaatttacggcttgtactgctcgcagctcaccaagtcgacgtgccgaatcaacgagttggaacggaatgaccccgagtttaagcggattgttacggtagctataatcaaaagtgatactgtaatatatttatttattatttttaagaatttggcaaaggatgaacaatttcgactccaaacgcttttaattctgccatttcaacatatcacaaaatatcagctgttgctcaatgtaagttttatgtcaaaaattttttttatttacttttatgactaaaggtgaataatttgaaaattttcaaaaaaagttaatttttgcttattttctcgaaaatgctaataaatataactttttaaaaaattcgaaatttataccaaaaataattcacaattggaaaattctcaattttttacttaattttactcgtaattaataaattttagctttatttttattttcttttaaattgggttttcataccataattagctattttttgagattttatcaaagatttattcaa

SEQ ID NO: 71664 - DNA, 136 bp, Heterodera glycines
  Genomic contig location: Contig_ID=SeqID_44132; Location=158..293; Strand=-
  SCN-specific regions: Sequence locations=1-136
cccccattttccattttcttcctattgagtggtgggaacacccaaacacacattcctcaccttttcttcatcatttgctcgtcgtttttgcattcacttttcacaaaaccttattcgcccaattcattatatgaat

SEQ ID NO: 71665 - DNA, 164 bp, Heterodera glycines
  Genomic contig location: Contig_ID=SeqID_44132; Location=511..674; Strand=-
  SCN-specific regions: Sequence locations=36-164
taaatttttaaaatttttttgaatttttaaaatttcccggttggtcccggtttttcttgcggtcccggtcccgaacaaaaatcgaggtcccggtcccggcttcacaggtcccggcaagtcccggtcccggttttggcaaaaattcccggtcccgtggcactcta

SEQ ID NO: 71666 - DNA, 862 bp, Heterodera glycines
  misc_feature (822)..(822): n is a, c, g, or t
  Genomic contig location: Contig_ID=SeqID_44134; Location=351..1212; Strand=+
  SCN-specific regions: Sequence locations=1-73,98-412,438-586,608-862
atggccgtcgacatttttggcactgccgccacggcgaaactttccacggcggtcggcagtctgcccgaacttttggagaagaagcggctgatcgacttgcacacgaacgtggccaccgcactgctggacaacatcaaaacccgaaaattggacgtattatacgaaacggaggagaaacttttgacaggccaaggttcgtgcacttcattccgccaccgtcgttctccccactccccgaaaattaataaaaacaaattagaaattttccaaaaaaaaaatccctaggatttttttcatttttcagaaattccggtcattgaaacgttgcgcgactgtccggacaaagacgacattttgcggctgattttgatcgctttgtgttctcggaatatgccaactgtacattttcacgtttaattaaaatataaaaaaattttgcgcaaaattccccttgtcaggctgaacagcgcgaacttcaggctttcattgacgaacgtgcaattagctcggatgcgctgcattttgtgcggcaactcaggtgtacgaaattgggtgcttttaaatttgggattttgataattcaagccctaatttccccaagatttttcttattttaaaaatattaccgaatttgtcagcattttttttagtcccgaaaaacatgattttcgatagtgttgtacaaataacagtgcatttcttttagggctttttctcatttgggtgccgaggcggaacagcaccaaggggccggcaccaagacggtcagcatgttctccaaactgctcagccactcatcgcgcttcgtcatggagggcgtcnaaaatttggtgcccaaaagcataacttaccactgacgaag

SEQ ID NO: 71667 - DNA, 225 bp, Heterodera glycines
  Genomic contig location: Contig_ID=SeqID_44135; Location=120..344; Strand=-
  SCN-specific regions: Sequence locations=1-225
ccgggactcaaatgtcccgctcaggccaaaaattttttctatttccgggaaaaaatcgaaatttttccgaaaaaaataccagtcgatagagctcgaaaaactatgttttggaagtggtctccgtttctctgggaaaaatcgttaaaaaatcctaaaattcaaaaacccgaaaaccgttttttaggcctaactcgaaaaattttgaaaattttcgaaattttaaaa

SEQ ID NO: 71668 - DNA, 1747 bp, Heterodera glycines
  misc_feature (32)..(32): n is a, c, g, or t
  Genomic contig location: Contig_ID=SeqID_44136; Location=1..1747; Strand=-
  SCN-specific regions: Sequence locations=1-2,24-111,152-197,219 -239,272-550,617-643,678-680,702-729,839-1000,1022-1258,1280 -1387,1417-1531,1557-1677,1699-1747
  Gene Ontology: Mol. function=lipoprotein binding; Cellular component =lysosome; Biological process=cell proliferation
gcagaaaagcaggtggcttgtgacatggattntaatgggatctggaaaggccggacaatttttcggattttgatttgccaattaccatttttactaagtctaagaaaaacaataaacatttatgggacttgtttaaaaaccaagaaaatccttaaatatccacgaaaattatgattttttatgaaggatgatttacaaaattattgcaaaaatttttaaaccttttttttggcttatgtaaaaactttctatttttaaaataaaaaatccatccaaaattttttttaccgctttttcagttgtattcagcctccttcctcgtggtggcgggcaaaaatttcgtcaaatccatcccgacggatcaaagccacaccaaatcggacgcatttgagccaatttcgggtgccgcgattaccagcgttgatttccaccatgagacaaagtcgattttctttgtcgatgctgccggcatcaacaagggcatcaaccgttttgtgttgggcgattcggagagccaagtgatcgtgaagaacaattatggcgggtgagaaatttactaattatttaattaattttcaaattaatcaattaattatagtaaattatttaattgattggtgattattaaagttgaaattttaggtttttaaaaaatttatttttatagaaaattttatggtatttccccaaaatccctttttgaatctatttagtgttatggcttgatagaaaatttttaagaaaaaatttaataattttttcaaaaataatagaatttttttgaggaataaaaaatataaaattttttttaatatcataaaaaataaatattattttagagaactttaacattaaatttaataccactatatttaggtacatcatcaaaagcgttgcgattgattggataaacagtgagtaaaaattgattttaaagctttatttttgaacaaacaccgaccgattcatactgtatcaatacagtacgaatttggatgagtgggaaatggatttttatttttaccatatttatttggattgtattttaccgtatttattattcctatttcaaatacactttagacaacatttatttcatcaatgccgactcggaccgctccaacattgaagtgtgccaaatgaatggagaaaacagaaaaattttgctcagcacacgcaccgaaacgcccacatcaattgcagttgatccgataagtgcgcgcgcggaattaatcgatttaaaatatcattagcgtgaattaattaattattgattattgtttttttttgcatttagcccgcttcgtttactgggctgatcaaggccaaacgcccgctattcaagtgagttttgcgaaaattttagttgtttttttacaaagaatggaaatttaaaaaaaaatttaaataattttagcccaatccgttaaaaaagaatataaaaaaggaaaactttttcattcttgtttccgacacattttgggctttaagctttttgatatcataaaatttttttaatcatttcggttaaatgaaaaatgtatttaaaaaatattgatattcaaatggcttttaagcgagcttggttggatggaacgcataagcaggtggttgtccatgacgaactcaaagagcccaccgacctgatcattgaccctaacaggggtgaaattttgaagaaatgtctctctgatttcatcgaaattcaaaaaaaaacacaaatttttttcatttttatttgggcaaa

SEQ ID NO: 71669 - DNA, 70 bp, Heterodera glycines
  Genomic contig location: Contig_ID=SeqID_44137; Location=786..855; Strand=+
  SCN-specific regions: Sequence locations=1-1,43-70
atggatgaaatgaacaaagaaaaggaaaagaaatctgactttatttcgaaacttgtccgacttctcaaag

SEQ ID NO: 71670 - DNA, 649 bp, Heterodera glycines
  Genomic contig location: Contig_ID=SeqID_44138; Location=334..982; Strand=-
  SCN-specific regions: Sequence locations=1-4,61-61,151-156,220 -233,263-299,327-543,576-584,628-649
catgattcttcacaaagtcagactagagtcaagctcaacagggtcttctttccccgctaaatttgccaagcccgttcccttggctgtggtttcgctagatagtagatagggacagtgggaatctcgttgatccattcgtgcgcgtcggtagttagccgacgaggcatttggctaccttaagagagtcatagttactcccgccgtttacccgcgcttaatcaagtttccttggcttaacattcagagcactgggcagaaatcagacacggtcaacgtccacaaggaccatccgtctcctctgttttaattagacagtcggattccccgagttcgtgccagttctaaactggtcgttcagcgccaaccgaagtgcataccctgacgagcatacacgcagctgaagcgctccacaagcagctctcaccactagtccacgcaccatccccaaaagaacagcacacagccacgggcaaaagccgcctgtttcacgcaacagcccggctgacccgacctttagagccaattcttttcccgaagttacgaatctaatttgccgacttcccttacctacattattctatcgactagaggctgttcaccttggagacctgctgcggatatcggtacgatcaggcaggagattcaaata

SEQ ID NO: 71671 - DNA, 561 bp, Heterodera glycines
  Genomic contig location: Contig_ID=SeqID_9506; Location=814..1374; Strand=-
  SCN-specific regions: Sequence locations=1-77,99-198,246-381,445 -502,543-561
atggccgaatttgcccaccgtgccggtgctccgttggagtgcctttgcatggctttgaaggtaaaaaacgaaaaacctaaataaataatgatatacttctaataaaaatgctaacaattatatctgctttattaatatatttgaaaggtccaaaagcgtcaggaaggaacggacgccgaaggcaatcggcgatggaagtaatttaatattattaaaaatggaaaaaattaattaaaatattaattccggaaaaaagaaagaaaaatgtccccgtgtcgttaaaatatgtttttttcggagtcgctggtcacaaatctggcttccatttggactagggtccggaccccgcccccgcccccggggacgggacaggttttttggcctcacccccgcccccgcgactcagacccccgcaacccccgcccccgcgaccttcgcccccgcgggggcatgggggtgaaaaacacacccctaagaatagcatattcgtggaattaaaggcaaaaatttatacaattttgaattttttaaccatcttttacaaaatttttatgaaataaa

SEQ ID NO: 71672 - DNA, 304 bp, Heterodera glycines; identical to SEQ ID NO: 51570
  Genomic contig location: Contig_ID=SeqID_44143; Location=584..887; Strand=+
  SCN-specific regions: Sequence locations=1-304

SEQ ID NO: 71673 - DNA, 266 bp, Heterodera glycines
  Genomic contig location: Contig_ID=SeqID_44144; Location=482..747; Strand=-
  SCN-specific regions: Sequence locations=1-112,134-266
ggagtctcgccgccaaatttaaaccgattggcgaactgtcggattaccagcaacaaatcaacggatcacaaggcaaaagctttacatacggatgctgtaccaaacatttgcttatttgtatttttgttttagaagtttcaaacattcgattcgccactcctccgccacaaccgccgccggtgcttcgcaatgttccgttgcctcccgtgacgtcgaataacaacgaaatgatggtggaccgcacttgtcgaaacaacacagcaaag

SEQ ID NO: 71674 - DNA, 350 bp, Heterodera glycines
  Genomic contig location: Contig_ID=SeqID_44145; Location=728..1077; Strand=+
  SCN-specific regions: Sequence locations=1-257,282-350
atgccgaacatacttgaaatgctcaataatgacgctacggttttgctcaatccattcacggcactgtttcaatcggtcaaaaaggccagcctcccggttgttgtaacgcgagattacaacatttacgccgcatttgtttgtaattgttgcgcattctccgagttcacattcctcgtaaaaaaatctgccacgttcccatgcaggtccaacaataacttgatggagaaagctgtaaaaaatgaataccgtattaggccacctttatttttgaaatttgtggtaaaaaattcggcagttatatttttttaaatctgtagacattaaattttgctttattaatgacacattaa

SEQ ID NO: 71675 - DNA, 302 bp, Heterodera glycines
  Genomic contig location: Contig_ID=SeqID_44147; Location=258..559; Strand=-
  SCN-specific regions: Sequence locations=1-90,144-302
atgaaaattcattgcatttttttcattcttcttatcaacgaacttttcgttgttcctcttatttttggacaaccaattaaagaaaaaaggtatttttaatatttgcttaaattaaaaaaaaaacataaattttaaaataaatagtcagtatggattaacactgtcaaatcaagctgaaattttaatggaaatgtgcaaccttggaattcgctaggtttttttgagttgaccaaattttttttttccaaaaatttccgattttcagtgtattagaaggtgtcccgatcactctaaacgaatga

SEQ ID NO: 71676 - DNA, 983 bp, Heterodera glycines
  Genomic contig location: Contig_ID=SeqID_44150; Location=158..1140; Strand=-
  SCN-specific regions: Sequence locations=1-156,194-318,340-388,410 -448,470-983
atggccaggaatggcatggcacgtaaagccctcaacccacaagcgtacgaagccagcgcggtcaaacaaatgcaaagttacaaacagacaaagtcaatggaattgtttaaagagcgcgggatgaaattcacttgtgtggactcatctcaacaacagcaggaggagaacagaaacggacgggcgggagggacgaggtgagcaaggggaaggacgaaacaaagcatggagacaaataacgggatttaagtggcgggacattgtcatcaattggcactgtttcggcatgtccagtcgacatgatggacccaagtgaccgcgaagcaattcagttctatgtgagtggtgacttatttgtaaatcattcagtaggatgaattttatgctttaccaaggaaaataaatgtaaaatttgggacttttatttttgtgagttttccgaaaaaaataattcctttttaaatgtgtaattgaatttcaatttctattcgtttgattttgtttaatatatatgtgaaaaatcattggaattttctaggaaggcgagcggaacggaggccgagaaacgaaaggaagcttagcaaaaagtacggagggaggaggatttggggcttcttcgcttgagcgggccaaacgctttgggcttattccaccaaaatttgaccctcgcattccgccgccaccaattttccaaccaccgaaacgaaaagaaatcgaacagccgaaggaaaagagggcaattaagcaggagacagaagtggtggtggaggtatttctgacaatgagccgattctttttttgctcagaaataatcagttattttgctctgctttatttttcagtaattttcaacctttaagatttccgacgatatcccttcgttccaatgcgttaattctgtcactcccgaaacgacgacctcccaaatttcgaattctgattcaatgtatgctgaaaatgaggagaacaaaaaacgggtaaataaa

SEQ ID NO: 71677 - DNA, 487 bp, Heterodera glycines
  Genomic contig location: Contig_ID=SeqID_44151; Location=51..537; Strand=+
  SCN-specific regions: Sequence locations=1-282,326-392,415-487
atccaacattttaggcgaaaataaggacccagagttcacgattgaatggtcaacaccatgtgaaatgaatgaagaaatgaaggacaaggcgggatctctcctcatagaggtggcggacagaatgctgccacgcttccaagacgaacacaacaaaaaaatcctgcaagaggtaaaaatgtttaatagtttgaaatttgagaactttgttagattttttttccaattttggaaaattttaaggcaagcctggggcaatgggtgctatattttaaatgttgtttctaaaaattataaataatatacaaaaagtacataaataatttttctagctcgccactagcgtcaccgagaaaggatggttgatggaggagcagatttataagtgagacttaaaaactattaactctcaatctttcaaaaattatttttagatatctggatcgcctccattgagtaaaaggacacaaaatataaaaagtttcaatta

SEQ ID NO: 71678 - DNA, 696 bp, Heterodera glycines
  Genomic contig location: Contig_ID=SeqID_9509; Location=338..1033; Strand=+
  SCN-specific regions: Sequence locations=1-696
gtggcggcactactctactgctgccagctgttgtgccgttgcctgtggcgtctacgctgggatccgaacgtgaacgcaattccgttgctgaccgcgctgggcgacttcctcggcaccacactgctcgccatcgcgttcctcgcccatgccgaactgttcccggagtatagcgtcaacggcaccaattgcactaacggcacaattagtcaacaagacacagttgaggatgccatgttgcaagtggttgagcaacaattgctgctgggcaatgccgacacaactctggcaacagaaactgctgaactgatgttgctgaaccgaacgctctgatcaatgaatgggtgactcatcgtgtcgcgatcatttttaaattattaattacggggggggcggcccggaggaatacgggttgtttcaaacgggcccaccattaattaacacattaagcgtgttttggtcaaaacttttttgattttaatcagagtcctcgcaaatgtcgcgcttaatttttaaggttttgtctttattttcaagagttgggcaatttttgaagatttatcaattctttttcgctttttcgatttttatccccaaaaaaaatcagtgattttccctcattttgcatgcctttaatgcacaaagcttctattgaatgtgagttcattctattttattaattgtgtatttaaattttaa

SEQ ID NO: 71679 - DNA, 2984 bp, Heterodera glycines
  Genomic contig location: Contig_ID=SeqID_9509; Location=1691..4674; Strand=-
  SCN-specific regions: Sequence locations=1-171,202-217,239-288,310 -317,340-748,774-796,827-1039,1062-2890,2913-2984
  Gene Ontology: Mol. function=malate synthase activity; Cellular component=peroxisomal matrix; Biological process=glyoxylate cycle
gacgcaaattctccaacttggcgcaatcagattgagggccaaatcaatttgtacgatgccattcgtggccaaatccactacgtgaacccggtcacgaagcaggagtacacgctgaagcaggacactgctggttggatacatagagaatttgttgggattttgtttggcggaattaaaacctttgaaaaaattttctttttagaattttttttatggtttaaatcttttaaaaattcttgcggttgattgacattttgccagaaagcctatcattctctaatttacattcttagaatatgaaagatcaaacaaaaaaattagagaccagatcaaatttgatcgttttaattcgataccgtactatgattaactatgtaattaatgtcaatttccatttgccagtgctcaaaatacgcccgcggggttggcatttgccggaaaagcatgtgctgatcaacgagaagcccatgtccgcttcgctgttcgactttgggctttatctgttccacaatgccaaggcgttgcaggagaagggcagcggcccctacttttatctgccgaaattggagaatgcgcaggaggccaaactgtgggccgatgtttttggccatgccgaaacactgctgggcctaccgcacgggacgatcaaatgcacggtgctaattgagcatctgttggccaccttccaaatggacgaaattgtgcatgcattgaagtgggaaaatgttataaattcaatttaaatgccatttttaatttttttttttttttttggcaatgcaatcgaaaacttttctaataaataattaaattttatataattaaagggattacattgttggcatcaactgcggccgatgggattacatcttctcatacatcaaagtcagctttccaaattttttttatgattggagagattaaactatagtgatcagtgatcactgatcagtttgtaattgttctgatgctcaaattagcattaattctctcaattagcccgtaatagtttatctgatcaatcaatcaattactgttgttttttaaaacttctcttatttgagaactgttggaagaaaagaagggttttatagagatcatattcggtccagaccccgtatacgggttttactggcccgtaatctgtacttttttggactgatgcgggtctttacgtgttaaagtttttgcgggttgtagcccgtaacccttacccttaccgtacaacccgaagagtctgatctgtagttgtttgggcttaaaacaatccaagcctactctgaccagtgcatatttcttctcacttcaattttctcatcattcctcaggtgttccgtaaccatcgcaaatttctgttgcccgaccgctttctgatcagtaagcccaaaaacaaagtgatcaagaattaattcggcacccaatttcagcgatgacttccgactttttgcgcgcctacacacttttgtccatcaaaattgcgcaccagcggaacattttcgcgatgggcggaatggcggcacaaataccgatcaaacacgacatggccgccaacgaaaccgcactgggcgctgtgcgcaaggacaaggagcgcgaggcatcggacggtgggtcggcaccatttgtaatgcgtcagggcttggcatacttactgtttatgatggattacggtatttactgttgtactggttaaagcaggcgcttctgatcactagttaaaatgggagcagctcgtccccccgtattgtttcccccccccccccccaaaaaaaatcaatagcaggaggatttggcataatgattatgagggattagagcgttagaatactgtaattccggtagcggttggcacatactaaaattatcacttatctctttgatgaaaatctgttacatattatttttatagcgaaattttaagtcaataaataattatcaatttgtggcatggtggccgataaatacgatcgaagaaatttagacaaatttgaaaaaaaaattgcgtcatttttcaaaaattgccttttcccatcttaattgaattgccaccgccccgttcccagtctgggtatgggcctgaatgtcatcggtttaggccacgacggcacttgggtggctcatccaggacttgttccgattgcgcgcgaagtgttcgaccaaatcatgcaaggcccgaaccagatcggcaagcaactgcagtcattcgagacggacaacaagcggctcacaatggcgccagaaggcgtgcgaacagaagccggcttccgcaggaacatttcgatcactttgggtaggaaaagcaggggaagaaaggcgaccggcacggcaccaaatcggtgttcgaacattttgatcaaagcctttctgagggttatgactcatgatcacagaccttgattttaccatgatcgaactctattccgtccatctttgattacttttttttaggctacatggacaattggcttcgcggcattggctgtgtgccgttgtacaatttgatggaggacgcggccaccgccgagatcagccgcacccaattgtggcaatgggcgcgccatgaagcgcgccttgagggtacggaatgattttttcattttcccgttattattttaattttttctgttttcagatggacgtacagttgatcctcagctggtcaaaatgacaatcgcttctgaaactgaggtagattttccatagtttcccgaaaaactctccattgctaattagtgtttatcaaaattgaaatttcatttttcattagcggcgcctcgtccgtgccggctctgtggtcaatcgcatcccggaggcctcggaactgctcgagaaattcgtgttggagcccgagttgagcgactttctcacattggatgcttacggtactcaatggaattttaaattttgaaatttcaaatttttagacaagctcgtctcggaaggcaagtgaacaacgaacgggggacggacacttctgtaaaatctaa

SEQ ID NO: 71680 - DNA, 603 bp, Heterodera glycines
  Genomic contig location: Contig_ID=SeqID_44152; Location=364..966; Strand=+
  SCN-specific regions: Sequence locations=1-603
atgcgtccacgctcaacgccttccgccgccgccggagggacagaagccgcggtcgatgccctacggcgagagaatgagcgacttaaaagagaaaactcccatttgaacaagtcgctggaaaagcaacgtgaagaagcggaacgaacggcgattcggctgagacggatggaaacgcaaagccgcgccaacgcagaagcgtgggaagagcgcaaaagaaacgaacgaaacgcggcacttttgcgaaaacgggtcgaagaaggtgcggagcgagagcgactgcttcaagagcgattggagaggcgggagagacacattgaacagctgagcagggaacagcagggccgacttggggacacagagcgagttcaggcgacgatggcacaatggcgagcgaaagtggcactattggagcaacgagagggtacattgagccaagagcgagtggtgttgggtgaacggtgcaacgaactgacgcggagactcgaagcaatgacacgcgagcacagaaatgccaaaaagcgattggccgaattgacaaaggcacaacgggaagagaaggcggaggagaagcttagggtggagggaaaagcaattggcggagaa

SEQ ID NO: 71681 - DNA, 1136 bp, Heterodera glycines
  Genomic contig location: Contig_ID=SeqID_44154; Location=200..1335; Strand=-
  SCN-specific regions: Sequence locations=1-148,170-230,253-275,297 -380,414-1057,1080-1136
atggccgccggccaccacctgaccaccttcccgtcgctggacgggctgacggagcagtttggggaccatgtgcggggccacggcttcccgtgggccatatttttggacaaaaattacaccgccccgacaccaccacagccaacaacaacggaagaagaagaagaagcggatgctaatgatggtaccgttaatgaggccgttaatgatggtgatcatgaattattgacggattgggagcagcagcagaaacagaaacaacgacggaaaaatccccgataatttaaatttcatcataattgtttttgtttttttgttagaattatgtgcacatttgatttgtttgttgatcaaattattttgttggccaccaaatgtgaaagaaaataataatttgttttttttaaaatttttttccaatttttctggtacaaaaaaagcggcggcgctgctcttttcgtgtgcgttgtgccgtacaacttttcaaccgtacgtgccaatgccgaccattcattgggttgccccggggcacggacgctgccgctgcggcacctaagcaacgagcaaagagcggcggagagggcaacgatcgctggcggcggtggggcacaattgtcggcacgctcgacgacggcacattccccgaggtggggcagcagcgccgggggcgggttcacagcgccacacaacaaatgaatgcgtttggtccaacaaaaacggtggcggtggtaaacggccaattcggcgccgaccggatcggtgccgttgataacaggtaaatgtaattgatgccagatttgttaaaacttgaactgacaaggaaaaaaatgtaacttttcaaagttggcggcgccgaaacggtcggcgctgaaacgactcagtcccggggggaagggcgagaccagcagagagtagagaatagagagagagggacgagaccagagagtagagaacagagaatagagagaggggcgagagagtgtgtgtaactagggcggggccgtcggtcgttttctcggccgcttttcccgtcacatagtttttgcactttcccattttgcccccggggggcgttttcccccgtttttcactcaacgctgcggtcggggagcacagcatttctttgtcgtcctaataaa

SEQ ID NO: 71682 - DNA, 47 bp, Heterodera glycines
  Genomic contig location: Contig_ID=SeqID_44155; Location=737..783; Strand=+
  SCN-specific regions: Sequence locations=1-47
atgacgtacaatccgaaagaagctgatagagaaattgaaaaagcgat

SEQ ID NO: 71683 - DNA, 632 bp, Heterodera glycines
  Genomic contig location: Contig_ID=SeqID_44156; Location=96..727; Strand=+
  SCN-specific regions: Sequence locations=1-149,171-218,249-291,358 -596,620-632
atggacaggataccgtacaatttccccacgccctcgtcccggtcccgtattcttaaactcgcaacatcgacatcggagtccagtaaaacagttcttttaatccttaattctatccgcttaatccccgacgatttttaattaagaaccccaacaaatcttgttgttgattttttgtcaattgtctcaattttttctcgtcctaaggtcggagacaattctaatttattttttttcaaaaataaaaaataggtcaaaaattggtatttcgtgaacaaattaacagaaatcctcaaaaaaagattaaaattagaaaaataattttttaaaataattttatttttaggaaatatattttttccacttcatcttcaaccaatgtttgacgcagcatatggtaatttcaataatattcatcgggaacgaagcaaaattttcccatgtctcagtggatttggatctgccgatggctcagcttttcggatcgaccggttttgcgctgccgacacatccgggtctcgacaagcagcatattgatcaaattgtgatcacgatttatcaattcttcaatgaaacaatgaattagggttgcgccaattggggggagagaaaatatttttgggaaaattgagaaa

SEQ ID NO: 71684 - DNA, 444 bp, Heterodera glycines
  misc_feature (99)..(99): n is a, c, g, or t
  misc_feature (188)..(188): n is a, c, g, or t
  Genomic contig location: Contig_ID=SeqID_44157; Location=839..1282; Strand=-
  SCN-specific regions: Sequence locations=1-444
ggcgcatcgttcggggggactgccccgaaaacaaaaaaattgattttttcaagtgtccgtttggggtactcaaacaattatggggagcaaaaatccacngcagaattaaagtacaggctatagggaagctattcccgaaggattcggtctccccataaatctgggcgcatcgcttcggggggactgcnccgaaaacaaaaaaatcgattttttcaagtgtccgtttggggtactcaaataattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacag

SEQ ID NO: 71685 - DNA, 80 bp, Heterodera glycines
  Genomic contig location: Contig_ID=SeqID_44158; Location=75..154; Strand=-
  SCN-specific regions: Sequence locations=55-80
gtcctgcccataatatctgtggcatggaataaattttggaactgcgctgcctaaacgcggtgcttaaagtgcgctaaaaa

SEQ ID NO: 71686 - DNA, 80 bp, Heterodera glycines; identical to SEQ ID NO: 71068
  Genomic contig location: Contig_ID=SeqID_44158; Location=687..766; Strand=-
  SCN-specific regions: Sequence locations=69-80

SEQ ID NO: 71687 - DNA, 585 bp, Heterodera glycines
  Genomic contig location: Contig_ID=SeqID_44160; Location=336..920; Strand=-
  SCN-specific regions: Sequence locations=1-186,208-585
atggaagagtttttctttggcgatgatgatttgaatttgcctccagggcaaccaaatcctcgtccacagccaaatacccctccgccacttaacagcgaccaacagaaggtctttgatgctgttttgttggcaatacagtcgaaccctagggattcgactgtcccccgccgtttcttcatatacggcgatggaggcacaggaaagacattcctgtttggccaaattattaggcgcttgcgaaaggccccatacacctacaaagtgcttgctacggcatccactgggtgtgcagccattttgctgccatatgggaaaacagcccattccacgtttcgtctgggtagagaagtgtcattagacaaactcccaagcattccgctggagagcttctttgcccgtcggattcgtgaggcccaactcatcatcattgatgagatcaccatgcttcacaacacggtgattgaggtcatcgaccgagtgtgcaaagagatggcaattcgccagcacaaggatctcctcttcggaggaaaaacggtcattttcagcggtgacttcaaacgagtcgctgccggtcgtgcctcatga

SEQ ID NO: 71688 - DNA, 351 bp, Heterodera glycines
  Genomic contig location: Contig_ID=SeqID_44161; Location=374..724; Strand=-
  SCN-specific regions: Sequence locations=1-20,51-351
atgacttgcgcatacgctaaactccttggtccgtgtttcaagacgggtcgaacagatgaccggcttttacaccgagaacgcacaagtgagagcctgagctggaccgaactggttgctggtacgtgtcgcacgcgaccgccaccgacccccagctcgagtcaacacggacccgaaaccattgcacaattcacccagagtaaacagcactcccccgatccgggtaccagaccccaaaaggctggcctcaagaccgagctcacgcagctactccgagcatctcagcgcactccgcctgcaaatgccccattcgccactgaacagaaggacagcaaaccccagtctggaggctag

SEQ ID NO: 71689 - DNA, 112 bp, Heterodera glycines
  Genomic contig location: Contig_ID=SeqID_9510; Location=159..270; Strand=-
  SCN-specific regions: Sequence locations=1-112
atgtgtgccaaggggccgggcgtggacccaaattacaacgcggaaacgtgcaggaaaagcgcatttgacaagctggacaaaatgacatttttcatcattggcgacatgggag

SEQ ID NO: 71690 - DNA, 1096 bp, Heterodera glycines
  Genomic contig location: Contig_ID=SeqID_9510; Location=1212..2307; Strand=-
  SCN-specific regions: Sequence locations=1-70,93-204,226-241,265 -415,437-579,613-1096
atgtcaaaaatatggcatatatttgcgcattttttacgaatatttgtttcggctctatgctggaggtatgtatttatttttaaatttattttcacgatttttcctaattttgatctgtaactggaattttggatttttttaaaattttgttgtaaaatagcttattttggaacgcgaaatttgttaaagaaccgcttaaaattttgattattgaaaattaaaaattgattaagaaaggctcaaaaaaattttaaataatttttagtctcggctttttgtgtctcgggttttcggtctcggtctcggggtcgagtctcggggtcaaacctcgggaaattttggtctcttcagtttctaagtctattaaacccaaatcttttcatactaattaccagattttaaattataatttttgttcagctaaaaagcaagaagaagcgaggcaattgccagcggtgaagccaatatttttaacagaaggctatttgattaattttattgtgcttgtccaaaggttcaatgatcattcgaaatattttcggcaaaatgatcccaatttttccattaattttgaacttcaaaatgaattggaaatgaattatgaaataattacggggaatgagaagaattggcagaatagattaatccaaaaagcaatggaagaatttaaaaaagcgaattatgaagcaaaaaaaagcgaaatttggcgtaaaaaattcaagcaaaaaacaatggaacaatttgaaaaggaatttaaaaaactatgggaaacggaaaaacttcggatggaatttgagaataaaatgaaaaaaatatatgaaaacgcacaggaaaatgttaaaatggaaaaaaatgtgagcaacaaaagtgaaacgcagagaagaaattatgaaaagaaatttgctgctttaatttcgtcgccattttacgaacatttaattgagccaattataattgattgagcccggattttattaatacaaacaaagtgaaaatagagacaaatcattttaaattagtcgaaagttcttttttctcatatcgtccgtctatgtatggaaatatgtcgatcacacatttatccgctgagaataaa

SEQ ID NO: 71691 - DNA, 1106 bp, Heterodera glycines
  Genomic contig location: Contig_ID=SeqID_9510; Location=3202..4307; Strand=-
  SCN-specific regions: Sequence locations=1-8,31-469,491-659,681 -698,724-925,947-1058,1080-1106
atgctttcttttataattattattattattcttcaattcttctttattccaatttcacatgcaaatccatcggtgagtttttacttgtcgaccaaatgttagggtatttaattaattggtctattttaattagatggacgacaatatgttaattgcttttatgaaatgtcatcaacaaacacaaattagtgaatattccacgcaaaaatatgaagcttaccttggcactgtgtattttatgagaaagaattggcaatgtgccaaaatagggaagagatttgaacaatatgaacggacagaatgccaaaaatatcgcaaatatttggggattttgtacgaatatttgtttagagaattcgccggtcacaacacagtgaagccaaaattcatgcttaaaagacaccaatttgaaatggaagaaccatcaattatttacgttttgcattcgttggccaaagttttgcgcttttatttaaatccatttaatagcaatcgttatcaatacaaattaaacaatttgttcagtaacaaacattttattaatgaatttgaaccaaaattgttgaacgcatttggtaatgataatgagcaggaagaaatgccaattaacgaagccattttaaagttggcaatttacacagcgaatggccaatcggatgaaattgtggaaaaaattattaaccgaataatttttgatcgaaatttaaagaaaatgtttaaaaaggcggaacaaaatgccaaagaaaacggtccatggagtgcaaatgaaataagtgaagacgcacataaaataatttggagatcaaaatttgatgactcattgaattgggtgagaagaaagcattcaatgatttgaaatttaatcatgtcaaatttagcaggatgacgtgttatttgtggaatttgtaaagggacaggcgacgaattttgacaaattcttcaagctcattcttgatgagggtgccaattatatgggctatctaatagagcttaaatgcacgaaaaatataattttagtttttttttccataaaattccagattttggattaagttttcattttaaagaattcaggaaaacagagaagaattgaagaattgaataaa

SEQ ID NO: 71692 - DNA, 237 bp, Heterodera glycines
  Genomic contig location: Contig_ID=SeqID_44162; Location=48..284; Strand=+
  SCN-specific regions: Sequence locations=1-237
atggctatctctttttttgataaattttatacacatacaaatgctctcgagcatgatagggagggcggtgcgcaatttaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttag

SEQ ID NO: 71693 - DNA, 304 bp, Heterodera glycines; identical to SEQ ID NO: 56071
  Genomic contig location: Contig_ID=SeqID_44162; Location=99..402; Strand=-
  SCN-specific regions: Sequence locations=1-304

SEQ ID NO: 71694 - DNA, 304 bp, Heterodera glycines; identical to SEQ ID NO: 69803
  Genomic contig location: Contig_ID=SeqID_44162; Location=479..782; Strand=-
  SCN-specific regions: Sequence locations=1-304

SEQ ID NO: 71695 - DNA, 374 bp, Heterodera glycines; identical to SEQ ID NO: 62678
  Genomic contig location: Contig_ID=SeqID_44163; Location=294..667; Strand=-
  SCN-specific regions: Sequence locations=1-374

SEQ ID NO: 71696 - DNA, 755 bp, Heterodera glycines
  Genomic contig location: Contig_ID=SeqID_44165; Location=296..1050; Strand=+
  SCN-specific regions: Sequence locations=1-23,47-104,144-203,225 -309,332-417,458-461,483-645,667-755
atgttatgctcaaattttcttgcatttttatttttattattttattgccatttttcatgtgccatcaatccggatccaaagtttccagttcacacaattcaaagtaaaatatttaatttaatttgaaacatatttaaataaaacaaatttcaattggttccaatatggaatttccaactcataaaatccaaaaacacttaaagtaattttattatattttaaaacccatcaagcgtgggaagaaggctaccccccccccccccccctgaatttttgcgcgtgccttttttaaattttttttaggttgattatttttcaaaaatttccccattgttcattttaaaaaattttcgggaggagggtggctatagctagccataaatcatcagattccgccctggctacgcccctgggaccaaaaattttaagatttaattatataatttattaaaaataacttccaaagcaattaattaaaatgaaatttaattggtcgcaatatttccaatttactcaatctgcattaattagccaattcattaattcaaatagctcatttgtcagttgatgcaccccatcgtacagcaacatttggtggcccacccggcgtcagaccgttcatttcgggcagcattttcaccagcggcgttggcccggctgccgcaggtgcgatcagctcatcccataaccatcagccaaccgccgtctgttccgagaacgaatttcgctgtgacgatggtgaaatttagaataaa

SEQ ID NO: 71697 - DNA, 691 bp, Heterodera glycines
  Genomic contig location: Contig_ID=SeqID_44166; Location=262..952; Strand=-
  SCN-specific regions: Sequence locations=1-437,463-465,487-578,601 -652,675-691
atggcgcagaagattcaagcatcaggattcgactccaaaatcaaaggcaacgccgaccaagaaacgcagttcgtccgggaatgctatgagcaatttggaataagcatcgacccatcaaaaatggctgtcaaaaaaaaggaaagcggtcgattgcaaagctgtgtctgaataatttatgtgggttttccttttcaagtgtcaataataatcggattaatttaaagggggcgtttctctttgcgcatctttggactttcgcagacgctgataactaacgacccggttgtcttaagggaacacttggacaaccgatcaatcgatgtgaccgcaattgacgagctcgatgaggagcacatcctcctcagctacgaaaataaaaaagagtgggttgaggagcacgactgctccaacataagtatggatcaataaattagcgcaaatatatatataatataaaaatttcagtgatatctctgtggatgacctcggctgcacggctcctactactaaaggcaatgcagaaagtggtgcgaacgcctgggtgcgggctgctatacactggtacaattattattagttcatcaacaaataaatagaaaattttcccagacacggattcgttgatctttctccacccgtaagacatctgcccgctcaaaactggcccacatttgggtcagttcacggatga

SEQ ID NO: 71698 - DNA, 131 bp, Heterodera glycines
  Genomic contig location: Contig_ID=SeqID_44167; Location=1025..1155; Strand=-
  SCN-specific regions: Sequence locations=1-131
agtacaggctatagcgaagctattccggaaggattcggtctccccataaatctgggcgcatcggttcggggggactgcctcgaaaccaaaaaaatcgatttttttcaagtgtccgtttggggtactcaaac

SEQ ID NO: 71699 - DNA, 199 bp, Heterodera glycines
  Genomic contig location: Contig_ID=SeqID_44169; Location=20..218; Strand=+
  SCN-specific regions: Sequence locations=1-199
agagaaaataaaaaagaaactcgtaatggctgctgggaaaaaggcagacggagaagttgccgcaaggcaaaaaaagcgaaaacgaaaaatgtccgacgaatcaaacggagacgatgaaagcgacgagaaggactcggcatccgaagcagaggaaggttggtgcgccgaacgagcagatattgggcattcatggagttga

SEQ ID NO: 71700 - DNA, 1311 bp, Heterodera glycines
  misc_feature (68)..(68): n is a, c, g, or t
  misc_feature (191)..(191): n is a, c, g, or t
  Genomic contig location: Contig_ID=SeqID_44170; Location=477..1787; Strand=-
  SCN-specific regions: Sequence locations=1-749,771-929,952-1311
  Gene Ontology: Mol. function=phosphatidylinositol transporter activity; Cellular component=subrhabdomeral cisterna; Biological process=olfaction
cctcaatgaacagccgccgtttgagtccaagtgccactgacagtgtggaacaggaaaaggacacggtntaaggtgggaaactgaggacggacgaggggaaggcgatcctggcattggaattgtaatctggcaaaggttaggttgccaatctcgcaagccaaccaccagggcccaacgacctcatcgtggtnggaaggccttgagcagctgatcaccgctcgcttttgctacggccccatggatttggtggttttgtctcatgaaaatgttttggtgtatgtgctgcccagcggcggtgaatggtttctgaagggcgtggagacgaccgacaaaaacgggaggctaagcattgacttgggacggagtttgcccatcggaattcacaatgttcgtctgattgtgcagggggatcgtaagtgctggcccttagcagttcattgccggtatctcctccctttttcagatacttatctcagtgtgaatatcgccgtcgttcctaccgggactcccgtggtcgtgttcagcatcgacgggtgagtaatttgccgatggttgtatcgtccgtacccatcctccaattgcctcccgtttggttgttttcagctctctgactgcctctgtttctgtgactggtcgtgacccacgtcttcgcccgggcgcagttgacgtggtccgtttttggcagcagcaggtgcagtcaaattcggagttgcttcccataggagtcgaaaacgcgattgcctttcagggctttttgatcatttatttgaccgcgcggcccgacatgcagcagcgattagtcagcgcatggctcgccactcacaacttcccccaagggctgctctttttcacgccttccctttcaacggagcctcttcggcagaagacgcaacacatcaaacacttgttggacatgggcatttgcatccatgctgcgtatcggcagtgccaaggacattccggttggtcgaccgtgttctgctcattggcagtgcttttgtttcccttttaggtctattcaaatgccggtttggagtcggaacgcattttcaaagtgggcggccatcgtcgacgcggttgtgtgtctttggacgacggttattgttaccatttgcatgaccttcattccggaaaaattgtcattccccggcgcgtcgagaatcccgtggggtcgccgtcggcacgggaccaatggcacaatccatcggaacagcagaaattcttcgctggcggacggcaccaatcgccgattcaacggactctttcttttgggccgaggatgggccgttacacaaccaaaaagatcagcca

SEQ ID NO: 71701 - DNA, 503 bp, Heterodera glycines
  Genomic contig location: Contig_ID=SeqID_9511; Location=491..993; Strand=-
  SCN-specific regions: Sequence locations=1-28,55-390,412-428,458-503
atgctttcccatgttttttatcggttcgtttatttttttttaattttatttttacaaaattcacattttagaaaattctttgaactcctaattgtgaatttgacagagtttcaacattatttgtgctaccataaaaatattgataattacaaaagatggcttccttatttaatgggaataaatgaatcatatttattggaagaagaattcccttacataatgcatatcggtaaatttgagttaatcacattaattacataattagatgaaattattacataatgtgcatatcggtaaagtttagttgagctaattacataaatcaaatggaaattattcgcaattaaaaaaaataatgtgactcagttggttaaagagcattccacgggtttggggagggccgtgtgtttgaatcccacctgctgctggcaaaaaatttttgttttctaattaattaatgtcattttggaaaaatcgcgctgaaatttaatggcaaaaataaa

SEQ ID NO: 71702 - DNA, 875 bp, Heterodera glycines
  Genomic contig location: Contig_ID=SeqID_9512; Location=557..1431; Strand=-
  SCN-specific regions: Sequence locations=1-98,139-172,208-461,489 -727,769-818,843-875
aaaaacaaagatgatctgttggaatgcccaaaagaaaatgtgccaatttctgtgctaagacaaaatgacgcccataaccaagatttgtcagctaaaggtaaaaaaaatagaaaaattttttcaaaattaaaaatatttcaccgactccccccaggcatttgtaaattgacatttttggattttctcaaaaaccgggccaaaaattttctagttttccaagacgcgcctaataatacagggccggtcctgcttcatctctaggaattagtaaaaagaattgaatttttttgtttaaagaaaatttaagtcattctccgatcggggtccccgatcccccgacctgattccccggcgctccccgagaatttattccacaatgggtcgggaaaatattaattacaatctctgtaaatgtatgcttttttggtccatggttttttatggttttttgatcacaaatctaatttttaatttaaaaagacaaaattctcgatttttaactcatttgaattaaataatttatgtgcttaatttaattcgactctttgcttagaatacaaaattcttgacgaaatgcaaaatgaattcaaaaagattttgtccaacgaatcgaagtcaaattacaaaaataactttgtaaaatcggaccgaaagaaatggctcgacgtaaaaatgctgttttggcatttcaatctttccattgaagacgcattcggaaaaatggatgaaattaatgtatataatttgtttaaaataattatataaaaacccttgtatttttttaccatgagcgtaagttatctaatccgtaattttcgaatttttaattttaaaacaaaaaacccatcgaattatagttaaaaaaccagaataaa

SEQ ID NO: 71703 - DNA, 99 bp, Heterodera glycines
  misc_feature (62)..(62): n is a, c, g, or t
  Genomic contig location: Contig_ID=SeqID_9513; Location=41..139; Strand=-
  SCN-specific regions: Sequence locations=1-2,28-99
atgaaacaaacacatttaaaaaatttaatccgttttgtcacggtatttttaattgcgattanattaattggcgctgacaatgcagaatcggacgaagaa

SEQ ID NO: 71704 - DNA, 337 bp, Heterodera glycines
  Genomic contig location: Contig_ID=SeqID_9513; Location=1035..1371; Strand=+
  SCN-specific regions: Sequence locations=1-247,280-337
atgaaagatgtctgcccgaacccatcaccagcatttgatggtgccaccaatgttccgttgttggccaaaacgcttaatccggccaccgccgacggcaccggcgcgtccagcacaatgggatgctcaatgtgccagtcgtaggtgcgcggagtgtacacgcggaaaatcggccaaacggtcaaccattcgccgttgtccgtgttgcattggtggtaaacgcgcaggtaaaattcgggcctatcaaaagtataaaatttttttattttttagtaaaaaattcacgtccagacctttgcctgggtttttgcgtaccgcttatttgttagttaaatattga

SEQ ID NO: 71705 - DNA, 733 bp, Heterodera glycines
  Genomic contig location: Contig_ID=SeqID_9513; Location=1512..2244; Strand=-
  SCN-specific regions: Sequence locations=1-45,67-177,199-257,340-711
atgcaccaaattggattggtattgtcattttcggcaacatttgtccttcttgcaactctttttccatcttgcgcagcaaacacagaatgtgtatgggcaacagggctggtcaagtgcaacaagaatcagaccaaagtgttgggggcggtggtggaactttgggacttggacagtccacaaaatgtataaattaatacaagtaattatgactaatggtctttgattatgttttaaacatgaaagattcataaatgttctataaatttacaatatattaaaaattatataaaatttgaatattaaaaaagaataaaaaaacttataacaaattttaaaaatgccaaatgaacaaaaaatcaaaatgaggcttattatttttaatttacgatcacaatttcagacggattttcaaaatccgctggactcagacgacaaggcgacattcacagaggtggacgacccgactggtttatggaagttggatggctgcgcatctgatcatgattggtttagcatcaatcggtatcaaaaatggtgtcatgacaactcgtacaattgcttcgatttggcctaggctttaggcttaggccgtaggcttatggtttttttaaaatacgagtttccttttacaacattatacgagttgccattgaccctcagaaattaatgaaaatttgtcaaagcttaaacattgggtgtcatttggatattaatcaaatttttgttgaataaa

SEQ ID NO: 71706 - DNA, 739 bp, Heterodera glycines
  Genomic contig location: Contig_ID=SeqID_44175; Location=816..1554; Strand=+
  SCN-specific regions: Sequence locations=1-304,335-454,499-739
atgccaaaatatgtgcaaaatatgtgccaaaccccgaaaatgtgcgatatgtttttatgtgcgaaaacgccaaaatatgtgtttttatgtttttataagtcgctctaaatcaaaaattgttcggagaaaatgctatttttgggcttctctcgccataactaagccgcaaaaaaaatatgttaaaacataaaaatcccagccctaataataaacaaacagagaatattgaacaacaccaagaatgcttaatttgtattgataacggatgagaaaatttgttgttatggaaaaaactttttggaaaagtatggtaatttttaataaaaacaattggtaatttttttgcgcgatccgccacaactttttcggttccgcttctcaccccatggctctcttttctccttgaggaggaaatacttttttttgaaaatgccgccaaataaaacgcaacaccaaaaaaatataagtacaattttcatttttttatttaaattttatgtcaaatgattaaggaaaaatggaatatttcagctctttcgttgactcttcagcaatggaaatgcaaattttgagcaaacaaagagagaattatgaagattttttctatttcctggcaaaagttttgagcaaatttggtggaaaattgacaaaaaatgagaatagggaaacaatcgaaattggcatcgatgggggccacaaaatattggaaagtttgaaaaatatgccgataatatgttga

SEQ ID NO: 71707 - DNA, 790 bp, Heterodera glycines
  Genomic contig location: Contig_ID=SeqID_44176; Location=127..916; Strand=+
  SCN-specific regions: Sequence locations=1-52,74-174,196-321,343 -365,406-426,450-536,577-790
atgagacaagagcactacaactgcaccactgaacaccacaaaaccagtgaaatgtttgttctttttatatactacctaaacaattttggtacgtcaatctcggcgcagatgcttattccgcagcagaaaatttttttgtaacacaactcaggggttgtctacgcacctacaaagtttcatttggaaatcccaacatctcctgaaaactctcctttgtcaggggaattgggtctgctccagcaattttctaatacataaaacggagtaagggttttacgggtttttagtccgtaagtccgttgtccgtatggatgcctagtccgtagtcctggtcctgatccgtattttctcaaaatcacgaactctaatttatattaatttcttgtaaaaaatatttttttaaatgaaaatgtactcataaaaatcttttccaaaaatgtgatgtcaaaaatcactttgtaaaatatttaatagtgattctaagcctattttggtcatttttatggcattttgtgcctatttcactttttacgaagaattttttttctaaaaataatcattaaaattttttatttacatgttttggtacatatttctgggtttttgtacatatttcttagatattttagcattttttatacatattttatttacatatttcgcgatttttcttacataaaaattccatccctacatatagtaaaagtaaaattgcaggtggaagaattttttgcggaacaatatttcaattttaatttgctttcattaaaaatcaaatttcaattaaaga

SEQ ID NO: 71708 - DNA, 331 bp, Heterodera glycines
  Genomic contig location: Contig_ID=SeqID_44178; Location=438..768; Strand=-
  SCN-specific regions: Sequence locations=1-331
gtttgcgtttcaaatatcgtaagattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaagagaaggcaactgttggtaccaagtttgcagt

SEQ ID NO: 71709 - DNA, 228 bp, Heterodera glycines
  Genomic contig location: Contig_ID=SeqID_44179; Location=163..390; Strand=+
  SCN-specific regions: Sequence locations=1-228
aatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagacatttttctgggatagagtataaatttaaaaattccctcaaaaataaaaggtctattgcgcaccgccctccctatcatg

SEQ ID NO: 71710 - DNA, 291 bp, Heterodera glycines
  Genomic contig location: Contig_ID=SeqID_9515; Location=174..464; Strand=-
  SCN-specific regions: Sequence locations=1-144,167-291
atggaaagatacgctttcaattttttacaatccaccgcagatttatcaatttctgcacaagaatatttatggtcaatttttggcattaaaacatcatcagccgcggtcaagaatctcgtgcaccatcagcctgaaatcgaaagtcaaattttcacattttgtggcactcaaattgcgatgaattcgttggctcgacgaattgccggactttcgggcgccgctgcagtggcaatggccggctttagcgcacacagaggtagaagagaaattcccgttttgcaaaagccataa

SEQ ID NO: 71711 - DNA, 519 bp, Heterodera glycines
  Genomic contig location: Contig_ID=SeqID_9515; Location=960..1478; Strand=+
  SCN-specific regions: Sequence locations=1-519
atgatacgcaggttcacattggaatgtctcagcagattcgggaccgaagtggaagacgtggcaagtgaaaaaatacatttaaagagcctttaatcttgggaaattggcaagggtaaaagttgtttttgtgaccaggaaggaaatccaattcaaatcgaacacgataaaacagtatatgtattgttaagaaactggttttgggcaaccaacattcgtatttccgcaaattgagcgacaccaagcggaggcaattcgctaatttgtaccaaagggcgctggaggatttgatatctagcgattatgaactgcacggaatcctcataacaagagtcagattaaattagacaaatggattaaagaaatatgtttttttgttttaaattagttacaattcaaatcctatgggctggttataaaaagatgcgtttcagatagaagtgcccttgattttgaagcacattcaaatccattggcgctgcaccggcgacgtgcagcgcgacgaagtcagtttttgggaag

SEQ ID NO: 71712 - DNA, 932 bp, Heterodera glycines
  Genomic contig location: Contig_ID=SeqID_44182; Location=1..932; Strand=-
  SCN-specific regions: Sequence locations=1-25,53-104,127-140,164 -713,753-932
  Gene Ontology: Mol. function=protein tyrosine phosphatase activity; Cellular component=nucleus; Biological process=transcription initiation from Pol II promoter
ggagtgtttcttcgctttcgtgtcttcaaatattttttgttaaaaatgatgaacattcggtccaacggcaaaattcggtttgctgtcagttgctcgtcaaacatgaaccgcagcatggaggcacactttttcttgcagtgagaaaatttaaaagaagaaaaagcaaattttgaattcttggaaaactattcaaaattgggaagtgttttttgattggtttagcccctgaatttcggcataaaataatgaaaaaacgagttaattgtaagtcgaagaaataaaaaaatgggattttatttggcctagatctgttttctggacaaaaatacagggagtccaggtggccaaatattgcctggaataatatgtcgatggtaccaatctgtttttttaagccaaaaaagtatttattggttttgggtcgctgggatcgaaaagatcattcgcaatttgtttaagttttgggccgggattgaaaattggctattcaaaaaaaaaaaaaaaattcatacctaaacctggtttgagccaaggaaaatccaagcctgggtccagctcctccacaagtcctccttcctcaaaagtaaactatcgtcctaactttgttgattaaaaaaataaaaatgaattctgcgaacccagaaatgggaaaataccctaatttcggtatcaaaatcaaagtcctgctcttcaaaaaatttgcgacaaatttctatatttaatttataaattttattaaatttcaattttatgggcacattttctgtaccccccccccccctccccccattagaaaacgtggcttcaacgtgcaaagctttggctccggcaattacgtgaaattggccggcccaagtgtggacaagccgaaatttacgagttcgactcaccacaaagagcacattttgcagacctgaagcaaaagacagcaa

SEQ ID NO: 71713 - DNA, 407 bp, Heterodera glycines
  Genomic contig location: Contig_ID=SeqID_44183; Location=845..1251; Strand=+
  SCN-specific regions: Sequence locations=1-49,71-182,214-407
atgtcatttatcctttttccgtcaacactatccttggcctattggttgtgctctggatttggctcttgggttcggatccccatgtatgttgccgaattaattgaattaaatcctctcatgggtttggacccctgcccctggtacataaaccttgggtggtctcgacattaaaaaacattggtaaaaaatgggtgttttttgggcggggggaggaatttggacgcccgtaaacgtggtcttatactactcttgaattataatgattaattaattttgttatttctcatttaatgaattattttaggcttgaattattttaattaactaactcggttcttttttttattactattttgtatctgaagacgaattaatgaattcgatttgatttttgacattcgaagtaa

SEQ ID NO: 71714 - DNA, 655 bp, Heterodera glycines
  Genomic contig location: Contig_ID=SeqID_44184; Location=1..655; Strand=+
  SCN-specific regions: Sequence locations=1-39,61-530,552-655
aaaaaaatcgatttattcaagtgtccgtttggggtactcaaacatttatggggagcaaaaatccaacgcagaattaaagtacagactatagggaagctaatcccgaaggattcggtctccccataaatctgggcgcatcggttcggggggactgccccgaaaacaaaaaaatcgatttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccacataaatctgggcgcatcggttcggggggactgccccgaaaacaaaaaaatcgattttttcaagtgtccgtttggggtactcaaacatttatggggagcaaaactccaacgcagaattaaagtacagactatagggaagctattcccgaaggattcggtctccccataaatctgggcgcatcggttcagggggactgccccgaaatc

SEQ ID NO: 71715 - DNA, 463 bp, Heterodera glycines
  Genomic contig location: Contig_ID=SeqID_44187; Location=435..897; Strand=+
  SCN-specific regions: Sequence locations=1-463
gtttcaaatatcgtaagattgtttgatagggccagacaagagaaggcaactgttggtaccaagtttgcggtaaaaaaatgagaaaaaagagataaccatttttggtcaagaattttttttgtttgcgtttcaaatatcgtaagattgtttgatagggccagacaaaagaaggcaactgttggtaccaagtttgcggtaaaaaaatgagaaaaaagagataacaatttttggagaatttttttgtttgcgtttcaaatatcgtaagattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaagagaaggcaactgttggtaccaagtttgcggtaaaaaaatgagacaaaa

SEQ ID NO: 71716 - DNA, 1098 bp, Heterodera glycines
  Genomic contig location: Contig_ID=SeqID_44191; Location=1..1098; Strand=-
  SCN-specific regions: Sequence locations=1-118,140-816,838-1098
  Gene Ontology: Cellular component=cytoplasm; Biological process=cell differentiation
cattgcgtttccgcaaaatgtcaaatttgaattttgaagacaatttgcaacgcgtacaagtggaaattcaagtaaggtgttaataaatgatcagcccaggtgataaagcttttagtccaaggggaaaattgtgaaaattcgtttgcaattttaacagatatccttcaaaatttgatttaatgttacttttggcggtttaaacttttaaagccacctgcttcccaactgatattggcttaattacctaattaggtgacttaattcagtggaagcaatgcctttataatccgatcgtcgctccgtttgccgacgtcggctcttacccaattttcactgacgaattcaaagggacgcgcaagtgcactttggatgtgtacgttcagggaaacttagagcatttggacgacaaagttgtgagttatggcagttctcatggcacttttcgtgccatcaattcatttgtctcgagaatcactcaattgagactcattgcttccatctcgtcccccacccaaaggttttcctcaccgttcatgacgttggcaagacgtatttgtcttgcgtggaccttgccaacagtccgacgctctctccgctggtcggtcagcgtgccgttttcctccacgtttctgtgccagggcaagcgcccggcgctgaaaattttgtcggagagtgcgtttaaaaattgaaaatgctaaaggcattatttgttatttgccgactactgcttttaagcttcccctcccatggaacaattgggggacggactttcacaagtgatggagcagttcaatctgagcaaatgcattgccgattggggagggcgcgggtgccgacatcgtttgtcgttttgcggtaacgcgtctcattcattagctcccgctttggtcactgattcgttccgttgctcgagatgagcttcccccaactcgtcgtcggtgccgttttggtccgttgcgtttcgacgacccacggaatcgttgccggcgtcaaagagcatgttagtgcccattcccatttctcgttaccgtcacgcgttaagttcaccgatttcgtgcggaatgatggtgaaatgactcacagcgcgtggaattggct

SEQ ID NO: 71717 - DNA, 884 bp, Heterodera glycines
  Genomic contig location: Contig_ID=SeqID_9516; Location=398..1281; Strand=+
  SCN-specific regions: Sequence locations=1-19,41-221,243-274,296 -442,477-774,796-884
atgacattttattatttgtttgcttgcttatacattattttgctcctcgctaattcatcgaccggtgggaataacaaaaaaggcaaacaaaatgctcaaagttacaatgaaaataatcaagcttcgaatacctataaagaatatttacctggatctgttctgaaaaatggtagaaacattaaagagctgaaggaacttttcgtgaaaaaaattaaaaaaattatgaaagaagcatcggaagaccgaggacaacgaaccacgaacaatgaatgcgctgttgatctgccagctgatttttgggatcaatttcaagaaattgcaaaactacctgaaattaaaggggttaaatttgatgggaatcgcatgataatagaagaaaagtgataaatgaacaatattttgaaacatgaaaagagatggatggaaaagatgcttttttagatttggttagtcataaaatttaacaattttttgctgttcttttatacttccgataaatttttgttgcgggaatcagtcagcgtgaaaatcttacagttttggatttattttaatgtactttctaatttaactcaacaaattggtttatttgcacaatcgttgaaacaaacattccatagtttccggaaggcggagtcgtacacttgcaaaaggtacaaaaaaaattttggggattgaagtagccaaggcccatatgactaaggctggcaagctaagcaactcctaaccaattgagtgatgatagggcaactgacgatacaactttaccaccaatcataacaattttcagcatttgcgcacagtcctaaccaccactaacttttgtgcctcctgccctaccgctcgtcggaaatctccactctaaattcaattttcttcaaaaa

SEQ ID NO: 71718 - DNA, 612 bp, Heterodera glycines
  Genomic contig location: Contig_ID=SeqID_44193; Location=298..909; Strand=+
  SCN-specific regions: Sequence locations=1-10,33-103,126-139,161 -195,217-510,532-612
atgaacaatataggctccgatcgattcatggaaacaatgtttttcgatgaagattttcgggtagggtcgagaggaattccagtcagaatttgaaacgttgtaaaattgaaaaaattgggtttttattcctttgaaaatgttattctccaaaaattattccggcaatttcgctggggaattagaaccacaatttagtatgaagaaaagtcatggaaagtctttaacgcttaaatggaatgaaagtttgtcaaatttgcggagcgtgactcattaggaaaaaataataattaatgtttcagctggatcaccctgaattggggcgacaggtaattgttgagcagccagaatttgaccgggtgtttggtgttcttcagcacggacagcatcatgatgcgcaggaagcgctcgtagagatggccggaggccagcgagaagatgttaatccgatcgtacgattgaccggtgcccatcaatttgctaaaaatgggagtcgaaagtgatggctatttgtttaaaaaatggttttaaaagatggcgttcaacagggttgattttttgtgatttatccattagaaaatgcaaatatctttggattcccaggcgtaatgaaaa

SEQ ID NO: 71719 - DNA, 1058 bp, Heterodera glycines
  Genomic contig location: Contig_ID=SeqID_44193; Location=1..1058; Strand=-
  SCN-specific regions: Sequence locations=1-230,252-545,567-601,623 -636,659-729,752-886,910-1058
  Gene Ontology: Mol. function=UDP-glucose:glycoprotein glucosyltransferase activity; Cellular component=rough endoplasmic reticulum; Biological process=protein modification
ttttagccaaatttttaccattttaagacaaaattttgaaattgggatcctgtggtgtcgttggcaccatcggggtggtgggccaaattcgttaagtaaattgagtaaaatttaaaaataatactcaaatttttctgaaaaatttttatttttcattacgcctgggaatccaaagatatttgcattttctaatggataaatcacaaaaaatcaaccctgttgaacgccatcttttaaaaccattttttaaacaaatagccatcactttcgactcccatttttagcaaattgatgggcaccggtcaatcgtacgatcggattaacatcttctcgctggcctccggccatctctacgagcgcttcctgcgcatcatgatgctgtccgtgctgaagaacaccaaacacccggtcaaattctggctgctcaacaattacctgtcgccccaattcagggtgatccagctgaaacattaattattattttttcctaatgagtcacgctccgcaaatttgacaaactttcattccatttaagcgttaaagactttccatgacttttcttcatactaaattgtggttctaattccccagcgaaattgccggaataatttttggagaataacattttcaaaggaataaaaacccaattttttcaattttacaacgtttcaaattctgactggaattcctctcgaccctacccgaaaatcttcatcgaaaaacattgtttccatgaatcgatcggagcctatattgttcattttttaaatttttgttgatattttctaccctcatttttttgattgtttaggaatcccttcccgtgatggcttctcattacggctttgactatcagctgatcgaatacaaatggccgagttggctccaccaacagacggagaagcagcgcgtcatgtgggggtcagtgttacgctcacgacgatgggaggcttttactatgcggacccgctaatttgctattttccaagaatttaggacatttatccccctaattttaataaatttggcgttctctgcattttttaacgttttgaaaa

SEQ ID NO: 71720 - DNA, 226 bp, Heterodera glycines
  Genomic contig location: Contig_ID=SeqID_44197; Location=269..494; Strand=-
  SCN-specific regions: Sequence locations=1-13,35-76,140-226
atgaaagcagagaaaagcaaagtaaaaatgacaattagaagaaacattgtgaataggtatttgaataaatattagcaattaaataatatattttctaaattttagaaatattttattgagtgattattttataataaaacggaattaaatacaatttgaattgggtgaatgaattatttttacacgggaacaggacaaaatttcgtcgccggaaaaaaaaattaaa

SEQ ID NO: 71721 - DNA, 215 bp, Heterodera glycines
  Genomic contig location: Contig_ID=SeqID_44198; Location=854..1068; Strand=-
  SCN-specific regions: Sequence locations=1-215
atttagaaacgggcgcgaagcgcccgtctgaggccgcgaagcggccttaatagcccaacaaatttagaaacgggcgcgaagcgcccgtctgaggcctcgaagctgccttaatagcccaacaaatttagaaacgggcgcgaagcgcccgtatgaggccaacaaaatttaaaaaacgggcgcaaagcgtccgatcgagggcgcgaagcggcctaaaa

SEQ ID NO: 71722 - DNA, 135 bp, Heterodera glycines
  Genomic contig location: Contig_ID=SeqID_44201; Location=632..766; Strand=+
  SCN-specific regions: Sequence locations=1-7,30-135
atggatcaacgagattcccactgtccttatgtgctatctagcaaatcctctgacaaaggaacgtgcttgacaaatttatcgggtaatgaagaacccgggggcgaaggcccaccacgaggccgcgaagagaaaaga

SEQ ID NO: 71723 - DNA, 273 bp, Heterodera glycines
  Genomic contig location: Contig_ID=SeqID_44201; Location=1..273; Strand=-
  SCN-specific regions: Sequence locations=1-50,83-91,135-273
cagcccggctgacccgacctttagagccaattcttttcccgaagttacgaatctaatttgccgacttcccttacctacattattctatcgactagaggctgttcaccttggagacctgctgcggatatcggtacgatcaggcaggagattcaaatagcttccctcgcattttcaagggccgtgtggagcgcacgagacaccacaggaaccgcggtgctttacgggcgcaacatccctatctcaggctgagccactcccaggcacgcacaccct

SEQ ID NO: 71724 - DNA, 1956 bp, Heterodera glycines
  Genomic contig location: Contig_ID=SeqID_9518; Location=184..2139; Strand=+
  SCN-specific regions: Sequence locations=1-149,171-400,441-512,535 -1051,1073-1080,1102-1502,1524-1546,1568-1956
  Gene Ontology: Biological process=DNA replication
atgccaaaatattgtacctgggttaaaaaagataaaaagtggaaatatccaagacaaggttaccaaaataaaattggtagaatggtaccagtacgcccatctgaaacagagaaatattatttgcgttttcttttgctaaatgtttatggaaaaagttttaaagatttaaagaccgttaatggagttgaatatgattcattcggtaaggcatgtttggctagagggttggtgagagacgatgaggaatggcacaaatgtttagaagaagccacgtatttttctcgaaaacacgcgaaaggcttaagaactttatttgtaaatatattggtacattgtgcaccaaaatatcccgccagattatgggattcattcaaagagcttatggttgatgatattaaaagaaaaaatccttccttttcaataaaacagataaataatattggattaaaattaattgatcaatgcttaagatattatgacaaatcattgagagattttaaggatatgccacaaattattaacaagacaaaaattgttgatgaagatgagatttacgatcctgaaaatgaattagaattagcgaatagattaattatgatgatgaatgatgaacaaaaagcaataatagataaaatgcgtaatatcttagaagaaaaagacggacaaaaatgcatttttatagatggaccgggcggaaccgggaagtcattcactttaaaaactatttatcatttggttagatcttttaataaaaatatttgtaacatggcattctcaggaattgcggcaacaattttaaaaaagggtcggacattgcataatcgatttaaactccctttaaacattaaaaaaacgtctacttcaggcattgaaatcaatagttcagacgcagaagaaataaaaaacattgaagtatttatttgggacgaagctccgatggcatcacgttttattattgatattatcgatagaaaattaaaagaattaatgggtaatgaaaaaccatttggtggaaaaattttcatactaagcggagattttagacagtgtttaccaataaaagaatttagtacaagatctgaaactgttaatttattgattaaaaattctcatctttggaatttttttataactatgaatttgaccaaaaatatgcgggcaaatccaaatgagagggaattcgcaaggcaattaattgaagtcggcaatggaaccgctggagaaaatggttttataactgttcctgatcagtgtataagcaagggtgatttagctaatgaaatatttggagaaatcataaaagaaagtaattttaatgaattgtctaattacgcgattttatcaccgtataataccgtagtcgatcgatacaacgaagaaataatggaaaaattccctggtgaaacccatacttatcttagcattgacgaaactgatttgattagcgatttaactgttacacccgaaattcttaattcgcttaaatgccctagcatgcctaaccatattttaaatcttaaacaaaaatcgatggtaatgttgttaagaaatttaaatgtaagagaaggattatgcaatggtacaagattacaaattgttgatacaggtgaacatgttttaaactgtgttataagaagtggtgataaaataggagaaacaacccttataccacgtataacattaattgaaaacaaaaattttccgtttgtattaagaaggcatcaatttccagtaagaattgcttttgcttttacaattaataaaagtcaatcacaaacatttgaaaaaatagggatagattattgtgacgaaccatttacccatggacaaacttatgtggcactatcaagggccaagtcatggaacggcattaaaataaaactatctgaagataacaaagaaaataaaataaaaaatatcgtatggcacgaaacattactgtaaaaatttttacga

SEQ ID NO: 71725 - DNA, 280 bp, Heterodera glycines
  Genomic contig location: Contig_ID=SeqID_9519; Location=129..408; Strand=+
  SCN-specific regions: Sequence locations=1-62,84-97,120-230,253 -256,278-280
gagtcgaaaagcgacttcgagggccatgaattcgattgggtaattatggcaatttgcatggacaacaaaaacgaggaggaggatgccaagaaaaaaatggaaaaggaggaaggagaagttgatgaagagtcggaggaccgcgaagatgaaattcaactggttggtgaggtgaaactgtccagtactgaggctgcaaaaaaatcgaaaaagaattgagaagggaaaaatcaatgatgatgatgatgatgatgaagagattgttgttgttgttgcaccataa

SEQ ID NO: 71726 - DNA, 519 bp, Heterodera glycines
  Genomic contig location: Contig_ID=SeqID_9519; Location=524..1042; Strand=+
  SCN-specific regions: Sequence locations=1-126,154-165,187-519
atgaaacgaagatgggactttcgttcaatgagcttttttgaacagcccagcttgcccgaacagtcgtcatcatcacaacgacaaagccaacaatatgatgatgataatcaacagtatggcgaaggtgacacaacaacaacagcagcaagaacaggaggcagaaaggacaaacaacaaaaggcagaggatctgtttaagcaggtcacccactcagtgcatagacttgaacgcttctccgtctcccggcatataactgaatttgttttgaacgcaagtgttgaagaaccggaagaagtgatgcgcagcgcattccagatgctaatggcacgggcaatccaacattcagaacagcaaagtgggaggaaagttgtgaagattggcgttactctgcaaggcagaggtctattgattgggaagtgtcgccattgctatgctctaacccatccatttgaacaggcctacatgatcccatcgtcctacctcttcgaccaccagagcaaaacagcagcgacacactga

SEQ ID NO: 71727 - DNA, 579 bp, Heterodera glycines
  Genomic contig location: Contig_ID=SeqID_9520; Location=799..1377; Strand=+
  SCN-specific regions: Sequence locations=1-57,99-525,549-579
atggacttaagaaattttggcggtgtgagtttcatggcccggcagaccaatgcaagggtatgctaatatattattttgaattttgaaaatcttttaaaatccaggacgcttgcacacggatttaaataacgttgtgcagaagttggtcggagttcattcgtgcgacatgaacgctgcgcatgtgtaatgtcagcgtcttgtaactggactcaagcgacgtgctgctgagacgtgcgaagcacctgcgaccattcgtgctcaagtgcttcaaaacacatgcacacctgtgctggcctcttttccgagcaaagatgccacaaaaaaggtgggttactatcaaaaacaattttgtaaataattttgttttctttttattcaggtcatcaaacgtttgcgccgtgatgaaaatgcaccgcgagtcgaacctctcaatttggagcagttggagattccgaatacctatcgtgtttataagcgcactgagattgacgaggagcaattcctgttggcggacactggcgtttttcaaattcacggacagaatggaccccaacggtaagatattaatcgtttaaacca

SEQ ID NO: 71728 - DNA, 372 bp, Heterodera glycines
  Genomic contig location: Contig_ID=SeqID_44204; Location=250..621; Strand=-
  SCN-specific regions: Sequence locations=1-59,81-212,239-321,364-372
tctccccataaatctgggcgcatcggttcagggggactgccccgaaaacccaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagact

SEQ ID NO: 71729 - DNA, 439 bp, Heterodera glycines
  Genomic contig location: Contig_ID=SeqID_44206; Location=437..875; Strand=+
  SCN-specific regions: Sequence locations=1-439
aaaatggtgtaagtaaaaatcgtaattacgcttaaaaagcttctcaaacaattttagcgcttccaattccttctacaaacgcctttatacatcccattatgagcgctaaaattatcagagtgccgaaaatcgcatgtgatctaagcctagcaaaaaatggtgtaagtaaaaatcgtaattacgctcaaaaagcttctcaaacaattttagcgcatccaattccttctacaatcgcctttatacatcccattatgaacgctaaaattatcagagtgccgaaaatcgcatgtgatctaagcctagcaaaaaatggtgtaagtaaaaatcgtaattacgctcaaaaagcttttcaaacaattttagcgcttccaattccttctacaatcgcctttatacatcccattatgagcgctaaaattatcagagtgccgaaaatcgc

SEQ ID NO: 71730 - DNA, 66 bp, Heterodera glycines
  Genomic contig location: Contig_ID=SeqID_44210; Location=776..841; Strand=+
  SCN-specific regions: Sequence locations=1-8,42-66
atgaacgttatgaagactggagaagaacatgacatcaccaatttcaaacttgggaaaactcaaaag

SEQ ID NO: 71731 - DNA, 764 bp, Heterodera glycines
  Genomic contig location: Contig_ID=SeqID_44216; Location=8..771; Strand=-
  SCN-specific regions: Sequence locations=1-451,474-506,528-764
  Gene Ontology: Mol. function=protein phosphatase activity; Cellular component=membrane
tatgttccgtggagacaaatcacattcacgggccggctgttcgacgttggtgaaggcagagcgaccacattgctattcttgctcaaatgcttaatttatatggctttggacattgtcatttgggttgcattgacatttctgagctacaaactgttggtttggactttcttcactccctttgaacgaggttgttaattctaattaattcttttttggattctttttgatttaggtttttattgcaatgatcaaagcatcagagagcccttagtccccaacactgtttcaacgtcccttcttatcgcaatcactttgggcgcaccgttcttcttcatttttcttgccgatttgatgcgtactacgaggcctcgcaggaggaatataactcgtgggtttggccacctgtttaaacattgcctttacttttagattttcattttaactgttgcataatttaaatccttttcattttgacggctgaataattcccttacttttcttttacttttgtagttaagatttatgctttctttcttattgtataatactaaatttcaaatacgctttagaggtcatcaaccgttccactctcgagtatttgaactactgcatcgctttctggctgatgactttggccatcgacgcttttaaatgcttgatcggtcgcattcggcccaactttttgtcaatgtgcaaaccacgggaatggagcgaagtgtgcactgtcacccctgatgcctatgtgaagctcgcccattgtaccc

SEQ ID NO: 71732 - DNA, 384 bp, Heterodera glycines
  Genomic contig location: Contig_ID=SeqID_44217; Location=443..826; Strand=-
  SCN-specific regions: Sequence locations=1-384
atgacattccaatctctgggactcaacccaccagcatttcaatctctgagactcaattctcaggctttccaatcactgggactcaattctccggcattccaaacaatgggactcaaatctccggcattccaaacactgggactcaacccaccagcatttcaatctctgggactcaattctccggcatttcaatctctgggactcaaatctccggcattccaaacactgggactcaacccaccaactttcaatgacattccaatctctgggactcaatccaccagcatttcaatctctgagactcaattctccggcattccaaacaatgggactcaaatctcccgcattccaaacactgggactcaacccaccaactttcaatga

SEQ ID NO: 71733 - DNA, 382 bp, Heterodera glycines
  Genomic contig location: Contig_ID=SeqID_44218; Location=463..844; Strand=+
  SCN-specific regions: Sequence locations=1-382
ccaaaccgatcttataagccacaacataaacaccggaaactcaaatccaattaaaagtgctccaaggccgattccctttggcgtaagagcaaaagttaccgaaatgatcaaggattacctggacaggggaattattcggcaatcatcttccccgtgggcatccccaatagttttggtcacgaaaaaggatggaagtgttagattttgtgtggattacaggaaattgaatgcggtaacagtgaaagattcttacccactcccaaacattgagcaaattcttatgtatttggggaaccgaaaatttttctcggttttggacttaatctcaggcttttggcaagtaaaagttaatgcggaggacgaacccaaaacggcatttact

SEQ ID NO: 71734 - DNA, 161 bp, Heterodera glycines
  Genomic contig location: Contig_ID=SeqID_44219; Location=1..161; Strand=-
  SCN-specific regions: Sequence locations=1-161
gccccgacgttccaccatggcacacgagtgctacggctttggcaatgtgcgagcaattaagcacgcacatcgggccagatgctggggcatttgtgctgcaccgcaagcggcgcataagtagaaagcccgacaccggggagcaagaatattgctatcttcct

SEQ ID NO: 71735 - DNA, 2932 bp, Heterodera glycines
  misc_feature (17)..(17): n is a, c, g, or t
  misc_feature (29)..(29): n is a, c, g, or t
  misc_feature (171)..(171): n is a, c, g, or t
  Genomic contig location: Contig_ID=SeqID_1289; Location=31..2962; Strand=+
  SCN-specific regions: Sequence locations=1-435,458-761,783-1309,1331 -1445,1472-1626,1648-1669,1692-1745,1768-2218,2264-2932
  Gene Ontology: Mol. function=SH3-domain binding; Cellular component =extracellular space; Biological process=cell proliferation
atggagctgatcaacancactctgacaanaatgtacaatgacccatcctccccagtgcgttttcaggtgttacagcactgtgaaagaagcgcggaaaaagattaaacatttacgaaaagaagaagtgcagagatatttggagggacatcgcacctatacattgatgcgccnccgcagggtgcggtttccaagagcaaaaactatagctgccggattcatgaccgatgtccaggtggatttggctgattttcaagccctttctcgtcataatggaggccaccggtatctgctcgtggcggttgatgtcctgtcaaaacgtttgtttgtcgtcccactgaaaaataagagggctgaagagatgttggaggcattcaaggagcttattgagcaaatgcccatgttcccccatcgaatattctccgacaaaggcactgaattcaaaaacaaactggtcaaagaattctttgaggagcacgagattgcgaagcacgagcccgtgcattcatcagtgaaagcctcagttgctgagcgagccatcagaaatgttaagcagcgactatacagatattttgcggaaaagcagactctcaactgggtggatactgtacagcaaattgttgatggaattaacagtgcaccgtctcgtgttcacgggatgcgaccaattgatgtcaattttcggaatgctcaaaaggtgtggaaacgaatgtatggacaacaattacttaaaatttcacaaaggcgagcaccacgtttccgtaaaaatgaatttgtgcgcatgagcagagagaaggggcagttcgagaaggggtacctgcccaattacggcgatgaaattcttgaggttgaccaagtgttgaaggcagtgcgtccaattcggtacaaacttcgtgatgatcgcggcgaaaagttcaggggcactttttatgagcaggagttggcacgcgtacgtaaggatgatgagacaagctaccgaatagagaaggtcttcaggaagagaagaaaacccgatgggtcagttgagatacttgtaaaattcataggctatcccgagagggaatggatcgatgaatctcagcttgtataaaagcattcagtttgttcattattttttacatttggataaatctttttctaatgacatcaaatagcttctttgtgtttttgccaagtaatgtatcagattaccccgacaatcaaccgaacaaatatagggtacgtcttccaaaacctctacattttagtgggtcgtgggtttgtgggctgcatagcatcagttatccctattcctggcactctacaattggtacattggatgaccaatggattgacattcatttcaccaatctccattccgttgatgatgaccgacagcgtgtcatcagagtacctgtcccacaggcgtcacacaaaaaagttgagcaactcagggattttttacaagcaacattgaagagtcaagaaaaagtcagacttaagccgcttgcgcatgaagaagggtacttcgataaaccggtagtgctcggctcgcctccacacgccaagcgccttaagagatcaacaattgatgatctctcttcactgccctctcccccgagatatgatgagacagatgagcaacaatcacagcagcagcagcctcagtctccccccagattcgatgagacagagaaagaggataaaaaagtcaaagaaacaacccctccttctgccgctaagcaaccgataccgccggctccaatacttgctcctccttcacatcctcctaccgaagcgccaaaggcagtcacagcaacgaaacaggcagctccaaaatctgccacagcaccgcccccaaagccaagtgtgacatctactattactgctgccaaaacaaccccgcctcccgctcccattccacccattaagcaagctccatcggccccgaagccttctccgtccaaaacagcggctgtgccgaagccaactccaacacccactccagcatctaaatcaactattccgactcctgcttcatcgaccaaggcgcagaatatccctaaaataccaccacctctggcagctaaaccaaaggagccaaatgtcgcaaagaagtccactgtaccaactaccgtatctacaacatctatttctagtttaacttctcagattgggcctacaccaacaacaccgaaaccaccgccgcctcctattaagcctattcctacttcaattccggcaccatcaccaccaccaccaccaccaccaccaccaccaccaccacagagtatagcaaaggacgctaaacgatcagtcgaagccccaaacgaaagcaataaggaatcaaagagattggatgtggatgataggttttttggcggtttagctgccggagacgagtttcccgacgacgatgacaaagagtccgaatggccatatgatcctttcaaaaacattgtcgatgatgtagaaatacaatatcttgatgactttgagcgattcaaggtggtgttcaaaaatccagtgatcagtcacttgtcattctcacctcagctaggctatgtgcttggatttgaaaacccccaacacgttgggcctcaagaaatctcaaaatacggctgcgacttacggggtggcttctcaagtttcgcagtctactcaaaaggactgaccgagaacatgattgttggtaattcgctgagttcgctgcttcgcgttgtgtcagtgagcggtgccacacccggtgactacaatgagaagatttatgattcgccaatatacgctcgagtgctgccacgggagatcagcgaaattgaaattgagttgcgcacgatggacaagggacgactggtgccattcgcctatggcacgaccatggtggtattaatatttaagaaagtgataaatttttaaaacccactcatttttgtattcattcactcattttacgcaa

SEQ ID NO: 71736 - DNA, 591 bp, Heterodera glycines
  Genomic contig location: Contig_ID=SeqID_1290; Location=2638..3228; Strand=+
  SCN-specific regions: Sequence locations=1-298,320-413,436-554,577-591
atggttctcgtcagcgaattttgtgctcaatttctctcctgcccgacaaagtcacttcgtgatcgactgaaccacccagaggaccgagtccgagttttgcagcaattgattgggaaaaaggtccagacaacatacaaggatcggaatggaatgtgcaagtgttttttcgttggtggaatgactgaacgaggcgcggcatttgaaccagcatatggacgtctgcgtaagccgttcaacattaacgtggcagcgcatttttacgctcgccaccgtgtcaaattgcactacccctatgtgccatgcatcattgaaggctttacccgtggtgaggaccgttattatccgatggaactgcttgaaattgtcgacgacaaaaagggagggcgattatttggtcgattgttcactgaaattgaggagcaggaggaggaggacaccaaaagtgattgttcacactcttcaaacacttcctatttacaatttaacggtaaaggattcaaatggtatgaaagcactgacgaaattgccaacactgggcgtggtgagtgcagccaaccatcgtcatcatcaccatcacacacgtattggtga

SEQ ID NO: 71737 - DNA, 1858 bp, Heterodera glycines
  Genomic contig location: Contig_ID=SeqID_1290; Location=3461..5318; Strand=-
  SCN-specific regions: Sequence locations=1-302,344-1113,1135 -1174,1197-1427,1473-1804,1832-1858
atgcttctgaccaatggaaaatcagccggcgaagtgcgagaccggctcgcgaagcggctggactttctgcgcaatcaaattggccgcgtggatgtgtactgggaatgtgaaattaaccaaatgttggcagcagaccctgagatgcgacaaatgtttggcagctatgtggacgacggcccacttgagatccgagcgtccttcatgggtgggcgaacggggccacgcaaacttttccacaaggcgaaggagggcgagaagatatcgtactttgacttcacgtcactgtacccctttgtcaagtttgttgccatatttgtgcaaatttttgcattaatttgacatttaagttttgagacccgctacccaaccggccatccaaaagtccatgttctcaaccaacaagtggactggcgttgcgctaccgacaatccgtacgatctgtcacttctcaaagtgtgggtggtgcccccgcggcgctgcgatgtgccagttcttcctgttaaagtgggcgatcggctgtgtttccctctctgcatcaagtgtgctgttgactacccaaacggaggcgttgacaacgagtacagctgcacccacaatgatcagcagagaggatgggtttcgacatgtacatcattggagttgaacgcagcactcgacgaagggtaccacgtcaccaaattgttccgggtgttgcagtacgagagcagtgatgatcaactcttcaaatcgtacatccgtgaattcatggcacaaaaaatacaagcaaccggctttgacgcaaacatcaaaggcaatgccgacttggaggatcaattcgtccgggaatgttacgaaaaatacggcatcaccatcgacaaggcaaaaatgcagccgaacaaagggaaacgatccatcgcgaaattgtgcctcaacaacttatgtgagtgacataatggaatttgatcattgataaaattttaagggggacgattctctttgaggaactttggattgtcccaaactttgatcaccggcgatcctgcggttttcgcggaatacctggacaatcgctcactggatgtgacggcaatcgatcaacttgacgacgaacacatgctgatcagctatgaaaagaaaaaggagtgggtggaggaacatgcctgttcgaatatcggtaaaaattcatcaatttgcttttaaaataaaattaagttttttagtaatttcgctgtggacaacatctgccgcccgactccttctgttgagggcaatgcaaaaagttgtgcgaacacaaggctgcgtgctgctctacacagatactgacagcctcatttttgcccatccgattgggctgtgtccgcttcaaactggccctcacctcgggcagttcaccgacgaatacccaaaacatgagattttggaattctgttcgggaggtgccaaacaagtaaattttcatttttaaaatttagatttttaattgtttaattttagtatggactcaagctgcgcagaaaagacgcaccagccgacgcagacaacgaatatgtgctgaaagtgcgcggtatgacgcttagctatgacgtcatccagaaccaaggacttcgctacgagacgttcaaggacaaagtgctacggtttgctgagacgggtgagccacaaccaatcaatgtgatgtatccaaatttcctacgaccaagcatcaaagatgggcgagtcatctcctgtccactacaaaaaatttataaaccatttgtcggcaaaggtattgtcggagccgactttcaaattttcgactttggtcacactctgtaatttttttgcactttcattttgtattttattttattgtgcgcataattaatgaatggaaaataaa

SEQ ID NO: 71738 - DNA, 1567 bp, Heterodera glycines
  misc_feature (1541)..(1541): n is a, c, g, or t
  misc_feature (1559)..(1559): n is a, c, g, or t
  Genomic contig location: Contig_ID=SeqID_9523; Location=1..1567; Strand=-
  SCN-specific regions: Sequence locations=22-699,722-799,832-837,861 -882,911-1095,1125-1369,1392-1567
  Gene Ontology: Mol. function=transcription factor activity; Cellular component=extracellular space; Biological process=transcription from Pol II promoter
ccccagaagaaaatgtgcctcctctaccgccgcgctcacccgcgccgaacgaaaacgagccacctcgaccgccgcgctcacccgcgccgaacgaaaacgagccacctcgaccgccgcactcacccccgccgaaagaaaacgagccgcctcgaccgccgcgctcacccccggaagaaaacgagccgcctcgaccgccgagctcacccccggaagaaaacgagccgcctcgaccgccgcgctcacccccggaagaaaacgagccgcctcgaccgccgcgctcacccccggaagaaaacgagccgcctcgaccgccgcgctcacccccggaagaaaacgagccgcctcgaccgccgcgctcacccctagaagaaaacgagccgtctcgaccgccgcgctcacccccgccggaagaaaacgagttgccacggccacctccagaaccaccacgatctcccccagtaccgcctcgaccacctccagctgaaccgaatgagcctgttcgttcaccatcagaaccaccgaaatcttcgcctcttaaggaaagacatttgttataaaatattgctgcagctcacttatcggctttatcggctgaaaaactgccgaaacttctgccggtgccgcctcctctgcccccgaaggatgataccccagttacacctctgacaccacgcccaaacgaagacattcaaataaaggatgatttctttggctctaaatattaataatcttgatagtcagagctgtgctcgaattctaaaaaaaggtcatcgcaggtcaaaaagagattgtgatgtcaaaaataaggattttttaaaaactcgaaaaagtctcaacttgcattttaatggtcaaaagaaagtgttaacaatgacgctttccataatattttaaataaacatataattttgagctttttgtacgaaaccacctacctatgtatttacgatttagtccaaatgtgcaaaagttatggcttcttaaacctccttggaatattaagaatcacacaaaaaaaaaatcggaaagtgtaaatgaaaaaaattacgcttttttccgaaaaaaaattcttggcgctataatttcttacagagcatatttaattcaaaaaaaataataataatctgtgactggcatttgaaacggcatggtacgggttgaatgttccacctacattgaccttttgattctctttctcttatcatcagtagggatgccaatcatatggataattttaataaattggcataatgtttgacaatcatttacacgagggcacctcgtttcccccccgccgtttcccccccgccgattccccccccgccgtttcccccccgccgtttcccccccgaatcgtttcccccccgagaaaatttttaaaaaaaaaaattgctaacttagaaatttttcaagaaaaaaatcttagaaagtttttttacaagaaaattctaagaaaaaaaattttttgagaaatttttaacgatttttttgaattttttttgaaaaatcttagtaattcacaatgaaaatttctcaaaaantttttttttcatagaatntttcttgt

SEQ ID NO: 71739 - DNA, 950 bp, Heterodera glycines
  misc_feature (45)..(45): n is a, c, g, or t
  Genomic contig location: Contig_ID=SeqID_9524; Location=8..957; Strand=+
  SCN-specific regions: Sequence locations=1-78,100-950
  Gene Ontology: Mol. function=RNA helicase activity; Cellular component=cytoplasm; Biological process=post-embryonic development
catatgctcaaagaagaattggtagtggccttaaagcataattgntaaattcttattttctgttcagatccttatggaacagatgaaggttttggttttggatgaggcggatcaactgctggaggatgagagcgctcgtgatttgcgccaaattgctaagattgacggatggcccaaggtaaaatagtgcatgacggaggttgtattgttttatttttacacttaaaacccgtgctttttcggtggaagaccgccagactttgctcttcagtgcgacttttcccgatgaggttcaaaaatgggctgacgaatgggtgaagccaacggcgctctttgtctccaacaagaaacctgtctcagcgaatgtgaaggttgtccaaaagtttatccgtgtcagtcgatcttcaaaaaaccatgagttgcttaaggttggtattattgtaagcaatccttcaaaaatgcaactatttcgttaagttattcgagcaagagcgtgctgaactgaaggcggaaaaacgtgtgttccctccccttaatttctattcgatgttccatcatttagcagatgagcccgagccaaaaatccggcctactatggtgtttgtgaagatgaaacgcactgctgatgtcatctccacatatttgaacctcaacaaagtgccgtcaaccaccatcaatgggttgattggttcttttaggctctttcttaatcaaagtgtttcagagaccggccgcaaaaacttcgacatgcggccttggatgattttcgggctggccgttaccaagtggtcgtcacgactgatgtctgtgctcgtgggatcgatctcaaggaattggaccatgtttgtctgggatgggttggaattataaacgaaacaccaaaatgcttataggtgatcaacatggacttacccatcgactacacaacttatgtccatcggatcgggtaa

SEQ ID NO: 71740 - DNA, 376 bp, Heterodera glycines
  misc_feature (274)..(274): n is a, c, g, or t
  Genomic contig location: Contig_ID=SeqID_44223; Location=166..541; Strand=-
  SCN-specific regions: Sequence locations=1-376
atgcacgcgttttgcgctcgagctatttatcatcgggcttgtcaatctaaagcgaaacaacaaagatggtgttttgaacgaataaagggcataggttattttgaagaagtgtcaaagaacatgcagcaataagcctgcaaaatctaataagtggaaaatacctgagtatagaatttattttcagaaagtgtcaacagacttttggaaaaatatatttgcaatttatcaacaattttgagaagtgagttagaaatgataaacttcacgattcaanaccagttttcggtgctctaattaaccgcgataaaaacatccgaatcaattaaatagcttctgagataataaggtttatcataaaatttcatttaaaaataaa

SEQ ID NO: 71741 - DNA, 567 bp, Heterodera glycines
  Genomic contig location: Contig_ID=SeqID_44226; Location=225..791; Strand=-
  SCN-specific regions: Sequence locations=1-567
atgcaacaaattattacatattggttttatgaaatagtatttccttttatataagaagcaattaagtgatgtatttttttatagttaagtataattaaggaattgatggacccgagcagaggattttatgacaaagacggggacaaagtgacattggccatcgatgttattgtgaaggaagaaaatgcggataaattggattattcaaatccaaacaaaacaaacgggaaaattgtgatggaaattggcaaattggcggaattttcgcgagagatttgtttgagtgaacggagcagcgaaatcaaacaaataaagggactttcgtggaagatattggcactgttaatcaatcagaataataaaagcagtgaaaagtgtttggcattttaccttttgtgtgccggctcaaaaaatggcacaaaatgggaatttatcccattaaatcaaattggcaattaaggtgaaaattggagttgcaaatgttcggccacaattcaaattgtctcacaaaagggcggggcggagaatttaattgggcaattcaatggccgtattttcaacaataaa

SEQ ID NO: 71742 - DNA, 610 bp, Heterodera glycines
  Genomic contig location: Contig_ID=SeqID_44227; Location=728..1337; Strand=-
  SCN-specific regions: Sequence locations=1-3,25-610
atggacatggaagaaagcagtgaactcgaagtggcagccgtcgattatgtgttccaaacaacacttgatcaactgccgatcactgccgaagaggttgctccacggacgcaagaagatgacgaattgcagcaagtgcttcatcagtgtcgcacacattggcccaaaaccgcacattcgtcaactttggccgcatatttcactcaccgcaacagactcagcgaaatcaaaggctgcttgctcatgggcgaccgagtcgtgatcccagccaaactacgacagcgcatcctcaccacactacatttcacccatcctggaattgtccgaatgaaaaatttggccaaacaatttgtgtactggcccaaaattgatctcgacgttgatgggtgggttagaaattgtgaagagtgtgccttagcatccaaagcgccacccaaagtgccgcttcaaccttggcctgcatccactcaagtctatgaaaggcttcacatggatttcgctggtccatgtgcagatggtaacaaatatctggtagtggtggattcattcagcaaatggccggaaatcattaaaatgaagtcaacaaccgcacaccttttgatcgataaaataa

SEQ ID NO: 71743 - DNA, 188 bp, Heterodera glycines
  Genomic contig location: Contig_ID=SeqID_44228; Location=963..1150; Strand=-
  SCN-specific regions: Sequence locations=1-188
aattcgaactttttttgctctgatttttttgtgcatagataaaaatttttgaaaatttgcaggctaatagcatttttcgaatgctttcgaataataccaagaatgtttaatttggttgagaaagaaaaaagttatggtcgaaaaattcgttcgacgacgtttcggctgacgacgttttgtcctactcc

SEQ ID NO: 71744 - DNA, 175 bp, Heterodera glycines
  Genomic contig location: Contig_ID=SeqID_44229; Location=710..884; Strand=+
  SCN-specific regions: Sequence locations=1-175
ttataaagtgattcgcgcaatcccaacgaatgacagccaagtgttggcattgcgtcatttcgcaaatttgatggagtcgtcaaacagtcgcaaaggcactgtccaattctggcaacatgcgtacacgttgcattcaaatgcggacatttttgccgattctgacagtgccaaaaag

SEQ ID NO: 71745 - DNA, 2637 bp, Heterodera glycines
  misc_feature (35)..(35): n is a, c, g, or t
  Genomic contig location: Contig_ID=SeqID_9526; Location=276..2912; Strand=-
  SCN-specific regions: Sequence locations=1-793,816-856,884-1232,1261 -1523,1548-1570,1592-2138,2160-2637
agcaacaagatcggagggatttccgacgcgaaatntaccaagtgtccatctacgggtcgactatgttgcgctacaaactgtacacatttgcgaacaacgaagacagtacagcggcgtactcatgggtacgggtttaaatgaacagaaacactaaaccaccccaaactgagttgccatttgtgcttatttgaataagattttaggcctaaatcccacaaatttcctcggcggcgcctttctttttagttaattgttagctcaaaatggtttattttcggactaaaatatatatagctgtatccaaaaaactcaaaatattgtaatataaaaacatcttgtttacaccttttaacaagttttcgttaaaattggcacatccaaaggacagttgcgtaataattttttggttcaaggatcgcttttgcgccgactctctccaattggttgagcacatttcatccctcaaagaacgggaaagtcggtgcatcaacgagactaataaattacaaatttgttttagcttcgattgcccttccctcggcttctcccctcctcggcgtcgttttgtgcggaattgcagcagcggcggttgtctattttctcatcgccaaacgcactgccgccacattgacttgacactgtttggtgttgggagaggcgagaaaagaaaaaccaacgaacgcattcccaaactcatcattttgaatggtttataaatgttaaattaaatctcccacaaaaacctctcattttaattttattatgccttttctttattattatttcattaatgttgtatttttattccatttataagttgaagcacatttttcattttttcaaataaaattgacaaataatcaaatgaaaatgtaaaatgatgatagggaatacttaattccttcttctgttattcatgagttttattcgtaaataatcacgggtattatttttgttttttgcattcctttggttttgtctcacaacggatagactcttttgtacacaatttgagtgtgcaaaagcatgtgataggtggcacaccggggcgacttgccacagttcgggtggacggtggccatgtgcagacgcgcctccaaatgggtggcatttagcaaaatccactcacggatcatctaaaaagcaattcatttccatttggcacttttttcgcaaacttaattaatgagactgaattggcaattccccgcttttctaaaattcggattttgttaaataataaaaaaaattttaaaatttcagcaaaaattattcaattttatggccgattcaacttcaatttcggcttcttctcgtgccgattatctaaagcggtacatgacagatgagaagaaaaagaaaaagggcgcaaaggaacaaaaaagcggaaaaagtgccgggtaaaaagcaaaaaatttggtttaaaattacgaaaagtgtttttagaatgcgactgctcgacgacgaggacactttcattcggacgccgcatgccaagccgagcaaaatcgacgaagaacgaattgaggaggatgaggacgatgagctaatgggacgacatcgaccgcaatttgatggcattgaaacggaagggcaaagaaatggctgggcccaatttcaaaacggactcattcgtcaccgtcgaaggaggtggggaagtgcattttactggagtatttatgattcaattacttattcattaactgaattttagccctttcggacgacgacatcaaaaaagagccgctttcccccgcccatttggaagcggacgaagaaaggggcaaaagtcggtcaaaagaaaagaaacgacggacaaaagacacaacagaggcaaagcacgaaattaaggaggaggaaacggttggtcatttgaacaatggaaaaccgggggacagatgtaaaatttagtaaaaaaaaaacgaaaattcccaggggaagagagcagtgacagaaagacaaaacccccaattaattgtcatatttccgcttttccaaattttgtcatcgattctttttaatagtaaaacccggttttgcaattgcaaaacatttcccaaataaattcaccaattataaaccttaaatgttttttggcatttattcctttcttaattgatagctttttaaatttgtctttatcaaagtgaataattcctttgttttgaccagaacgaaatgccaacaatcgccaaaaagcgacggatggacaacggaggacgcgcggggcttttgagcaaagaggcgatggagcgggaggaacgcgagctgcgcgagagggacctccaagtgagcaaaacatgggaaggaaatgggcgacggttcgttccattttaaaatttaaattgcacaaaattccacctgattagtgaggaaaactggcccggcactttttacgtccgtatttacaaatgatttgaccattttaagcgcctcaatgagttggaagcgtccaccgcggagagtggtcgcgacgcggaaacgcgcaagcgcgagacggggtttgagcgaaggcggcgcggggagaagcgcgagacggcggaggacgcggcacgcaaagagcgcgaggcggccaaacagaaggaaatggaggccaaatattctctgtggaaccgaggggtggcacaggcggaggaa

SEQ ID NO: 71746 - DNA, 304 bp, Heterodera glycines; identical to SEQ ID NO: 51570
  Genomic contig location: Contig_ID=SeqID_44232; Location=345..648; Strand=-
  SCN-specific regions: Sequence locations=1-304

SEQ ID NO: 71747 - DNA, 234 bp, Heterodera glycines
  Genomic contig location: Contig_ID=SeqID_44232; Location=725..958; Strand=-
  SCN-specific regions: Sequence locations=1-234
gtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatg

SEQ ID NO: 71748 - DNA, 116 bp, Heterodera glycines
  Genomic contig location: Contig_ID=SeqID_44234; Location=605..720; Strand=+
  SCN-specific regions: Sequence locations=1-116
tgccggtttttatagcaattaatgacccgtcgataaccgccgatcaaattgacgcgttggtcgccgacattgccaatggactgttcgccgtctgtgtgacgcttggtgttgtgccg

SEQ ID NO: 71749 - DNA, 440 bp, Heterodera glycines
  Genomic contig location: Contig_ID=SeqID_44237; Location=425..864; Strand=-
  SCN-specific regions: Sequence locations=1-440
caaccatttttgaccactgatttcggctgtggtaccatggcgagcaatgaggggaaggtggaggcgggcaattggttgtccatttggaaattgtgcaatttcacgtgaagcgtctgctgatgagtggtctgacgatattgacaccagaaaccggtggccattttgagcgactcttcgtcacttttcttctgttttcctgcagaaatggcctaaattttgatattgaattaaatatgtactagtgaatgaatcaatgaccatgtaaaggacttcaatgcttttcaagttgttgaccagggagatgcccagcccgtgcaagtgcagctccaattcgatgtccggctgttccatctgtgaaattttaatgattgaaaaaccgatggaatgtgaaaacaagataaatggttctgcccctctgtccactcacttcatacgcttgg

SEQ ID NO: 71750 - DNA, 81 bp, Heterodera glycines; identical to SEQ ID NO: 58971
  Genomic contig location: Contig_ID=SeqID_44239; Location=250..330; Strand=+
  SCN-specific regions: Sequence locations=1-13,47-81

SEQ ID NO: 71751 - DNA, 838 bp, Heterodera glycines
  Genomic contig location: Contig_ID=SeqID_44240; Location=162..999; Strand=-
  SCN-specific regions: Sequence locations=1-526,548-579,601-678,705 -787,830-838
gggggactgccccgaaaaccaaaaaaatcgattttttcaagtgtccgtttggggtactcaaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcggggggactgccccgaaaacccaaaaaaaaattttttggataaaaattatttaaatgaactgactagataatatttaaaataggtttttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagact

SEQ ID NO: 71752 - DNA, 707 bp, Heterodera glycines
  Genomic contig location: Contig_ID=SeqID_44243; Location=187..893; Strand=+
  SCN-specific regions: Sequence locations=1-52,127-334,358-707
atgcttatgattcatccaatgactgaaccatcggttgacggttaatgaatgctttaatttttttattattaaaaaattaaaaataaatctgacacaatttaaaaaataaaattcatttttaatattgaaatctttttcatatggatgggataaaaaaactcagagtcgtccgaaaattttgaaaaaactagaccatgaccatatttagagttggatccgggtcaggatttcggattaaagttaccctgacccaaatacattttttttcataaacctatgtttaaaaagcatatgaaaatttattatatagttgctcaaaatttaagcccaaatccacttaaacataaatattaaaattcctttttaaatactaccgtcttcttcgacaccaaatcttttggaattttcgaattaccaattttgttggctttaaatgtaaatcattttaaaattaacattaaaaatcattgctaaaaagcattaatttttatttatttgtaggcaaaagtcaacaaaaaagtacggcttcagcaccagcggaatttcagcgtgccaaatgtttagctgaaagtgaagtgattaaggaaaagccgagcattcgaactcggctcattgtttgtgtggtatgtggtgcgatcattgcgttctgtttgatcaaacttttcatatggaaatgattattttgttcaaaaaatgaagaaaaaaaa

SEQ ID NO: 71753 - DNA, 49 bp, Heterodera glycines; identical to SEQ ID NO: 60106
  Genomic contig location: Contig_ID=SeqID_44246; Location=478..526; Strand=+
  SCN-specific regions: Sequence locations=1-49

SEQ ID NO: 71754 - DNA, 848 bp, Heterodera glycines
  Genomic contig location: Contig_ID=SeqID_44248; Location=52..899; Strand=+
  SCN-specific regions: Sequence locations=1-428,450-504,526-652,680 -718,740-848
acaacttcggtttcatattaaaattgtcggaattcactttgacacatttcgacatttataaattgcttgaaacaattttgaatgaatcaccatcatcaaacaaaaaagacacaaaaagtgccaaaaacaaaaacaaaactgcttccgcgccatcgccaccgaaaatttacacatttttgatggacaattttatcgcttcatcacattataaaaaacatttggaaacgagcaaaaaaattgacaaatttgtgaaatgtgcttttgtcaattttggccaacttttgcttttgcgcgggaaattcaatttcccggaattcaaaaaatttgctgatgaaagagaaaaggaatgtggcaaattgccatttaaagatgacattgacatcgataatacacctttatcagggtaggaaatctgtaaataccaccggacctcaaacttttttaaaaattcatcgaaatttgccgcgtttaaataaaagctatacaaaattgaaaaatttcattattttcaccaccaccacaaatgcaatacttaacaattttcagatgcaaacaatttgcgttgcaattgtttaatgatgaacctttgtggaattatgctagagcaattaaaattgagcaaaatgaatgcaaaagtaaaatgaactgattgcctaattaattattaattaatgcctaactttttaatccttttaggcgtgttacaatttgctgatgccttatgtacaattgttgaaatggtcaaaaatgatcagaaacattcaaacacaaacattagaaaagtgaatgagtacaaatttttgaaacaaatcttggaaagaattggtgacacagaaaattatgaacaa

SEQ ID NO: 71755 - DNA, 398 bp, Heterodera glycines
  Genomic contig location: Contig_ID=SeqID_44249; Location=296..693; Strand=-
  SCN-specific regions: Sequence locations=1-105,127-398
atgcattggcgcttcgactttttcgccctcggattcaatgccatcgtttttttcctctttctgttcgccttaaattcggagggccctgagaagtggtcgtgggaaaatgtgttgttggtaattattcacaatatttaatggtcggaatgtgaacatttttagctcggcgcatttgcctcgcaaattcctcttcaaatttgggcaatttctgtgttgaaggcgtgctatgtaagcaagagattttttagaaatcccaaaaaattttcaggatttttatgtgcttctttacgtgttcgtctcattatgcgagaaatgaactccattttattatttaattttcattttttgttgccatctccttttttcatcaaattcacttttttagagcgaaaaataaa

SEQ ID NO: 71756 - DNA, 193 bp, Heterodera glycines
  Genomic contig location: Contig_ID=SeqID_44250; Location=116..308; Strand=-
  SCN-specific regions: Sequence locations=1-193
ggtaaatattgatcataggccccaaactcaaaaatgcttaaaaacggtcagaatcgatgtaaaaaggtttgaaatgggttggaaaaatagaattaggggcgcgcttgcccttttccaggatgaaaagtgccgaaaatggagtgcctaactcagctgggactcaagtgaccgcactataaaaagcacccaaaag

SEQ ID NO: 71757 - DNA, 49 bp, Heterodera glycines; identical to SEQ ID NO: 51181
  Genomic contig location: Contig_ID=SeqID_44251; Location=512..560; Strand=-
  SCN-specific regions: Sequence locations=1-49

SEQ ID NO: 71758 - DNA, 385 bp, Heterodera glycines
  Genomic contig location: Contig_ID=SeqID_9528; Location=290..674; Strand=+
  SCN-specific regions: Sequence locations=1-385
atgtccgacaattcccaaattgctatccagcttcaacgaatggcttttttgctggacgaaaaggaagccggattggaaacaatccaaaaacttttggtcgccaaaaacgaatttttggaaaaaaacgcagctgatatattggagcgacagaagattcagcatgcgatcgaatcccagcaaaatgcgcgtgctcagctgctgatcgaaataacgaacaatcttttgaccgctgcgagcgatttccaatttcatttggatttgcatattattggggaaaaccccctatcagaaagtccttaacctcaattttctgttcccggtgcccaatcgctaacaatcattatttttagagacaccggtgatacgtatagttatttgtcactta

SEQ ID NO: 71759 - DNA, 420 bp, Heterodera glycines
  Genomic contig location: Contig_ID=SeqID_9529; Location=364..783; Strand=-
  SCN-specific regions: Sequence locations=1-51,73-420
atgaaccgacggtaatgcattttaaaaatcaaaattcatttgccctaaatattttccccaatttcagttgggtttgtattgacgtttggatggacattttcccactttttgaccatgctcaactcggcctcaaaaggtcactgatttcgttgtgattattagagaccgcattttgaggcatatgtcttttttttctgcgcactagttcccgtatattaagcataaataacacattttccacttggtttgagacttctatgttgacttttattatgcctttttttgcctttttcgggattttcgtgccttaaatgccttttttggcattttgccgttttggtgccttttttgacgttttttttccgattttagtgccctttttggcgttttttccgaaaattccattaaaaatagaataaa

SEQ ID NO: 71760 - DNA, 941 bp, Heterodera glycines
  Genomic contig location: Contig_ID=SeqID_9530; Location=681..1621; Strand=+
  SCN-specific regions: Sequence locations=1-17,40-527,549-605,627-941
atgccgtcccttttctccctcattttcttcctcatgctctttgtcagcagcccttctcggcaccgattagtcactgctgtcagcagcaactcatcgtcgtcgcccattggcaccagcaccgacgcttttggcattccttcgccgaccagcccaatctctactgctttaacatcctacacgaatggcactgccacttttggcatccccccaccgccgatcagtccgatcattaatgcttcatcctctctcccaccgattgatccgttggaagcatcggttcagttaaaaatcggcttcctctttgccaacggcacccaacggttgcgaacgcttttcggctttggccaatccgcgcccgccgtcactttggcacttgaacgggcgaggcaagagcacctcatcgacagcatcaacttcacgtgggcaattagaatggatttcgaagctcataattaaggcccggatttttagaggcgaaaaattccaatttaggagcctaaataagggcgaaagaatcgcgaaatttttgaaagaaattttcaaaaatgccaaagcgaaaacagggccgaatgctaaaatagaggccaaacttttattttgggagcgaaaattcaaaaataagaatttttaaggtcgaataaccaaacttgggattccctagtgacggataggggcgttaaacgaagaaatttcgcgttaaaatgtgtttttcgtgcatttctcaccgaaacaaagccgcagaaaaaataagtaaaaacttaagaatccggggccctcctcataatcttaaatcaccttaaatgattattggccgtaaatgccaattttcagttacacgtggcgaatgtgcgactgctttcagccttgggctgtcggctacgctactcaactgattctgacggaaaatgtggacgctttgatcggtccgccttgtgttacca

SEQ ID NO: 71761 - DNA, 49 bp, Heterodera glycines; identical to SEQ ID NO: 51181
  Genomic contig location: Contig_ID=SeqID_44261; Location=927..975; Strand=-
  SCN-specific regions: Sequence locations=1-49

SEQ ID NO: 71762 - DNA, 404 bp, Heterodera glycines
  Genomic contig location: Contig_ID=SeqID_9532; Location=799..1202; Strand=-
  SCN-specific regions: Sequence locations=1-46,90-259,281-364,387-404
atgcacaggcatgccttaaaacagctaagaaaattaaaagatttggtaattttttttcattttttttttaattttaaattttttttttacagaaatttccaacttcacaacccttttaccgtgcccttgttgattgtcataatcaaatatttgccttctacaaaactgttgggcccggcgaatcgggctgtctgtcctacagtctttgcgttttgccacgaataccaaaagcattgtgtacagtaaccaaaagcaaatttgatactgtggttgcaaatggcgcagtctttcatgtcagaacgaagtcggaatttgttgaagagcgctgcacagaaaacggaggcggaatataatcaaaatcacattaaaacattaaaaaagcattttcaattttttcaaataaa

SEQ ID NO: 71763 - DNA, 631 bp, Heterodera glycines
  Genomic contig location: Contig_ID=SeqID_44262; Location=228..858; Strand=-
  SCN-specific regions: Sequence locations=1-462,484-631
acaaaacggcgattcttgtgcccttcggtcaagaccaaagaacagatgatcttcgagatagatttccgaatttcggcgacaattggcgaaaaaattatgtttggtaaaaaacatgacggttcaaccgatgatcttcgcaaggcaacgagggtaagaaaaaatgtttttcaatggatcaaggggatatttgattttgttttttttcattcgaaaacacacgaatcctgttcaccgtctgaataattattttttagatgatattagacatggtaaacagcggaatgttttacgacgaattgggcctgcgcgaatttactgtaaaaatgttacttctctatgtcttaaaacaattcctttttgaggttgccccaccaggaccggcactgaaaaacaaattggacaaatttgtggaccggaaattgaatgaatgtgtggcacgagtggagaaattagtgaataacaaaaaggttaaattgagtataataaaacattaaattgtgaatggtgcaaatgatttcaggacgaagtgaaagacctggccgagcatttggaggcaagcgacggttggcacttgaacgaggaacagatccatcaattcttcaaaagcagaaacgcaaatgcgtccccatga

SEQ ID NO: 71764 - DNA, 423 bp, Heterodera glycines; identical to SEQ ID NO: 65209
  Genomic contig location: Contig_ID=SeqID_44263; Location=280..702; Strand=-
  SCN-specific regions: Sequence locations=1-2,30-32,155-206,236 -236,320-325,358-423

SEQ ID NO: 71765 - DNA, 857 bp, Heterodera glycines
  Genomic contig location: Contig_ID=SeqID_44263; Location=716..1572; Strand=+
  SCN-specific regions: Sequence locations=69-140,208-344,377-857
gtggtgcatggccgttcttagttcgtggagcgatttgtctggtttattccgataacgagcgagactctagcctactaaatagttggctcattgcttctgtgggcacaacttcttagagggattttcggtgttcagccgcacgaaattgagcaataacaggtctgtgatgcccttagatgtccggggctgcacgcgcgctacactggcaaaatcagcgtgcttgtccttccccgaaaggggttggtaaaccggtgaaaatttgccgtgattgggatcggacaattgcaattattgtccgagaacgaagaattccttgtaggggcgagtcatcaactcgctctgaatacatccctgccctttgtacacaccgcccgtggctgcccgggactgacccatttcgagaaattcagggacggatagagtaccggcttcggacggtatgcatactgtaacctatttaatcgcagtggtttgaaccgagcagaagacgaaaccaagtaactgtaagtgaacctgctgctgtatcattaccctagtgattcctattcaccacctacctgctgacctgttgcgctagcgatggcaccaccaaatgcccccgaccgctgatgagcacaggtcgtacgagatgacttgtggacgctgcccaacattacgggatagctgcctcacaagacatggttttggggtgcttccatacgttggagctgtggtataccgctcagtgctgcacatgtgaaagcctgtgtatggctgctgcgtggcaatgtgtcggtggcgggccgcctcgcttggctggttcgctgcgccaatgtgggatgcacgctcgtggggcgacctaacggctgtgctggcgt

SEQ ID NO: 71766 - DNA, 170 bp, Heterodera glycines
  Genomic contig location: Contig_ID=SeqID_44264; Location=458..627; Strand=+
  SCN-specific regions: Sequence locations=1-54,88-143
tgaagtcagagttgcttgactctgaacccaggcgttgaatgttatgagctacaggtgggccatttttggtaagcagaactggcgatgtgggatgaaccaaacgagcagttaaggtgccaaagtgcccgctcattagaccccataagaggtgttggatgatatagacagca

SEQ ID NO: 71767 - DNA, 49 bp, Heterodera glycines
  Genomic contig location: Contig_ID=SeqID_44266; Location=771..819; Strand=+
  SCN-specific regions: Sequence locations=1-49
attgaaagccatccattgcataccggttctcggcacagcaaagcactaa

SEQ ID NO: 71768 - DNA, 501 bp, Heterodera glycines
  Genomic contig location: Contig_ID=SeqID_44267; Location=441..941; Strand=+
  SCN-specific regions: Sequence locations=1-407,433-470,495-501
atggtaagacgacgcattcatcgtgagcaggatcttgctgaaaatgagttggatatgtcctgcaaggcaatttgtagccgagatcgattttggcacggtgccaaggatgaacaacaaggggagcaggatgagaaggagcatgacaattgcccaatggcacaaatacgaacagtgtacaaggcgggatatggccgaaacgagcggcgccgaaacgagggtgtcccttaaaaagaggacctttttgaaaattttttcactttttttgtctaattttttttgtttaaaaagtcctgaagccaagtacccgggagttttagaggtcgctgatcacgaatatgacaattatttgggcctattaatcaaatttggcgctagttataaagtctcagaatttgaacaaaagggggacccttttgttttgcaaaaattttttgagataaaaaatcgtgaatatactttttattcaccataattgtgcttaatgctcatcattatatgtaa

SEQ ID NO: 71769 - DNA, 547 bp, Heterodera glycines
  Genomic contig location: Contig_ID=SeqID_44269; Location=275..821; Strand=+
  SCN-specific regions: Sequence locations=1-182,213-547
atacaaatttggacatcccattgcatttggtggacaattcgtttgaggacaatttggcgcttggccatggtcaccaatacatggaacgattcggttaccatgacggcaatgaacgcgacgaatttttgacaaaacgtccgaaacgacaggcggtgataataataaaaacaactaattattccttttattatttttaaataatcatttataaacattttcacataataatttcttgtaaagcaaatttgattataatttcgcttcataccaaccatggacggtcccaggatttcggcttggggggggcggagtaggacaaaacgtcgtcggacgaatttttggaccataacttttttcttacttaaccaaattagacaatcttggtaatatttgaaagcttttgaaaaatgctattagcctgcaaatttccaaaattttttatccatacacaaaaaaatcagagagaaaaaaaagttcgaaatactaggtttttgagttccttctggccataacttttttgctaacgaaaatttttgaaattttgcaa

SEQ ID NO: 71770 - DNA, 596 bp, Heterodera glycines
  Genomic contig location: Contig_ID=SeqID_44271; Location=32..627; Strand=+
  SCN-specific regions: Sequence locations=1-112,150-382,429-566,588-596
atgggcatttggtcatccatttggccacaaattattttgccaggaattttcgcattggtctccgttttgttcaatttttcgttaattttggtcacttttacgaaaatgtgagatttaaattttaaatttaattcatttttgatttttaagaaaggatcacaaggtgtgcaattggctgttggccttcgattcgttttgccaattgtttttcgtcgctcctttccttgtcaattttttggcccagattttacagtacaccacagttgattaccgtatttgtactggtagtcttatggcatcaactgtggcatcgtatgcctcttttttggcactttttttgatctctgccgaacgtttattaattgttttgttcccaatcaagtaaatattttttaaacaaatttaattatcttgtatatatttttttagaatgaattggatcaaagaacaaacaattcgacgattttctttgttttttctttattttctatcctttttggcgttatgatgatggtctacatattgtatgaattgactattatcactgtgccctttgaaaggcatacaattttttattttaaattttacagtaataa

SEQ ID NO: 71771 - DNA, 477 bp, Heterodera glycines
  Genomic contig location: Contig_ID=SeqID_9533; Location=316..792; Strand=-
  SCN-specific regions: Sequence locations=1-477
cctacggccgaggcgaaaatggagaattccataaaccggcatacatcgctggacggtaccgcttattctacgtcaactcgaaaaacacgaaggtcaagtctgccgcgtggtatgcgaaccgtggagtccattacaagatcgaggactgcccggacaaaccggaggacgaagacggttacgtgccaccacccgaacaagaacaacccggagtcatcgctggccaaccgcctgtgactcttgcaaatgcattgcatgatgtttgtgaatttttaagccttccattagagtaaacaatttaggatttgcatggacctgctgatcgtgaggctatcatcggccttcagccgaccgatgaaattgcgtcagcattcgacgcttttgcagaaaaagctgaagacttcgtggacctattgcgtacacgaatcatggaattggagcagcagacgcgaactctgcagcgcaatctgcgacaaaaag

SEQ ID NO: 71772 - DNA, 1223 bp, Heterodera glycines
  Genomic contig location: Contig_ID=SeqID_9534; Location=853..2075; Strand=-
  SCN-specific regions: Sequence locations=1-391,413-824,846-853,875 -961,983-1015,1037-1054,1076-1223
atgatcaaatcgatggtacaaatggcgaaaatacggcgaaaacggcggaaaaattccatgacattttgatcgatgtaactgaaaatgtgataattataaatcaaatccaaaaatcaatttttacaggatttgaatgcgtcagaatccgatgagtttgttgggcaacggatttcgagggattggcaatggatttccatcgaccaaaatatgctcaacaacatcacagaaattgaagaaagcctggccaaagaaaaggagctcggacggaatttgaagagacaaaacgaaaacattttgatgaaccgacaaaagcatttaaatccttcataatttcgcctccgtccgttcaccgctttttgtccccgtttagcaagactgtcccaagggccatctgaccaaagagcagttcatcaaattgtacaaggtcagtgccgtgccgatttaatcggtcgaggactgactttagccttactcatgccccgcttcttttcaggactttttcccctccggctccgcggaaggcttctgcgaacacgtgttccggaccttcgacacggacaacagcgggttcatcgacttcaaggagttcttgcttgccatcaacgtcacttcctccggcacacccgagcagaaactcgaatgggcattccgggttttgaattttgaattcaaaacgatgccattgcctttgtcccgttcagatgtacgacatcgacgggaatgggacgatagacgagaaggagttgatcaaaatcatcgaagtacacacaaatgggggcttgacatttccaacattttgccgtttttaggcaatttacgaaatgttgggccccgaagtgaccaaatcggcggacgattcgccaagaaaacgggcgaaaatgattttcgagaaaatggacgtaaataatgactagggctgccaaaaatatgcacgaaaagtggccaaaatatgcgcataaatatgcaaataacattttttaaatcaaaaattttgtaatgaaaaaaaaatttggggaaacaatttttgaaaaaattttccaattcttagtggtgtatttttaaaaacatttttggtcgattcttaggggtgtattttttaggacctatttttaggggtgtattttccgtttgtattgcatttttgttaacaaattttccaaaaaatggcaaaatatacataaaaattcataaaaacccaaaatatgcaaaaatatgcaaataaa

SEQ ID NO: 71773 - DNA, 94 bp, Heterodera glycines
  Genomic contig location: Contig_ID=SeqID_44272; Location=32..125; Strand=-
  SCN-specific regions: Sequence locations=1-94
atggttcaaattcaggtccagaaatattccaagcaggacaaattgttggaaatgcttaaaactgatgccatttggaggccacgcccaaacggag

SEQ ID NO: 71774 - DNA, 282 bp, Heterodera glycines
  Genomic contig location: Contig_ID=SeqID_44275; Location=220..501; Strand=-
  SCN-specific regions: Sequence locations=1-144,166-282
atggtaagacgacgcattcatcgtgagcaggatcctgctgaaaatgagttggatatgtcctgcaaggcaattcgaagccgaaaccgattttggcacggtgccaaggatgaccaacaaggggagcaggatgagaaggagcatgccaattacccaatggcacaaattcgaacagtgtacaaggcaagaaatggggaaatttggtctcacatttccatgcctattctttgccttttgggacagactattctctcttttgtttcggattatgagggaaattcttga

SEQ ID NO: 71775 - DNA, 59 bp, Heterodera glycines; identical to SEQ ID NO: 52421
  Genomic contig location: Contig_ID=SeqID_44277; Location=47..105; Strand=-
  SCN-specific regions: Sequence locations=1-59

SEQ ID NO: 71776 - DNA, 59 bp, Heterodera glycines; identical to SEQ ID NO: 52421
  Genomic contig location: Contig_ID=SeqID_44277; Location=177..235; Strand=-
  SCN-specific regions: Sequence locations=1-59

SEQ ID NO: 71777 - DNA, 59 bp, Heterodera glycines; identical to SEQ ID NO: 52421
  Genomic contig location: Contig_ID=SeqID_44277; Location=307..365; Strand=-
  SCN-specific regions: Sequence locations=1-59

SEQ ID NO: 71778 - DNA, 59 bp, Heterodera glycines; identical to SEQ ID NO: 52421
  Genomic contig location: Contig_ID=SeqID_44277; Location=437..495; Strand=-
  SCN-specific regions: Sequence locations=1-59

SEQ ID NO: 71779 - DNA, 59 bp, Heterodera glycines; identical to SEQ ID NO: 52421
  Genomic contig location: Contig_ID=SeqID_44277; Location=567..625; Strand=-
  SCN-specific regions: Sequence locations=1-59

SEQ ID NO: 71780 - DNA, 59 bp, Heterodera glycines; identical to SEQ ID NO: 52421
  Genomic contig location: Contig_ID=SeqID_44277; Location=697..755; Strand=-
  SCN-specific regions: Sequence locations=1-59

SEQ ID NO: 71781 - DNA, 59 bp, Heterodera glycines; identical to SEQ ID NO: 52422
  Genomic contig location: Contig_ID=SeqID_44277; Location=827..885; Strand=-
  SCN-specific regions: Sequence locations=1-59

SEQ ID NO: 71782 - DNA, 317 bp, Heterodera glycines
  Genomic contig location: Contig_ID=SeqID_44279; Location=774..1090; Strand=+
  SCN-specific regions: Sequence locations=1-317
atggagaaggcctgcaaaattaggagagattatatcgattttagtgcgctaggttcgatgaaactttttaaaatataagcctaaatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtattaaaaatttttagattttttattcatctccctttttgatattgaaagcatctgagtgcctaaaataacttgtaa

SEQ ID NO: 71783 - DNA, 76 bp, Heterodera glycines; identical to SEQ ID NO: 53797
  Genomic contig location: Contig_ID=SeqID_44279; Location=1202..1277; Strand=+
  SCN-specific regions: Sequence locations=1-76

SEQ ID NO: 71784 - DNA, 648 bp, Heterodera glycines
  Genomic contig location: Contig_ID=SeqID_44279; Location=59..706; Strand=+
  SCN-specific regions: Sequence locations=1-334,370-648
aaacaaaaaaatcgattttttcaagtgtccgtttagggtactcaaacaattatggggagcaaaaatccaacgcagaattaaagtacaggctatagggaagctattcccgaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcagggggactgccccgaaaacccaaaaaaaaatttttttggataaaaattatttaaatgaactgactagataatatttaaaataggttattactcttcctttcagtatccctgcaaagtttggtgcgcttctgatcagtttctgaaaaaaaagttaagcctaaactttttggcctgtttaaaaaggaattaaaaattttattcatctccctttttgatagaaaaagcatcagagtgcctaaactaacctgtaaataaagttttgtgtgtttcagagcactttctgaaaaaatacttatgaattaattttgcaaaaaataaataattaatgaaaaagt

SEQ ID NO: 71785 - DNA, 565 bp, Heterodera glycines
  Genomic contig location: Contig_ID=SeqID_44280; Location=34..598; Strand=-
  SCN-specific regions: Sequence locations=1-383,418-565
  Gene Ontology: Cellular component=mitochondrial matrix; Biological process=energy pathways
atgccgccactgccaaaggagccgatcagctcaaagcccgtctccgaaataaaagtgcccaagttccagcagcagccaccgcacgctcccgccggcgactccaccgccatcactggacaacgcagcgaaacgcgagtgaagatgaaccggatgagactgagaatagcggagcggctgaaggaggcgcagaacaccagcgccatgctgaccacgttcaacgaggtcaacacaaatgggggggaggcgggtgacatgagtgaatgtttgtagcgagtcacacatttatacagcttgctatttttaaaaatcttaataaattgatttgtccgtttgcatcacaaaaaacaaaacaaaaattctaataaaaaaacaaatcgaatgatagaataattatctttttaaacatttttattccttgctcttttcaggtcgatctgtacaacgtggtacggatgcgcaagcagtaccaagaggcgttcacgaagaagcatggtgtcaagttgggtctgatgtctccgttcgtccgcgcgtccgcaattgggttgcaggaactgcccgtggttaa

SEQ ID NO: 71786 - DNA, 82 bp, Heterodera glycines
  Genomic contig location: Contig_ID=SeqID_44281; Location=1..82; Strand=-
  SCN-specific regions: Sequence locations=1-11,33-82
gaaataattaattaattcaatttgtattttctcgcttcttatcaagtgctattagtagaaagaaatgaatcgtattgttcag

SEQ ID NO: 71787 - DNA, 208 bp, Heterodera glycines
  Genomic contig location: Contig_ID=SeqID_44281; Location=884..1091; Strand=+
  SCN-specific regions: Sequence locations=22-208
tttggttttattgcatttttgttaaggaatttttcaaaaaatgtcgaaatagtgaaaaaatagtgacaaaacgccaaaatagtgatttttaactattttagtgacgaagtcgccaaaatagtgatttctagtgacgaaaagtgacgtccaaatgaaaaaattttaatgcagaaatgcgttttttgagctcctttcttcaaaacaattg

SEQ ID NO: 71788 - DNA, 1798 bp, Heterodera glycines
  Genomic contig location: Contig_ID=SeqID_9535; Location=10..1807; Strand=-
  SCN-specific regions: Sequence locations=1-318,340-599,624-747,770 -1401,1456-1798
atgggacgcatggaattggatttggaccaaatggtcaagggaaagccaaatttggtggaggaggaggccgcgtatgggcagcgaaagcgcgagatcactgcctccatcgccaacatgttcgagcagtacgtcgactcattggtgagggaattttgaataaatagcggggctctgggaccggtctcgtctggtattctcaaaacggcatattttcagtctcaagaaatacaaataaacgttcgaatcagaaatacagattttcatctcattttccgaatctcctggttctttttttgattttagagagtcgaactctaattattaaattaacaatgaaataacgattcgattatcataaactgcaactataagtaaaacttcaaaattaagaatcggttgcgccctttgagcgtgaaatgtgtgctggcggatgacgaattgaaaaggctgaaacgacgacggcgcgtgatgggcatggacgacgacgacattggtgaacagctgaacaccgttaaggtgggaacattcaaaaaaataataattccgaacattggacaaaagaggagaggaacttttggctctactgcagttcaaacgaccaaaaaataaatttgacaatttatatcataactttttctacaaatattcgaattaaactttcttggtttcattcaatagccctaagtgttctctcttagtctacaaaatctcaaaaatttcgtaatgtttcaaaaaagttatggccaaaaatgtttaggaaattaaaatgcattttctttaatggcaatttatgctttctcatgtttagaaacgttaccaagcacagtgcaaaattcgtgaggatcacaaaataaatgtggaggaagcgaaggacgcattcaaaactttggccaaatattcgccggcagagaatgaacagtcccacgaggaaacgagggcgttcaccaaaatgaaaagtgttggttggcactgcgggatccatgccatggcattttttgtgatttaggatttcacgaaccatcaaattccggacgacgcggacgcattggacgaacggatgacgagggaattgagcaaagcgtccaaagggcgtcaggagggcactgaaaaggcatggcacaaaaattatttggaaaaaataaaaacttgaaaaatagcaaaacaatcagacccttggtaatttggagggtaaaatccaagaatttttttttgttcttcgggctaaaattatttctccagtgttattttaatattttcagcgccgggggaaatgcatgaatttgtagctatttttcgccacaaaatgactaattttggccattttggatcaaattttcaacaaaaaaacatggtaaaatggggaccggcggtgcctttaagcgttgtcatgaaaactcttggaaattttaatataatttgttaagaaaattcttaaaattttcaaaaaaaaaaattgccaattgaacacttggattctaaatatagcgcgaacgtctcatcccaaaatcaattaattacccatttaatactaaatacatcattagataaaatatcgcattttttgcaggatgtccacgagtaccagcgactgttggaggagcacgacaaattgggcacggaagtgcggcgagtgggcgaacggaacgaacggtggaagcgcgaaatggacgacagactcagcgagtggttggacccgctgggcgagttggtggcaaacatcagcaacaacttcaccaactttttcgcccaactcggctgtgccggcgaagtccgactcgacacgccgccggagaacaaa

SEQ ID NO: 71789 - DNA, 576 bp, Heterodera glycines
  Genomic contig location: Contig_ID=SeqID_9536; Location=1588..2163; Strand=-
  SCN-specific regions: Sequence locations=1-271,293-296,322-576
aaatttctatttttaattaatccacctgtggaccaaactcgcactcgtaaatggccatttaaatgccaattttattttgatggtgggattgccatcttggcatcaacaaaaacgcaatttcgtcctacgatttttgcaatgttagacaaggtttgaggatgacaatatagtggaatgtgatttcgtgccccttattatggaggtacatccattttttgaggtaaaagaggagattgaatttgtaacaacacgaatgataaccttcttaactcttgaaaaaagaataatttcacgacctattattttttaaaatagaaatagaggaaaatgggtattcttcaaataaccctatttatgcgacaacgaaattacaacattatttagtcaatttcgccacttcattcataaacatttccgcccactttttctcattcattcgcactaacgagtattctgatggcatttttgagaatgcctcttctatcaggcgcaatggcatattcataacaataatccgcaaacaactcatatcgcgtgtggattctccattgctaaataacccaattattaaataaa

SEQ ID NO: 71790 - DNA, 659 bp, Heterodera glycines
  misc_feature (643)..(643): n is a, c, g, or t
  Genomic contig location: Contig_ID=SeqID_44285; Location=42..700; Strand=-
  SCN-specific regions: Sequence locations=1-187,209-315,356-659
atgactttcagtttgttttcatgcatttaagtcgttttcgagacattaacccaaatttctaaaatttaactttcgattctttgttcgaaatcgggtcctgttttaggaattggtcgaaatggatgccatattcgtgatcagcggcccaagtaacccccgacggtgggcacaaacaacttcattcttttgttgattatgtacacaatttcccctccatttttaaggcaaacgggcacaggacttggccgaagaaggaggacttgccgaaatgatggacatttttcgcactaccacgacagccgaacgaacggaggcggcggaacgttgaagggtgaaaatgacattttaaaaattttcactgactgattaaatgaaaaaaaagaaaattcattttcatattgcaaaacgacagaccaacagcagcagcagatggacacggcactgacaatgatgagagggaattgcggctcacaaacaatcggacggatgtgattttatattcgatcattttccatgtatggatacgtactacatatgtatgttttatcgccatgtatattttgatattttgcttgtcacgctcgatatttgctgctgctctgattgtacatatgttttgtattattgtgcctaacaacattanatactcgataaataaa

SEQ ID NO: 71791 - DNA, 93 bp, Heterodera glycines
  Genomic contig location: Contig_ID=SeqID_44288; Location=867..959; Strand=+
  SCN-specific regions: Sequence locations=1-93
atggggagcaaaaatccaacgcagaattatagtacaggctatagggaagctattcccgaaggattcggtctccccataaatctgtgcgcatcg

SEQ ID NO: 71792 - DNA, 968 bp, Heterodera glycines
  Genomic contig location: Contig_ID=SeqID_44289; Location=4..971; Strand=+
  SCN-specific regions: Sequence locations=1-77,99-459,481-968
cccgtgccgaattagactcaatggatttaccccctgtctctttggatgctgctctagggcatttacagagcagattcgaaaatgagaacacaaagagtatagcgagacaaaacctcgcgatttgcagacaatacccgggagaaaaagtttttgattttgccactcgtttaagtgaggcagttaggactgctttggccggggaaacggagggaaacattaggaaaagactgttggaagaatttttggatcggttaatccccgagctacaatacgaagtgaaatcggagaggccaacggactatagcagggcttacgaattagctcaacattatgagcttctccaggcgtcgcgcaagtcgacttcaaatgtggccatgaatgaacttattgaaaaagtcgaggcgttggccatgcaaaatgtgagacatgccccaaatttttctgatcagcgcgatcaccgggtttgtttttattgtaaaaaagcggggcatgtgataagagattgtgcggcgagaagaagggaagcaaacaatgggccaaattggcgaagagatgaaaacagccgtagaacggaacgcaatgggaattattctcggccattcgggcagggatatgaaaggaaccgagagacgtggagaagcggaaatagccaacaaaatagtcggccaaatcagaactatcggcgatacagagaccaaagtggtactagacgggaatgcgatcaagaaaatcgtttcccaagaacacccacaccaagagtaaaccctaggggaggcagaatagcaggtgcccgagtggcaagcccctactttttggcaataatcgctattttcggcagtgttctctccaacctcaatccttgcaaatgttccaaaacggcagccgatgatctgtttaccggacgctccgtcgagtttatcggaaattcgccagaggagccaatctcgccccacgtggcaaccgactga

SEQ ID NO: 71793 - DNA, 178 bp, Heterodera glycines
  Genomic contig location: Contig_ID=SeqID_9538; Location=741..918; Strand=-
  SCN-specific regions: Sequence locations=1-178
atggttagacgaaaagaggaatttttaggatgggacgcaccccatctgatattcccatttttctgtttcacaactggccaacggcgactgtgctcattgacacgtagttgtccaattaaggtacttggactttccacagtaaaatgtggtgcaaattttggaactgtcccgcctcacg

SEQ ID NO: 71794 - DNA, 443 bp, Heterodera glycines
  Genomic contig location: Contig_ID=SeqID_9538; Location=1936..2378; Strand=-
  SCN-specific regions: Sequence locations=1-418,440-443
gctcattgacacgtagttgtccaattaaggtacttggactttccacagtaaaatgtggtgcaaattttggaactgtcccgcctcacggcggggcttaaaagcatttgtagcgcaataaaagttttttgttttgaatttttcacaatttatttaaaaaagccaaaaaatccggatccaattttaaaaacgaaaatagtgcacaaaaaggagccgcctcacggcggggcttaaaagcatttgtagcgcaataaaagttttttgttttgaatttttcacaatttatttaaaaaagccaaaaaatccggatccaattttaaaaacgaaaatagtgcacaaaaaggagccgcctcacggcggggcttaaaagcattgtacatcataattaaaagcgaaaataattttcgtatattttttcacaatttatttcaaaagacaacaaaaaa

SEQ ID NO: 71795 - DNA, 304 bp, Heterodera glycines
  Genomic contig location: Contig_ID=SeqID_44292; Location=127..430; Strand=+
  SCN-specific regions: Sequence locations=1-304
aaaattccctcaaaaataaaaggtctattgcgcaccgccctccctatcatgctcgagagcatttgtatgtgtataaaatttatcaaaaaaagagatagccatttttttgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatg

SEQ ID NO: 71796 - DNA, 109 bp, Heterodera glycines
  Genomic contig location: Contig_ID=SeqID_44293; Location=247..355; Strand=+
  SCN-specific regions: Sequence locations=1-109
ctcaatgttagcattccatgcgaggatgggtcgaaaactgtgcagattccgtccgccacaaattgcagctgtttcgactgttcccgcaagcgccggaggcgataattag

SEQ ID NO: 71797 - DNA, 209 bp, Heterodera glycines
  Genomic contig location: Contig_ID=SeqID_44293; Location=763..971; Strand=-
  SCN-specific regions: Sequence locations=1-209
gaattggctgagttgtttttccgcgaattgctcggcgactcgcccaccggacaactcgaccaaagccgcttctccgccattgtggacgattatttgtacttcaccatgggaatttttccttgggtttttcagaatttattttcaggttttccgacctcgcaagtggcggaggcaatgacggaacagtgggaaacaaatctccgaaaatt

SEQ ID NO: 71798 - DNA, 321 bp, Heterodera glycines
  Genomic contig location: Contig_ID=SeqID_44299; Location=608..928; Strand=+
  SCN-specific regions: Sequence locations=1-321
atggcattccaatctctgggactcaacccaccagcatttcaatctctgagactcaattctaaggctttccaatcgctgggactcaacccaccagcatttcaatgtctgggactcaaatctccggcattccagacactgggactcacccaccaactttcaatggcattccaatctctggggctcaacccaccagcatttcaatctctgagactcaacccaccagcatttcaatctctgggactcaacacgccagcatttcaatctctgggactcaaatctccggcattccaaacactgggactcaaccccccagcattttaa

SEQ ID NO: 71799 - DNA, 1375 bp, Heterodera glycines
  Genomic contig location: Contig_ID=SeqID_9539; Location=2433..3807; Strand=+
  SCN-specific regions: Sequence locations=1-40,62-376,399-834,856-1375
atgcatcttgactataagccggacaatttggtttatgttgaattggaaaatggaggcaaaattctcaaagtgattgacttcgatggcacttatttgctgcccgatgcaaaagaccgtaagggaaagttggcaattgtcagcgatcgtttgaaaattttgaccggcaccgaaaggtataatgcgcccgaattttacgcggaattattcgccaaaaaggtcaaaagttgtattccaattatctatccatttaagaaattgcaataatttagctttcaacaaaaacggacatttgggcagttgggataatgctttacgaaatattatttttgcagaaaaaatatacaatttatgaagaaatgggaagtgacacgcaggtcagttttatacatacatatgtataaaataaaaacaatgggctttgattaaattatataataaaaagagaccgacttttgaggcatattcatttttttctgcgcattagttccggtagattaagcataaaaaaacccattttctacttggtttgaagcttctacgttgacttttcttatgcctttttcgggatttcgtgccttttcatgccttttttcaattttttggtgcctattatagtgcctttaatgcgatttttggtgcctttttagtcggtctctaataataataatacgtaatttaattttttcggaaatgaatttcatcaaaaaacgatttttaaggtaaaggtgaaaaaaacagtttcaaatgggaataatctgcagcaataaatattcagattagtgatggtcggaaaccgaaacgggatccgggaatttatccaaaaagaaaatttgcaaaataaaaaaaaattaataaggataagaaaatctaaaattttaaattcactcaatattcatcactatttaatcacactagaatatgtttttgtaaattacatacaattcccattcttttatcataatttttccgtcatgacgtatcaaaatcgtctgtagaacacaaaaggtaactcgcttggtgggactcgaaacagagagtgtgacctaaaacccgcgccccgggattggtataggaattcaaaattacggtttagactagccaatttttaggtgaaaaaacattaaccatttcaaaagtcgaaagagtaattattgtatttgcagagctttaaaaatttgttgtatcatctcaatgaaattcatcgtggttttacagtgtcaaaagatctcattaaatacaatcaccatccaatcacttattccgctgaatggctctcaaaatttaatgtgaaaattctattttggatgttccaagcatggacagattttccaagggttggcctactgattacggtaattatctaattatatttaaa

SEQ ID NO: 71800 - DNA, 1629 bp, Heterodera glycines
  Genomic contig location: Contig_ID=SeqID_9540; Location=64..1692; Strand=+
  SCN-specific regions: Sequence locations=1-467,489-529,580-701,726 -744,766-1039,1073-1629
atgagtgccaaaggaattatggactttttggacggcaactgttgtccagtggaattatacgaagaaaagttagaaattgagaacatttttaacgatttgtcagtgaaagaattgaacaaaaacattgatcagagagtagaaatggacacaacggaatttgaggaaaagcagaaattgttggcgatgaaaagaatgatgaaaaaagcgcgagtaaagcgattggaaattgccaatgtgctgaaactgatcagaacgcattgcgacacagagacaacgggggactgactgattagcacagaagcgatagctaacaaataagcacaacaaactcttatcatcccatctgaactccgtaatcatcattagaaggatagcatttttaggacccaaaaaatgagaggtgtatttttctctgcactctcaattttttgattcatctctcgtttttcggaagatgtgtaaaagattttccaaaaaatatttttgagcttgcttttgaaaatctagtgtaaaagccatccatgtcaacaaaatttttattaaaactttcaaataaaataaaatattttttgattttaagttttgtaccaaaataccggtattaatggtaagattcataaatttatcaaaaacttcctagtgaccgttcattcagagttaaaatctctgagcggtattctaattcaaaaaacatttactctggggtgcctgccacaaggtaagtgtcttaggccctttgctttttcttatttttattaatgatctcccgaataatttgcctaacaaataagcatgttggtattaagatgtgagcatgaaaatgataaaaatagagataatttatcttccacgcttaagccaataaataaattgtcataaaataatggcctaaaaatatcaataggaaaaacaatggtcctttacctgggtgaaaataacacaaaatttttttttttcttgatggcgaaccattgccagaaacaaaaaagtgtaagggatttgggcattttaatcggtcaaaagctttccttttctaaccatattaataaaattttaaaaaattcatatttttcttgttttcagcttctccgagcgttaaactcggaagcttgaaacattaatttcggcatataaaagctatatcagaccacagtagaatacgcaacagaaatttggaatccattaaaaaaagaaaatgtccgcaaaattaaagcagttcaaaaatttttaacaagaaaagtcttcaaaaattgtgggcttgttagaggagtgatttgtttcattgatatttattgtttgttcaatttgacacttattttgtgatttgacacttattttgtgatttttgactaccatttatgttttttttattattcgctggcattttatgttgccattaaatcatgttcagtaccgtcttttttggttagccgacttttgcgccgcagacatttgcgccacgccatttgcgccgcgacacttgcgccgctcagcaaaaaatactcttgcgccgctgacatttgcgccgtgccatttgcgccacgacacttgcgccgcctaacaaaaacgacatttgcgccgcgacatttgcgccgtacagcaaaaaaagacatttgcactctgattaaa

SEQ ID NO: 71801 - DNA, 328 bp, Heterodera glycines
  misc_feature (322)..(322): n is a, c, g, or t
  Genomic contig location: Contig_ID=SeqID_44302; Location=852..1179; Strand=+
  SCN-specific regions: Sequence locations=1-328
ccatcattggacatcgtcgagccggaaatttcgcaaaagctttccaaaaaggtcgacccatcggcggcacttttcgccgttttcgacgggcacaatggcgccgaatgtacgctggccattttttaaattctacattaattggggactaattaattcctcgacaatttccattttaaggcgccacttttgcgagtgcccatttgacggagtgttttttggacgcttttgagcaatcggacgatatcgaaaaaatattgaatgacgcatttgaacgactcgacaaacgcataacagaaaaatgcacgagtgaggttggaattgngaaagg

SEQ ID NO: 71802 - DNA, 413 bp, Heterodera glycines
  Genomic contig location: Contig_ID=SeqID_44303; Location=262..674; Strand=-
  SCN-specific regions: Sequence locations=1-413
atgtcgataaatggttccgcgttgagcgctttccaacggatttggcatgggtttctctcaaagaaaaaagtttctcgcgccgaagtgatgagtttggctgaacagattgatccggaagtgaacgacaatgagctttttgacgaaattacggcgctgaatgaaatacttgaaagtatttctgaccagaaatttggtgaaatgaacgcagaacaggatcacctcttatgtcgagtttatttctccaataaaatgtaattcctagaaaagctgtcttttgttttaacattttttgtagcttttttggctctattgctctttatgagtccaatcaattaatcatagttggtttttatacaataagtttgctcatgttcgaagcttttgggtatcattcgaaagcacaaagtctgtag

SEQ ID NO: 71803 - DNA, 437 bp, Heterodera glycines
  Genomic contig location: Contig_ID=SeqID_44306; Location=435..871; Strand=-
  SCN-specific regions: Sequence locations=1-390,413-437
atggacactgcgctgccctcctcctgctggtccctttccgtgccgtcgtcgactgccgccgccgccggtggcatttgcaccggcggttccatgccagcgacgacgaacccggcacaaattggactgatggcaatgcgccggtccgaaacggtgccaccccttggccatcccgacacctcactgttctacatgtccaattttccgtccatggaaatgagcagccgacgaccaccccttcccccgttggtgccgttgccaacattcaccgaggaggaagaggaggagggggagagagatgacgatggcaccggcatttttagggaaattgaaaaataggcattcttttggacattttgaaccccaaagaattttagtgccatacaatgaatctgaaaaaggtttttatttttataaaacttttaacattttcgaataaa

SEQ ID NO: 71804 - DNA, 68 bp, Heterodera glycines
  Genomic contig location: Contig_ID=SeqID_44307; Location=577..644; Strand=+
  SCN-specific regions: Sequence locations=1-68
tttcaaatatcgtaagattgtttgatagggccagacaagagaaggcaactgttggtaccaattttgcg

SEQ ID NO: 71805 - DNA, 179 bp, Heterodera glycines
  Genomic contig location: Contig_ID=SeqID_44307; Location=721..899; Strand=+
  SCN-specific regions: Sequence locations=1-179
tgtttgatagggccagacaagagaaggcaactgttggtaccaagtttgcggtaaaaaaatgagaaaaaagagatagccattttttggtcaagaattttttttgtttgcgtttccaatatcgtaagattgtttgatagggccagacaaaaaaaggcaactgttggtaccaagtttgcggt

SEQ ID NO: 71806 - DNA, 704 bp, Heterodera glycines
  Genomic contig location: Contig_ID=SeqID_44310; Location=40..743; Strand=-
  SCN-specific regions: Sequence locations=1-596,618-704
gttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttggttttcataaatatttttttcagacagtgctctacagcgcaccaaat

SEQ ID NO: 71807 - DNA, 144 bp, Heterodera glycines
  Genomic contig location: Contig_ID=SeqID_44311; Location=1071..1214; Strand=+
  SCN-specific regions: Sequence locations=1-80,102-144
atgttcaccagcagtgctcaaaagtatcttggccgtaaagcaagcgaaatccggatgatggaacaggacggagacggggaagggttggctaggcttttagattccttcattggaaagaagattgtagccaaaataactattaag

SEQ ID NO: 71808 - DNA, 1251 bp, Heterodera glycines
  misc_feature (1121)..(1122): n is a, c, g, or t
  misc_feature (1191)..(1191): n is a, c, g, or t
  misc_feature (1227)..(1228): n is a, c, g, or t
  misc_feature (1230)..(1231): n is a, c, g, or t
  misc_feature (1246)..(1246): n is a, c, g, or t
  Genomic contig location: Contig_ID=SeqID_9541; Location=22..1272; Strand=+
  SCN-specific regions: Sequence locations=1-108,130-335,376-420,442 -461,500-586,644-913,943-1018,1041-1106,1149-1150,1187-1204,1226-1251
  Gene Ontology: Mol. function=cysteine-type peptidase activity; Cellular component=intracellular; Biological process=digestion
atgagtccacaattgttggcatataataatgtaagagattatcagagaaattgtgattattgaatagtgcaatttattgtatttcaaaaaagatgctctcccaactctccaaatggcttatatgtaattagaaagcattaatcagtaaaaggctaatcaacttataaagccgttaaattcctttttattttttcccctatccttaccctattttgagatatacagtatgcctattctcactaatcttacaaaaattcaatgcattatttatattattttattgcattttaatttgttatttgcatgccccaattaaaatgcaatgcgtatatggcaataaattcaattataattttatttagaattaattttaaacatggaaaatatccttgatcgtgttggcgagaatattttggagcgcatccaaaacaaacagtttgaaagagatgtactgtaaattcaaaaaaaatatatataactttaaatttaatattttattccttcattaggtagagggattcatcccggtgtcgggtgagacaccgtccccatcatttgatctgctcagagaccattggctgcaggcaataaaaattaattaaattataaaaataataataaataatatattgttaatattatagagagatggtctctatgaagatgcaaagtttccagtggagtcaattcaattgtacttcactgcagggccagtggcgatccgatggctgaggcctggtgaaattgttgctcatccacagttcataaaccaggagcccattgctggggatgttcggcaaggaagcattgggaattgctgggcgctgtccgcggcatcggtgttggcgcagtatgggcccctgttttacagggtggtgcccccggatcaggggttcgggcataattacgccggtaaatttaaaataattaaatttaaatattcagtcagaatttaaaaaaaaattgttttgaaacgattccttttttcaatgacatacaattttggtagggatcaactgcgacttgggtcaacttcatctgacaatgagccaatttcgtctcgccaactccgttttggtatataatgggctaactccgtctcagacaaaaattcaaattannatttattagttttttttattataaaacgccattttttggcaataatattttaaaattaagtgataattntatccgactaccacaaaaatgttcaatttcccttgnnanntactgtagtttttgngacta

SEQ ID NO: 71809 - DNA, 1221 bp, Heterodera glycines
  Genomic contig location: Contig_ID=SeqID_9542; Location=1139..2359; Strand=+
  SCN-specific regions: Sequence locations=1-12,34-158,180-439,468 -945,968-1221
atgaaagctaaattttatttattagcttatatattactagtatgctgctgctcaaaactttttcatggaattagttttgaggaattaacatcaaacaatcacgccaaacccttaattgatcaatatcttcgaaaggaaataaagactaaaggagaattattggaaaaactggctgaaatcggagtcgacctaagcttgagaagcttggaaagatatatttcaaaaataaaaaatagaaaatcaacagaaggaaacaaagtagatatggaaaatgccgaagtatcgcaatgtttttcaaaatttgataacaaatttctttttatcattgggcatgaatccgaatatcgaaaattcaataaaactaacgagagagaaggcgtaatttatttgtactgtatgtgttgcaaaaaattgaaaaaacccaattctgacaggttagttttaattttaattataatttttatatagttatgtgtatttaagtttaatagctagtgcaatattacgcgatggcttattagacagaactcatcaaataattcatgataaacaatgtaaaggagtaccgcttgagcaactagctgctgaacaaatagataggagccaaagacgagatcttgtgcaatgttctataaaccctaaatctttgtggcgagaagtatttctctttattaaaaccagaactttttttgttaaggggtctgatcgggctagagaacacgatgttgctgaggatattgaaattgaagatatttctggaatttcatttaactaccctaattggcaatctgtaagaagctcttactaccgtagaagaagaaatcacctaggggattgttctgatccctttaatgtcccagaaaggcttcaactaaataaacggggttcaataaaattgcttcttaaaaagaaaatttccgaagaagacatgtaagcattagttgggtaaatttattaaataaaaactttaaggtggttgcgatttagagataaagaattaggtgtaatgctttttatttcacattctcaaataaaagctgtcagtcactgtaaagttttaggtaatagtacctaatgatcataaagaaagattattttttagtttccgacggtacttttgaattggcgcctttgaaattccaacaaatttggacaattcacggattggttagagcttttccgttggcaggtgtattcgcccaatttagaaatttcggttag

SEQ ID NO: 71810 - DNA, 699 bp, Heterodera glycines
  Genomic contig location: Contig_ID=SeqID_44312; Location=168..866; Strand=-
  SCN-specific regions: Sequence locations=1-20,42-136,159-428,450-699
atggccctcggccctgcacttttccgtcttcgccagcacatcacctcagccgagaacttgctggatgaagacgatccggatgcccaaacagtcatctccctgaggcaggaacgagaccacatcatccgaatcctgtcaaggatggaagctgaaatggatgcatggggtacaatcatgaacgcacttcaaggcccggcacgagaggcagaagaagcgctatttgccaactttgtgagagacgaccgtcatctgacggattggttggaggatgcgcgagaactgctggctcacatagcagcagagctcgcaaatccacccaaccaagtcatgccagcgggaggacagcagccagtagctgctgtgaaccaagccatgccacaaatgccagccataccggttgcaatcaatgctgctgctggtgcaaatcttcagcagccagctgctgccaatcatgcctatctgccacctccagtgccggtcgccaatgttcacaatatgccaattttgccgccggcagctgctcctcaagccactgctcggcttccacagtcagtcttcctgttttttcgggcgaaccaatggaatggcccgcgttttggcagagtttcgagagtgccgtcgaccgtgccgcccttgagcccgtcgacaaactcaactatctccacggttgcctacgcggaaaggctgctcgtgccgtaa

SEQ ID NO: 71811 - DNA, 1021 bp, Heterodera glycines; identical to SEQ ID NO: 44314
  Genomic contig location: Contig_ID=SeqID_44314; Location=1..1021; Strand=+
  SCN-specific regions: Sequence locations=1-502,533-599,644-773,804 -816,838-887,920-925,950-1021

SEQ ID NO: 71812 - DNA, 205 bp, Heterodera glycines; identical to SEQ ID NO: 54900
  Genomic contig location: Contig_ID=SeqID_44316; Location=269..473; Strand=-
  SCN-specific regions: Sequence locations=1-54,111-111,135-135,157 -157,180-205

SEQ ID NO: 71813 - DNA, 217 bp, Heterodera glycines
  Genomic contig location: Contig_ID=SeqID_44317; Location=449..665; Strand=-
  SCN-specific regions: Sequence locations=1-217
  Gene Ontology: Mol. function=thiamin-phosphate pyrophosphorylase activity; Cellular component=cytoplasm; Biological process=thiamin biosynthesis
gccaaaagggattccgctgattatcaatgaccatgtcgatgtttgcctggcctcgggcgctgacggagtgcatttgggtgccaacgatttgccggttgagtctgcacgtgaactgcttggccccgatgcaattttgggctattcagtgaacaatgaaaaagcattggaacatgccattcgacttggccataaaattgattatttgggcgttggaccg

SEQ ID NO: 71814 - DNA, 518 bp, Heterodera glycines
  Genomic contig location: Contig_ID=SeqID_44318; Location=400..917; Strand=-
  SCN-specific regions: Sequence locations=1-2,26-392,416-518
  Gene Ontology: Biological process=tyrosine catabolism
cgcagcacattgctctgaacacttcggacattgttcacgccatccaatcgctgcgcgcccgcggcttggagtttctgagcatcccggacagttactacgcgtctctgaagcagcggctgagcgacgcgggcgtggagttgaaggaggacttggagaaactgagggagctgaagattctggtcgattttgacgagcagggctatttgctccaaatattttcaaaggtaaatttacgaaaagggaaaaaccgaaaatgaatgaacgaggactaattgatcaataattaagccatgccaagaccgccccacccttttcctggaaatcatccaacggcacaaccaccaggcaagtgggcacaatgccaatgtcgtcggcgttaggttgccaatgccaaaatgaccaattccccccagggctttggcgccggcaacttcaaagcgttattcgaaagcatcgaggcggaacagaacgaacgtggcaatttgttctacaaagacgtggcggtgggaggggaaaaa

SEQ ID NO: 71815 - DNA, 90 bp, Heterodera glycines
  Genomic contig location: Contig_ID=SeqID_44319; Location=580..669; Strand=-
  SCN-specific regions: Sequence locations=1-18,46-90
aaatgtcaaatcaatcaacttcttctgctgctgctgctgccggatcgacggcgccgccatcgccttcgaacgaagcttcttctccttcgg

SEQ ID NO: 71816 - DNA, 997 bp, Heterodera glycines
  Genomic contig location: Contig_ID=SeqID_44319; Location=610..1606; Strand=+
  SCN-specific regions: Sequence locations=1-15,43-319,370-475,497 -537,570-836,858-876,898-997
atggcggcgccgtcgatccggcagcagcagcagcagaagaagttgattgatttgacatttaaataaattttcgggtctattatcacttaaactcggatttttagtgctaaaaatcatgaaatatgtgttaaaaaatgctgaaatacatatatgtgctaaaaaccaaaaaaaaatgtcaaaaatgtgcgaaaattaaaaaaatcaattgtatttataccagggatgcgatcgaaaatttttcaaaataagaacattgagcccaaaaaatcagattttggggtcgaaaatcaggacattttgcttcattgcttcaaaacagttatttttacaatttattcaatcaaaaatgtattaaatattatattttttcacctcccattaacgattttaacaattttggggaggaaattagcaaatcgtaaattttaatgcaattttttagcggcgtaatttttccaaaaaacttctgaggaatgggcgaggggagagggtccggcggtgccattaggcaccccggaaaattttttttagattttcaccaaaaaaggccaattttttcaattaaattaagtcaagcgacgacttttttgctttaaaacactttttttgcggcgcgtttttaaaaaaattttggaggatggacggagggtccggcggtgcctataggcgccgcagggaaaaatttttgcgatttttaatgcgatttgttaacagatttttgtcaaaataaccaaattttgccacaaatcttatattttcttaataaaatagtgacattatgccatacaatttcaaaaatgtgagtttatttaagaaatcaggacaaaattttcaggacaaatctgataaatcaggacatttttattttatcagatttggaccctccaaatcaggacaaatttgataaatcaggacagatcgcatccctgcagtactatcacatgttactttttggggaacgggaaatggcgttggcattggccaaatgccatcagat

SEQ ID NO: 71817 - DNA, 634 bp, Heterodera glycines
  Genomic contig location: Contig_ID=SeqID_44320; Location=169..802; Strand=-
  SCN-specific regions: Sequence locations=1-124,153-255,277-292,314 -387,416-555,577-634
caagttttttacaaccacttattgccaatttaatttcttgcagatttaaagccatccattgcctgccggttctcggcacagcaaagcactaatacggtgtttgactcactttaaaaaataattcattacccaaaagttttttacaaccacttattgccaatctaatttcttgcagatttaaagctatccattgcctgccggtctcggcacagcaaagcactaatagggtgtttgactcacttcaaaaaataattcattacccaaaagttttttacaaccacatattgccaatctaatttcttgcagattgaaagccatccattgcctgccggttctcggcacagcaaagcactaatagggtgtttgactcacttcaaaaaataattcattacccaaaagttttttacaaccacttattgccaatataatttcttgcagatttaaagctatccattgcctgccggtctcggcacagcaaagcactaataaggtggttgactcacttcaaaaaataattccatacccaaaagttttttacaaccacatattgccaatctaatttcttgcagattgaaagccatccattgcctgccggttctcggcacagcaaagcactaatagaggtgtttgactc

SEQ ID NO: 71818 - DNA, 136 bp, Heterodera glycines
  Genomic contig location: Contig_ID=SeqID_44321; Location=697..832; Strand=+
  SCN-specific regions: Sequence locations=1-136
atgcacattgcgccattggagttacatccattggcacgcctggttcagggtcgttaccataaaatgcactgcttgtgcgttgcttcgtgggatcatgtacttgtacgtgttctcacgttacttgctcagctcggct

SEQ ID NO: 71819 - DNA, 452 bp, Heterodera glycines
  Genomic contig location: Contig_ID=SeqID_1292; Location=345..796; Strand=-
  SCN-specific regions: Sequence locations=1-452
gattctcgagttacggaggcattggaacaactcacatcggaccaaatcgaacgtgaggacggagggggaaaatgggagaaatggggggggggacaaaagggcgaaaagccaaaagaaaaacgcacagagttccgaaagtacttcaacatgttcgacaaggagggcaaagggttcatcaaagcaactcaggtgaagaaaaaagtgaatgccattggatggaattgggggggtcgcaatggcattttgaaaataaagccaaaaaaagcataacattagaaatgccattttggcataggaaatgaaaaagcgcattaaaacacaaatgacaaacattccgtcaagaataggtgggccaaattctgcggacaatgggccaagcattcgaggaacgcgacctgaagcagctgatccgcgagttcgactcggacgggtcgggcgaaatcgaatttgag

SEQ ID NO: 71820 - DNA, 844 bp, Heterodera glycines
  Genomic contig location: Contig_ID=SeqID_1293; Location=617..1460; Strand=-
  SCN-specific regions: Sequence locations=1-514,537-709,731-844
  Gene Ontology: Mol. function=structural constituent of ribosome; Cellular component=cytosolic small ribosomal subunit (sensu Eukarya); Biological process=protein biosynthesis
atgatgtgagtttgggcattttatttttcttttcattttcaaatttgaattgttcagtgaaacactcgagacgagcgaagtgttgaagcgggtccttaagtctgcgctgattgtcgacggagtggcacggggtctaaacgaagcggcacagactttggacaagtattacgaaattccttctgcaccattttttaaaattgctttttttctgcactatttcaggcgtgaagcgcacttttgtgtgctggccaaaagctgtgacgaggcgtcctttgagaaattggtgcgctcattgtgcaaagagcacaccattccgattttggaggtggaggacaaggccgaactcggtcaaatggttggccagtgcaaatacgacaaagacggaaaagcgcgcaaaatcgtcggctgttcggtggcggtggtcaaagactacggacgtgacgaagaggcgaagaatgacttgcaggaagtgctgaagaaaatcagcgactgatgaggttcctatgtcatcatattgttgtttttgtttggttgttaccgcggctataaaagactcttctgtttaaaatgacatttttgggtttataaatttaggcctttttagttaaaattaattaaagttgcgttgaaattttttgatagttaatgttaacttgaaaccaattttggacgtaggcgcaaattcatacaacagcatcccttttatgggcagtgttgggcaaatgctctctctttacaatcgttcctttttcactttctccttttcggtaacatcatttttacgcatcgtttttcctctcaattttttaattttctttctgaatggacggcacacaaaaataaa

SEQ ID NO: 71821 - DNA, 1257 bp, Heterodera glycines
  Genomic contig location: Contig_ID=SeqID_1294; Location=946..2202; Strand=+
  SCN-specific regions: Sequence locations=1-740,776-931,953-1257
atgccgacctttccgtggagtaaaaagagaaaggcatccgacgatgaggtggtcgagagtgggatgacggtacgccaaatattggaggagcgggaggagtacgtgaaaaacattggcattgagtatcgattcggctgctacgaggaaaagcgcgccgattcgtgccaatatttgggcgaatatttcgaggccgtccaaaccgacttcaaatccgccttcgacactttccgccaaaattgtgagcagcgaaagttcccccgcagttgcttcaaatacggccaatatttggccgctgggagggcgtgcgaggcgagcttcaaaaaggtcggatggatgaagaggggggtggggggggggggaaggtgatatttgcacaaaaatggccatgagtgttgcagaccttaaattgcaaaattctataaagggtttaattaaggcgatcgaaccgctcagattgtcctgcgatgcgggcatcgccaagggctgtcgcgtgttggcgctgattttgtggaacggggagtcggaccgtccgccggactcagcccaggccgagcagttcatgaaacgggcggccgaactgggcgattacgaggcgagctggacattaagcacttggtggtcaatggagggggctaaataaacatttccaggaggggtgaatcatttttttgtgtaccattcttttccagggcatggattaatcattccaaaaaacaaatttaagttggaattctttctaatgcaattttctttattttaaaatttaaaggtatttgggtgatacaataaaataccaacgtgaaaagtcggcgccctatggtcacaaaatgggggaattgtccagggatatgcaaaaggcgcttatgtacggactcaaagcgtgcgacgagggcgacctttttcaggtcgcataattaaacaaatttagggcatttattttaaaattcttcttttatttcagtcttgtgtaaatgtgtcgctaatgtatcgaaatggagaaggaatcccaaaggacgagaaaaagtaagaaaaggacaaattattttaatatcgggtaataatgtactttgtaccccccccccccttttacgaaaaaaaattttcaaaattttttcgtagtaatgtgtttttttggggccgaaaaattcgattctgatatctatttcggcccattacaaacccctgacccggactcgaacaaaaattcgaaaattcaattttcgaaaaaattttaagttttgcaaccaaatgcatgaa

SEQ ID NO: 71822 - DNA, 500 bp, Heterodera glycines
  Genomic contig location: Contig_ID=SeqID_1295; Location=366..865; Strand=-
  SCN-specific regions: Sequence locations=1-88,110-350,372-500
atgcacgaaatcattcctcgtgaacagatgccaccgctcctgaccccggaagaggaaacggtatttaaatttaattaaatgttcccacttatgaattttgaaggtgtggcagccacttttgggcgggggagggggcgccgacttttcggcaatcttttgtttacaaggcggtgagtcaattgtgcataattttcatacattcgaatttgtcaaaagatcatttcagatgcctaaactgttgcacggctcctacaaaaatttggtggcgttcctcgacacgaattccttccgttttgaagacaaagtttggctctttgagtcagagtgagtgaattacataattaaaacaaaagcaattttagtatcattcataagacggtttttcgcatggtcaaagtccgtttgtatttggccttcaaatctccgcacaacttgagaggcttggcattcatcacggacccggacggctattggattgagattttcaatccaaacaacat

SEQ ID NO: 71823 - DNA, 1419 bp, Heterodera glycines
  misc_feature (9)..(9): n is a, c, g, or t
  misc_feature (16)..(16): n is a, c, g, or t
  Genomic contig location: Contig_ID=SeqID_44322; Location=172..1590; Strand=-
  SCN-specific regions: Sequence locations=1-189,508-882,931-1197,1274 -1308,1351-1419
tttcacttncgcaaanaagcagaagggaagacctttccgaccttttacaacgctacattcgacgtgcctacagccgatgggcacattttgttgtggcacacacatggaaaattgtggtcctctgctttattgcctccgcaatttgtggcttcaaaatgttgaacacgaagtagacttttaaaaaaattgttttaataaatttaatagattatttaataataaaaatttttaatttaatatatataattaatcaaatttcgaatatcttcattcattctcattaattataatttaattaaaataagcaaataaataattaaataattttttatttcattttcttcaaataaataattatttatatgtataatatttaatatcaatgtaatcataattatgatcataacaattttatctataaacaacatattttaagatttaaagaacatttttatttaaaaataaaaaaaagttttattttttaagaattaatgtaattatttttccccctcattaaacagagtcaaaaatcaaatcaccggctacacaccgtatggctcgcgttcattgaacgaatttgctgtccaagatgaattcttcggacagactgggctcggagtcaaaattttgttgctgattttgccgaaaaagggcaacaatttgatgaatttggaatcattgcgcgaaactgtcgatgtaaaaaattttcgtttttttttgctgaatttttcaaaaaatttttttttttgtttcaggttgacaacctcgtccggcacaatttgaccttctacaatcaaaaacatgaccgtgatgaatcattttcaatgatttgcaacttttattgcaacgtcagcgaacctgtccaattgttttatgtaagccaaaaaatttttttcataaaattaaattttcaaaaaaaaaaaaattttagactggctttcaagaccagtacgatcgggtaatgaaacacgaaccgctgaatgaccgcatcaaacttgactacccattttcattgatcatgggcagaaaagtcaatttacaggtcggttaaaaattgaaatttttgtaaaattttttgcaaaattttagccaaatttctacggggttcatgtgtcgaagacgagcaagcccaagtttgggaacatggacaaaattgagtccatcgtcatacggtaccgagcggaaaagacgagagggtaattaattaactaattaatgatgaaaaataattaactccattaattatttgcaaatttccattacctaattaattttccaatttttaggtggaccgatgacgacataaggttaattaagaaattaatttaataaatactttttatttaatttgtcaattttacagtgcatacgaagatacgatcaccgactacttcgaaaagtaaaaaaaaaatgaataaa

SEQ ID NO: 71824 - DNA, 370 bp, Heterodera glycines
  Genomic contig location: Contig_ID=SeqID_44323; Location=456..825; Strand=-
  SCN-specific regions: Sequence locations=1-51,86-213,240-336,368-370
tctccccataaatctgggcgcatcggttcagggggactgccccgaaaacccaaaaaaaaattttttttgaataaattatttaaatgaactgactagataatatttaaaataggttatttctcttcctttcagtatccctgcaaagtttggtgcgcttctgataagtttctgaaaaaaaagttaagcctaaactttttggcctgtttaaaaaggaattaaaaatttttaaaaattttattcatctccctttttgatagaaaaagcatcagagtgcctaaactagcatgtaaataaaatttggtgcgtttcagagcagtttctgtaaaaatacttatgaattaattttgtaaaaaaataaataaataatgaa

SEQ ID NO: 71825 - DNA, 439 bp, Heterodera glycines
  Genomic contig location: Contig_ID=SeqID_44326; Location=131..569; Strand=-
  SCN-specific regions: Sequence locations=1-439
aaaatggtgtaagtaaaaatcgtaattacgctcaaaaagcttctcaaacaattttagcgcatccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaattttagcgcatccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaattttagcgcttccaattccttctacaatcgcctttatacatcccattatgagcgctaaaattatcagagtgccgaaaatcgc

SEQ ID NO: 71826 - DNA, 421 bp, Heterodera glycines
  Genomic contig location: Contig_ID=SeqID_44330; Location=1042..1462; Strand=-
  SCN-specific regions: Sequence locations=1-120,142-281,303-421
atgcaaacactgcgacacgcgcttttcgacgcaatcaccgccaacggcaaaaaaagtggcgaatcaccggttaaacaggcaaatgatcaaaatggataagcaattataaaacaaagaatcgaaaataagaaaattaaatttcagacgccgttccgactttcagcaaaacagcaaaagaagcgcagaacaaacgaaggggggtaagaacaaacattggcaaaaagagaaaataaaccaattagaaactaattacataattatttcagaaaaattaattccgataatattttatttattgcattctgttgagatcggcataacaataacattggcaccccatcgaatggaagtggcgatttgccaatgaattcggcggcggaaagggcccggcagcgtaaaataattcattcatattaataaa

SEQ ID NO: 71827 - DNA, 1185 bp, Heterodera glycines
  Genomic contig location: Contig_ID=SeqID_9546; Location=1336..2520; Strand=-
  SCN-specific regions: Sequence locations=1-70,133-401,423-750,772 -821,860-884,908-1185
atgagccgttcttcaattgacgctctgtttgcgaattcaattaagaagcagagttcgtctcagaatggtgaatattttaataaaattacacaaataaataaatagtatagtatttttaattaattttaaaatggcaattaaaatatttatccatttttatgattttggtaaattctctgccgacgaccgaatgttctccaatcggtgctctgcagaaattcatcacttatttggacagccgaccctcaacgagtcaacagcagcatcagaacgatggtggcttaattaatccgacaaatttaatctgttaatgacgcaattagcactaattatctttttttattgtttaaggtcttcatctctttcctcagttaccgtatttgctctaattatcccccatgggggattatttttcaacctcttcagaaaggggggggggataattagagattgggggataaatggagaaggggggattatttttcgacagaattattttgtgtaaaatttttgaaattttttgaccatgtcgccaaaaaatgtcatcgagtcaaagaaaaatcattttttattgcattttttaaaagaaattctgttttttctagttttttaactaggtatctataattagggttgcaaattatatggattaacatattttttctgcgcatatgctatgaagaaaggggcttaaaaataacatttctgcgttaaaatttttcgatttggtggaaggtttttagtccatataaatccatattttgggggttttcggggataaatcaatatttcgacattttggcgtttttagtccatattttggccatttttggcaaattttcacaagaaaatgcaaaaaagcgaaaaatacacccctaaagttcaattttttggaaatttttaaaaattacaccccaaacatatgaaaaattttgggttttcgtcgtcattttggcatttttaaatcactattttgggcttgccactataaaaaacattttggaagtcggctttccaacttttttggttataacttttttcaatcttaactaattttttcaaatttttgcaagctattcatccctcattttttttgtcaagaattttggatgtaaaaaatgtcaatattttctaaaatattagaaggaaatgtaacctcatttgcaacagcacccagtgaataaa

SEQ ID NO: 71828 - DNA, 491 bp, Heterodera glycines
  Genomic contig location: Contig_ID=SeqID_44332; Location=314..804; Strand=-
  SCN-specific regions: Sequence locations=1-178,201-491
aacaaattgggttggaaattattccgcttgtgcaaacatttggccatttggaatgggtgctcaaattggagcagttcgcccatctcagagagcatccaaagtttcctcaggtgaatttctattgattgatggttaactttagaaatgtacaataaaatgaaaacaccgctttgaaaaattatatgaaaatattatttttgcaaaattcggcaaatttttgtattgcattaacagtttttttgattcttcggcttgttcgtattaatgcatttattaattttgtttgtttttggcaggttatttgtattgggaatgacgaagcatttgaactgctcaaaacgatggtagtccaagtggcggaagtgcacgcgcggttcggcatgcgccattttcacatgggggcggacgaagtcttccaattgggcgtgtgcaatgaaagtgtgcgcgagatgagggcacagggcggcagagaaagggtaagggcgaagaat

SEQ ID NO: 71829 - DNA, 849 bp, Heterodera glycines
  Genomic contig location: Contig_ID=SeqID_44333; Location=48..896; Strand=-
  SCN-specific regions: Sequence locations=1-174,198-484,533-849
atggccaattcgccctcaaccaccgtcacattttctgggatttcgacaatccgtgccggtgtgccggatgtttccaggtcctttaaaaaatagaaataaaaaaggggtgcccaaaaattgaaaaaaacaattaaaaagtgaaagatttttgtttttgtgctgcttttctcaaggaaaaatattaataaataaaaaatccaaaaaataggcgccaaaaatggcgaaataggcacaaaaaaggcgcctaggtattaagcacaaaaatcccgaaaagcatacacaataattttgaaattttttttaccaaaattgccatcctttttgtcaccaccgccatgtcctgtcgctcctcctcgttgttgtccacctcgtctgttgcctcttcgcccgcagcgcaaaccgctgctgcagcctgtgcaggccggtccgccgcggtgctgccaacgcgtcgccttccgctactggacgcggtccgctcctgttcatatttttatacattaaatatttaaaagaatattttgtaaaaaaaaaacagtaaaaacgaaaaatactccgttaaaattaattagaaaaaaattcaaaaaatccattcctaattgttttacaaatatgcccctctcatcattttctgtttacaaaaatattcccaatgttcagcaccttcaatgacccctcgggcggtgcagggcgatcgaccaccttcaggcgcaagtccaccgaatccgagcccaagtcgttcacaatgcgaatggaataggtgccggtgtccgattgttcgcatttcggatagcacagctggatgagagtgtctaaaaatgggagaaaaaaacgtgaatataaaaaaataaa

SEQ ID NO: 71830 - DNA, 1482 bp, Heterodera glycines
  misc_feature (1446)..(1446): n is a, c, g, or t
  misc_feature (1478)..(1478): n is a, c, g, or t
  Genomic contig location: Contig_ID=SeqID_44333; Location=88..1569; Strand=+
  SCN-specific regions: Sequence locations=1-277,326-612,636-1040,1076 -1094,1116-1167,1190-1216,1360-1482
acactctcatccagctgtgctatccgaaatgcgaacaatcggacaccggcacctattccattcgcattgtgaacgacttgggctcggattcggtggacttgcgcctgaaggtggtcgatcgccctgcaccgcccgaggggtcattgaaggtgctgaacattgggaatatttttgtaaacagaaaatgatgagaggggcatatttgtaaaacaattaggaatggattttttgaatttttttctaattaattttaacggagtatttttcgtttttactgttttttttttacaaaatattcttttaaatatttaatgtataaaaatatgaacaggagcggaccgcgtccagtagcggaaggcgacgcgttggcagcaccgcggcggaccggcctgcacaggctgcagcagcggtttgcgctgcgggcgaagaggcaacagacgaggtggacaacaacgaggaggagcgacaggacatggcggtggtgacaaaaaggatggcaattttggtaaaaaaaatttcaaaattattgtgtatgcttttcgggatttttgtgcttaatacctaggcgccttttttgtgcctatttcgccatttttggcgcctattttttggattttttatttattaatatttttccttgagaaaagcagcacaaaaacaaaaatctttcactttttaattgtttttttcaatttttgggcaccccttttttatttctattttttaaaggacctggaaacatccggcacaccggcacggattgtcgaaatcccagaaaatgtgacggtggttgagggcgaattggccatcatcaaatgcgtcgtggagggcaacccggcaccgacaattgtgtggaaaaagggcgcccgaaaaatgccattgaccgacgaccgagtgcggtgccaaacggacggtgacacgggacatgtaagtggcaatttttaaatgaaatttttaaacacagaaatttaaaaaaaactgctgttttttggaaaaaactttttttgtgaaaaagtcatttatcataaaactgagaaatcataaaaaattttttgttttaatttcaataaaattacatttttcataccgtagccctcaaatggaggacaagaaaactttttactgtagttctaatcttggaagggatttttacggcactcaattaattaattaatgtagctcatttatttctaaactaaattcaaaacttagcagcaaatttaataaaaaaaaatttatcaaattctaaaataatgttaaaaatattttatcaaattaaaataatgttaaaaatattttatcaaattaaaataatgttaaaaatattttatcaaattaaaataatgttaaaaatattttcaggtttctctgatcatttccaaatgtcggccacaagatgggggcgagtacacattgatggtgaagaacgcgcatggcaagcacaangttggcgccaagctgcttgtcacgccagcggncgaa

SEQ ID NO: 71831 - DNA, 639 bp, Heterodera glycines
  Genomic contig location: Contig_ID=SeqID_44338; Location=320..958; Strand=-
  SCN-specific regions: Sequence locations=1-24,47-80,102-639
atggatggtgggccccctttttggaaaaatttttttattattaaaagtcgcgaaaacatgtttatgggggttttctgggtcggagaatccgaatacaacattcatttttaccaattctgaatcccggaccagaattcaaacaaaaaagtcgaaaattcaaaaatttcaaaattcacttttatgttcatatctatacagaataattatttttcggtgtttcaatggtttttgactggattcagcttgttttcaacaattctggaacaaaagtgagaattttgaattttaactttttgttcggattcgggttccccaaccctgagaacccccatagacaagtttttcacgagttttttgaacaaaaaaatatcttccaaaaagagggcccaccatctatagtattaactttattttgtttatacatgcataacattgcacttttgcagcaagagatgaagaaacactcaacgacccattgcagcctcaggacgcggagggcgatcactgatgagaaggcgggaagaaccactggtgatcaatcacaatctttgttgttctgcatattttcatttcatgttttgttattttttgtataaatattgcacgttttgtatttttttaggctccgattggattaaa

SEQ ID NO: 71832 - DNA, 59 bp, Heterodera glycines; identical to SEQ ID NO: 52421
  Genomic contig location: Contig_ID=SeqID_44340; Location=257..315; Strand=-
  SCN-specific regions: Sequence locations=1-59

SEQ ID NO: 71833 - DNA, 59 bp, Heterodera glycines; identical to SEQ ID NO: 52421
  Genomic contig location: Contig_ID=SeqID_44340; Location=387..445; Strand=-
  SCN-specific regions: Sequence locations=1-59

SEQ ID NO: 71834 - DNA, 59 bp, Heterodera glycines; identical to SEQ ID NO: 52422
  Genomic contig location: Contig_ID=SeqID_44340; Location=517..575; Strand=-
  SCN-specific regions: Sequence locations=1-59

SEQ ID NO: 71835 - DNA, 59 bp, Heterodera glycines; identical to SEQ ID NO: 52421
  Genomic contig location: Contig_ID=SeqID_44340; Location=647..705; Strand=-
  SCN-specific regions: Sequence locations=1-59

SEQ ID NO: 71836 - DNA, 59 bp, Heterodera glycines; identical to SEQ ID NO: 52421
  Genomic contig location: Contig_ID=SeqID_44340; Location=777..835; Strand=-
  SCN-specific regions: Sequence locations=1-59

SEQ ID NO: 71837 - DNA, 59 bp, Heterodera glycines; identical to SEQ ID NO: 61858
  Genomic contig location: Contig_ID=SeqID_44340; Location=907..965; Strand=-
  SCN-specific regions: Sequence locations=1-59

SEQ ID NO: 71838 - DNA, 59 bp, Heterodera glycines; identical to SEQ ID NO: 52422
  Genomic contig location: Contig_ID=SeqID_44340; Location=1037..1095; Strand=-
  SCN-specific regions: Sequence locations=1-59

SEQ ID NO: 71839 - DNA, 577 bp, Heterodera glycines
  Genomic contig location: Contig_ID=SeqID_44341; Location=479..1055; Strand=-
  SCN-specific regions: Sequence locations=1-116,138-183,220-235,257-577
atgctcgaccaaatttataatttttcgctcagtcatcgacagttatttaattattttggaatttgcactgacattccttcgacaattgtttacattttggaaatgattaccatcataaggcataaacaattttcaaagtcatcattttataaattgttcttcatccgtaccgttgctgtaagctatttaaaaaaaatatttcaaaatttatgaaaaaatgatttttgtttaggatcttcttaatttagtgcctaataactttggcaatttgcttcctgcattctttggccaacaattgttgccaatttacagcaccgtaccaaattgggcaatcgttttcttaacctttttcgtaaaaactttcgaattcaaagtctcaaacattgtgacagttttcattttgttgaatcgtttcactgcaattgcatttccattccgtcacaaaatggtaattaataattagttaaattaattcgttattttttagttatggaaaaagtacttttggcatttaattgtgtttatgttgatcttaccaatgataattactgtgccaagcacaacaattattttttag

SEQ ID NO: 71840 - DNA, 1820 bp, Heterodera glycines
  Genomic contig location: Contig_ID=SeqID_9547; Location=21..1840; Strand=-
  SCN-specific regions: Sequence locations=1-466,490-765,788-843,866 -1820
atgaaacgtttttccctctctcaaaattcttcctcctccttccccaaaaaatcccaaccaaataaatgcattcgtaaaattgataacctcacttcaaaaagtaaaaaatatcaactggtgcgctcaaaatccaagttcgtcattgaggaaattgacaaatgtgctgaccccgctgctgagctccgttcatgtgtgcaccattcgattgaggaagcaattttagatggacaaaacacacttggcgctgcaaataaggtaggtgtcataatttcttctgaacttttagaccagggtgacatcatactgcccattacaccaattaccgcaaatgtcgtggacgccgttttcaaccagttttgtaaagtggagcagagcaaatcgaaacacgtcaacttatatggcgctccctttataattaccgtcactgtcctaaacaccaatggactaccgcgacaacggacaacaaagggaaaagggcgaccacctgtctcctcacaatcgcacattttcaaagtcaacaacaacgacaactactgtcttttttacgcgctggaactgatgcgctactactctttgtataaacgaggaattatcacgcgtgataactggcggtggattaacaacaaccaaacaacggttttacgacaaaaggcgctacaactactccgcgaggcgggtatcccgacaacggagacagagtacgacgcagaagtttatatacatcaagtgcaagggttgtggaacgtcaagtatcccggtgagtacaaaatatttatttttaatgattaccagatgcgcccaatcaccaaatccgatatcaccgactaccagtttcccattcttctctaccacaacaacaaccactttgacggcatcaaaactctttcaaaatttttcaacaaacgttactattgcatctcctgtgaatctgcctacagtcacaaatttgaacactcttcaaaatgctcttcactctgtcacgggtgccgtgaggtgggcgttgactatccctgcgatccccagcaaggatacagcaaaaaatgtgagcactgtaacacaccttttacaacaacagctgttatgggcgccacctccacaaggatttgtgcaccaaatttcaacgctgcgaagattgtggggtaatttataacataaaggttcatgggagtgttgggcataaatgtggggaacagttttgtaaactttgcaaacaatttcatataaaagaagacgacgaagacgggatgaacccctgcacgaaatgcttcatccaaccccttaaacaacaaagaattaagtcatacaggatcatcgcatacgactttgaggcgacacaggacaagaaggtggagaaccgtttcgaacacgaggtcaactttgcagcggctaccatcatctgcaccgactgcattatcaacggctactggaacaaatcacttcagggaaaaaagtgccaaatttgcggtcctcaccgctcaatcaccttttcaccctttgactacacggagacaacagtcgaccaaaaagtcgtcactcaacaaccgctgtgcgaattcgtccagtggcttcttttcgaccacaacaaaaagtttccaacagtcgcgtttgcacactttgggggccgctacgacatgacgatgatcatcaaggaagttttgtcgcaagggattcacaacccggacatcatcaaacaaggaaatcgcctctacgagctgaaaatcagggaaaacgagcatggcccactcaccatttttcacgacagctacaacctaatgcccatcaaactatctggcctcatcaaaatagtgggcttcatataa

SEQ ID NO: 71841 - DNA, 569 bp, Heterodera glycines
  Genomic contig location: Contig_ID=SeqID_44342; Location=354..922; Strand=-
  SCN-specific regions: Sequence locations=1-380,414-460,482-569
atgccgaaagttgcccaaccgatggttaagaatgttgtgaaaaaagggaactcgaatgcgttcattgtggtcacaaaggaacgtccttttttggtaatgaaaatttgtattgtacttactctataatcttatttacacttttagtggaagactgagaccgaattgaagaaaaaaatggagaaaagggttccaattggatttatgcctttgaagaaggtattagaaatatcaataaattcagaactaataaattaagaactgtgcaaaaaacttggaaaagaagtcggcaattttgccgaaatttgacaaaacaatgcaatgggaaaccgcagacgcatgggaaggagttgtttttgttgaaagaaaatttgaggtttttgttataaattaataaatcaaatttttaaattaaagactaattttaactgtaaattctttacatttaagcctatgtctacaaattttgcaaagaagacattttactcaaacacaattgctgccgaacctaactggcacatgtatatcaaaaaattccattggtaaactaagacaaaggaaaagtaaataaa

SEQ ID NO: 71842 - DNA, 576 bp, Heterodera glycines
  Genomic contig location: Contig_ID=SeqID_44342; Location=1029..1604; Strand=+
  SCN-specific regions: Sequence locations=1-325,411-576
atggcgcaacattcggccatgcgatttgtgatggcttcggaacaatctgatgtcatttgtaattaatactatcatatgtaaagggtttttacagatcttggtgcatcagaattttgggcaatcattgtattttcaatgctttcccagcggtccaacaatcgacgacggagacacccgatgacgtgtccgcccatggttatgcctgcaccaccggcatccatgatttcggctatcacaccattgatgtgtaacagctccgtcacattgtcacgaccctttgatagattttagtcaaactatttaatagaaatttgttaagaatatgaaattttaattacttatttcattttattttttattttcaatttgttacatttagatgaatattttttattaatattttttattaacctcaatgggctttgacaaaatttctagatcgtactcttcagcacacttaagatccagtttgtgaccgcagatcacgagcttctttggagttatttggacaatcaaataacgcatcttggcgaagaattttttggagatagaaagggaggaatagctgatatttag

SEQ ID NO: 71843 - DNA, 180 bp, Heterodera glycines
  Genomic contig location: Contig_ID=SeqID_44342; Location=1431..1610; Strand=-
  SCN-specific regions: Sequence locations=1-180
aaaactctaaatatcagctattcctccctttctatctccaaaaaattcttcgccaagatgcgttatttgattgtccaaataactccaaagaagctcgtgatctgcggtcacaaactggatcttaagtgtgctgaagagtacgatctagaaattttgtcaaagcccattgaggttaataaa

SEQ ID NO: 71844 - DNA, 659 bp, Heterodera glycines
  Genomic contig location: Contig_ID=SeqID_44343; Location=746..1404; Strand=-
  SCN-specific regions: Sequence locations=1-311,342-531,569-659
atgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggagggggggggcgaaggcccaccacgaggccgcgaagaggccgagtgagtaccttcggtgcaggaaaattattaaattttaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaatttttcgaaaatctgagtctttcgtttttatttatttgcaaaattaattcataaatattttttcagaaagggttctgaaacgcaccaaattttatttacatgttagtttaggcactctgatgctttttctatcaataatggaggtgaataaa

SEQ ID NO: 71845 - DNA, 563 bp, Heterodera glycines
  Genomic contig location: Contig_ID=SeqID_44345; Location=266..828; Strand=+
  SCN-specific regions: Sequence locations=1-563
  Gene Ontology: Mol. function=adhesive extracellular matrix constituent activity; Cellular component=basement membrane; Biological process=epidermal differentiation
cccggagttgctggcccagacggtgtccaggggaaaatcggactgcgcgggtcggacggaattccgggggcaagtttggctgaacaagaatggtgtgtattttcattaaaatccgaattttatatgatttgcattcgcaggtgctttgactgtcctcaagcaccgcccggcccaaaagggccaaagggaccgaaagggccgaacggagtgccgggactgccgggaagagcgggaaaacgttctcaaattaatttatcccttaattatatgggtataagtttagccggagagaaaggccctcccggggtgcccggttcgccaggattacccggattggtcggtccgaacggtccgcccggcccgaaaggggagccgggcaaggtaataagaaaataaggtgattttttaattacaaaataaaaacacccatttagctgaatgatctgccggcagcaaagggtcccacggggcttcacggcctcgacggccctctcggaccccccgggccagacgggccctccggcaaaccagggccaagtggaccacccggacaactcgtttga

SEQ ID NO: 71846 - DNA, 652 bp, Heterodera glycines
  Genomic contig location: Contig_ID=SeqID_44348; Location=331..982; Strand=+
  SCN-specific regions: Sequence locations=1-186,229-574,596-652
atgtcaagtggttggaaatttgtgctttatttcctcctgctgctgctgctgcttgtacaattttttgctaatttgtcaaacaattaataaacaaatttaggcctcaattacaaaagccaaaatttttgttgataagcaacctgccattgaactgaatgtgattgttgatgatcgcacgcctacgcgtaaaaaactaattaaatttaattaattatttgaaaaattttagtgggagccaaaaatgatgaaaagccggcaaaaatccaagttgataatgagcaacaaaagcgtgaagaacgtggcattgaggcgctgccttttttgtttaacaaaaattgtgaactcgacgatttgatatgccaacaacgtgaatgtaggaaaatattatttcatatcatataaaaagggtgggatacgaccgaaattgaaaattcgaaatagggttcaacgtcgggaaaatttgcgaatttgcaccaaaaaacccagaatttgactaccttttttaagggcttaaactgagtcttaaattttaagacgaaagatagggaaaggcaaatatgtttgaattttcattgaatttttagagaaagttggcattatttccagcatattccctcattatgtacagaaccaaatcccacattttacttaa

SEQ ID NO: 71847 - DNA, 304 bp, Heterodera glycines; identical to SEQ ID NO: 69803
  Genomic contig location: Contig_ID=SeqID_44349; Location=525..828; Strand=+
  SCN-specific regions: Sequence locations=1-304

SEQ ID NO: 71848 - DNA, 108 bp, Heterodera glycines
  Genomic contig location: Contig_ID=SeqID_44350; Location=58..165; Strand=+
  SCN-specific regions: Sequence locations=1-108
atgactagagcaatcgacgctaacggacgacctaatggaaaaaaatccccgaaaggagagaatttaattaaatccattccttcgggggaccgtgccgggtgccgcggg

SEQ ID NO: 71849 - DNA, 73 bp, Heterodera glycines
  Genomic contig location: Contig_ID=SeqID_44351; Location=921..993; Strand=+
  SCN-specific regions: Sequence locations=1-73
atggcaaaaacatttggacccatgggacaaatgccgcagcagaaacagcagcagggaaagtgccggccgatcg

SEQ ID NO: 71850 - DNA, 1560 bp, Heterodera glycines
  Genomic contig location: Contig_ID=SeqID_9549; Location=1179..2738; Strand=-
  SCN-specific regions: Sequence locations=1-545,567-1147,1169 -1196,1218-1560
cgttgggcactgattctgctcaactacgacttctcgattgagtttgtcagaacggactgcacaggacaagccgatgctttgagccgactgatcagcgaccaacgatcatgctctaaagacgaagacgtcgtcattgcaaaattgttggccgacacggaagcagatgtggcacatgtattcaacacgcaaacggaacaattgccactcaccgcaaaggaaattgccgaggcacagctcagtgacccgctgatcagagaagttttagagtgtacaatgggacggtggccaaacaaaggccttaatcccgaaataaaaccatattttactgtccgaaacaatctgtccataatctcagattgtctcgttttcaacggacgtacgatcattccacaggcactgcgcgatcgaattttgaaggcacttcacctcgctcatcctggcattgttcgaatgaagagcttagcccgagaattggtctactggccgtcaatggacgccgacattgaatcacttgtcaaaagctgtgttccatgccaagaagccgccaaacaacccacaaaacatcctctccaaccatggccatcaacaacatccgttttcgaacgtgttcacattgatcttgccggaccatgcagtaatggtagaacttacctggttgtaattgacacttattcaaaatggccagaaattttccagttaaacaatacttcgtctcattcagttatttcacagctacaatggttgttcgatcgttatggtgttccaaaaacgcttgtgtctgacaatggaccccaattttcgtcatccgtttttaaggaattttgcaaaaataatggcattaaacacattttcagcccgccatatcatcctcagtcgaacggagcagctgaacgctacgttgactacttcaaacgccaactcaaaaaatgcagtggtgaccgaaattggcttagcaaatcacttctctcatatcgctcaacaccaattgctgttttaggccaacgctcaccagctgaattgtttttaggccgaaaattgcgcacaaaattgtcactcatgaggcccgaaaccattccaaagcaacaacatcacgaacacacgtccaaaatgaaattgcaatttgacaaaaagcacaatgtaaagccggtacagtttaaaattggagagcaagtccaatttctcaattaccgaaatggcaaaacactttggctttttgggcgcattgtttcaaataaagggcttatttacgaaatccgttcccctcagcttggcaatcgaattgtcacgcgtcatgccaaccaaatccgaacaacaatggcacagagaggtgacgaaacatgtccggtcgccgatgacatcatctttgcgagggaggagcatggaactggaaatgaaacgacggacgatcaacagacaaacacgcagccacaacaacgggcagcgcaacaagaagaacaagggcaaaaccaacaaccacttcctttgcgtcgttccgaacaaacgaggaaacgtgttcgttttcttagtccgacgcacactggacagagttacgatcactga

SEQ ID NO: 71851 - DNA, 1339 bp, Heterodera glycines
  Genomic contig location: Contig_ID=SeqID_9550; Location=490..1828; Strand=-
  SCN-specific regions: Sequence locations=1-419,450-468,490-721,743 -1072,1108-1166,1189-1234,1257-1298,1320-1339
agcaattgtcgtacgatctgatcaatgtcatagaaaaatgtaacagagaacgcattgaagttgaaatttctgaagatttggtctatgatgagtttgctgaaattggtggaaaggaagggagcgaatcggatgatgaatttgaaatagaaggcgaaagtcaatttgaaagtgaagaggaatcaccaacaagtgatttaaattactgtatttaaatatagtaaatttaatcagaatcatcgtcatcttcaaattatgtgccatcaccaaaaaaagtgatgtctcctcatatcacacttgaagacaaaaagaaggcccttattttttatcgaagtgctcaaaaaggatatagatcactaacggcaatgtcaaaaaactttcgttggatcaaaaaagaatctgatttaaagaaacttcgaaagtaaaattgaataaataattatataaaaaaactttttagctttgaaatcaacatgaaagacaaaatatcggcttataaaaatttggatcatctgctttttgagttttttatcgaaaaacggaaaatgaatttgccgatcaaaaattctgaccttcgtcgatgggcattacaattaaataaccaatcaggaaataaagtttctggatttaaagctggaatttattggctaaaaggatttaaacggcggaagcacattgtaacacgaaaggtacaacaaatttttttgttggttttttagtataatttttagattaccaaatttgttggcaaaaaatgggcaaaagaccaagaaaaaatatacactgattcggcagaatttgtttctgataccaaaacactcattggaaaagaacaccctgatttggtccttaatacagaccaatcagggttcgaattagaacttcattcaacacatacgctggaaatatccggcacaaaaaaagttgaaggatatgttcagagtgttggatcaactactcattcctacacaatctgcccaatattttctgctgatggacttttgtatagtccaatgttgattgttattggagaaaaaagcggagtttttccaaaaaaaggcattttccaggcaagaattttttaagaaatgaattattttaaaatttaaaggctgaaaatattttgtctgttgcgggacgatctcatataatgaccaaagaaattgccaaaaaatttgtctctgatgttttattgccaataatttctggcaaaaaaaccgttttgatccttgattcgtggccaacttggaaaagtgtgattggagaaaaagagagcacttccgagcggatggtggtggatgacattcgcattcaaacaattccaccgggatgtactgggcta

SEQ ID NO: 71852 - DNA, 488 bp, Heterodera glycines
  Genomic contig location: Contig_ID=SeqID_44353; Location=105..592; Strand=-
  SCN-specific regions: Sequence locations=1-107,132-271,373-378,403 -408,430-488
atgttggcgggtttgacaaatttgtacaccgactattggatctcagcagcaatgagaaataacaaacagaaaagagggagaaaagggcgttggctttggaaaatagctgataaaaaggagaggcgagcagacgatgagtgagataaaaatagtggcaaaaatggacaactgctgcattgggagagtcataaaggggacacaaagtgttcgcacagcatcgaatatttccttcattttaggcgtcattcttccccactgcacttctttcttcggtttaattacccaagtttgaggtacttggcgtgtcctgcccataatatctgtggcatggaataaattttggaactgcgctgcctaacggcggtgcttaaagtgcgctaaaaatgatcaaatgattatcaatttttatttttcttaattccaaaatgaattcgaaacgcaaaaatttaatcataattcatgtggtaaaaaatgcatttaaaaataaa

SEQ ID NO: 71853 - DNA, 82 bp, Heterodera glycines
  Genomic contig location: Contig_ID=SeqID_44353; Location=819..900; Strand=-
  SCN-specific regions: Sequence locations=71-82
gtatcctgcccataatatctgtggcatggaataaattttggaactgcgctgcctaacggcggtgcttaaagtgcgctaaaaa

SEQ ID NO: 71854 - DNA, 359 bp, Heterodera glycines
  Genomic contig location: Contig_ID=SeqID_44354; Location=136..494; Strand=+
  SCN-specific regions: Sequence locations=1-359
atggcaggaaatctccaaagaagtgatcatcaaatcattaagggtcagttaaaaaattaattcaggaaaaatgtctaaacttttaagtctgtgggctgactacgccattggacggaactgaagacgaaaaaattgcttgcttcaagccggaaggagcaattggaccgatagggatcaaatttttgcgcaagtttaggacaaatgaaacggcgaaagatggacgaaacaatcacgaagaagacggcttatctgatgacgatgatgcaggctggatggagtcggagatgacgacgaattgttcattttttgagccccttttactgttgaatttattttaatttttttggaaaatgtgccaa

SEQ ID NO: 71855 - DNA, 304 bp, Heterodera glycines; identical to SEQ ID NO: 56071
  Genomic contig location: Contig_ID=SeqID_44355; Location=8..311; Strand=-
  SCN-specific regions: Sequence locations=1-304

SEQ ID NO: 71856 - DNA, 304 bp, Heterodera glycines
  Genomic contig location: Contig_ID=SeqID_44355; Location=388..691; Strand=-
  SCN-specific regions: Sequence locations=1-8,31-304
aaaatttcctcaaaaataaaaggtttattgctctccgccctccctatcatgctcgagagcatttgtatgtgtataaaatttatcaaaaaaagagatagccatttttctgggataacctgtaaatataaaaatcctctgtgaaataaaatgtcgattgtgcacagccctccgtctcatacgcaagcgctttagtgaggtataaaatttctcaaaaaaagagatagccatttttctgggatagagtataaatttactaattccctcaaaaataaaaggtaaattgcgctccgccctccctatcatg

SEQ ID NO: 71857 - DNA, 452 bp, Heterodera glycines
  Genomic contig location: Contig_ID=SeqID_44356; Location=530..981; Strand=+
  SCN-specific regions: Sequence locations=1-385,447-452
atgaattcccagcagcgccaggcagaacgtgcccaactccgtgcaaggttaaacttacttgtcgacgaggtcgactttgtggtccaagggctgatcagcaattatcaggccgatggattgatcaacgaggtaagttttctttattttttatgctgtttttgctttttttgaattttaatcttgattgaacaggcgccgcatgagggacagctgatgggcatggaccatggacaaggtctacagcatgagcagcagcagcagcagccgtgggaactggacccaccaatgcctgcacagcaattcgaaattgggccacagctcccggatgcgtgggaactggttccctaccagccgacaccacaatgggcccaagttgcacatgtggaacaacacccgcagcagcagcaacactaccacccaccagcacaacaacaacagcagcagcaaggcgc

SEQ ID NO: 71858 - DNA, 1061 bp, Heterodera glycines
  misc_feature (1055)..(1055): n is a, c, g, or t
  Genomic contig location: Contig_ID=SeqID_44357; Location=24..1084; Strand=-
  SCN-specific regions: Sequence locations=1-222,266-579,601-1061
atgttggatgtgagcgggctcaccgaagcggatcaaaagaagaacccgggcgcaattgttcgtgcattgaaattttacgctgccgcggtcaaacaacgggaaaatgacaaattcatgtacccacaaaaatcggtaaatttttcataattttcatggattttgcattccaaacccattaatatcaatcttcacatagttcagtaactcaaaagccttaaagactatgattttaggattcaaaaatccccgggtttttagactaaccatccattatacttttcaaaaaactctctgaatcgggaatcccgcaacattccccgaccgttcctgataaaacactcactttttagcaatcatggttaggtttaatcagttatttgactccccaattttgttacccttttttctaattagtcccctaattggagtgcttcctccaactgttaaatttcgtccggcatttttttttgttatgtttccaaatacatttttaaggtttatcccgtctccgaggatgacattgaaacggacgaatttgaatttgcgtccggctccacgaccgcgtcaaatggtggtgcaattccgcgccgcagcagcagcactccgcaccaatgcaacagcgaaagttgcggcaacatcaacagtggccacgctctggagcagttcaatgcgacatggtattatgacacggatgagtcggcaaccgtcgctgatcatggtaaggacacacactggccaagcagggacttggcaaacgtgtcatgtcccgagattattgggtttgttgttttttgcaagggcttccaagtgtccataaaaccctccaaaatgggagacacttcgctccgaggaggggccggtgtaaaagaggttgcggcgggtgtggcgaagtcaccgaccaatcgtggaaaaatttgctattttttcgataaaaattccattaaaattccaacatttttccccgccgtcgcccgtcattttcagaatttttttttgaaaattggcacgctgcaaaaagagtttcaaaccttcaaacttgccaaattgaaccgcanaattag

SEQ ID NO: 71859 - DNA, 1257 bp, Heterodera glycines
  Genomic contig location: Contig_ID=SeqID_44358; Location=39..1295; Strand=-
  SCN-specific regions: Sequence locations=1-1085,1179-1257
  Gene Ontology: Mol. function=zinc ion binding; Cellular component =integral to membrane; Biological process=digestion
ttcgttgaacactcaaacgtacccgaacaaactgtggcacgaagggcgagtgccgtacatgcttgaggagggaatgagtgcgctgtgagtgaggggttggcactacggagacaaatggactcatttccagtcaaagagccgccattgccagcgcatttgacgaatacaaaggcaagtcgcaatttgcaagggaaggattggccaaacgaatgaaagaaagggccaatgccttaaggcaaaacgtgcattcgcttcgtcccgagacaaagtacagaatccgacttcatttatgtgagacggaacttcgggttggggtgcgtaagccgtggttttggcatgaaaagcggcggtcggtccctttgtcagatgctcttcgtacgtcggaagagcggggggaaatcagacggtgtctttggagttggacaaatgcttctccaagggaatcattgcccacgaattggcacgtccaatcaaactttgccaccgattcatcccccccccctcctctgttcagatgcatgcgttgggctttttccacgaacattcgcgcacagaccgagacgaatacgtggatcttttggaggacaatgtgcggccgggaatgctgcgaaacttcgagaagtacccaaagaaaatcatcgaccctcttgggatgccgtatgactacggctcggtgatgcattaccacaaattggcattttcacgcaatggaagggcgacaattgtgccggtttgggaaaagggagggggcattctgacaattgcatttgtaagaagtcgaaaagcgtggaaattggacaaaggtttgaagggaaatttggcaaagaaatcagaggacgaatttaggcacaaattgagtgaaatcgatgcgatgaaagtgaacaaattgtaccgatgcgacagcgaaggcccagcgacggaaacgacgacgacggcaccgaagcggacaagcgaaacgactgcggaaacgaagacgacgccggaggggcagacggaggagcaaacgacgacggaagagagcgaaccaacgacgggggaagaggaaacggcagagcaaacggaagagacgacaacggacgacggggcaggggcagagacggagacgacgacggaagagacagagagaggcacaacggaagagacagcggcaacgacagagacggaaacggagccagagaaaacgacgacgcatttggcattccgaaacaaaacgaagccaaaggagaggagaacgaagtggccaaatgtggccaagaa

SEQ ID NO: 71860 - DNA, 178 bp, Heterodera glycines
  Genomic contig location: Contig_ID=SeqID_9551; Location=639..816; Strand=-
  SCN-specific regions: Sequence locations=1-178
atggatccgagaaacggcttttacgacaaaaatgaggacaaagtgactttggccattgatgtcattgtggggcaagcagaaatggacagagcaatttccgctgatcagagcaaatcgaaagggacactttttatggacattgaaaaagtgtcacaatttgcgcgagaaatcatttgga

SEQ ID NO: 71861 - DNA, 304 bp, Heterodera glycines
  Genomic contig location: Contig_ID=SeqID_9551; Location=1..304; Strand=-
  SCN-specific regions: Sequence locations=1-192,216-255,277-304
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcgtttttgatactaaagcatcagagtgctaaaattaagtaaagataaaatttggtgcgctttagagcactttctgaaaaa

SEQ ID NO: 71862 - DNA, 1620 bp, Heterodera glycines
  Genomic contig location: Contig_ID=SeqID_9552; Location=146..1765; Strand=-
  SCN-specific regions: Sequence locations=1-72,95-105,159-638,667 -667,689-716,738-1055,1077-1195,1217-1231,1262-1263,1287-1561,1584 -1620
atgtctttgtctgtggttgatcggatgaagcggatgttgagcactggagaggacgcggatgtgcactttttggtgggggaaggagaggaaaaggaggcaagtttgaaaataaaagtatttattaattaatttttatttttatttaatttttaaaaaaacctttttaagagagttgcagcccataaagtaattttgaagcatgcttccgaagtattcgaggcaatgttccgttttgactcacagaatcaaaacgtagaaaatggtaaaaatttgatgaataaattaattggtcaattaatttattagcctgcgctaattgtgttgtggaagtgcccgatgttgaggcagcagcgttcaaagtgatgctcagcttcatttatgccgacgatttgagccaattggacggagacaacgcaatggcagtgctttacgctggtcaaattgtttttgtgaaattaatctaacaatttaattattcattaattagccaaaaagtacaacatcgttggcctggttgtcccatctttgcaaattccaatttcaaaactgcacaatgttttctttgcctatgcccaggctcagctctttgaattagaggtgggatgacagagcactcaaaagcatcactctttcaatagattaaattgtttataaaatttttatattgaacaaattcagaaaaggcaaaaattatgcatcaattattttgaaatatagaaatttaaaaattcagtattgggtattgcgagtttcggaattttaaggaggtcggattatggcgatttttgtaccatgcgaaaatatcgaaatattaattatttagttttttgagttaagaactttgcctatcattgtttgttttatattgatgagaatgcggacactttgctcaattcggtggcatttttgcaaattgaccaaaaaacgttgtgtgaaattttgagtcgtgacgaattgcaaatcagtggagaaatttcaatttggaacgcagtatgatattaatttatctaagaaaattacgttgatattttttggctatccgttgggctgacgagaaatgccgtcaaaatgccgttgagtgctcctctgaaaaccgtcgtgccaagctcggcccagcactgttcaaaattcgctttccgctcgtgtcaaaagaagaattttcgagaaatattggtaagaaactaaagtctacaaggaatttaagactttaaatgttcgaaaatatattcccattaaattaattaaaataatttaattaattccgtttccaatttatttatttttcagttccgtccggtgtgttaacagtggaagaagtgatcggcatttatcagtttcattgtcatccgaatttgcacatggtttccgagctttacccattgaaatttccgaggcagggaagaatttcggaccgaacagaagggacacttcagctggaaattgaaaaaatgtcggaatttgcgggcaaagttatggggagctgccgatacagcaaaactgtgcacatccgagggcttccatttgaaatacttgcaaaaataaatgcgacgacggaaaacgatgaaaattttgttgggaaatggctgggcattttcctttggtgcacagcgccaacagaag

SEQ ID NO: 71863 - DNA, 950 bp, Heterodera glycines
  Genomic contig location: Contig_ID=SeqID_44364; Location=185..1134; Strand=-
  SCN-specific regions: Sequence locations=1-169,259-333,362-428,459 -508,534-566,615-763,785-854,878-950
  Gene Ontology: Mol. function=meprin A activity; Cellular component =integral to membrane; Biological process=digestion
gttcgtcaagcgtatttaaaatggccaagcgctatcattccatacacagttagccaacaatatttgctgtatgggcgtgatcaaattgtgcaagcaattgatgaatattccactaaaacgtgcattaaatttcgtcccaaaacacccagcgatatggattatgtaaagcaaataaattataaattaaaaaagatttaaatcaaataaaaataattttttttaaattaaaatcaaataataaatatttatttttttaaagattcacatttttcctgatgatggatgttattcgttggttggaaaagtcggtggaaagcagccggttgttctaccaaattaaaaatttgttttttataaaaatgatttttcaggtaagccttggagatggatgcatgagtaaagggattatgtaagtacaaaagattaacaaaataaattacattttttaatttttttttccattattttagaatccacgagctgatgtaagttgtattagatttgaatgaaaattaaaaaattaaaatatttttgaggcatgctgttggcttttttcatgaacaaagtaaaaaataataataatttttatgcaagtaattaattatttaaaaaatgacttttttaaggtcgcagcgatagagataattatgtgaatatcaaatgggataacattgatcaaaatctgcgtgatcaatttgacaaatattcccaaaacatgatcgactttttgggaacacaatgtaaatttaactttattaaaatttttgctacaagaaattcaaaatctttttagatgattatggttcagtgatgcactatggaccatatgtgatctttgatttatcagataatccttttaaaatttaaatattatttaggcatttaccaaaaatggaaagccgacaattcaaccaaaacagcctgggaaaaccattggacaggcaatttaa

SEQ ID NO: 71864 - DNA, 304 bp, Heterodera glycines; identical to SEQ ID NO: 55978
  Genomic contig location: Contig_ID=SeqID_44367; Location=338..641; Strand=+
  SCN-specific regions: Sequence locations=1-304

SEQ ID NO: 71865 - DNA, 384 bp, Heterodera glycines
  Genomic contig location: Contig_ID=SeqID_44368; Location=263..646; Strand=-
  SCN-specific regions: Sequence locations=1-50,72-384
atgacggcaatcgcagcagtatcgccaccctttgagtccgcaagccgaaatggcgctgccggcaccggtgcaggtggttgtgttgctggaactgctcgccaccgacaatttgccgagtcgcgctcactgtccaccgcaacgaattggtgcaaaatgagaaatgcaattgccgaagcgggcaatggcaatgatggtggtggcgtggaagctctgctgctgacgaagaggacgaaggcggcggcacaaatgccgaattgtgccgctccatccacaaaagcggcgacagcggacaaatgccacccgattacgacaacagtggcgccggaggcggtaccgtactaccagcttaacagtgccgaaaatgtcaatggtgaagcaaattga

SEQ ID NO: 71866 - DNA, 49 bp, Heterodera glycines
  Genomic contig location: Contig_ID=SeqID_44370; Location=265..313; Strand=-
  SCN-specific regions: Sequence locations=1-49
ggaagctattcccgaaggattcggtctccccataaatctggacgcatcg

SEQ ID NO: 71867 - DNA, 109 bp, Heterodera glycines
  Genomic contig location: Contig_ID=SeqID_44371; Location=558..666; Strand=+
  SCN-specific regions: Sequence locations=1-109
gggggacccttttgttttgcaaagtttttttaagataaaaaaccataattttttatccggggttttaaaggtcgctaatcacgaatctgacatgtattttgactaattt

SEQ ID NO: 71868 - DNA, 1168 bp, Heterodera glycines
  Genomic contig location: Contig_ID=SeqID_9553; Location=1029..2196; Strand=+
  SCN-specific regions: Sequence locations=1-272,295-719,744-779,801 -1168
  Gene Ontology: Mol. function=ubiquitin conjugating enzyme activity; Cellular component=proteasome complex (sensu Eukarya); Biological process=endocytosis
atgtcaaacattgcctttataagaattcaaaaagaatgcaaagaaatcattttatgtaaagaggtaattaaatagaataatccaaaaaagaaccttttttacagttacaagaaaatggtgtaacaattgaacctgtaaatgagacgctttttgaaatcattggaaagatacgaggtccaccaggttggaaaattggactttttagttaattgtagaattatttcagatagcccatacgaaaacggaatatttattttggtacaacttaaatctttttttttaaatttattttttggtaatactttggtttgcccccccccccctattttcaaaaaattattttttgttcgcgatcagcgaccccggaatgtctctgaaacattttatttttatcttttgaataaatcaaataattgaatggcgtgaaacaaagtattaccattttatatccttttgttattctatttttaaggacgttaaaattccacaagaatatcctttccaacctccgaaggtttgatcgaataatatacaaaggcaagagagtattttttacttataggttaaatttactactcatatttggcatccaaacattagttcgcagactggtgctatatgtttggatattctcaaggaccaatggttttgtgtgtttatattcacattattcaataaaatacgatttagggcggcatctatgactctccgaacaggtgaaattaatttaatataaaataatagggagtttatagcttctggactggttgttctctttagtgcttctcagtgtgcaatcgttgttactttcaccggagccaaaagatccacaggatgcaattgttgcgaaacaatgcttaagtgaccctgcattattcagagtcagttgttaccaacctttgaataatgacttggtttgtttatctatttaagtccactgcaaaatattgggcacaacattatgcaaacgctccgggggaaatagacagaaataaggcaaaatgtgtgtccacattacaggagatgggagcaagtaaggtgaacaagcaaaatcaattcaaagcagcactcgttttaatcttcatcttcattttaggacgccagtatatccgctttaagctgctataattggaaccttgcaaaagctaccgaatttctctttacataa

SEQ ID NO: 71869 - DNA, 856 bp, Heterodera glycines
  Genomic contig location: Contig_ID=SeqID_9553; Location=2325..3180; Strand=+
  SCN-specific regions: Sequence locations=1-310,332-395,417-467,489-856
atgtacaccggagatgctgcaatttcggggtcatctgcacaacaggcaaaaacgggcaccgaatcgagcacgagcaagccaaaggcgtgctgcgtctgcaaggagacaaaaggggtaaacggggagttgggtataattacacactcaaaattcatcattcgggaattgtagacctcttcccttcccacattccgagctaaactcggaaaatcataaattaaataccattagatagagcagagtcgacttgcatgctatttttaattttagcggtgtctggcgcctatttcaaatccacttgcctgcaaacacttaaaattttagggtttttgtgacggttgatcatgaatatggcatccatttcgcccaattctgaatccttgacccaaacttgcattttttaatattctatttttaagcatttaattattaacctcctacagctttaatcgcacatttcttttttgaattgatgtaaaattatttgttctagttgggtcgggggttcagaactagccgaaatgaatgtcaaattcctgaccaacggtcccaaaaactcaaaataaacacaagacgaccttgatctatccaatggtatattaacttatatggggtttcaaaagttacacctcggaatattcccttttaagcctattgtacgaattttttgcaccaattttctatgtactaattttcgaccatttttattcggaactaaatatggaattggttaagtaaggtgttacctaagtccattattcagaagcgggacgaatgtattattctgaacggtgaagagaattgtggtcaactgatcgaagcacacaaaaaatgcatgagagaatatggatttgaa

SEQ ID NO: 71870 - DNA, 186 bp, Heterodera glycines
  misc_feature (155)..(155): n is a, c, g, or t
  Genomic contig location: Contig_ID=SeqID_9553; Location=3408..3593; Strand=+
  SCN-specific regions: Sequence locations=1-111,134-158,180-186
acggggtaaaatgcgcaatttgcgtcaaaatatcattgaacacttcactagtcaacccgttcaaagagtgtagtcaaatgctaccgttatgttgcgtgtttttagtcgatgaactttgaggatgggtcttcttattaagatttgtgtgttttctncccttccttttatttaaaggttaaaggatta

SEQ ID NO: 71871 - DNA, 1685 bp, Heterodera glycines
  Genomic contig location: Contig_ID=SeqID_9554; Location=58..1742; Strand=+
  SCN-specific regions: Sequence locations=1-92,114-320,385-385,408 -586,608-634,656-681,705-712,734-793,820-889,912-1345,1368-1442,1495 -1498,1520-1685
atgagtaaattttaagctgtatcgtgtttttttctcctaaaatgctttttaataccacatttagccatttttgaagattttactttatgtttaacaaatttgaagaaattttgagaaattacaccctcaattggaaaattttatgtgcatatttttcactttttatgtgcatatttcacgatttttggtgcatattttatgcgcatattttgcgattttatgtgcatatttttgccaaccctaaagattaggggcgacatgaagtttgggcactgggaagtttgggcaccgggaagtttgggcaccagaggggggatttcaaaaaaataaaacaaaataaataaataaaatgttatataaatcattaaaatttagtaaattttagcaacccttttttcttaaaatttatatgttcttgaaaatcaaaaaatttatgtatgggaacctggcaatcttattatttaatcaattcttacggttgtttaaacgtataattaaacgtgtgctagtttctgtttggacttatacctgaataccggcttagttgggcccgaaataacaagaacccgtctaattttgtttaaactcataaactttaagtcttgaacatactgagccttgtaatgttataagttataaataatacatatgtatggcattgatattgaattaattgtaatgagtttagcaaaataagcatgcttaatcgaatgaatattcgttaaagaactttctatttcctaacttgattaaattttctatgcttttaattagatggttgcaattcatagacaattaaaaaatatttttattttttaactctttaagttggtgcacaaacttcccggtgcccaaatttctggtgcccaaacttcccggtgcccaaactttccccgccccccttttgttggattggtcaaaaataagtgacatattcataatcagcgacccccgaaaacccctcaaaagagtccccctaagggtttttagtaaaattacattatttttcgtcccacctaaactataaaagttccaattactgtatttaaggaattaattctgttcattttcaggaagttaaaaagaactccattgaactgagtctattcgaatacgaccgacgctttgaacagaaatttccgcaatttttcatcaattatgactaccgtaaaccattggatgtgccttccaatttgcatcacaatttcgattttttgatagctgatcctccatttctatccgacgaatgttttattaaaattgcccaaacaattcgcctgctgtctaaaaaagagaccaaattgataatcaacacgggcgctgtaatggaaggactgctccaacggattttggatgtgagaaggactgaatttagacccgtacacaagaacaatttggccaatgaatttctgtccttttcgaattaccctttatccattttgtaacttattcttactttcttttttgtaatttaatgaaattaatttaaattctgtgtttttattttgacattgttttttaccatatatgtatttaattttttcaagacaatttatattcataatttaagcaacaaaaaaaggcatttttgacgctgtgattccgatggcatacggcactgttcagcaacagttgtgggccgagttgctctgttgttcaaactgcggaaatgtatgagttttaaa

SEQ ID NO: 71872 - DNA, 623 bp, Heterodera glycines
  Genomic contig location: Contig_ID=SeqID_44372; Location=358..980; Strand=+
  SCN-specific regions: Sequence locations=1-307,332-623
atgtacgagatgaaagtgcggaagcagaaaaagcgaaatcccaacgtcgtcttccgagattctttcaatctgatgccgtgttcattggctgcgcttatcccttcctatgggctggacgtggaggacaagccgttcttccctcatctcgccaatagaccggagaactacggcagagaaattcagcctacacctgacgactacctggctaacggaatgatgcccgggaagaggcgccagttcgacgagtggtacgccgagcaccatcatgagcctttttggctcgatgaagcgcttgccaggtaatttctttatttttatttaattttttattgttgatttttcagttattgcacgaacgatgttgaaatcctgatggcagctctcgtcgcattccgccgtgaattcttcgagatttcgcggcgacaggagtacattgatggaattgacgacagggaaaaccatgacggcatcgacgtactgcgcgagtgcatgaccatcgcgggagcgtgcatgcggcatttccgcacaaatcacctgccctctgaacatctggccatcgtccctgagcgcggctatgacaacgcgcagaaccagagcctacttgcacttcgcttcttccactg

SEQ ID NO: 71873 - DNA, 364 bp, Heterodera glycines
  Genomic contig location: Contig_ID=SeqID_44375; Location=8..371; Strand=-
  SCN-specific regions: Sequence locations=1-82,116-138,160-364
atgcagaccagatacgccagctctgtccgtttccacctcatcggtttcacgtcctctttaactctctcttcaaagtgctttgcaactttccctcacggtacttgttcgctatcggactcgtggccgtatttagtcttagatgaagtttaccacctgatttgggctgcgatcccaaacaacccgactccaagacacgtaaagatgggtaggcaccgccagttggacaggtcttgcaccttctctggagccccggtcaagggaaacttgaacaagcgggccaacccaagctcacggtctatacgctacacctcgcaaccccagaggagctgcgattcagcgctggactcttcccagttcactcgcc

SEQ ID NO: 71874 - DNA, 524 bp, Heterodera glycines
  Genomic contig location: Contig_ID=SeqID_44378; Location=436..959; Strand=-
  SCN-specific regions: Sequence locations=1-524
cattcccatcactgggactcaacccaccagcatttcaatcactgggactcaactcaccagcatttcaatcactgggactcaacccaccagcatttcaatcactggcactcaacccaccagcatttcaatcactgggactcaacccaccagcatttcaatcactgggactcaatccaccaacatttcaatcactggtactcaacccaacagcattccaatcactgggactaaacccaccagcatttcaatcactgggactcaacccaccagcatttcaatcactgggactcaattcatttcaatcactggcactcaacccaccagcatttcaatcactgggactcaacccaccagcatttcaatcactgggactcaacccaccagcatttcaatcactgggactaaacccaacagcattccaatcactgggactaaacccaccagcatttcaatcactgggactcaacccaccagcatttcaatcactggtactcaacccaacagcattccaatcactgggctaa

SEQ ID NO: 71875 - DNA, 709 bp, Heterodera glycines
  Genomic contig location: Contig_ID=SeqID_44379; Location=60..768; Strand=+
  SCN-specific regions: Sequence locations=1-631,653-709
atggatgtgataaatgaaagtgccaattcagaaattcgtcaaaaactcattcaaatgccacaaggctccgctgatcaggcccagccaatgtcagaagggacaataattatcgatttggaacgaactggatcaacaacaacaattgcaaatgaatttgcttcaatcccacaacatgatcaaactggaacaaatgataatgcaaacccaaatgatcaaacaaattttgttaatccaaatgatcaacaattggtcaaaccaagggaaactggtcaattgatgccaatgaccgctgataatttaaatttggcatcccttcatgaagcggataatgttgaacaatttgtgatgatccctaccccaaatatgcgacaaatcaatgcggaaaatcgcgtcaattcaaaacgcaattcaaaaagcggtgaaaaaactgattttggcgctgccgaaagcataaatgaggcttctccgtcaactgtacaacgaaaacgaggacggtcaaaaacgctgaaaatccaagacaaaaatgcagtgggcaaatcaaaaatgggagtggaaaaaccatcgatgaaatcggcaaagggcaaatcaaaaatggtatttataattaaatattagaaatctaaggtgattacataaatgttgttgttgcattcctgttttaaaagataggctaacatggtttttgttttgttgcacttttgaatggaaa

SEQ ID NO: 71876 - DNA, 759 bp, Heterodera glycines
  Genomic contig location: Contig_ID=SeqID_44380; Location=131..889; Strand=-
  SCN-specific regions: Sequence locations=1-9,31-479,501-651,674 -694,737-759
atgcctttcttcttcttttttctggagttcgccaaagcctgcggcggtggcactgaattaataccattttttggctacgctttgcgcatcgttgtcgaggcgcccatcgaattggggacggacacaaaaacggaggaggacgatggccaacagcagaaacaatggggcgagtgcgcaacttttgggagtggaaagacggagaaaggtgggcatttaaaagcaaaacatttagtcaattgtgccattctcgcaattttcagaggccgaaattatcttcgaaaagaattcccaagaagcgccggcggagacatttagggacgaaccgttcttcgaatttgtcaaggcaattgtcagcgtaagtttgggaaacagaaagatgacgaacatataaatgggaatgtaaaattttaagaattttttcgacggttggggcaccgaacgctttcgtcatgggcgccgttttgcgggcggcgaagcggcacacgggggaagcaaacgggccaaattctgtgcaaaacttcgcctcaaagtgggcaagggatggcgcctggaggagcatttgtttgaagagttggccaacaacaacacgggcgaagtgctgcgcattttccaagtgccaattgccgaggacgacgaccaaagcgaagagggaaaattgtgagcaaaaaatgggggaacttttggttgaattaagaaaaaattcaatggaaaaatattgttttaaattaattttggttgtattttcagggttctcattga

SEQ ID NO: 71877 - DNA, 1099 bp, Heterodera glycines
  Genomic contig location: Contig_ID=SeqID_44381; Location=80..1178; Strand=+
  SCN-specific regions: Sequence locations=1-435,457-730,760-1099
atgagaaggtcacaaatgctagcaagaaacgaatcctttttggagacactgtgtaatgccaaaaaggcgaatgaccttattcgagacgcaaccgatgagcaacttttgtgcctagtcgaaatatgtctcaacattctaaagggtcgggttccattgcgtactcggcatttgaataagctgaaagctcatgcacaggtgcttcgtcgtctcgcccgcacacgctgctcgcgctctgccaaaaaggttttgctacagcacggagatggcctcccagctattgtggggctcattgcgtcaattgctcttccgcttattatggatgtcattgaaaattataaataaggtgcaacaaagtaaaaaaaaaagaagtaaaatgcagcatacaaagcgctatttgtttgtccccgaagaaatttatcagagtttggcatcaccgccaccgtctgacggaacaccaattgggctggtacgtaacagaattaaacaaatcaaaaacgatgacggcataaatgaggcagaacgggcaatcaaatatgagcaggaacttaagcgtctcaacaagctgactcgggacgaggatgaacgtcccgtgggtgttaaattagaaaatttgagtgatgtggttgacgctatgccaaaaccagtcaacgtcaaaagaccaattgttgtcgctacgcgtcgccatttaaaggttgggcgtgcgcgaaaagcaaatgttgaacaactagaagatgttgatgatgatgatgatgatgatgaaactccaaagccatcgagttcaaataaacgacaacccacacaaacggaaatcttaaaattaatttataaaaacgcccaatctcttggagtgtctgaggaaggacaggtcttgagagcgggtgggcggccttttataaccagcagtgtttatgacattgttagtcacctgatgaacaaggacaagcgtggccaaaacaaagagacaactgcattcaaagaatttgttgaaagggcaagacagatcccgctcttgagtaggcacttatttcccgaaggccaatccggcaaaggcatttataaaaacaccacactgaaatttaatccatctttatggatttga

SEQ ID NO: 71878 - DNA, 956 bp, Heterodera glycines
  Genomic contig location: Contig_ID=SeqID_9555; Location=1078..2033; Strand=+
  SCN-specific regions: Sequence locations=1-338,360-796,818-852,874 -875,902-956
atgtgctcatatataatcaatagaacccgtacaggaccgggatcccgccgggattttgccggtcccggtccccgtcccatattttttagacaaaccaccaagaccggtagtccctttaaaacgggagtcccggtcccgagatcgggagtcccggtcacgagatcgggagtcccggtcccgagatcccgtcccggttcattttccaagtcccggtctcggtcacggccatttgggccggaaaaacggtctaaattttaccagtgtaacagccccaaatttgataaataggtgaaacgtttctaatttaaattttcaagatagaactttagattttttaatttggggcaatttcaactgttaaaaataccctgaattcaatatgaaaataaataacatttgcataactttcttttaccaaaaaatatttccaaatttatgaaaaaatcaacaaatttcacaataaatttcattaaaactcaaaaattttccgcagcgtcgcctagtacaaaaactaaatttttttctaaaaaagttagctcaaaatagtaaaatttggccatttttggtgtaaattttttttgaaaaatgtgctaaaaacacttgtacctaaattacaattgaaaataaagcaataataagcacaaatggtaaaatattcatcaattaataaaaataatgcatttggtcatctcttaaataacactcaagattattagcaagaatatttcatcatgttaaatattgaaggccgaatccatgcggattttgtaaaaaaaatttatgagaaattttaatattgcagacaattatcatttttacattgtatttgtcggctatttcgttattttaattatataaggaaataatgaaaaacctttaattatttaaaataattattattgaattgtaaatcttccatatttttgacttgaatataattgcattgatttattaaa

SEQ ID NO: 71879 - DNA, 326 bp, Heterodera glycines
  Genomic contig location: Contig_ID=SeqID_9556; Location=1179..1504; Strand=+
  SCN-specific regions: Sequence locations=1-41,63-72,94-217,242-326
atgacgcaaaatgagagagtgcagaactttcagtccaagtcatacaaaacatttttgatcaaggaggatagagaaaataattttaatagagagtgcaatgggaagaagtttagttcccaatcttcgctgattcctttggtaatagacggagaattatcattatgtttctattgtctcgatgtctttgaatctcttccaataacactctctattaaaatgtttgttctctgtctttcttcatcaaaaatgcttatgtctgaccagtactgaattttttagctctctcattttgcgttatctcttctcaagtgatatttcccgctgaa

SEQ ID NO: 71880 - DNA, 560 bp, Heterodera glycines
  Genomic contig location: Contig_ID=SeqID_44385; Location=327..886; Strand=+
  SCN-specific regions: Sequence locations=1-55,78-127,149-169,191 -286,308-350,386-403,427-560
atgtatttcgagaagtatcgtgcacttgcgaccggtcttttcaaaagttcacttcgtttttcaatctcttctttaggtgttactgtttgcggtgctggagttggtaatttctgttattttttgtctcatattttgtaaaattcatttaggaacatttggtttctctaaattgatcagcattttgattgtccactttgactggcgtacagtttttctcatttacgcaggttttgcctttcgagttctagagacaacctttctttcatcaatttgttttcttttgtcagttgttgttctgctgtgtgtgccgtgcggtgccctttaccggccgattgaatttgtgccgatttacgaaggagagggggaggaagaggaggaggaacacggaatgacggacaatgcaaaagaaatgaccaaagaggagaacgacggcgaaacggacgggcaacatcagtacaaaggtcgcacccgcaaagcccaaaaaacaaaaccattctgatgatagtttagttttcttttttttttttgctcttcaggccaaccagtaatgccttggacaa

SEQ ID NO: 71881 - DNA, 338 bp, Heterodera glycines
  Genomic contig location: Contig_ID=SeqID_44390; Location=241..578; Strand=+
  SCN-specific regions: Sequence locations=1-220,242-338
  Gene Ontology: Cellular component=mitochondrion; Biological process =glycine metabolism
atgccaattgccaacccaacagatggttcttccgttggctttgtcaccagcggatgtccttcgccaactttagggaaaaacattggaatgggttatgtggacaaggcgtatgctaaagttgggaacattttgacggtcgaagctgggcgagacagaatgattgaggtcgaagtggtcaaaatgccatttgtgaaaagcgcctattatctgaagccgacttctgtggacgaagacaaaaagaaatgattaacattaattattgtatttgcattttacattaaattatatatttccatttttaatcacttattatatttgcatttctaattaatgtacaa

SEQ ID NO: 71882 - DNA, 1884 bp, Heterodera glycines
  Genomic contig location: Contig_ID=SeqID_9557; Location=3313..5196; Strand=+
  SCN-specific regions: Sequence locations=1-125,147-203,230-534,556 -737,759-768,855-1217,1260-1271,1293-1764,1786-1884
atgccagagttggaggcggagcggaagggcatgctgaatctgaccaacgggacggtatccgcaccgggcacggacaagcagctgtcgctggaggaggcggtcctgcgcaaggatagaatacaccgaaaaggtgagaaatagcttttagtttattctaagggtacaaaaaagcattaaagtcaattcggatacaatgctttctagctcggttgttgtttgtttgttttacggtaatatacccggacgggaattcccggtcctccgaggtcccggttcccggatattgaaaatttagttcccgtcccggaaaaacaagcactggtaagaatgggggtctgagtgaaaattaatatattctttaaaagtaacgctgccaattgtgcaaatggcctagtggctgatctttttgattttctagttctttcccatggttcaatccctctacgtaaataaaatattttgaattttctttttgtatattcgtgggtttcctatcgataaaatatgattcctcatattttttttattgacacatattttatcattttttaaagaaatccgccaaattgagcctagtaatctcaaaaaaccagtttttttgttgaaaatctgttaacaaatcacaaatcaaattttcaaaatttctcgccggaccccttctttcacaaaagttttttgaaaaagcgcgccgaaaaaaagtgatgtaaaaagcaaaataatattcgatcatttagtccaaaaaatgattattgtttgaaataattgaagaaattttatttgaaaattttcattaatttatttatctttaacttttggatttcataaaataaataacaaaataaaaatttatttttgtgttattttcacttgaataaaatttgaattttcttaattttttgattcttttaaattctaaaaaattcccggttggtcctggttcccggacaaaaaccgaggtcccggtcccggcttctcaagttccggcaagtcccggtcccggtttttcttgcggtcccggcttctcaagttccggcaagtcccggtcccggttttgcccaaaattcccggtcccgctctactctaatattcatttataactttttctttttttatgataagacaaaatctgtcaatacataatagcctttgcaaatgtgctttgtcgatacggagattcaattaaactaaaagatgagtgagggcgcatctaagagatcgttaataaattggctgattttttaaaaactttattctttcattatatctacgaaaaattaaaaacaaatatgtattagtatttttgacctcatttgtattttttttaattttaggctttttcctgctagtttgggcatgccttctctgctacctcctcagttatttgcccggtgcatctgctgaacaaggcactgttgaagccctccacacgcgctgggagccggaagcaattggccccatcactttctctgacatcaactacgattatgaagactacggccaaacaacagaggagccaccaaccacgactcccccgccgccgtccacaacaagtccgcctcccacagaaccggaaccgccctctgcgaccacgccaaatccaacagtgccaacaccgacgtggtgccctgttgccatcactggtttggcagcgctggtcgtccttctgtgcctctgtttgtgttgctgtccgtcagtgccacaatcggttgcaaattggtgccgccgttttgttcatcgcttctgtacatgtgccggcgaaggtgaaaaattttaatgaactaaaaactatcaaaagctacggcacaagtgccacgccaaactttttccgcctcggtctcggatcccggtagagtgaattgaaaaaatgcacaatttttaaagcaa

SEQ ID NO: 71883 - DNA, 1058 bp, Heterodera glycines
  misc_feature (703)..(703): n is a, c, g, or t
  Genomic contig location: Contig_ID=SeqID_9558; Location=209..1266; Strand=+
  SCN-specific regions: Sequence locations=1-343,368-989,1020-1058
gctttttcctgctagtttgggcatgccttctctgctacctcctcagttatttgcccggtgcatctgctgaacaaggcactgttgaagccctccacacgcgctgggagccggaagcaattggccccatcactttctctgacatcaactacgattatgaagactacggccaaacaacagaggagccaccaaccacgccacacatttttgaaaaaattcaaaaaattttaaaaatcaataaaaacaagtcttatggtgtttcggaggttccgggttcgggattcgaaatcggtcgaaatggatgttatattcgtgatcagcgacctccgaaaccccataagacttgtttttattaatttaaaaaatttttgaattgtcaaaaatgtgtggtaccatctaaactattaccaaaatatagtttaattttatttatttgccaccaatttgttgcaattaatatatgcttcggtaaaaatttgtaggtctcccaaggacgactgcccaaaaaaaacaacgttcactctttctattttaacggtgacaacacttttctttgaaatcgatgaaaaaaattaaccgtttcatggtcaaatcgaaatttagaagacagggatgttgtctgcagtacgtgcgaaacacccggacacactgctgtgaattgcgaccagctgaacccggacgtgtgaatgggaaaaaataccgatcnaaatgatgagtagggcgaggatttctagttttttaactattttttctgcggcattattttgatgagaaatgcacgaaaaaccacatttttagctcggaaattcttagttttaacgccactattcatcactagaaaaaattattttgtaagttggccactaaaatccgcgtcgaagaggtgtgccaccaatttcggcatctgctgcggttgtcgcctcatcaaagcgagtgccaaaacgagttatggctcagcgcatcgcaagaggaaaactaaatccggcttgcccattaataatgaataatttttttttaattttgccgaaatttggccgcggaggctcgagaccgagataaaa

SEQ ID NO: 71884 - DNA, 95 bp, Heterodera glycines
  Genomic contig location: Contig_ID=SeqID_44392; Location=1..95; Strand=-
  SCN-specific regions: Sequence locations=1-95
tccaagtttagcccacaaatctgctgactaattccctactcattcactccgttccgaaatgccgaccactgtcgtgcgcacaacaaccactcgga

SEQ ID NO: 71885 - DNA, 385 bp, Heterodera glycines
  Genomic contig location: Contig_ID=SeqID_44392; Location=699..1083; Strand=-
  SCN-specific regions: Sequence locations=1-94,116-385
aaatgttgatttactgtgcaaagccgacttcaccagaagagccactcagacagaaatcagacggcgtttgaatggccgaagggtcgatttgctgctcagtgacatggcaccgaatccgaccggtgggaggcgacagcaatttattaaatttatttttgtcattgctcaaatttcgttccgttaaggcgaatcctacatggaccatttacggataatcaaactctgccgtgacctctttatgttcggcactgtgcccgatcccgagccaatccttgcgcccaatggaattttactttgcaaagtttctattcattattcaattttcaaaaaaaaattcctagattttcgacggcgttcacagaaatgacttaatcaaagaattgag

SEQ ID NO: 71886 - DNA, 283 bp, Heterodera glycines
  Genomic contig location: Contig_ID=SeqID_44394; Location=590..872; Strand=-
  SCN-specific regions: Sequence locations=1-283
ctgttcgattccggccttttcctggaacaatcggtcagcggaagcggaagttggtggaacccaacgccagcggaccaagtgccgaccaacagaccaggcacggtacgatgccggcactttcccaaaccatcccataaaaatgccaaaaccaatcggaatgcgaaagcattgactttgcctctcttcgttaagtgtcagtccgactcgcgtcaactgtccgacgaggagcttcactttgccaagtcgcatctgttgatggccgagtccgtgcctccgtttggcg

SEQ ID NO: 71887 - DNA, 50 bp, Heterodera glycines
  misc_feature (26)..(26): n is a, c, g, or t
  Genomic contig location: Contig_ID=SeqID_44398; Location=218..267; Strand=+
  SCN-specific regions: Sequence locations=1-50
atggcgattgtgcacagccctccgtnctcatacgcaagcgcttttgtgag

SEQ ID NO: 71888 - DNA, 1216 bp, Heterodera glycines
  Genomic contig location: Contig_ID=SeqID_44401; Location=235..1450; Strand=+
  SCN-specific regions: Sequence locations=1-199,317-436,458-486,509 -543,579-760,783-802,851-901,955-1093,1115-1186
atgagagaaaataaaataggaatatacaataatcacttaaacgcatttgtgaccactgtgagttaaggaacggtggctgattgtgtgcaaaataattgtcctacggtggtaaagtattatcgtccaactgtggcacaaaaagcggtggcaaaggcgatggattcgcttgctacgagtaaaggagtgacaccccgagaggtaattaataattaattaattaatcctaacaacaaaaaaaactaaaattttgatataaaaattctttaatttctcctataaatttttatttgtaaaaattaaacaaattgtttttataggattttacaaaagtgtttgcttctaaaaagtcgaaaaaagaattgtataaaattgcttctggagaaatggcaccccattttttgttgaacgttggcgacaatttttacgacgaaggcgtaacaaaagaggatgttgcagagcgttttgaacaggtaattaattgttaattaaggataatttataaaacaaactataccacaaagtatttatttaatacgggaaaagaattttttaataaaaaaaatatttttatataaataccaatggttttctttttatagaattttactgaagtgtacaattatgacagtttgaatgtgccatggtatacaattgctgggaacaacgattgggaaagcaaagatggaattgagccccaaattgaacacccaagtggcaaatggtaaatgtaaacgttttaaaatgagagtaaattctcttgaaaattttttaaaaattaatttgcctgcaaaatttcggaaatttcaaaaggttgtgacaaaaagaagcgaaaaacttttgtcaattttttccgtaaataatactaaaaaaacaaattttttgaaagtatgtactttttggctaaatatctattttattattttaaataataattttacattttttaaattttttcaggactttccctgcccaacattatgtggtcaattacgaatttggagaaagcccggacaaccgcaaaactgctcgtttcattatgatcgacacaacagtgctttgtgggaatggggcaaccgttttcgggaaaatgcagaaaaaagacacacaaaaatatgccaaaatgattgagaatgccaaaaagcatttcaaatggttgcgcaaggagttgcgagaggcgaaacgacggttgaaatatgaacaataaataaattaaaaa

SEQ ID NO: 71889 - DNA, 1333 bp, Heterodera glycines
  Genomic contig location: Contig_ID=SeqID_9561; Location=152..1484; Strand=-
  SCN-specific regions: Sequence locations=1-283,305-878,904-1117,1140 -1333
  Gene Ontology: Biological process=cell growth and/or maintenance
atgtacggaggacaaacaaatgcgaatggaagtggagttcaaatttgtgttgaacctttgaatgaatgggaaatacaggaggttggatatgacggagtcgagaaatacataaagttagtcgtcagaaagtttgtgagaatttctccccattttctttgttttctttaagaccgctcgcatttaaagaccatctgaggaaaaatgcacaaaacatcgaatggagcaaaataattggggaaaagacaaatgcggacactttaacggaagaaagtgactcggatgacagccaactcgaaggaagtccgatcggattggctcagacgaccaaaggattcattgagcccattgctggaccatgggcaatggtggccaaacatttgcagtgagtcaacccaattctaatttctccaaaaaatggctgattgtaaagattttagcaattcgctgcaggaagtggacattctgatggattgcatgcgaatcgcccgcactgattatttgagtccgatggtcaccgctttggtccaagacgagcggacggaggccgaacaagtggccgtgtccaaggcattccaactgcacactcgacgaagagtgctaaacgaaacggcacgggaaatcgaacggatggcaaatgcacggcgcggagcatcgtccgaaactgacaaaaacgacttcttcaatgaactgagggaattgcgcgagaattggcgtatcagaaaagtgggaccgaacatttttggagacctcggctacaaaacatgtaattattgcaaagggatgagagagtagggcaaagagcgacgaattcccaaagtttttttggtcattaggtcactcattgttagcccttaattcataataccatttttaaacaaaatatttttgttgacatttttctcagttgtcccaaaatttgcacccaatgaaattttcgatgttacacaaaaatcagcatcaaacagacgtgaaagtaccataaagcataacaatcggtcgttcattgagctgcgactgcctcagaatctaaggtatttcatttcagtatttttctttcaattctatgaaatttgtatttaatgtgtcgcaccgatttgttggtatatatcgaaaaaggtaacttttttaaatgttttattccttctaaaattcattttcaataatttgagacgatgaaaagacggccgaatcgttctttaaagtgaccaacagaccatcgactagtgaagaggacgttaaacacgtgcactggcgcaaggctttgccatgggctcaaaattctttgatttgcagagaaattttggcacgagtattacgcattccattcgattga

SEQ ID NO: 71890 - DNA, 920 bp, Heterodera glycines
  Genomic contig location: Contig_ID=SeqID_44404; Location=471..1390; Strand=-
  SCN-specific regions: Sequence locations=1-867,891-920
atgaagggctgcagaaaaatggagaaattcagtaccaactttgtccacttcagtcccaggcgaataactcgccagggtttgaactgagcgagggggtgccagcagacttattgtagagttcaatgagctggatttttccagtttttaaaatttcgaaaattttcaaaatttttcgagctaggcctaaaaaacggttttcgggtttttgaattttaggaatttttaacgaattttcccagaaaaacggagaccactttcaagcaaccgtttttcgagctctatcgattggtgatatttttgaaaaaatttcgattttttcccggaaatagaaaaaatttttggcctgagcgggacatttgagtcccgggtccataactcgttaggggttggttttatcgaaaaaacgccttagggcaaaattgtagagcttttgaagctctatcgaatggtgtgccatatggcgggaaattttcaaaaattttcgagctaggccccctagaaattttcgaaaattttttttgggttgaaaatgggggtcaaaaatatttttctggggtattttgatgtgctgagcacgaatatgatgtttatttttcgtttcaaaatttttggaattttttaaaaattctttattttttggcaattttttggccctcgggattttggcctaatatttgaaaattcataacaaatcgaagggttgatcaattttacaggaataaagccttaaaaatagagaaaaatcaggagaattttatgggatttaaatgaaatttatatcttcaaatgaaaaaaagttattcaagaatttctggaaaaatccgaattttcagaaaaaaattcagaactcggttccgtaaaggtgcttttgaaattttaaatactgaaaaaatccgcaattttttgctctaccaaataaa

SEQ ID NO: 71891 - DNA, 405 bp, Heterodera glycines
  Genomic contig location: Contig_ID=SeqID_44405; Location=915..1319; Strand=-
  SCN-specific regions: Sequence locations=1-405
atgcccgcgccacacgataaaacgtcacttcgatcgtttttgggagcgcttaattattatggccgattcataaaagaaatacgtgagatacgcactccgcttgatcagctcctaagaaaggatgaaaattggaatgggagcgaagagcgacagaaggcttttgaaaaggcgaagatcatgacttctgatctgctgttgacccattacaatccgactcttccaataatcgtggccgcagacgcttccaaaaacggtattggcgcaacgactggccatgtttttccggacaaatccgggaaagtgatcgaacatgcctcatgtgttttgtcaaattcccagcagaattacagccagatcgaaaaagaagcaatggctcttgtgttcgcagtgcagaaattccactga

SEQ ID NO: 71892 - DNA, 828 bp, Heterodera glycines
  misc_feature (11)..(11): n is a, c, g, or t
  Genomic contig location: Contig_ID=SeqID_44409; Location=27..854; Strand=-
  SCN-specific regions: Sequence locations=1-828
atgaacgctanaattatcagagtgccgaaaatcgcatgtgatctaagcctagcaaaaaatggtgtaagtaaaaatcgtaattacgctcaaaaagctcctcaaacaattttagcgcttccaattccttctacaatcgcctttatacatcccattatgagcgctaaaattatcagagtgccgaaaatcgcatgtgatctaagcctagcaaaaaatggtgtaagtataaatcgtaattacgctcaaaaagctcctcaaacaattttagcgcttccaattccttctacaatcgcctttatacatcccattatgagcgctaaaattatcagagtgccgaaaatcgcatgtgatctaagcctagcaaaaaaatggtgtaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaaatggtcaagtaaaaatcgtaattacgctcaaaaagcttctcaaacaattttaacgcttccaattccttctacaatcgcctttatacatcccattatgagcgctaaaattatcagagtgccgaaaatcgcatgtgatctaagcttagaaaaaaatggtctaagtaaaaatcgtaattacgctcaaaaagcttctcaaacaattttagcgcttccaattccttctacaatcgcctttatacatcccattatgaacgctaaaattatcagagtgccgaaaatcgcatgtgatctaagcctagcaaaaaatggt

SEQ ID NO: 71893 - DNA, 85 bp, Heterodera glycines; identical to SEQ ID NO: 65905
  Genomic contig location: Contig_ID=SeqID_44410; Location=472..556; Strand=-
  SCN-specific regions: Sequence locations=1-85

SEQ ID NO: 71894 - DNA, 141 bp, Heterodera glycines
  Genomic contig location: Contig_ID=SeqID_44410; Location=1..141; Strand=-
  SCN-specific regions: Sequence locations=1-141
tgtttgatagggccagacaaaagaaggcaactgttggtaccaagtttgcggtaaaaaaatgagaaaaaagagatagctattttttggtcaagaattttttttgttgcgtttcaatatcgtaagattgtttgatagggccag

SEQ ID NO: 71895 - DNA, 1056 bp, Heterodera glycines
  Genomic contig location: Contig_ID=SeqID_9563; Location=799..1854; Strand=-
  SCN-specific regions: Sequence locations=1-606,651-767,791-863,885 -909,951-1056
atgaacatcaccgcagctccgatcagcgaatactccacaatgcttgtgtacatcacttcgttgaagcttgctgtcattaaaaattacccattttctttttttcggctttatccctcatttagcaattcaaattcagcgataattacccaaaacgcactcggccccgtggcattttcgcaccgatcgtttgacggtcagtccggcaccaagcaaaaggccggtgccaccgatggaaatgtccaaatttgccccgttcaaatgttcggcattttcaaccgacggtgcgtcccaattgacaaactctccgccgccttctccgtccgccgtttgggacagttcgatcagttgcgattgtgctgttgtgattggctgcggaaaggtggcatgacgggcaaacacttgtctgatttgtttttttctatgttttttttcagtttggcattttgcccaccgaatttcgtctcccatcagcgattcttcaatgagaatgtaacggatccaagtccaaaggttggtcgcgattaaatgcgcagtgccaaaacggcaaatcacttggtaatcgcttatggccaactaaacaatggtagggttactgtattttttacgtttaataaatatgatttatttattataattgaaaaattaaaaatgccttccaattgcagaacacaaaatgcatttgcacaaagacaaacgcaatggccataatgtccaaaacaatgacataatgtgggcatgtgccatcgctggcacacagaaaaacattaaaagctgaaaaagagagtgccaaaatcacacaaaatggtacaactctaagcgattgcgataccgtaatacacagtgccaattacgccgaaaacgacgcagccgaggcgcaggaaaagactgccggcacttggcccgtcgtggctaacctgggaaaagcaaaaatcaaacacaaaacagacaaaggcacacaagtggaaggaaccttgcgcaattcctggaactgctcggaattgcattggttcacaatgtttgcggaagattcggcactaaaaacggcaaaaaaataaa

SEQ ID NO: 71896 - DNA, 2384 bp, Heterodera glycines
  misc_feature (35)..(36): n is a, c, g, or t
  misc_feature (53)..(53): n is a, c, g, or t
  misc_feature (62)..(62): n is a, c, g, or t
  misc_feature (69)..(70): n is a, c, g, or t
  misc_feature (72)..(72): n is a, c, g, or t
  misc_feature (80)..(80): n is a, c, g, or t
  misc_feature (2225)..(2225): n is a, c, g, or t
  misc_feature (2239)..(2241): n is a, c, g, or t
  misc_feature (2245)..(2245): n is a, c, g, or t
  misc_feature (2254)..(2255): n is a, c, g, or t
  misc_feature (2257)..(2257): n is a, c, g, or t
  misc_feature (2260)..(2260): n is a, c, g, or t
  misc_feature (2263)..(2264): n is a, c, g, or t
  misc_feature (2266)..(2266): n is a, c, g, or t
  misc_feature (2270)..(2271): n is a, c, g, or t
  misc_feature (2275)..(2275): n is a, c, g, or t
  misc_feature (2279)..(2279): n is a, c, g, or t
  misc_feature (2291)..(2291): n is a, c, g, or t
  misc_feature (2294)..(2298): n is a, c, g, or t
  misc_feature (2301)..(2301): n is a, c, g, or t
  misc_feature (2303)..(2303): n is a, c, g, or t
  misc_feature (2314)..(2314): n is a, c, g, or t
  misc_feature (2316)..(2316): n is a, c, g, or t
  misc_feature (2320)..(2321): n is a, c, g, or t
  misc_feature (2328)..(2328): n is a, c, g, or t
  misc_feature (2334)..(2334): n is a, c, g, or t
  misc_feature (2338)..(2338): n is a, c, g, or t
  misc_feature (2342)..(2343): n is a, c, g, or t
  misc_feature (2353)..(2354): n is a, c, g, or t
  misc_feature (2359)..(2360): n is a, c, g, or t
  misc_feature (2363)..(2363): n is a, c, g, or t
  misc_feature (2368)..(2369): n is a, c, g, or t
  misc_feature (2374)..(2374): n is a, c, g, or t
  misc_feature (2381)..(2382): n is a, c, g, or t
  Genomic contig location: Contig_ID=SeqID_9563; Location=1..2384; Strand=+
  SCN-specific regions: Sequence locations=1-383,405-475,497-742,766 -779,810-904,946-970,992-1064,1088-1204,1249-1892,1914-1927,1950 -1950,1981-2384
caaatgatcagtcggagagggcaaataatttgttnnaattagtcaataaattntgaaaatgnactattnntnacgttttntaatgtttactcaaaagcatatgcttaggaataaaaataaatgttggcttcagtttgtatttgtttagtacaaaaaatgattgtttctcaagtttaatcaatcattcccccggggggggggggggcttttggctgtaagcaaagcgccattaaagcaacaaattgcccgtataaatgccaacggatcatttttcaacatcctgaaatgccatttctatttttaattgcataacaaacgggggaaaggggcacagaattttgaagatttggtggttatttgagaaacctaaatgctcaacttattaagcattttcatatttctttgtgcagaaattcggtgatgtgcggcctttcgttgttttattcaatgcttgttaccatattcggtatcattttatttttgtgtttattgtatcccgagataaaagcccatacattttaatgttttagctttggttttggagctgtcccatttaatggtgacaaataacagtcggcgaaatttgggcttcaatgacatggtaattaacgtaatttattttttttaattgaattttcattttgctcagatgttcggcatttacatgtacggctgttccatcctttttctgctttactgctattgtgcgcttcttctcaatccacgatggaaacgcaaaattggaaaattactaagaaaaaagtatttccataaaatgcataaatttaatttataaaatttatttttttgccgtttttagtgccgaatcttccgcaaacattgtgaaccaatgcaattccgagcagttccaggaattgcgcaaggttccttccacttgtgtgcctttgtctgttttgtgtttgatttttgcttttcccaggttagccacgacgggccaagtgccggcagtcttttcctgcgcctcggctgcgtcgttttcggcgtaattggcactgtgtattacggtatcgcaatcgcttagagttgtaccattttgtgtgattttggcactctctttttcagcttttaatgtttttctgtgtgccagcgatggcacatgcccacattatgtcattgttttggacattatggccattgcgtttgtctttgtgcaaatgcattttgtgttctgcaattggaaggcatttttaatttttcaattataataaataaatcatatttattaaacgtaaaaaatacagtaaccctaccattgtttagttggccataagcgattaccaagtgatttgccgttttggcactgcgcatttaatcgcgaccaacctttggacttggatccgttacattctcattgaagaatcgctgatgggagacgaaattcggtgggcaaaatgccaaactgaaaaaaaacatagaaaaaaacaaatcagacaagtgtttgcccgtcatgccacctttccgcagccaatcacaacagcacaatcgcaactgatcgaactgtcccaaacggcggacggagaaggcggcggagagtttgtcaattgggacgcaccgtcggttgaaaatgccgaacatttgaacggggcaaatttggacatttccatcggtggcaccggccttttgcttggtgccggactgaccgtcaaacgatcggtgcgaaaatgccacggggccgagtgcgttttgggtaattatcgctgaatttgaattgctaaatgagggataaagccgaaaaaaagaaaatgggtaatttttaatgacagcaagcttcaacgaagtgatgtacacaagcattgtggagtattcgctgatcggagctgcggtgatgttcattgtgtggaaaaacatcggacaacgccaaaaaaagtcggagcaaaaggaaaacaaaacaacgaccgcaaaagggtaataaaataattgaaaaacagcaattatttattaattaattaatgtttaattgctttttgagttatgtgagtcgaaagcaccgaattcgaatggactgctcaaaggtaaagccaaagaatgggccaaaagccgaattgaatttctattttaaccccaaaattcagagcacaacaggtgggacgatgatgggaatggcagaatgccaacgaatgaggattaactcaaaaacaaccaaggactcttcttcggattggcatttttaaccaccactttcacctcaatatccattttctccnattacacaatcatnnnacanaacacacanncnatnatnntnttcnnctcnaccnacatcatccatntannnnnaantnctttacattananctcnntattttnaaaaancctncctnnattccatttnnacctnnatntcctnnaccanaatccannaa

SEQ ID NO: 71897 - DNA, 304 bp, Heterodera glycines
  Genomic contig location: Contig_ID=SeqID_44412; Location=584..887; Strand=-
  SCN-specific regions: Sequence locations=1-304
aaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtatattgcgcaccgccctccctatcatg

SEQ ID NO: 71898 - DNA, 228 bp, Heterodera glycines
  Genomic contig location: Contig_ID=SeqID_44413; Location=731..958; Strand=+
  SCN-specific regions: Sequence locations=1-51,93-228
atgaatgaaactcaaataaaagagaaagaagaaatggtcataatgcaggtgatttattataatttttataatctaaacatttttttaataaagatgtgttctgatcaaaatccttgctggccaatgattggttatggcatatttttgctcattttgacaatcggtggaattttgtcaaatttttcagtgattttcatcacaattcgaacaaagtttaaaaatttttaa

SEQ ID NO: 71899 - DNA, 223 bp, Heterodera glycines
  Genomic contig location: Contig_ID=SeqID_44413; Location=1120..1342; Strand=-
  SCN-specific regions: Sequence locations=1-85,122-162,184-223
atggcggtacaatcatgtgaattacagtatccatcagtacaacagtgagaaaaaaagacgagttgaatttcattatggaaaaaagaaatttaaaaaattgtttttaaatataatttttatactttagcggaaaaaagcacaacaaacaatcgttcaatgccaatgaaaagcattataaggagggatcagccgatgcttgttaaaggaataatgccaaaataaa

SEQ ID NO: 71900 - DNA, 53 bp, Heterodera glycines
  Genomic contig location: Contig_ID=SeqID_44416; Location=101..153; Strand=+
  SCN-specific regions: Sequence locations=1-53
atttaaagccatccattgcctgccggttctcggcacaacaaagcactaatagg

SEQ ID NO: 71901 - DNA, 637 bp, Heterodera glycines
  Genomic contig location: Contig_ID=SeqID_44417; Location=199..835; Strand=+
  SCN-specific regions: Sequence locations=1-113,175-207,232-260,282 -419,443-492,535-637
gatttacatattaaatttggaccttttctcgatgaaaaagcagcagagtttgattctgatactttgaatcgttacaaggagcaacagagggtaagttttgctttgactatttcttaaaaaatttataaatttaaaatttcttactattttttttgaattttcttataaaaatttctacaatacctaagttttcttggaaattttctttctttaaatttttattaaaaaactgatttcatttggcagaataaaaacacataaactgttgatcaaagagggagcatttttagatggtgggaaattagtacaagtacttaaccatatcaacaatgcttaatttggttaacaatgaaaaaattatagtccaaaaattttccggcaatgttttgggatgcaccagaaatgtttaattgctttccataacaaaacacccaaaacattttctgcaaaaaaaatggcgctacttgcaaagagcgctcttttgaattctatcaaaaacaaaaggggggacccttttgttttgcaaaaaatttttgagatacaaatccatgaaaatttgttatccgggggttttagaggtcgctgatcacgaatctgacatctaattcgaggtcttggaccccaagaaccccaggga

SEQ ID NO: 71902 - DNA, 104 bp, Heterodera glycines
  Genomic contig location: Contig_ID=SeqID_44418; Location=140..243; Strand=-
  SCN-specific regions: Sequence locations=1-104
atggaggcggtgcacaacgaaactccatctggaatgccgactcacaaacggacaatcaaagtgaacaaaattttatttgattattgtttaaccaataaatccag

SEQ ID NO: 71903 - DNA, 754 bp, Heterodera glycines
  Genomic contig location: Contig_ID=SeqID_1296; Location=973..1726; Strand=-
  SCN-specific regions: Sequence locations=1-504,526-576,616-754
atgccattgtcagcaaattctaccaaattagcagttgtttcaattggcattttggcgttattatcaattttatcagcagaagcgcaagccatgcaaactgcagatgttgagggaattgacgagcagaagctgctttttctcgcttgtattcagggcaaattggaatcgggtaagtgagtggggcaggactgatttggtcggtaattgtcagaggccgggatttcccaattctatgagtacaggtaagagttacgggcttgacattaatacgggttacgggttaaaaatcctcaatccgtaagaacttgaatcagcctgaaaaagtacgggttacgtcccctatacaaattccgtgatttttaatcttcgtacccttcggatttcttagcttttttcctacatttttttcatttttgaggagtttttaaggaaatttttttattaaatgcccaaaaatccaaaatttcgcaatttttccatacatatttcatttttttttacatattttgagaatttttgagaatttatagaaattattgttaaaaaaaatttttggaggcgtaccccttaaatcagtttttttttaaatagatatcaaaaattaattataaaatacttgttgtgtccaaacacttggacttctcggtttttagccctttttcttttgacaagaggtttttggaaaagagtttattcaagtcagaaagcaaaagtaaaaagaaaagattaaatgtgattaatgcaaagaaataaa

SEQ ID NO: 71904 - DNA, 1419 bp, Heterodera glycines
  Genomic contig location: Contig_ID=SeqID_1296; Location=3483..4901; Strand=-
  SCN-specific regions: Sequence locations=1-66,88-131,155-660,682 -922,945-949,971-1013,1046-1299,1321-1419
aataaactagaaaacagtaataatacttccattgacagcatcccgaatatttttctcaaaaactgtaaagaaaatttggtttatccactatttcatattttttgtttttcaatgatgactggccaagtcccaaacatttggaaaaaatcaattatttgtcctgttccaaaaataccgaacccaataaatcccattgactttcggccaatttcgcttttatgctccatctcaaaaattttagaagaaaatattacccagaaaatcactaattttgttgagacaaatgatgtacttccgaattgccaacatggctttaggagaaaacactctgttacaactcaacttttggaagtcattgatgactttagtttggctttggaaaacaaaaaatcaattgatgttatatattttgatctagcgaaggcatttgatactgttccgcacgaaagattagtttctaaactcaaaaatattggtataaatggtactttactaaaatggcttcaaaattatctacaaaatcgtacatttttcgttagagttggctctgcgttttctgatgaattcccatgcttaagtggtgttccgcagggatcaaatttgggtccgcttttatttttaatttacatatcagatcttcctaatttttgtaaaactgaaaatgttgaaattaagctttttgctgacgatcttaaggcctattctatactctcaaaaaatactatttctccactccattctttcattaataaatttcggaattattgtgaattaaatggccttaaaatcgctcctaacaaatgcttagtttcacatattgggcctaaaaaccctaatgaatgttactttataaataatattccaattttaaaaagtgaaaaaggtgaaccagttagagaccttggcatttatttttcaaatgacttaaaatgggaaaaacatatagaatttattaccaaaaaagcaataagaacatcttttgctttactcaagtcacttaaaacgaaaaacccaaaaattcttataaatatatttaatatttattgtcggtccattttggaatttggttctccggtttttaatccatatatgaaaaaagacatcgatgctcttgaaaatgtccaaaaaacatttttacgtattgtttttagacgtaataataataaggatgatatacccgggtataacgaacttcttcaactctttaaacaagaatcccttttaaaacgcagaacaaaaatcgatttaaaacttttccatgatataattttgggaaagatccatattcagcataatgattctttttcaaaaatatattcaggactgaaaaacgattatattataaaaaccgcttattgttcaaccaatgttcggtttcattcgttttttattcgtacctctcgcctctataggagtttg

SEQ ID NO: 71905 - DNA, 525 bp, Heterodera glycines
  Genomic contig location: Contig_ID=SeqID_1296; Location=6206..6730; Strand=-
  SCN-specific regions: Sequence locations=1-460,482-525
atggcagaacaattcaacgccattgctgaacgcctcaacgaaattgagcgcaaaatcaacagcaacaataacgacaattccagtgcggaggaaaaagaacgcaaacgaagcctcgttttgattggcctgccggaggctgtggctgcaaagccgtcagaacgcgccaaagagcacgcggaaacagttgcggaagtgttggacgctttggatgtggaggtttgcccgcagatggtgtatagaatggggcggcggattgatgagaagcgaaaggggccgcgtttggtcaaagttgtcttgccagcgacgacgttccaacgttttgcattggcacaatgggggcgcaaccggacggaactgaagcagcatgttggttggcagcgacttctcgtcaggccctctctgacgaaagaagaattggcggctgagcgggagattcgtgaacagaggcggatgaattatgaagaaagcaaaaagaatgaaatggtgacgacgcggcgtggaggcaacatgggaaaaaacttttga

SEQ ID NO: 71906 - DNA, 718 bp, Heterodera glycines
  Genomic contig location: Contig_ID=SeqID_1297; Location=189..906; Strand=-
  SCN-specific regions: Sequence locations=1-347,377-718
atgggtcgactaagatttttcgattggatccgacggtaaaaagttgatcggaaatcaaattattaacggttcataaatttgactatcgatatttttcactagtggtgcattttctcattgaaaactcaatctttaggggtgtatttttcccgaaacttcgggtaaaatatccgaagccgaagcacaaagttcgacggtcgaagctcggcgtagttttcgaagccgaaggcgaagcccattttttcgaagcacgagttttaggcgttggtgtgaaaaagtgctaattttggacctgtatattaaaaatatacattcatcattacattttgaaaaaaatgatgtaaatgatatttttaatatatttgaaaaattaaaagaaaaacaattacttagaggtgaactgatcaaacgcaaaaatagagaaggaaaccaagagcacaaccaatttgaccacgcatgaaaaactaatgatagatataaatctaagcttagcaaaagccaataattaggggtgtattttcaatttgaaaactcgatctttaggggtgtaatttcccgaaacttcgggtaaattacccgaagctcgaagcccaaaaacgcaaagttttcgaagcttgaagcacgaagctcgaagtttcgcccgtcctgatccggacctaaccctcccccccctccctcagaatgatgcttcaatctgtagcgttatcgatgtaataaa

SEQ ID NO: 71907 - DNA, 65 bp, Heterodera glycines
  Genomic contig location: Contig_ID=SeqID_1297; Location=1277..1341; Strand=+
  SCN-specific regions: Sequence locations=1-14,36-65
aataaaaattgggcttcgccttcggcttcggcttcgagtgctaagccgagcttcgcccagccctg

SEQ ID NO: 71908 - DNA, 174 bp, Heterodera glycines
  Genomic contig location: Contig_ID=SeqID_1297; Location=1853..2026; Strand=+
  SCN-specific regions: Sequence locations=1-103,137-174
atgcgtaagtgccaaaaattagaaataaaaaaacacagagaaggtgttaatggtgttgatcaagcaaaattggacaatgaaagagatgcgaaagtgagtgatgaaaaaaataattaaattttgtaaatttattattcgagttgaatcaattataaatactagataagcaattga

SEQ ID NO: 71909 - DNA, 159 bp, Heterodera glycines
  Genomic contig location: Contig_ID=SeqID_1297; Location=2060..2218; Strand=-
  SCN-specific regions: Sequence locations=1-159
atgatgggaatcccgagtcggaatcccgatcaatcccgaagattttggaaaaacaatcgagagggatcccgagttagggtccgtcccgtccaaatttcggtcccggttaatctctatgcattttttcagaattccgtggtattatcggaatttgcttaa

SEQ ID NO: 71910 - DNA, 535 bp, Heterodera glycines
  Genomic contig location: Contig_ID=SeqID_1298; Location=113..647; Strand=-
  SCN-specific regions: Sequence locations=1-213,325-535
atgttcgatttcgtgccgaaactgcttgccgccggccttggcattcttttgttgttcatcagttccacttccgctggtggtcctttcgacggcggctcctttggcatttcgccatttggcacttcggcatttggcgcggcaccgccactttttccccctccgcctgctccgtttttcagaaattacgggcgtaagtgctaaaatttccatttcttataaataataataataatttagtcttaaataacaatttaacaataatcgagtttttaataaaaattagaaataatatattaatttagtattaaatatcaatttataattgttgaagcctttgcgcttcataaattgtttgtctacatatatccatatccaatttattcagcatctgggtatggcggttacggtggttcatttggcggtttcggcggctccgggtacggtaaaaaatgattgaaaaattgatcagacattcagtgattgacccgcatacatttttacacttatacttctattgtaatatatgttaaataaa

SEQ ID NO: 71911 - DNA, 1118 bp, Heterodera glycines
  Genomic contig location: Contig_ID=SeqID_9565; Location=209..1326; Strand=-
  SCN-specific regions: Sequence locations=1-437,459-611,640-761,783 -922,945-1005,1027-1118
atgcgtcatcatcgctggacgagtacgacagctcgctgctgctgtaccattcacggtcgccggcacaaatgtgagtgaatgaatgtgagaatgggatttgggggatttttggctgaattttttggtgttatgtgcgttattgggtattctatgtataagcagcgttaagaatttctgtattaatcgcacttttttataatatatttccgccgtatgctcatttatataaatatactgtatatttcatcattgtaattttcttaaatatctcattctatcgtgtaaaaaacttgttgtttcttttttgcttttccaatattttatttgttttagttataataccaaaatcaaaacttataattttcataaatttatttattcacataaaaaaagccagcatttgtcatttcagcgttttctcattctaacaataagtcattcacatttttcactttgttattgtcgattagaccgcccaattagcaaagagtggacacattcgtttctatgtattttaaggattattccagagcaaaagtttcaggaaatttatggtgtttttctttggatttatttaatttcactattaaaaaattcttagaaatttaccaatatatatatatatatatatatatatattatttacagccaaatgtatatgaaatttaaaacttttactataaatgaaaaaaaaatcaggatttttgaaattttcgctacagaatccggaatttataaaaccaccttcacctgcctacggattttgttgttttttataatcaaattttaatgcattcacaatttctgtcgtgacttctttttttagtttaatatatttaaataaccaaaactttttctctgctttagagggttggacattttttgcctccggcagcatgtgttgcatttattgagcccaatgctttcatcaccagcagatgctgcgtatcactgatttttattttattttgttttgatttcttttttgtcgcattttttttatatgaatatacttttgttttttatataatgatgatagttattctctatttcacttcttttcttatgttcattatctatcatctgttatgaaatggaatggaacaaaatttaataaa

SEQ ID NO: 71912 - DNA, 768 bp, Heterodera glycines
  Genomic contig location: Contig_ID=SeqID_44422; Location=160..927; Strand=+
  SCN-specific regions: Sequence locations=1-66,88-191,214-325,348 -420,442-768
atggaagatttaagtgacttattgccagaaagttcagtttggagtgttatttataccccacgcaatcaaattgaaagaatcaaaagggtcaaaatcccactgattcaacttaaaaagtttgatggatcggttgagagttggataccattttgggaaacatttcgagtacatgttcatgaagacaattcagtaacaaaaattgaaaaacacaatttgttggaatcaaatttagaaggggaagcaaaagacttaatagaaggcataccaatttctgaggatggctaccaatttgcgattgatctattgttagaaaaatttggtcgcgcattaaaccaataaataattttgattccacaaagtgacacagttgaagaagacgaaaaattatacattaaattcgaaaaaatttgcagactgttgtcaagcttaaaccaaaatattgatttgtctcctcattatttatttttagaagggaagttatcaccattagttttagacaaatattttgttattaaagacgcagaagacaaccaaaattgggacacaacaaaattcagaaatgccttatcaagagcaattgaacaaataaaaaacagacaagaagtaaaacaaaaatgtggaaaagaaagagatttaaattataatagaaatgattcagaagttactatgaattttgcagttaaatttcgagaagaatgggaaaagttgctgaatgaacaaaaaaccaaaaaattggaaaaaaccaaagagataacagaaggagtttag

SEQ ID NO: 71913 - DNA, 135 bp, Heterodera glycines
  misc_feature (73)..(73): n is a, c, g, or t
  Genomic contig location: Contig_ID=SeqID_44423; Location=1..135; Strand=-
  SCN-specific regions: Sequence locations=1-1,23-135
tagggaagctattcccgaagaattcggtctccccataaatctgggcgcatcggttcggggggactgccccganaacaaaaaaatcgattttttcaagtgtcccgttggggtactcaaacaattatggggagcaaa

SEQ ID NO: 71914 - DNA, 120 bp, Heterodera glycines
  Genomic contig location: Contig_ID=SeqID_44423; Location=226..345; Strand=-
  SCN-specific regions: Sequence locations=1-56,86-120
ggttcgatgaaactttttaaaatataagcctaaactttttggcctgtttaaaaaggaattaaacatttttaaaatatttattcatctcccttttgatagaaaaagcatcagagagcctta

SEQ ID NO: 71915 - DNA, 436 bp, Heterodera glycines
  Genomic contig location: Contig_ID=SeqID_44423; Location=580..1015; Strand=-
  SCN-specific regions: Sequence locations=1-56,83-165,211-211,237 -392,419-436
ggttcgatgaaactttttaaaatataagcctaaactttttggcctgtttaaaaaggaattaaaaatttttaaaaattttattcatctccctttttgatagaaaaagcatcatagtgccttatttaacttttaattaacatttggtgcgtttcagagcacgttctgaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcttgtttaaaaaggaattaaaaatttttaaaaattttattcatctcccttttgataga

SEQ ID NO: 71916 - DNA, 303 bp, Heterodera glycines
  Genomic contig location: Contig_ID=SeqID_44426; Location=280..582; Strand=-
  SCN-specific regions: Sequence locations=1-105,180-303
atgggcaatcagcatagatttcaggtacacattttgcatttgtctaatttatgcccccctcccttcccacaacggcattttcagccccgtggcaacggaccgtacggcggcggcggtggtggtggtggtgaccgtggcgaccgtggtggaggcggtggtggtggtggccgcggtggtggaggcggacgctacgggcgcagtccgccgcgtgaccgaccgcgcggacgctttccctaccgtttggcggtgtccgggctgcccatcagcggctcgtggcaggacttgaaggaccacatgcgtgat

SEQ ID NO: 71917 - DNA, 119 bp, Heterodera glycines
  Genomic contig location: Contig_ID=SeqID_44427; Location=156..274; Strand=-
  SCN-specific regions: Sequence locations=1-119
aattttcgcccacgtacgagaacatcgtggtgacaacactgctctccggcagaacaggatcggcgatttcgacgcgcaggaacagacttttcatgggcgatttcacaatgtgatcgcag

SEQ ID NO: 71918 - DNA, 279 bp, Heterodera glycines
  Genomic contig location: Contig_ID=SeqID_44430; Location=1..279; Strand=-
  SCN-specific regions: Sequence locations=1-79,113-246
atttataagcatttgtagggttctcagcagtttccctgcaaaatttggtgagcttctgatcagtctagaacgttgggtgataaaatgaaaaaaataattaaaaaaaaataatgctggtgtggtaagtgtgaagaactgtgttcctccaggcaaaaaattctaagaaaatttataagcatttgaagggttctcagcagtttccctgcaaaatttggtgagcttctgatcagtctagaacgttgggtgataaaatgaaaaaaataattaaaaaaaaataat

SEQ ID NO: 71919 - DNA, 323 bp, Heterodera glycines
  Genomic contig location: Contig_ID=SeqID_44430; Location=458..780; Strand=-
  SCN-specific regions: Sequence locations=1-79,113-246,280-323
atttataagcatttgtagggttctcagcagtttccctgcaaaatttggtgagcttctgatcagtctagaacgttgggtgataaaatgaaaaaaataattaaaaaaaaataatgctggtgtggtaagtgtgaagaactgtgttcctccaggcaaaaaattctaagaaaatttataagcatttgtagggttctcagcagtttccctgcaaaatttggtgagcttctgatcagtctagaacgttgggtgataaaatgaaaaaaataatttaaaaaaaataatgctggtgtggtaagtgtgaagaactgtgttcctccaggcaaaaa

SEQ ID NO: 71920 - DNA, 1156 bp, Heterodera glycines
  Genomic contig location: Contig_ID=SeqID_44431; Location=59..1214; Strand=+
  SCN-specific regions: Sequence locations=1-115,142-285,307-333,361 -361,385-389,470-720,744-916,938-1005,1053-1156
atgcctaaaattaaatccaaatttgaatggatgggcgagtgggtaaacagttagtagcttcactgatgaaaatcttgagaaatttttgattttcaattgcaaaaacaaccgatgaggaaaattttttaaaattatttgcacccctaattttcaagtttttttgtgcatatttggtgcatatttcacgactttatttgcatatttatgcgcatattttggccatttttcgtgcatatttttgacagccctgtttattatggttgcaaatatatatatatttttcgatttttgaatgcatttttccaaaataaatagtttaaaattttggtcaagaaaaaataaataataaaattaaaaaaacgtgaaaaaatttgaatttttgagccgccaaaaaaataataattttttattgcattttcattaaggaatttttaaattttatatgaaaaatttgaaaaatactaaatttcaatctctttttcttccttagcaaatgtttttttaattaaaaaatgattttcgtttagaaaacggactgaaaagagtgaacaaaaaatttaagaaaaatgaaaagattgtcttaattgaaaaatttgaaaaaatgaaaaaagaacagttaatcaaaaaaagaaatataaacaaaaaggcaaaccaaattgaaaaggaaattgccaaaaaactcgacgtaagtctgacgtcaatttacacttggaagagacaatttgaagaagaaaacaaaaatgaatggaccaaaatgaagaagttgatcaaagtatttgaagaagtgaagcacagattcattttggaaaagggaaaaatgacgagaaaagtcatgaaaattgttgagcaaaaaattgcaaataaaattggaacggatcgccaacaaattttcaaatggaaaaggaagtttaaagtgaaaaatgaggcaagaaaagatgacaaaagtgccatcatagcggaatttgaagcaatgaaaaaggaatatttgagaaaacatggcaatttaaacaaaaaagcaaaagaaattgaagaagaaattgtcaaagagttgggcacaagtcggacaacgattcgcagatggaaggcacaaatggcaagtcaaaagaaaaatcataacaaagggagacaaggggaaattattgaaaaatattgaaaa

SEQ ID NO: 71921 - DNA, 1295 bp, Heterodera glycines
  Genomic contig location: Contig_ID=SeqID_9568; Location=215..1509; Strand=+
  SCN-specific regions: Sequence locations=1-58,80-81,235-399,422 -523,546-648,670-812,841-1017,1039-1229,1251-1295
atgccctcgcgctccaccacctccatctcggttggcattggcattttttttgcccttttttgctccatcttctttgccatagttactgttgctggtgttattgttggcatttccgctgccgttgttactgttgctggtgttattgttggcattttcttcgccgttgttactgttgctggtgttattgttggcactttctttgctgatgttactgttgttgttgttattgttgttagacattttttttggtattttaaaagttctgtctaaatttttaaaaattgtgtcaagtaggtccatatctataattaaattaagtaaataagttcgcgctataatcagggcttcgatttgttcttatttctaagaaatgttctgatttggagggtccaaatcttagaaaatgaaaatgttcttatttctaagaaatgttctgattttgggttattgttcttattttgttcttatttcttaaaattattcaaaaattttgaaattttatggcgaaatgtcactatgtatcaagaaaaaatttaagatttgtgtcaaaagttggtaatttttgacaaaaatctgttaacaatcgctttaaaaatcgcaaaattttcccggcggcgcctttcggcaccgccggacccccctgtccatcccccaaaattttttgaaatgtgcggcaaaaaaagcgttgttaaacgcaaggaaaagccgtctcttgcttttaattgcaatttggcctttttttggtgaaaaactattaacaaatcagaacaaaattacaaaaaatttttcgacggcgcctatcggcaccgccggaccctccctcttgcccaatacccaaaagtttttttggaaaaatgcgccgcaaacaaaattgtttaaaatgggattttttgatcccgaatgctctgaaatgtacgatttgcttatttcctccccaaaattgttaaaatcgataatgggaggcgaaaaatataatatttaatacatttttggccgaataaattgtaaaaataactgatttgaagccattttgcaaaatgttcttattttggaccctaaaattttatttttttgccttgatgttcttattttgaaaaattttcgatcgaagccctggtttaaagtaaagttatgaccaaaaatgttcaaaaaaacttaattttttgagtttctcagttcataactcttttgaaacaacgaatttttttgaaattttgcaggataataaaaaacacttaagactatcgagaagtacgaaggtttaaaaatttggtttattttggacgaagttgtga

SEQ ID NO: 71922 - DNA, 201 bp, Heterodera glycines
  Genomic contig location: Contig_ID=SeqID_9569; Location=219..419; Strand=-
  SCN-specific regions: Sequence locations=1-4,26-34,56-201
atggaggccagtttttggcacaaaatccttaaaaaacattcaataaccctaaaaaacttgccgaaattcgcctttgccgttgaaatgtttgtccacaagtgcattgaaactggacgaaagcaatgccaaattagaggccgagctgaggacggtcaaataaggggagaatgtccatccaaacatccatgcaaacgcaactga

SEQ ID NO: 71923 - DNA, 1100 bp, Heterodera glycines
  misc_feature (39)..(39): n is a, c, g, or t
  misc_feature (62)..(62): n is a, c, g, or t
  misc_feature (108)..(108): n is a, c, g, or t
  misc_feature (134)..(134): n is a, c, g, or t
  misc_feature (1067)..(1067): n is a, c, g, or t
  misc_feature (1078)..(1078): n is a, c, g, or t
  Genomic contig location: Contig_ID=SeqID_44433; Location=14..1113; Strand=-
  SCN-specific regions: Sequence locations=1-181,203-944,966-1100
atggcggacatcaacatcccccgctggggcgagctggancagtggaagaacaatgtgcaccnaattcatggtggtgtgaaagagcaacaccttcggcacacaccgcancccccatcgccaaggacaacgacggncatcgccatggaacaacagtcaacgacgacgacaaaacgatcgccaaatggtggtgccggtgccaatggggacgacggtgatggaggaaatgattgtcatgctgcagaaaatggaagcgaggagaaaaagccaacaatgacgacaacgacggtggcggcggtgaagaatgaggacgaaaatatggcaaggcgctgcgcgagtttctcggcttttgggtggtcgagaaaatcctcccaagcgtctttgatggcaaaccggggacgatgccattgcgtcgtccagcaaacctggcaggctgtcaaaatattctgccagagactttctcggcatattgttgaaactaaccactcattttcataaaattctacgcttttttgaaaattttctgcgggttttttccgagaaataaaattgaccaagaccgatactgacagacgccgtctgggaatttttttttaaatttcggccccttaccctattctaatgaacagtgttattacatttattaaatgctaaccaaatttggtttaaattaattctcaaccttgtacgccatagcactgctgctgctaattgtaaggaaatgaattggttcatgtttcagctggtcggatgtccggtgtgccatggcgaattccaaatgcgcgaaattttcaaacacatgcacacctgctttgtcaattatttttatttgaaaaaagcgtggtaaattcctttccctggtatggttttgattttgatttttttttagataccgaacaatcagtacaatttgtactgcgaggcgtacaacaaaattgacggcaccttttgaaaagctctggtgaatatgtagttagcaccgaatatcctttcaaaaattcttagattttttttagaaaactcccattggcactgtgttgaatgcttttcgcaggaaaatcaaagacganaagctggccanacgatgcaaggcattgatcagg

SEQ ID NO: 71924 - DNA, 275 bp, Heterodera glycines
  Genomic contig location: Contig_ID=SeqID_44436; Location=686..960; Strand=-
  SCN-specific regions: Sequence locations=1-219,262-275
atggctaattcttcgagaattgtttggagtgtgaatttgttcacatttaaagatgcgttttgctccggaaattttggggtaattacagtcattacactttggccaattaatgggggccaacgtgacacaattgcattaattgtcattggcgttaacaattccaagcaaaatcgaagcattgatccaatccatgaaatatttattccgagtagattttggatttaaattatttaaataattttcatttattatttttttttaccattttgaataaa

SEQ ID NO: 71925 - DNA, 855 bp, Heterodera glycines
  misc_feature (64)..(64): n is a, c, g, or t
  misc_feature (71)..(71): n is a, c, g, or t
  Genomic contig location: Contig_ID=SeqID_44437; Location=1..855; Strand=+
  SCN-specific regions: Sequence locations=1-120,151-286,308-319,341 -437,459-855
  Gene Ontology: Mol. function=ATP dependent RNA helicase activity; Cellular component=nucleolus; Biological process=ribosomal large subunit assembly and maintenance
agagtcaggcattgccgtgggaatcggtggatacataaacaaaataaaccaccaaattattttntagattntcattcggtttcgaacgtgatcaatttcgattttccgctctcaactgatatgtctgatttttattgaattttttatactaatttttgcttgaggtatgtccatcgagtgggcagaacggcacggggatttaacaaaggcacagcaatttcttttgcttcccaggaagagttgaacctttttgaggtggttcgaacggagatcaatgaacgaagtcaaaaaaaaaaattttttttttcgtttcttcgatggttttttatcaccttttttcagtgggccaggcggttatccaaccttatgaagtgcgtatgaaagactttgaaagtttccaacttcgagcaagggtacttcctttgtttttgttaggcttttaaaaaaatatttttataggatgttatagcggcgtgcacaaagacggtaatccgtgaaacgcgaatggctgagataagggcggaactgctcaagtcgaaacgattggacgcatattttgagaagaacccgcgggagaagcgtgctctggagcaggaccggaagcagttcaagctgaatgtgcacagtgctggcattgccgacgtgccggattatattggtaaagaaaagcgagcaaatttgtgaatttacaatcgttcagttccgaaagcgcttcgtggacaggactttaacagtgagcaaaaacggacaaaaagtgaaaggaacaatcggaagagaaaacggccatttgagaaggcgggggcaaaacggaagcacgcaaaaatgttatccgatccgttgcaaagcttcaaattt

SEQ ID NO: 71926 - DNA, 106 bp, Heterodera glycines; identical to SEQ ID NO: 66704
  Genomic contig location: Contig_ID=SeqID_44439; Location=202..307; Strand=+
  SCN-specific regions: Sequence locations=1-106

SEQ ID NO: 71927 - DNA, 100 bp, Heterodera glycines
  Genomic contig location: Contig_ID=SeqID_44439; Location=1462..1561; Strand=+
  SCN-specific regions: Sequence locations=1-100
ggaaataagcttaatagggcctagttaagctgtaaaaaaaatttggagcgatttgaatgagaatagaaagagccaggttcgatgaagttatggtaagcca

SEQ ID NO: 71928 - DNA, 1016 bp, Heterodera glycines
  Genomic contig location: Contig_ID=SeqID_44441; Location=16..1031; Strand=+
  SCN-specific regions: Sequence locations=1-448,539-574,598-615,637 -639,661-663,702-731,816-940,962-1016
atgtggcttgaattacaggttacacaactggaaatggaagcgcaaaaaattcgtggcatttatgacgccacccgtttggaagcacaccgtgcaattgaggtattaattactaattgccgttaattacattgcaattagtaattagcaatttttataactgtaaattaggtaattaattttactaaattgaacaattaatgatttaggcggcgaatgcgttcacgcaaattgcgcacgggttgctgcaggcgcgcaacaacactcgcaccgcacaacaactgatgaaggagacgcaagggcatctgcgcggcgttgctgaagcggcaacaaacgcaaaaagtgcaagcaaatcgatgggcgcaacaattgacacggctgcaatggaagtgtctgcggcgaggtaagaggaaaatttagcgatttttttttgagtaaaattaatgatcagtttaaaaaaaataaaacttagaaatgtttcaaaaaaattcaactatttttttataagaaaatttcaagaaaaaaaaatttttaaatttttctggcgaattttcaaaattttatgatgaattactaaaaagaatttttctttaaaattttctccaaaaatagcttaaatttctttctttcttgaatttcttataaaacaaataaatgatttttctgaaaaatttaaaaatatatttgaataaaaacatttttttgatttgcttcatttagatcttcaaaaaacgattattacattttaaaacttaaatttaaaaacaatttaactaaaaattaaacattaatttttgattataaattttattttaattgcacgctttttttattgtcaatccctcagggcccagggcgacactttggacgtgcgtttggccaacattcagccaaggctttctcaggccaaagcggacctggccaaagtcagccggacaaacggggagctgaacgcacgcgaggacacagttgccgaaattgacaaaatcatggacaaagcggagaatgcctatcaaaaa

SEQ ID NO: 71929 - DNA, 1071 bp, Heterodera glycines
  Genomic contig location: Contig_ID=SeqID_9571; Location=891..1961; Strand=+
  SCN-specific regions: Sequence locations=1-386,431-435,467-510,532 -561,606-647,692-1071
atgcgcatttcgacagcgtgcaaaatagcaggacaaattatgatgaaaatcaaaaacttttccgggtttgccagtgaaaagggcgggggcgagcagttcagcaaagcggtgtatgtgaagggattgccgtggcgtattttggcactttcacaagcgggcaaagggacgaagaaaagcctgggcttttttctgcactgtgatggaggcaaaggtgggggcattttagatctttgatgctttcattttgattttttgaattttgggtgggcaatggcgattctcatcgagcaaatcgaaacttaaaacgaaactgcataaaattatcaaaacgaaactcggaacccaaaaaggcctgaaattctcgaaactttcgaacgctcgaacccatttttattattatttttttttaattttggaattaatttattttgattcctttttattccattaaaaaatatcaaaaatttgatttttaatatcggatttaaattagggtaggagccagaaagaaggggcgggggaggagggggcgaatcgcgctcaaaccggggaacggggatgaaatatttttatcttataaaagaaatattttattataaattttactcctatttatattttcatttactaattaattgtgatgcgccattttatttttatttttttgcattaaaaattttcaaataaaaatcttttcattgaattaagctgtcgattggagctgtaagtgttcagcttcgcttcgaattctttctcgatcgcaaaatgaagaacgcgagaatttcactcggagattcgataagcaaatttttaatccaatttcgaacatctggggcttcaattcgttcatcactttcaaggcaattagttataaaacaattacaaatggtaaaaattaattaaggaattgatggacacgcgaaacggactgtacaataagaaaaatacagtaaccctgggcattcaatttactgtggaaggcgaagacggaggtgaacaacaagcgatggaagccgactgaagaagcatttcgaaacacaaagcttgaagccggacactatcagtaccaaa

SEQ ID NO: 71930 - DNA, 136 bp, Heterodera glycines
  Genomic contig location: Contig_ID=SeqID_9571; Location=5008..5143; Strand=+
  SCN-specific regions: Sequence locations=1-136
aaattagtcaaaatacatgtcagattcgtgattagcgacctttaaaaccccggataacaaattatcatggttttttatcacaaaaaaattttgcaaaacaaaagggtcccccctttttaaaaaattttcaaaaagg

SEQ ID NO: 71931 - DNA, 922 bp, Heterodera glycines
  Genomic contig location: Contig_ID=SeqID_9571; Location=2322..3243; Strand=-
  SCN-specific regions: Sequence locations=1-320,342-628,657-687,710-922
atgcaaggaaattgcaacgacatgtttgtgttaaatgattgtgctgaagcggacggaaagtgcggcaacggcacaatggacaaattctgtgaaaagcctttgaagtggaattgcaaagagtgcaacggcacaaaatgcaacaacatttccaaattgtccaccgcatcgacagcgaagccgatgataaagccaataacggtgaaaaatgatgaaaacgtgagtctttgaagtggcgctcaaaaacgcaaaagttccgtaaaaataaatacctgaatcgaaaggcgtctccgggaaatttttgaatattctgtaatttgttgggaaatactgtggaaaatttcgcatttttcaccttataaaacaccttaatcgtcgaaaaaccgtaagaggtaattgaatagtaattaagacaatttgaaaatgactgataggtaattattagggaccggctttagatatatgtacttcatttttttgcctaactttaggccatctaagaagaatgaaaaacgaatatgactttgtttgcggcttctagacccaaaattttttcatacttaaagcggatttttgtgcttaatgctttatctgagtcaaaaattagagatgaaaattagagttaaaagggaaaaatttaaaaaatatattaatatattccttaaaaggacactgacaattgtctcactcaaattttcaaaatttcccccggcggcgcctatcggtaccgccggaccacctttttccccaaaagttttctggaaaaagcgcgccgaaaaaagtgatgtgataagtaaatctaaatttcaaataatattcgaccatttggtccaaatgattaattgcttgaaataattgaagaaatttgatttgaaaattttctttaatttaatttagctttaacttttggattttattaaataaa

SEQ ID NO: 71932 - DNA, 896 bp, Heterodera glycines
  Genomic contig location: Contig_ID=SeqID_9571; Location=3446..4341; Strand=-
  SCN-specific regions: Sequence locations=1-92,114-140,162-520,544-896
atgacagatatactcaaacaatgggatatcggcgaagctcaggaagcgcatagatgcgtgggcagctgccagacataccgttgctcagacagtaagaaattagaaaaagtaaaaatgacacggtaattgccctggccgcttacgccaaaaatttttctcaaagaatcggaatttctctaatttgcaaaaaccgatagagcatcaaaaacagatggttcaaagtggtattctttttttgagaaaaatctttaaaaaagctaattcaaaaaccgatttctattctctcgaaatttttgaaaaattttcggcttccttaacatggaaaaaagcaataatttgacttagagtatggaggcgatcttttcgtgatcaatgggtgcgataattgggagaaaaaatgcctcgacaatcaattggaaaaattttgcaacgaatcattgacaaaagtgcaagttgtggggaattgtacgcactgtaccacctctttatgcaacaaggaccaactcaaattgtcaactggtaacaaaaataaggaaggaaaaagagcaacaatgttaacgctaatatgccaattaattaatttgataattggtaacgaaatgtttgtccccagccacgaaatgctacggcacccttctcccttcgaatgattacaaggtgcccaaggagttcaaggagctgttcaccaattacaagaagcgaagcacaattaattgcaagggagagaagtgccaaacattcacttgccaagacggtgaaaattgggcaaacaaaaagagggcaaacaattgggaatgattgtcttaattttatagaattgaggaaaatgcctttcggcacctttcactgaacactttttgctttcgtttttttgactccgatcccaactcattaaa

SEQ ID NO: 71933 - DNA, 318 bp, Heterodera glycines
  Genomic contig location: Contig_ID=SeqID_44448; Location=1..318; Strand=-
  SCN-specific regions: Sequence locations=1-318
aatgagaaaaaagagatagccattttttggtcaagaattttttttgtttgcgtttcaaatatcgtaagattgtttgatagggccagacaagagaaggcaactgttggtaccaagtttgcggtaaaaaaatgacaaaaaagagatagctattttttggtcaagaattttttttgtttgcgtttcaaatatcgtaagattgtttgatagggccagacaagagaaggcaactgttggtaccaagtttgcggtaaaaaaatgagaaaaaagagatagctattttttggtcaagaattttttttgttcgcgtttcaaatatcg

SEQ ID NO: 71934 - DNA, 289 bp, Heterodera glycines
  Genomic contig location: Contig_ID=SeqID_44448; Location=896..1184; Strand=-
  SCN-specific regions: Sequence locations=1-289
ggtcaagaatttttttttgtttgcgtttcaaatattcgtaagattgtttgatagggccagacaagagaaggcaactgttggtaccaagtttgcggtaaaaaaatgagaaaaaaagagatagctatttttttggtcaagaatttttttttgtttgcgtttcaaatatcgtaagattgtttgatagggccagacaagagaaggcaactgttggtaccaagtttgcggtaaaaaaatgagaaaaaagagatagccattttttggtcaagaattttttttgtttgcgtttcaa

SEQ ID NO: 71935 - DNA, 513 bp, Heterodera glycines
  Genomic contig location: Contig_ID=SeqID_44450; Location=386..898; Strand=-
  SCN-specific regions: Sequence locations=1-63,85-213,257-270,292 -346,411-444,478-513
  Gene Ontology: Mol. function=general transcriptional repressor activity; Cellular component=nucleus; Biological process=negative regulation of transcription
atgaggcggtccactccaaatctgttcagcgtccctgactatcagcagccgagcgcatttcgaccgccgcctcccgcagccgccgcggttgccaaccttttgcagtcgcagcaaccgcctcaacagtcgccctcctcagtcgccgcgaacgcgtcagcgacggttgcggcggtcgcactgagcaacgcactgtcttccgttcagcaactgctccaacaccagcaacaacaacaccagcagcaacagcaacaacaacggcttgccgcgatggcagtcgctgccgccggcgccgctaccgccaacggactgttccggcaacactcatttggcggcatcggcttcaccgagcagcagcagcagcagcagcagcagcagcagcagcagcagcagcagcagcaacaacagcaacaactggtgcaactgcaacaaatcgctgctgtgccgcaacaacaacaacaacaacaacaacagcaacaagttgctcacaatcagcaacaaaattcgccaaaatga

SEQ ID NO: 71936 - DNA, 153 bp, Heterodera glycines
  Genomic contig location: Contig_ID=SeqID_9573; Location=76..228; Strand=-
  SCN-specific regions: Sequence locations=1-60,82-96,123-153
atgcgattcaatgggaatttcaagacttctcagatggtatttacaaattctgatcaacgtaaaatttatccttggctcagtgattttcaaaaagttgctaattttttaaaatttttagatatcgatataagagagatgaagctgaccgactaa

SEQ ID NO: 71937 - DNA, 1253 bp, Heterodera glycines
  Genomic contig location: Contig_ID=SeqID_9573; Location=443..1695; Strand=+
  SCN-specific regions: Sequence locations=1-207,229-257,279-494,553 -688,723-800,855-972,1009-1253
atgcaaactttcccaggttgtccaaggcgttttgcacaagaatcggctgccggttgcggtggaaagcacaacagcgagcagtacaacaagacgaactacccggcgagtgcacaacaaccagcgaccggtggtgctgaacccgttgaagacgttccattgccaacgccggctgttgtgccgactgaccgtcgacgacaacacgttcatggacccggaggatgggccaacctcacggctcgccctttcggcacatgccattggcaaccacagcaactttttggtgccattgcaaggcgacaaccggatggagggtgtgccgttggagaacggcgagtacagcttccggctgcaagcccgggaccggatgggccaggtgggcatcggctttttgaataccgtttttatatacgagagttggaaaatgacgagaattttatttgtttttcattgccccgatgtgaaatgttgctttcataaagagttaattaattgcgattttttttttgaatttattagttaaataataattagtaaattttaaattaaatttaacccataaaaagttttgaacttcttttttttgataattcttaatttatacatttcatatatatttaatggcacttttcctatgccgcaccccccccccccaaaatgtcattatcccgacaaacgaaaaaacttttctaaatctttgagttttttattttgacatagattttgattagcacctcaaacagccccggaaattgttttggtttgtcggggtcatgacatttttaggggcgggggcataacggaaaaatacaaatttaataaacagaaataaaaatttaatttttttcaattaaattcattgtcttgcaacaacaccgtattcttggagtcatacaagaaagcacaaattagtacaattctgtacaatttttttactatgtaatagcttaatttgagaaaacaattttgtgtcgctaaattttaattttaaattttattaaaataaatattcaggcaaattcggtgccattccaagtgattgtcaaggagcacagctcacgtgaaaagccaacccacagctattcattgctgatggatgtgccgttagaacgctttttggaccagccgcagtttatgcgcgactttgtgtaccgccttggctcgtctgttcatcgaatttcggatgccgaagcggccgcagaaggtggtgaccgaatggcacgaattgccagcgaaattcaggtgggtttaagaaa

SEQ ID NO: 71938 - DNA, 355 bp, Heterodera glycines
  Genomic contig location: Contig_ID=SeqID_9574; Location=640..994; Strand=-
  SCN-specific regions: Sequence locations=1-355
atgaacgcgcaagtgggcaacagtcaaactcatttgaatttttgtttcatgtttattaaaaccgaccttgcgcacgtggaacttgctgcccatggccttgagaaagtcgtgccgtacccgctccgtgctggcatgcatcatccgatcacgggtggcattgatctgacgatcatcacaaattttgcgactcaatgtcgcattggaccatttcagcattgtttgatgaccaccattgtccaacagttcctcaacctaaaacattttgccaaaacataaaatttgaaatgattaagaaatatgctcgagagtctctgttcatgactcgagaattttctgcctttattatcgtaataaa

SEQ ID NO: 71939 - DNA, 223 bp, Heterodera glycines
  Genomic contig location: Contig_ID=SeqID_44453; Location=1..223; Strand=+
  SCN-specific regions: Sequence locations=1-6,39-223
tcggtaccagcccaacaacaacagcagcaacaacaaaacgtctgcattggcccatgccccagcggcgaattgcccctcgggggtaaaaacccggtgttgtgcggcgatcggtcggactcaatcggctgtccttccggctttttctgcgccgatgggcccccgtcggtgtgctgtcccggccacaaaagtgccgcttctgtcggcgatgtccgacgaaagccgt

SEQ ID NO: 71940 - DNA, 359 bp, Heterodera glycines
  misc_feature (28)..(28): n is a, c, g, or t
  Genomic contig location: Contig_ID=SeqID_44454; Location=799..1157; Strand=-
  SCN-specific regions: Sequence locations=1-96,122-359
atgacagagaaatataagcaaaaaaganaatattcaaaaaatgaatggaaacaaaattatgccgaaatttgtaagaaaattggagttagcaaaactacaataataaaatggaagaaacaatttggcattagcaagaaaagaataacggaggaagaaaaaaaggagaaaatgaaaatttattcgcaaataaaaagagaaaatacaaaaatgagtgataatgaaattgccaaaacattgaaaattcaccaaaataccattataagatggaagaaacaatttgtcgaagaaaattttggaggattgaattgatgcttctaaaaaattagataaatttgaccaaaaattttaaattgaataaa

SEQ ID NO: 71941 - DNA, 1167 bp, Heterodera glycines
  misc_feature (986)..(986): n is a, c, g, or t
  Genomic contig location: Contig_ID=SeqID_44456; Location=638..1804; Strand=-
  SCN-specific regions: Sequence locations=1-198,221-261,284-578,636 -848,870-892,924-1167
tcttacgtgccgtaactagcggtgtgtttgtgcttgctgctacgtccgtggccgtgatgagacgacgcggtagtgcccgtgcttggcctagcacgtggcttaagactcaatgagtgtcagctcgggcaccgccagctttttctttttttttcattatttttttttacacttctgttgaagaatgaattctagtcttatcggtggatcactcggctcgtggatcgatgaagaacgcagccaactgcgataattagtgcgaactgcagaaaccttgaacacaaaacattcgaatgcacattgcgccattggagttacatccattggcacgcctggttcagggtcgttaccataaaatgcactgcttgtgcgttgcttcgtgggatcatgtacttgtacgtgttcttacgttacttgctcagctcggctgtggggttttggtgtgctggcgcgaacttgtggttctaattcgcgttttacggaccgtaactcaagcgcaccaatgctttgcatgctgtggcggagtgcctggattactggcattcctgctttgatttttcgacctgaactcagacgtgaacacccgctgaacttaagcatatcagtaagcggaggaaaagaaactaacgaggattcccgtagtaacggcgagtgaactgggaagagtccagcgctgaatcgcagctcctctggggttgcgaggtgtagcgtatagaccgtgagcttgggttggcccgcttgttcaagtttcccttgaccggggctccagagaaggtgcaagacctgtccaactggcggtgcctacccatctttacgtgtcttggagtcgggttgtttgggatcgcagcccaaatcaggtggtaaacttcatctaagactaaatacggccacgagtccgatagcgaacaagtaccgtgagggaaagtgcaaagcacttgaagagagagtaaagaggacgtgaaaccgatgaggtggaaacggacagagcntggcgtatctggtctgcattcacccgtttgttgctgtacgttgtactgctagcctccagactggggtttgctgtccttctgttcagtggcgaatggggcatttgcaggcggagtgcgctgagatgctcggagtagctgcgtgagctcggtcttgaggccagccttttggggtctggtaccc

SEQ ID NO: 71942 - DNA, 351 bp, Heterodera glycines
  Genomic contig location: Contig_ID=SeqID_44456; Location=420..770; Strand=+
  SCN-specific regions: Sequence locations=1-20,51-351
atgacttgcgcatacgctaaactccttggtccgtgtttcaagacgggtcgaacagatgaccggcttttacaccgagaacgcacaagtgagagcccgagctggaccgaactggttgctggtacgtgtcgcacgcgaccgccaccgacccccagctcgagtcaacacggacccgaaaccattgcacaattcacccagagtaaacagcactcccccgatccgggtaccagaccccaaaaggctggcctcaagaccgagctcacgcagctactccgagcatctcagcgcactccgcctgcaaatgccccattcgccactgaacagaaggacagcaaaccccagtctggaggctag

SEQ ID NO: 71943 - DNA, 976 bp, Heterodera glycines
  Genomic contig location: Contig_ID=SeqID_44457; Location=593..1568; Strand=+
  SCN-specific regions: Sequence locations=1-778,800-976
  Gene Ontology: Mol. function=ubiquitin-specific protease activity; Cellular component=cytoplasm; Biological process=protein modification
atgcaacgcgataatttgctcacttgccttgccgatttgttctcaaacatttcgagtcagaagagaagggttggaacaattgctcccaaaagattcgtcacaaaattaaagcgagaaaatggtagtttcaattaaaaaaaagatcaaaatttaaacggttctaagattttttgcttttttaagaattgttcgacaactttatgcagcaagacgcacatgaattttttaattatttgttgaacgcaatttctgaagttttaatggaggagaaaaagaaggagcaattgggcggaagcctaaggaaagccaacagcgcaatggcaccaaacaaacggtcgttttccgcgaatgcaaaaggccaacccaacgatttgtccgcaaagcaattgaccaggtactatttatatgtaaaactatgttgtatacatgttatatcaaaaaactaaaaaaatgcataaaatgggttaggagattttttttttgcttttttactgtttatttttgcaaaatgtcgattttcaagaagtctttctttttaatgggtttttgttaaggcaacatccctaaaaggtattaaattacgtgccgagcattatgcattattacaaaaacttatttttttcttcgtattggccaaagaacattagcagaaaaacccgccctaatgatatttttaagcacttctgacatcactggtcaacaggagttgacgtggattcaagaagttttccaaggaacgcttacgaacgaaacgaaatgtctgaactgtgagacaatcagcagcaaagacgaggactttttggatttgagtgtggacattgagcaggttttggccattcgatgtgccattgtcaagccgaattggctctttttcagaatgtttccattagccattgtcttcgcaatttttccaacatggaaacactgtcgggtgaccagaaatatttgtgcgaaacatgcggcagtaagcatgtaa

SEQ ID NO: 71944 - DNA, 862 bp, Heterodera glycines
  misc_feature (50)..(50): n is a, c, g, or t
  misc_feature (63)..(63): n is a, c, g, or t
  misc_feature (69)..(70): n is a, c, g, or t
  Genomic contig location: Contig_ID=SeqID_44459; Location=259..1120; Strand=-
  SCN-specific regions: Sequence locations=1-213,245-325,347-407,430 -515,540-667,689-862
atgagcctgggactcgtgtttttctcattggctgacagcaaagtgttgcncaatttcgacccncgcggnnctatgaatgatttcactcgctttggtggcggatgcgattattggcaatgtgcaggagaaagcgatgagggaatataatgcatcaaacgacgaaaatggtgaatggacggggatagggcgctgacaaattgaataaagcgaaaaatgacaatttttaaattttttggggattttcatgccctaaaatcgaaccgatagtcatttaaaggttcggttccgttcgcagtttatggctatggctaatgtccattttgatggttaaattgaaggtgctgttctcctattccatcggtttcgcctatattttggtcggcctttgcctttccggtcagattggcgaggctttccttttctttgcccaagtttgtcttcttcgtcctcctctgtcccccttccccgcccctatagcgccctctccaaacttacggctattccgttctgattggcatcgtcggctatttcggcgtcaatgttgtgctcacaatggtcagaacttcgggtgctttggtcaccgttacggtttggagccgaacagagtccgactttcttttcccattcgttaatttaggtcaccacaatgagaaaggccgttaccattgttttctccttttactttttcgccaaacccttcactttgggctatttgtggggcggtttggtggtccttctggcaatttacctcaatgtgtacacgaaaaacaaaaagcaatttgacgcgaaattggctgagtggtggtcgaatctcgcggagtcatacaatggccaaaagtttgccgctgagcgtaaattattg

SEQ ID NO: 71945 - DNA, 636 bp, Heterodera glycines
  Genomic contig location: Contig_ID=SeqID_44461; Location=145..780; Strand=-
  SCN-specific regions: Sequence locations=1-169,209-219,241-402,487-636
atgcgcgactgtgccaaagcgaaggccgaaacaattgccatcctccgaatcatcgcccatttcaaaaacggcaaaaacgaaacttggcgtttcgtttgtccgctgattgactatttgaaatatttgacggaccgaacgtttaacgcgaaagagaaatggccagcgaattggcaatgttatggtgcggaaatggcaaaaactgtgagagagcaacgcaaaatgctgaaaaataaacattttgaattaatcgacacgcttttaaatgatgggactgaagaaaacgccgaatttttaattatcgtacgcgaacagcgcggtacggtagcgaaacttgagcaattactgtacctaaacggcatacttaaactgtgcgaaaggccaaaaatgcaactaaaactgatgaataaaaaatgtaaaatgattatttatttataactaattaatcacaattaattaaaatgaaaaattaatttaaaaatattaatagtgactaatttacatggacaaaaatcattaatacgataaaaactataaaatatgcaaaaaacaatccaaaaatgaaatatgattaaaatatatatccataaaattccaattaaaatctaaattaagcctcaaaagtacaaaattaataaa

SEQ ID NO: 71946 - DNA, 756 bp, Heterodera glycines
  Genomic contig location: Contig_ID=SeqID_9575; Location=389..1144; Strand=-
  SCN-specific regions: Sequence locations=1-186,213-282,304-756
  Gene Ontology: Mol. function=protein binding
gaattctctcgtcgctgcttggattacattgaccaaaatgccgaaactttatttgaatcagaggaatttttacaaattgatcaaaatttgttgtgcgaaattttcgggcgtgaccaattgaaaatcgccgacgaactcatcatttggaatgctgtactaattaacgattatattctattaaaatgctaatttttattaaaaaattattttttcaggcactccgttgggccgacgaaaagtgccgtcaaaatgccgtcgaatgttccgctgagaatggtcgttctgcgcttggcccggcactgttcaaaattcgctttcctctcatctcgacggaattttttaccaaaagcatcggtatcaattgaatttttaagctaataaaattagttttccggtttatctcagttgggccccggcacgtttgggccaagcggggttttggctataacttttttcttcgccaaccaaatccaacaatcttggtatcattcgatagccctaagtgtcctatattagcctgaaaaattttgaaagatttcgctaaggttcaaaaaagaatgataccaagtttgttggatttgtttggcaaagaaaaaaattatagcaaaaaccccgctggggcccaactgagcgagtccgattagtttcatatattatttttgcagttccttctggcgttttgacaaccgatgaatttctctccgtttatcagttccattgcagccccaatctccgtgatgtgcccggccttaaacc

SEQ ID NO: 71947 - DNA, 435 bp, Heterodera glycines
  Genomic contig location: Contig_ID=SeqID_9576; Location=8..442; Strand=-
  SCN-specific regions: Sequence locations=1-107,158-435
atggcgtcgtcaaaatcgggcattttggcggatcggatgaagcatttgttgggcacggctaaacttgcggatgcgtactttttggtgggggacggaaaggaggcgagtttttatttcaatttttatatatttctaagttttatttttgattttttaagcttttgtcggcccataaactcattttggtgtccgcttccgacgtttttgaggcaatgttccgttttgactccaaaaatggaaaaccggaaaagggtaaaggaaaaatgcgttgtgtttaaaatttttttgatttttcaatgtttttagcctctgtcgacaatcccgtggaagtgcccgacgttgaaccaacagcgtttaaagtgatgctcagcttcatttacgcggacgatttgagcgaattgaacggagacaacgcaatggcagtgctttgcgcgg

SEQ ID NO: 71948 - DNA, 62 bp, Heterodera glycines; identical to SEQ ID NO: 67267
  Genomic contig location: Contig_ID=SeqID_44462; Location=753..814; Strand=-
  SCN-specific regions: Sequence locations=1-62

SEQ ID NO: 71949 - DNA, 986 bp, Heterodera glycines
  Genomic contig location: Contig_ID=SeqID_44463; Location=105..1090; Strand=-
  SCN-specific regions: Sequence locations=1-374,396-673,695-826,853 -935,978-986
aaaacaaaaataaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatatgggcgcatcggttcggggggactgccccgaaaacaaaaaaatctattttttcaagtgtccgtttggggtactcaaacatttatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaaggtaaaaataaagtagaggtatatcgaagctattcccgaaggattcggactccttataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagact

SEQ ID NO: 71950 - DNA, 661 bp, Heterodera glycines
  Genomic contig location: Contig_ID=SeqID_44466; Location=420..1080; Strand=-
  SCN-specific regions: Sequence locations=1-198,257-267,331-511,534-661
atggacagtttgtgcggctcttcggatgacacgccgttaccgcagaccaaaaagtctaaaatcattcggaagaaactttcggctacattcaaggtactttggaattgattagaaattcgttttttgaattggaagatcatggaattttagggacgggaaaaaatttcaccgaattttgccgttaaactttgaaattttcaaaaaatcttattttttacaagaaaatttgaggaaaaattttgtcaatggttcttttctggaattttcatataaaaatttttcttattgttagattttttcttgaaattttaaaaactttttaaaaaatttcttcggtgaaattatgtcccggctaaattttggggtgcacccggaatttctgtttttttttgcgcggacatttcaattttgtttcaggccgactcgaaccgcgactctgtgcaggaggtcttggatgctttagacgttgttcaaacgagagatagccatttttctgggatagagtataaagttataaattccctcaaaaataatcggactattgcgcaccgccctccctatcatgctcgagagcatttgtatgtgtataaaatttatcaaaaaaagagatacccatttttctgggataccctctaaatataaaaatcctctgtgaaataaa

SEQ ID NO: 71951 - DNA, 484 bp, Heterodera glycines
  Genomic contig location: Contig_ID=SeqID_44467; Location=64..547; Strand=-
  SCN-specific regions: Sequence locations=22-214,236-484
atggagcaggaggagaacagcgagaagagcacaacgccaacaacggaaagtgacatcacactgtctgaccgcatgcagcgcaaaagcgacacatcgtcctcaacaaatatttgttgcgacgaaacggccgaggcattttttgacgcaattttgccgcatgacaaacttcaacaaccgcagcagcaaccgcttcagcgtacgtacacgacaacatcaacaacaacgacagcaaagaggcagttgacggaggacgagcgacagctgttagccgacgtgatcgtctccagcatgtttggcacgtcgagcaatcaaacgaacggcgaagacgctgcaacaaattcagctgcagcggaccatgctggtggcagcaacagcacaatacgtcaggcggagattgacgagcagcagcattacgctgcaagcacaacttcatcatcgtacgcctgcacagtctcttccacgtccaaacaagctgatggtccag

SEQ ID NO: 71952 - DNA, 1316 bp, Heterodera glycines
  Genomic contig location: Contig_ID=SeqID_44468; Location=203..1518; Strand=+
  SCN-specific regions: Sequence locations=1-395,438-511,587-726,749 -878,900-1215,1245-1316
gtatttacggagaatcagcgaaggtgcggatccgactttggtggacattgagagtttagacgaggaaagtggggacggggaggagcgggacgaagacggaccaatggtcggacaaacggtggccgcgtcgtgcgaagcattcgccaacagtcgaatgaattgtggtaagaacacagagatggatgaaggggtgttgtcagagagagtggcgagctcaaaagtacaaaacacagcagatagtcataaccacaaaaacaaacaggaattctcgcttttctatgacgaaatttttgttattttggggttcaattttcaactaatgataaaatgggtggtccagcggtaccgtcggaaagcgccgccggaaatttttttaggaaataaaaaaggttcacatttttttgaatttttaaaaatattataaataaagaaattttcgataattttttcgctgggttggggagcaaaaaaatttaatcagaaaaagaacaattaatgcgtgctatttgtgagcaccgtggcgcagtggaagcgtgctgggcccataacccagaggtcgatggatcgaaaccatccggtgctatcatttttttctttttttactgacaataattgttccattaccactaaaattattttattgtataatttaggaagacgagcaaaaccgaaaaggcaattcattacgccgaaagtacggcaagcagctccaaaaggggtgatactaaatgggtaattgttttggaatcattttaaatttattttgccagagtaaatttgtgtctgccattacccattcgcattggaagtgcaaattgtgcagtgccgacatttacgcggcggttattagtgccggcgttataaaacacttcaaaaaattccatcgttcatttttgtccactgttcaatttgagctttgcaaagtaaacattttattggacacataaccgtaaaattctactcgaaaattaaggcgagactcgagaaaataagcgacggaaaaatggaatttgttggagaaaagctaatcgaatgttcaatttgcagccaaagttttcccgtgacacctccgttcaacatttgtagagccatcagacacatcaaactaaagcatccggaagtgatgccggaacacagaggcggacagagtgcccgggtgggtgggaaaggtgcaatacgtttccatccctcttcatcgtattcaaactccgcccgaaaaaattaaaaaatttttttaatttaatgagattttctagtaacaattataaattttgttttttaggatggatttcaatgccaagagaagcagcagaacg

SEQ ID NO: 71953 - DNA, 623 bp, Heterodera glycines
  Genomic contig location: Contig_ID=SeqID_44469; Location=696..1318; Strand=+
  SCN-specific regions: Sequence locations=1-36,58-324,346-623
atggaatggacgtcgcccggatcaacttcagtcaagaggaccaagaagtgagttttttcacttctttgaatttttgagggccatcttttagtaaaataataaaattgcagtatcaccgtgttaccatcaaacatgtacgtgaagcagctatcaaatgcgacggaggacgtgaacaagcgcatcgcgtacggcatcggagtgggcaaggagcgcgggttcatccacaacggcgactttgtggtgattgtcaccggatggcaagcgggtcagtgtggttgggaagtgacgcatttactcattcatcccccgtctttgcctccccaaaatttcaaaaaatagagaattttgatcattgattgggcatggcctaattagagcattccttgcttatctttttgtttaattgacaatgagtatcccaccacatgtaaatgattgattgccccatttgttctcaggtgccggctccacaaacacaatccgtttgcagaaagtcgaataacagagggacgtgtccaatgagcttttgaagacttcgcgtgaccgatgaaaactttttttaggaatttacgcttttgtgacttttgttttcatatttttgttgactcggtgtttatgctcaa

SEQ ID NO: 71954 - DNA, 563 bp, Heterodera glycines
  misc_feature (514)..(514): n is a, c, g, or t
  Genomic contig location: Contig_ID=SeqID_44469; Location=1..563; Strand=-
  SCN-specific regions: Sequence locations=1-40,63-143,165-196,233 -362,384-563
gcacgttggccataatttataagggtcgagggtcgataaaatttggtatatttttatgtatgaacttggaatttcgaaacaaaaatttattgtttcactgaggcaaacgaaaaaaaaggcaaaaaaaaaaatcggtttgtaaatataaaaatgaaatattgtgtgtgaaaagatagaatcaacaaatgacggatcgaaaatttcttttataaagattttgacaaaaatgaccatggtcatgaccatagctatgagagtgggaagagaagcaaaaaaaagaatcgacatgccaattcaaagcaaaatttaaaaatttactttttaaaatgtaaattgttatcgcccaccccatattagagaaatcctgaaagaatgaaacaattcatttattgaccattttctttgcattcccaggaaattcacttttatgttcgtagctgtatagaatgatcattctttgatattccaatggtttatgaccaaatttagattttttggtcaattttggaaccanaagtgagagatgagaaaattttcgactttttgttcgaattcgggtccgg

SEQ ID NO: 71955 - DNA, 653 bp, Heterodera glycines
  Genomic contig location: Contig_ID=SeqID_44470; Location=226..878; Strand=+
  SCN-specific regions: Sequence locations=1-34,85-212,236-653
atgttatcccaagaagagacagaggatcgattggtaaaaattttaattattatttaaatgttgatttaattctttttatttattcaggagcgaacctctgtatgcggaattgaaggatctgatggtttgtccgggcgatttgcggaaatgtctgtcacacttcggacatcggaaggatcagcgcaacttggtcgtcgacgagctggattggcacgacgacgacgacgacgacgacataacagaaggagcttggtgaaagagctatgcttgtttaataaatgtcgaccggaatatctcgcgatgatgcttcgaagaaggaagaaggaaaatatcaaatttataggcgatcggaaaatcgaaactgtacatcttcgacagaatttacaaatttatccggaatcatttactctttttggtgctaatcgtatgtacgcctatcgtggtatgcttggtgtcacggtagagcaacatttatacgctaagcatcgtgtccgtctaaaatttcccaacctcccatgtgttgtacaagatggcggcaacggccatcaaagttatttcccacttgaacttttgaaaatatcttcgttagctatgcaagatgaaactgcttaattatttgttgtatttttttaatggctgcaattataaagaaa

SEQ ID NO: 71956 - DNA, 177 bp, Heterodera glycines
  Genomic contig location: Contig_ID=SeqID_44471; Location=466..642; Strand=+
  SCN-specific regions: Sequence locations=1-8,31-177
aaaatgttaaaaatttcggaggtattttttctaggcttaaaaaatgcgctgatcacgaatctgaactcagattttgaaaatcattgatttttatctaggatttttcatcaactacttgatttttttccaaaattttaagaaaattagtcgggcttaaaagtcacacacagatgttgt

SEQ ID NO: 71957 - DNA, 881 bp, Heterodera glycines
  Genomic contig location: Contig_ID=SeqID_9577; Location=785..1665; Strand=+
  SCN-specific regions: Sequence locations=1-324,347-630,658-881
  Gene Ontology: Mol. function=RNA binding; Cellular component =nucleolus; Biological process=rRNA processing
atgacagatgctcagcgttttcaaacgattgtccaagttcatgcatttgacccattcagaaacactgaggcggcgcttgaaaatgcgaataacattgcggaaggttttgttttttattttcttgtttgattattgtttttagggattatccacgttgatttgctgaactttttggaggctaatctaccgaaaaaaaagaaaaaggttctgcttggagttggtgatcagcgtttgtcagcttctctagtagaggcattaccaggtacattttatttttgcgaccaatgaaagattatagcaatcatcgaagcacgaacccattcgctctttcatggaatcataatttaagcgaaaaccatttaatttttcctcattttttatgtattcgtgttgctttcaatggcgtcgtgcaggaattgcttcggggcattcggatgcattttcgcgtgttggccaaggatttgccacatgcacaactcggaaaggcacaactttcattgggccatagctattcgagatccaaggttaattcaataattggtaacggatggataatatgaagttctacgatttaaggtgaaatttgacgtccatcgtgtcgataacatggtgatacagtcaattgcactgcttgaccagctggacaaagacatcaacttgttcggcatgcgcatcaaggcttgtccattccatcgcgaatttattcccgtattgtttgaatttaggaatggtacgcttaccactttccagagttgattaaaatagtgccggaattatacaaatacgtgtgttgtgcaaccgcaattatgaatcgagaaaaaatggatgaagcggggaaacgaaagtcaaaggtactaccgagaaaatttgacaaagtttaa

SEQ ID NO: 71958 - DNA, 514 bp, Heterodera glycines
  Genomic contig location: Contig_ID=SeqID_9578; Location=313..826; Strand=+
  SCN-specific regions: Sequence locations=1-121,143-318,340-514
  Gene Ontology: Mol. function=RNA binding; Cellular component=small nuclear ribonucleoprotein complex; Biological process=rRNA processing
caaatacgccgaaatatggtcttttgttccattcgactttcattggacgcgctcaggccaaacacaaaggtcgtatcagtcgtttcttggccaataaatgcagcttggcctctcgcatcgactgtttctctgatgttcctgtgccctctttcggcgaagcattgcgtcagcaggtaagcatatccgaaaataaccaaacatgaggaaggtcaacgagaaacactaagggtcgggtttcgataaacgaatataaaacaaccataggtttatattgaaaccataaaaaaatatatgattaaaaaggggaagcaaattaagattgttcaaagctgcttttttctaacaatgaatgagttatttatttgacctatgtaataaatgtttaaatcttaagatgtcaattcctgtttaggtggaagagcgtttagtttattacgaaaaaggagtcattccgaagaagaatcttgatgtaatgcatggagctgttgaggaggcgacagtcgaagttgaaaag

SEQ ID NO: 71959 - DNA, 485 bp, Heterodera glycines
  Genomic contig location: Contig_ID=SeqID_9579; Location=1210..1694; Strand=+
  SCN-specific regions: Sequence locations=1-255,278-485
atgccgaaaagtgacgaaaggattttgggaccatcagggaaatttgagcaatttattctggttatgcatgtaaattaagagatttggcgacggaaggtcatttgggggtaaatgcgaagcaaaggaaaaagggcggatgggcgagacggagcaaaaggcggagggaaagggggggagggactggttttggtgttggtatttggtacatccgacggtttggcgccgtcgcaacttatgggatgatgacgaacgctcaatgcaaaacgatgacaataaataagtgaacaacggagcaattgcagaggatgagaaaggcgaaagaaagcgggaaaaagggacaacggaagcggaaacaaacggagaagcggaaaacgaacaacaaccaaaggatggataagccaattgcgttacttctgaacaattaattaaggaaagaaagtcctctcccatttgatactctaagcaatcggaatttcgagaaacaa

SEQ ID NO: 71960 - DNA, 557 bp, Heterodera glycines
  Genomic contig location: Contig_ID=SeqID_9579; Location=1570..2126; Strand=-
  SCN-specific regions: Sequence locations=1-163,201-557
ggtttggaacgcgtgacgatgcttttccttgggttgcccaacgtgcgtttggccagtctttttccgcgcgacccgaaaagaataacgccatagaaggaagtgagagtttaagcgactttactgttgttttgcaaatattcattcatataagttgttttacaggaaattgtttttgaacaaaaaataaatattgttctggtctcacattttctggattcaccaaatcgaaactcaatgacctctctcttcaagcgaaaatttaagtgaaggattgcacaacaaaaagctgaaaggatggagaggcgacacttgtcccaatttactcttctataaagcccaatctgccgattttttctataaccttaattgtaagtataacatccctcaactaatgaaaaaggattcggcgacctctcaccgcaatatttttatttgtttctcgaaattccgattgcttagagtatcaaatgggagaggactttctttccttaattaattgttcagaagtaacgcaattggcttatccatcctttggttgttgttcgttttccgcttct

SEQ ID NO: 71961 - DNA, 80 bp, Heterodera glycines
  Genomic contig location: Contig_ID=SeqID_9579; Location=2531..2610; Strand=+
  SCN-specific regions: Sequence locations=33-80
gtcctgcccataatatctgtggcatggaataattttggaactgcgctgactaacggcggtgcttaaagtgcgctaaaaaa

SEQ ID NO: 71962 - DNA, 912 bp, Heterodera glycines
  Genomic contig location: Contig_ID=SeqID_9580; Location=1..912; Strand=-
  SCN-specific regions: Sequence locations=1-343,365-878,900-912
  Gene Ontology: Mol. function=ATP binding; Cellular component =intracellular; Biological process=aspartyl-tRNA aminoacylation
ctaatgtaatgtatcatttcatattggggttttaagtcctcccagccattttattggccttgatcttgagatggctttcaatttccattaccacgaagtaggccattacaccataattagatcgtctaattcttttaccgtgctttgaaggttcttcaaactattgctgagatgttcattgacctgttcaaatatttgcaaggcaattacattgctgaaattgaagcagtccgtcggcaatacccagccgagccgtttctctttacacaaagtccactcgttttgcagtgagttattttaaatacactttcacatttattctcccattccgtcgtttttatatttatggggttttgtttttctccaatgggtcttttaagtctaatcttcttggcatcattttttcgtagaaccatttgcttgttcccctactcgtttgcccttgaaaattcgtttacataaacttttccgacaaagactattctattgccgctttctacgggtaaaataataatagtggatgtgctcatcatgttctacggctcctacattattataaattagtgcatttaaattgacttaaattctgcaaattccctcacattctatttttcattactttcataaagataccccgaagcggtggccatgttaaagaaagctggtgttgagcagggagatgaagaagacttgagtacgccaaatgaaaagcttttgggcagattggtgcgtgagaaatatcaaacggtgagtgacggaatgagtgttgagggaaatgaaaaaaatttgaaggatttctatgttctggacaaatacccattggctgtccgccctttctatacaatgcccgacccaaatgacaccaaatattccaatagttacgacatgttcatgagaggtattgcctaattg

SEQ ID NO: 71963 - DNA, 779 bp, Heterodera glycines
  Genomic contig location: Contig_ID=SeqID_44474; Location=70..848; Strand=+
  SCN-specific regions: Sequence locations=1-419,448-467,490-576,599 -609,631-779
atgacttcgcagaaaccggcggaagacgatccgattggtgctgaagaaacagttacgacagctgcagattgtgtcaatgaactgctggaaacaacagaaattcaagcggaagttgatgaattggtaaagagtgtcgttgaatttgtttcggaagcggcctcagcagcggcggatgatgttgaccatcagcagcagcggaatgcggcggatgagtcggcaaagagtcgttttggcatttcgtcacatgaaattgccattccctgcaaggaattcgaccgtctgttgcgtaaaatcggtttaaaatcgggggcaaagaggcaatgccctgggaagaggatgtgccctccgcgcaaagtgaaggcatcggcatcggacggagtcagtgcgaaaatcccaaaactgagtgagaatggcacagctggtgggaagcagaagaagaagaaaatgcaaaacattgtggaatttgaccaaggttatttggggactcacgatcagaattaaaaaaggaaacgagcagggattttgatatcatattcttgtctggcataaattccgaatttaacgaaattactgatgattgaaaatattccttattataagggtaaatcgctaatttgttttgttctttaagtgatggcttcccttttgggcaacttcgaagatgacccaatctttctgaagtgcaaagaagttcagggaatgaccaaagacttggctcaactcacctttcaaatcaaccaatttttgtgccatttcattacgttcatacccgtcgagat

SEQ ID NO: 71964 - DNA, 505 bp, Heterodera glycines
  Genomic contig location: Contig_ID=SeqID_44475; Location=298..802; Strand=-
  SCN-specific regions: Sequence locations=1-133,155-258,287-397,419-505
caaaagttttttacaccactttattgccaatataatttcttgcagatttaaagctatccattgcctgccggttctcggcacagcaaagcactaatacggtgtttgactcacttcaaaaaataattcatcacccaaaagttttttacaaccacttattgccaatctaatttcttgcagatttaaagccatccattgcctgccggttctcggcacagcaaagcactaatagggtgtttgactcacttcaaaaaataattcattacccaaaagttttttacaaccacttattgccaatctaatttcttgcagatttaaagctatccattgcctgccggttctcggcacagcaaagcactaatagggtgtttgactcacttcaaaaaataattccttacccaaaagttttttacaaccacttattgccaatctaatttcttgcagatttaaagctatccattgcctgccggttctcggcacagcaaagcactaatagggtgtttgactc

SEQ ID NO: 71965 - DNA, 983 bp, Heterodera glycines
  Genomic contig location: Contig_ID=SeqID_44477; Location=313..1295; Strand=+
  SCN-specific regions: Sequence locations=1-58,80-499,521-983
atggcacgactcagccacaatttgtccattgcactgctgcagagcggcagaacacagctgagcaaaaggaacaacaacgacggaccaagccaacggaccatcaaacacacaaagtaacgcaaaacggggggggggtggttaaggacttgagaaagcgggaaggtcaacggcttgaggggggaacggtaacgcccttcttttaccgtatatgctctaattatagcccagtctctattaatcccgcagtctccaattatcccccagtctacgaggtgttttgaaaaataatccctctatcataatcccccagtctctaattatccccccttttctgaggaggttgaaaaataatcccccatgagctataattagagcaatacggtattccctcaccccacccgaatttttttaaagaatatttcaagaccaatttcttttagtttaaagtttttttgtttttgttttttctcaaatgtttatgatgaattacttagttttttcaaatttatccaaacaaaatcgctgtgaaaattttctaaaaatttttttgaaaaattcctaattgtggatagggcttgtctaaatcttctgtgtaatgttaagaaaactatcgtttcagggcgctgatcaaagaagtgcctgaagcgatattttgccgaagttttctcctctccaatggctcgctgaaaattgcttcttcaattctgaacgcaaaaaaggccgtttctgcttcttctgatgatgatccgtccttcatttcggagttcgttttgtgcggcgaggcgccgcgcctttgggcaaaagtgaaacaattggagggccaaaaacgctttttggaggcggcgcaacttttggacggtgtcgaagtggagaatttgcggttgatccatcaattcttggccaatcaaatgacagattctctcagacttctactggaccaagcccgtctctaccgaattgcgggaaacacaaaaaggcgttga

SEQ ID NO: 71966 - DNA, 92 bp, Heterodera glycines
  Genomic contig location: Contig_ID=SeqID_44477; Location=512..603; Strand=-
  SCN-specific regions: Sequence locations=1-92
ggattatttttcaaaacacctcgtagactgggggataattggagactgcgggattaatagagactgggctataattagagcatatacggtaa

SEQ ID NO: 71967 - DNA, 280 bp, Heterodera glycines
  Genomic contig location: Contig_ID=SeqID_44479; Location=214..493; Strand=-
  SCN-specific regions: Sequence locations=1-136,192-280
atggtggtgtctgcaaaaaatttagcaccgggtttaaaaaatctaggaaaattagtaagcatttgtagtgttccgatacgtatccctgcaaaatttggtgagcccctgatcaattacaaattatttatggacgatcaaatttttagaaatttttatttatttttgcataattaattcataaatatttttttcagaaaatgctctgaaacgcaccaaattttatttacatgctagtttaggcactctgatgctttttctatcaaaaagggagatgaataaa

SEQ ID NO: 71968 - DNA, 425 bp, Heterodera glycines
  Genomic contig location: Contig_ID=SeqID_9581; Location=6..430; Strand=+
  SCN-specific regions: Sequence locations=1-164,192-425
atggcacctcctccacccccgccaaaaagcaaatcgtcaattgaggtaaatttggtataatgctgattttttgcctgaataatgctaatttttttacaggaggatcaaactcagcagcacgagttggcggcatcgcccgaatgggcacaaaatgatgtgccaacaataaaatgaatttttggcattttgtttcctttttgttacttttaggtggagcaccccgtagtgaaagtgttcggcttccaaccgaatcgattgggccgggaatggccaccgaacccacaacagcccgaagacacacagctggggttgggagactttgtgttctttttaatcttcatttatccataaaaattattttaggcaggccaacaaacacaaaacgttgggggacattgactggatgacagtaaaatgaataacaa

SEQ ID NO: 71969 - DNA, 305 bp, Heterodera glycines
  Genomic contig location: Contig_ID=SeqID_44482; Location=96..400; Strand=-
  SCN-specific regions: Sequence locations=1-305
aaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtatcatgctcaagcgcatttgtatgtgtataaaatttatcaaaaaaagagatagccatttttctgggatagagtataaatttaaaaattccctcaaaaataaaaggtctattgcgcaccgccctccctatcatg

SEQ ID NO: 71970 - DNA, 608 bp, Heterodera glycines
  Genomic contig location: Contig_ID=SeqID_44486; Location=18..625; Strand=+
  SCN-specific regions: Sequence locations=1-41,63-233,256-479,502 -528,564-608
atgtcaagcgatgtgaagccaatttttgttcacatatttacacttaataaacaaaaagtaatcttaatgaattgtcaaaataataaattcaaatagtattttctgaaatttttgggaccgattcttagaggtgcatttttcgtttttagtgcatccgtaaaaacttaaaaatctcagccgggattttgcggggtcctagcatttcatagaaattgcgggattaaccccgcgggatcccctcccacaaaaattatgagttacaatccttcaacgggatccgaactgctagataggggtcgcacctgttatgatttatcagaaatcttctaatttggatttatcataaatagggatacgatttttaggtgctaaaaactgctaaaatagttaggttttaggttctaaaaaaccaccaaaataggtgctaaaaatgggaaattaggtgccaaaaatttcggaatttatgggtgtaaaatcgaaaattttttcaaaaagcaaaaatattatgccaaatcataaatgagatacataattttaaaaatcaaaaaaatatataaatttttgagatgattttttgagaataataatttgttaaatgccgtgaaaaa

SEQ ID NO: 71971 - DNA, 590 bp, Heterodera glycines
  Genomic contig location: Contig_ID=SeqID_44489; Location=346..935; Strand=-
  SCN-specific regions: Sequence locations=1-321,343-388,411-590
atgcgggatgttgaagggctcccggacatttggacagtgatgtcatttgacagtaaagtgatttggacaaaattgtccggttctgtccaaatgtccgtaacagtttgaagaattgttttttgttatttaaattattttataggttttcactgaaaatcaattaaaatattttatgcttatcattagcctgctgaccgttttaatgaagaaaaccctcaaaataattagctctgtgaaaaacgccaaattttttaattttcatattgttcctttagcaaaaactcattacacgaaagaaaaaaagatggaaattattagaacatttaacaaggaaaaagagaagcagccaaatttgacaaatgctcaattagcaaaacgattaaaagtaaattacaattacatttacaaatggaagcagcaatttaaaaagggtaaaatttaaacgattctgaatatgaatacttaattaaaattaatggaaacataaatttagacatttcagagtcaaagcatgctttatcgcttaccgattctccttttgacgacaattttttgggcttggaatcgcacaactaaaaacagaaattaaa

SEQ ID NO: 71972 - DNA, 514 bp, Heterodera glycines
  Genomic contig location: Contig_ID=SeqID_44491; Location=164..677; Strand=+
  SCN-specific regions: Sequence locations=1-212,235-514
atgaaaatttataaatggattaaagaatttggtcttcaaaaacaaacacagaaaagctacaaatcaaaaactgatgaagaaaaaatagaaattgttcaaaaattcattgaaatgtcaaatgaatttaaacgaaaaagaaaatattcaagaaaagaatggaaacaaaattatgccgaaatttgtaagaaaattggtgttagccatggaacaattaataaatggaagaaacaatttggcattcgctgtaaaagaataacggagaatggaaaaatggaaaaaataaaaatttattggcaaataaaaaaagcaaatcaaaaaatgagtgatgaaacaattgcaaaaacaatggaaataaatcgaaatatttttttaaaatggaaaaaataatttggggaaaaaattttggaggattgaagaattaacgatcggaagaaatcaaataggaaaaacaaatgaaatagtgaagcataataattattttttattcgtaagtgattttattttaacatctata

SEQ ID NO: 71973 - DNA, 1355 bp, Heterodera glycines
  Genomic contig location: Contig_ID=SeqID_9585; Location=1204..2558; Strand=+
  SCN-specific regions: Sequence locations=1-32,54-76,103-395,417 -527,560-637,661-1355
atgaagaaaaagcaaattgatcaatttcttgaagaaatttatgacaaatgtggagaagaaaaggtggaaaattcagaaataattaataaaatattaaaaaatggaaaaaaaatgatgaaaatcattgaattctgaaaataaaagatgaacaaagaattgaaattattaatcaatttgttataatgcaaaatgaattggacgaaaatggaaaacgaaaaaaatatgaaaatgagaatgaaattgcgaaaattcaaattttatttcaacaaaattccattttttttactaattattgagatggagtatggccagccccaatacctttgaagtaagggtaacggcgcccaaaagaaaggcgcgccctgggaaaatgaaaaattttggcccggtttgcaagaaaatgaaattttgtaaaatttacccctcaatttggaaaaaattatatccatatttcgcgatttttggtccctattttatggccatatttcgcaattctatatccatataattccaaaccctaataatgatattaaaaacaaaaattttaaaaggaatgtattggtttgtgttggatctgcatttttggcttaattcattttttccattatttatttgtttctcttttctccgtttttggcatttgctatgttgtaatttccctggcccttctgttcctcactcactcataaaagggaccccttcgtccaatccatcgaaaaatattcttctaaacaattttgtgtaattccatctgtttggcccctcccatttgtcattggtatttaagtctttgcttattctcttatccttaggatttcactcacccattcgttgactcaggttccctgcctaaagcgatacaactcacttaacaatttgctttgtttttcttactatttaaaaagcgatcattctttatttaactttgcatttccacttttgatttccattttaataaattgtcttaaaagaagccttgctgaaaagtaaccgggaaaagttcagagtttgggtacggacacaacacattttggtgccacgacccgggacccctaaaagagtattttaaggggcatctcaggctttgtgccgggagaaaaaaagcaaggaaaatttgagctggtcaaagctgtgtgcttccagccgggctgttgtgccgtttaaaaaaaagtgaaaaaggctggtcaaaagtgtgtactttccagtcgagctgggtgcttaacacgagaaaaaaagaagaagaattgaatttgaaaatggaaagtgaaatcaacatttcacctaacaacgtatcggactttgatcccgttcatttcactcccgaagaaaatacttggtcgaatgcgagcatttga

SEQ ID NO: 71974 - DNA, 1484 bp, Heterodera glycines
  Genomic contig location: Contig_ID=SeqID_9585; Location=2695..4178; Strand=+
  SCN-specific regions: Sequence locations=1-12,34-38,60-110,132 -559,581-1042,1065-1484
atggacacatttgagaccaaagaaaagtttattgaagtggaggaagaaattggaaaggtaagtaatcatatggaacgttatgagacgttcacaaaggttcgatttgggaaaattgttggaaaactgaaggaggaggttcggaaaattaccgaaaatttggatgttctaaaaggccgagtacatttgttggaatttgaacaagataatccagaaagacttggtgaatggtatgaggacaatcccaagaacataatcgattgcctgatgacaaaggggcaacggaaggggaagacaatatccaaattggggacgaaagttgcgaaattatggttgcagctccatttttagggggaatcacccccctcgagggttatgatggaaacccaagtgtatcattctcacggtgggttgcacgtttcgaggatatgctaacactatacccacagtattctgaagtgcaaaaattgagcagattgagaattttactcagtggacaagcccgagccgactttgactcaagtgaaccctcacctgtctctctttctgatgttctaaaccatttaaaaagaaaatttgaaaacgaaaatactcggtcaattgccaggcaggcaatggcaagttgcagaaaagcaccgggcgagcgtgtctatgagtttgcaaaccgactaaatgaggtagtcagaactgctctatcaggagaaaatgaggagacaataagaaagagacttcttgaagaatttcttgaaaaattaacccccgaattgcaattcgaggtcatattcaaatgcttatgaaattgctcaagattttgagcttcttcttgccactaagcggactaaccaagtgtctgtggcagattcattcgctgaattgacgcataaagttgaagcattgtccatccgccaacattctgtacctaaaagaggaatagaacggcgcgtctgttactattgtcggcgtccaggccatgttctaaaggattgtagagacaagaaaagggacgaagaaaggagaggacatggtggtcaaagggaccgaccgtttatggggaaagaaaatggaattatgagagaaatgaaagagaacaccggcataggcatttttcaccccacgacaggccaactatggaggaaatgagagggaacaccgacaacggcacttctcacccccacaacaggccgagccatggcagaaataatcatcggtcaccaattgcttatgaaggaatggaatatgaaaatgagcgaactcagtcgccggggaggcgagttcaatttggtggccatagaataggagcagcaaggattgctagcccaatttttctagcattaatggttattctttcattgttaggtgcaaattttgcgacaaattcggtggagagcccaatgatttgccatcccgattctcccgcaactttatggtcaatcccaattgacccggtttgtccaagttggacacaacggaattgcctgtggcaatga

SEQ ID NO: 71975 - DNA, 1838 bp, Heterodera glycines; identical to SEQ ID NO: 9586
  Genomic contig location: Contig_ID=SeqID_9586; Location=1..1838; Strand=+
  SCN-specific regions: Sequence locations=1-534,556-747,769-982,1004 -1220,1242-1765,1787-1838

SEQ ID NO: 71976 - DNA, 407 bp, Heterodera glycines
  Genomic contig location: Contig_ID=SeqID_44492; Location=145..551; Strand=+
  SCN-specific regions: Sequence locations=1-76,98-112,134-206,240 -331,353-407
atgcctatctctttttgtgagaaattttctatgcaacacacgctctcgaacatgaaacgaagtgcggtgcgccatggccattttatttttcaaataattttctatatttaatagatattccagaaaaatggctatctcttttttggagaaatgttctatgcgcccatcgctctcgtgcaagaagcgaagtgcggcgcgacatgcccattttattaatcaaataatttttatatttaatagctcttaagggggatacaaacgccaatgagtcccgaaaacttcaaaaagggtctttcataaacttatccttaaaatttctctgtactgcctcaaaattatttataaaatgaaaagtgaccatttttcccactaattgaattctatttttcagctcattttatgccaaa

SEQ ID NO: 71977 - DNA, 308 bp, Heterodera glycines; identical to SEQ ID NO: 54826
  Genomic contig location: Contig_ID=SeqID_44493; Location=337..644; Strand=-
  SCN-specific regions: Sequence locations=1-62,90-102,137-153,261 -261,293-308

SEQ ID NO: 71978 - DNA, 555 bp, Heterodera glycines
  Genomic contig location: Contig_ID=SeqID_44494; Location=618..1172; Strand=-
  SCN-specific regions: Sequence locations=1-471,552-555
atgccgctcctccgatgcaacagccgtccggtgggggtcacgttcctcgtccggtccgtcccaatgttgaacaaaatgccaatggcaatcaacagcaacaggttgcttgtacccccctccctcattaccaaatttttctcccgcttataaccattttttcctccaccttttttctttccatacccactttttccaaacatttttcctttccctagcgccgaggcgcggctccttaccgccgcaacaaccgcaactgcggtcaacagccggcaaacgccacaaatgcccaccagtccgggtgccaaggctgtcccagcccgcgctccgactccgcgagtcgaacaaatcctgaccgagttgttgggtgaagtgcacaacttcactggtcaattcgcgcacttcgctggtcagttctctcgcttcttcgcccatgtgaagaagaacaccatccctccgcctttgctaaacggtgatgacgaagaggaggaagaagaagcagaatcggaccaggaggagggggaagtcgaaaaggaaaacggacagaaggatgattga

SEQ ID NO: 71979 - DNA, 65 bp, Heterodera glycines; identical to SEQ ID NO: 59656
  Genomic contig location: Contig_ID=SeqID_44496; Location=937..1001; Strand=-
  SCN-specific regions: Sequence locations=1-20,56-65

SEQ ID NO: 71980 - DNA, 1800 bp, Heterodera glycines
  misc_feature (28)..(28): n is a, c, g, or t
  misc_feature (1376)..(1376): n is a, c, g, or t
  Genomic contig location: Contig_ID=SeqID_9588; Location=429..2228; Strand=-
  SCN-specific regions: Sequence locations=1-147,170-395,419-787,809 -823,845-985,1033-1117,1148-1167,1215-1362,1409-1436,1460-1542,1602 -1700
atgacacgtttttcacacttccgcaaanacggtggtgcttctacaacaactgatgatgatgatggtgttcatgtgctaattgccaaaattagggtacttttattatgctaattgccataattagtgtccgtttatcatgctaattgccaaaattagggtacatttattatgctaattgccataatgcttttatcatactaattgccaaaattagggtacgtttttttatgctaattgccataattagtgtccgtttatcatgctaattgccaaaattagggtccgtttatcgttgctatgtcgttataaaaaagccataaaatagggcgttataaaaaacctcaaatgaaattttcaaaaaaacaaaaaacaactacctataacctaaacccaacttaaattttattcttgatatcattcgatagcactaacagttctcaattatcataaaaatttcaaaaaatttcgtcaagtttgaacaaagttattgcaaaaagtacacaagcaaccaggtttgcaaaaaaaattttggccataacttttttgaagctttaactaaattttacaaaatttttcaggctagtagaaaacacttagtgctatcaaataatatcaagaaaataaaaaattttggccttaaggatgaattgattaatccgcttcgacgaatgaatgcacaaaacattgattttgcttgtcttaaagcgattttattgctgcaaccggacgttgctgaaatgagtgagcaagcaaaaaattggtaagacttagaaaacaatgaaattttaaacaattttcatttctaaataaatttccctcttatttttacaaaatcgaaaatttgttttttaaattgacgagcttttttaaacgactttttctaaattttgcgacttcgagccaattttttgaaaatagaaattagtatttttttagaggccagttgtgctgataggtgccgcttggaaaatttttttttgagggcatttttaataattttttttgcagaaaatttttaaatttttttttattccttcttttaatggtatttatttaatttattggcgccgccaccggggaaattttttaggcatttttattgattttttttgttaaaaaattgggttaaattttaaaatttttcttatctcctcccttcgatggtacttatttaatttatttaaatgaaaaactatttattttaacaaaaaaatggttttttgaacaaatttaggattctccaaaaccgtgacggccttttgcgtgccattttggtcgctggaaattccaccactgaagcatccgtgtgtttggcccgaatgcttctgttactgcctgcattgttcacaattggacaggtcctaaaaaatttttanaatttttttaaaataaatttaaaaattttttaggcaatcgcacaaaataaatggatggctgaaatgcttggcattgagccaaaaggcgtcgcaaatttggatgtttcaaattcaaactcatcaccggaagcaaggccagtgagcttggaaatgccaaaaaattcggtaaaaatttaaaaaattaaaattaaaatttttgaaaagcaattttttttttaatttttaggcgcaaaatgttgtgaaagaaaataaaattgctgaaaaaattgatgaaactgctcaaaatgatacagatgttgttgtagtggaagcaaataagatgccaataaataatgtaaaaatttgtttttttaataaaaattattttagttttaattttttcattaaaatagaattatttaatatattaaaaaatcaaaataaa

SEQ ID NO: 71981 - DNA, 1123 bp, Heterodera glycines
  Genomic contig location: Contig_ID=SeqID_9589; Location=256..1378; Strand=-
  SCN-specific regions: Sequence locations=1-133,238-245,267-279,416 -522,587-716,763-907
  Gene Ontology: Mol. function=ligand-dependent nuclear receptor activity; Cellular component=nucleus; Biological process =transcription from Pol II promoter
ccgttttacaaatgtgtgccgtgtggacaaagaacggcgaaacgcgtgccgttcatgccgttttcgaaaatgtgttgcgaacggaatgcgaccagatgcaattcaaaatgagcgtaggaaaaaaagcttttccttttttattaatttaatattttagctaatttaaataaaaaaataataataattcgtcaatcaattcaaaatattatatatatataaattgatttcttttatattgttactttatggcaaataatatataaaatttcttctcaatatattaattaacattagttacataggattatttcttttaataattatcgcattaattaattagtgtatcaatctttaattaaatatattttgtaaaattattttttaattacctataaataattatttaattttttaaaggtgatcgcatagggtcaactcgtcgtataatgaaacaggttcttgatgatgcgcaaacatctccaacaacaatttcagacggaataaccgacgaattaattggggtaattaataaaaaaaataaagaaaattcattttgttatttacctaattaattttattttttataggactcaaatagtgaaaataatcataatagcaaatcgccattgaatgttgttcaacatcaaaaacattattcatttgtcggacagatgggaacaaatagcaaattaattttggaacaattggtaaaaaaaaattaattaattaaatgtataaattttaattaattaatttaattaaaaaacttagttggaaattgagtcgggtgtccaatttgcgcccgttttgcactcgtcaacagcaattcgagatcgaactttccaatatttgaacaaatggtcaaactcattgcacggattttctgagttgaaattcaatgataaagtaaaattaataaaatcataaaaaatattattttatataaaaagagaatttattaaaataattaattgtgtccctttaaaagtgattttaattatttgcccaatttattaattatataaaaataattaatatataaatattttgtagataacatttaaacttatatttttttaaattttttctttaattttaaataattgaaaactattttaataaa

SEQ ID NO: 71982 - DNA, 962 bp, Heterodera glycines; identical to SEQ ID NO: 44502
  Genomic contig location: Contig_ID=SeqID_44502; Location=1..962; Strand=+
  SCN-specific regions: Sequence locations=1-315,339-536,558-560,587 -781,826-863,888-962
  Gene Ontology: Mol. function=structural constituent of cytoskeleton; Cellular component=sarcomere; Biological process=regulation of striated muscle contraction

SEQ ID NO: 71983 - DNA, 1472 bp, Heterodera glycines
  Genomic contig location: Contig_ID=SeqID_44503; Location=84..1555; Strand=-
  SCN-specific regions: Sequence locations=1-413,435-1040,1064 -1374,1396-1472
atgcatatgcaactgcacagatgctcctacagttggtgtggtcctagcgacccaatttacgggcggtgcaagaaggggttcccagccccttactcaaaatgtacgattttgcgcccggacaggcccgcgatgtatttccggccttcaccaactgatggtggtgcccaattagaggtaaacggcttaatatacgacaactcacatgtcgtgccgtataatccttatattctgctacgttaccgagtacaccataatgtactgtttgcatatggtaacaaagcaaatattaaatacgcactcaagtacccttttaaagggccaggacattgttatgtcgagtgcaaagaagagtccggcaataaaatcaaaattgacgagccggctcaatatgccaagatgaacttccgtggtgcaacggaagcatatgccattgttcattcaatgccatttgcccgtctttcgcatcatgttgtcaaattggcaattcatttgccaaaccaacagcccattgtatatagggcattccagctggtgagcaaagctcaacaaatccagcaaggcgaactgccagaaacgcagtgttcagcctattggaaacaatggcaaaatgagtggaagaatgatccaaagtttaaggacattcttttcgaaaaagtcccagagcggttccgatgggcaaaggacaaatgggtcctgtacaaaaggcagcaaattaaaaggccacctatcggccgaattgttcctgtacccccatcggacccggaaaggttcgcgctctattcacttatgcgtcactttcctggagacccagaccatcttaagatggttaatgggttgctttgtacctcattcactgaggctgcaataatgcatggtcttcttgaagacgacaaaatttgggacaaaactctggcggaggcagctctgtcgcgctggccagatcagatgagatggctctatgtgagcatcctgctctatggccagccgagtaatgccatagaattgtggaacaagtacaaagaccaaatgtacaatccgcaaggcattattactccggcacagcataaagtagcagaggatagagccttagccgacattgattggcggctccacaactttggctacagttgtgtccattttggcctgccagacccgccaacttcaattgccaaaaatactggcgcggcaattgaagagtttttctttggcgatgatgatttgaatttgcctccagggcaaccaaatcctcgtccacagccaaatacccctccgccacttaacagcgaccaacagaaggtctttgatgctgttttgttggcaatacagtcgaaccctagggattcgactgtcccccgccgtttcttcatatacggcgatggaggcacaggaaagacattcctgtttggccaaattattaggcgcttgcgaaaggccccatacacctacaaagtgcttgctacggcatccactgg

SEQ ID NO: 71984 - DNA, 265 bp, Heterodera glycines
  Genomic contig location: Contig_ID=SeqID_44504; Location=478..742; Strand=+
  SCN-specific regions: Sequence locations=1-118,166-265
atgttaatcactaactccattccagcgctggtaaacctcgaggaccaatcgctgcagtttctcaaccagtctttgcacgacgcggagatggtaattgcggtgtacggtggacatgacgaggacgaccatgatgatgcggaacaacaacaacagcagcaccagcagatggccaaggagtacttgctcgtcttccaaaagctgggcatttacgtggatggccaaggtcaacccgaacagtgatgaacatgaagcggacttataaata

SEQ ID NO: 71985 - DNA, 479 bp, Heterodera glycines
  Genomic contig location: Contig_ID=SeqID_44505; Location=219..697; Strand=+
  SCN-specific regions: Sequence locations=1-479
cgagtggattccctgctgattgtgccgttgatgacattgacgaggaggagagggaacgccgaaagcagcagtacattgacaacccatggaagggctgtacggtgcggctcgacgccaacaacatcaagccgaatcccggcatgcggtacctttcgaagctgtgcctcaactcgctgtggggccgtttcgctctccggaatcggctgacgaaaacggagatcatcgactgccacgctgatttggccaagtttctgaacgacgtcaaaatcgacatcagcagcatcgaccaactgacggagaaattctggatggtgtgctacaaggcgaaggatgagcacgtggtggagcacgacaccagcaacgtcgccattgccctatggactacggcagcggccagagtgcacttgctcaactcacttcaattggtctacaggcagcaagatctggttcagcgctacgacacgcgcattttatacatg

SEQ ID NO: 71986 - DNA, 711 bp, Heterodera glycines
  Genomic contig location: Contig_ID=SeqID_44506; Location=50..760; Strand=+
  SCN-specific regions: Sequence locations=1-53,77-107,144-463,486 -509,537-543,574-675,697-711
atgcattggcagtgcttccgagcttccagatttgccgttggcacaaattgttcaatggcaatgggatgggaatgggcaacaagtgatcaaaacagtgagtttattcgtattaaaaaatttagttttttaaattaataaattatctacctatactatgattatttattcgattagagtaaaatgatcaaagctcgtgagacatttaaattctacgtcaattctctgtgttccattgtgattagaattctcaaaaagcgggaaaaaagtgccaagaagtaatgccaatttttgtttggcaaaatataaatgtattttcttgttttagtctgtgcccaccgatcagtttgccagacgaccaatttacggttctcattggtgataataaggtgaagtcatacactgtttatcagatcacggcacctttaggctaggttcttaaatccgccagaaaggtcggatcgacaaataaaaaaataaaaataaaacttgcaattttaaatgatcaagaaattttaacaaatacatttttatattataacaggcttttaaaaaattatgatttttaaaattttagggctaatagaataatatgtgaactgtagaatgattttaaaattgaaaattcgttgtttttgacaatttttgatttatttaaggagttttcgcaagataaaatcatcaagaaaagtaaaagacgctcctccccaaaaa

SEQ ID NO: 71987 - DNA, 48 bp, Heterodera glycines
  Genomic contig location: Contig_ID=SeqID_44511; Location=291..338; Strand=+
  SCN-specific regions: Sequence locations=1-48
attgaaagccatccattgcctgccggtctcggcacagcaaagcactaa

SEQ ID NO: 71988 - DNA, 1035 bp, Heterodera glycines
  Genomic contig location: Contig_ID=SeqID_9591; Location=169..1203; Strand=-
  SCN-specific regions: Sequence locations=1-40,142-269,303-1035
atgtctttcaacgattttgagtgcaaaattgttacaaaggtaatttttaaataaacattcatttatttgaaaatattttattttaaatttatcaaaactttattaatttaaaatacagatatattataaaagttttatttagccaattgatgacatttgcattgaactgaatggtctgaacaaattgaaatcacggcacgaattgttgtgccaaacattggcatcatggaaactcggcatggaacaagtggaattgggaaataaatgccttttaaaaatgaattaattatttaaagaacaactcgcagctgaacattttgaatgaaactgctcaaattttaaatgcccggcacaaatccgttgttgaaatgctcgcttcgaagtcgggtaaaattagagaaaaaaattgaatgtttggactttaaagtcataaaaattttttctgggtcgggaaatcacggattgtggaagtcctgcaaattcgagaatgggaatgtcggagtcggtgattaacttaattgcataattaagccgaccccgtcatgcttaaacggcttcagcgcgaaatccatgcaatggagctgcaggttgatatttggctgcgcgaaatttcagacgtgagcaatgagcgagaaaagttgcaaatggaatatgcggtcattaattaattataattagaataggatcgatgctcattagtctcattaaatgacgtttaattaaaatgcaaatctctcattctttaaaatataaaaaacaactaaataatcaaatgatcgagttaatgaaattcataattatataacttaaattatttaagcattaacgacaccgatttttaaagccgtttattgtaaaatttatgaatttttcagttcgaattttcccatcaaaatcagcagctccagcgcaatgttgcaaatgtcgagttggccaaaatggacgccgattttttgtgccgaaagcactgcaaaatgtggcacgaatttttggcggatgagcaagaacaaaaagagggaaacgaagagcaataaa

SEQ ID NO: 71989 - DNA, 130 bp, Heterodera glycines
  Genomic contig location: Contig_ID=SeqID_9591; Location=4371..4500; Strand=-
  SCN-specific regions: Sequence locations=1-98,120-130
atttgccagaaattgttatgctcgacttcccccgcgtgcgtcaaattgccgaaaatgtggttcatccgatcttcgaaaacggaaaacaatgttgtcaaagcctttataaatggaaattttttattgttga

SEQ ID NO: 71990 - DNA, 544 bp, Heterodera glycines
  Genomic contig location: Contig_ID=SeqID_9591; Location=3833..4376; Strand=+
  SCN-specific regions: Sequence locations=1-36,61-162,185-284,307 -334,370-520,543-544
atgacaacagcaaaaatgagcagtagccaggcacaaaacagcagcggcggcagcagcggtcagcttgtgtcattagcaaatgagtcagcttttgtctgcaaaattaacattttccatctgtttaaagcactaaacaccgccagcaatgggatgccgaattacaattattaattaatatataaatgaaaaaacgaaagataacaaaattaatttggctaaaaaaaaaaaattaaattcatgctgttgtgagagaaacaaattttggaattgattcctatgatggatttaattagaattttattgaatgaatcaatttaatcagactcagaatttctttaataatataaaataatttaaaaaacttatattgtcagatgcattcaaattaaatgatttggttggcagattaaaaagtgtgtccagaattcaatctttgtctgcaaaatcaaggctggaatctgaacaaaatctgaacaattccgagaggcccccagggccatgaaatgtatttaactttattaacaacaacaataatttttcaaca

SEQ ID NO: 71991 - DNA, 506 bp, Heterodera glycines
  Genomic contig location: Contig_ID=SeqID_9592; Location=119..624; Strand=+
  SCN-specific regions: Sequence locations=1-257,280-307,343-482,505-506
atgagcagtagccaggcacaaaacagcagcggtcagcttgtgtcattagcaaatgagtcagcttttgtctgcaaaattaacattttccatctgtttaaagcactaaacaccgccagcaatgggatgccgaattacaattagtaattaatatacaaatgaaaaaacgaaagataacaaaattaatttggctaaaaaaaaaaatttaaattcatgctgttgtgagagaaacaaattttggaattgattcctatgatggatttaattagaattttattgaatgaatcaatttaatcatactcagaatttctttaataatataaaataattaaaaaaaaatatattgtcagatgcattcaaattaaatgatttggttggcagattaaaaagtgtgtccagaattcaatctttgtctgcaaaatctaggctggaatctgaacaattccgagaggcccccagggccatgaaatggatttaactttattaacaacaacaataatttttcaaca

SEQ ID NO: 71992 - DNA, 671 bp, Heterodera glycines
  Genomic contig location: Contig_ID=SeqID_9592; Location=619..1289; Strand=-
  SCN-specific regions: Sequence locations=1-344,377-639,661-671
atggcggcggttcgtacgatcgatgcgacccaaaattggtgcaattggccaaaagttttcgatgggataagctgatttgcaggtacacaaaatgggtattttaatattcaaaatggcttgtggcgcttggccagacaattcagtgccgacggaactttggccaattccgtcccagccatttagagcatcatttaactatttttaattgtcaaacccactcaaacttgtaaattattcaaaatttcttaacatgctctattagctaattaagctcaaacacaatgtgaaaacagctgtattgtaaatattgtgctagactgaaccagaaaaagcatcaattgtagtatatattatttaaatttaattatttttaattgtattggcctaaataattagtttagaaaaaaaaactcacaaattttttataaatatttcgggttttcaaatttcaaatgacaacaatttgacaatttaattttgcacccattatcccctcctctcctctgccacaggataattgagatttcatttaaatttattaatttgccagaaattgttatgctcgacttcccctgcgtgcgtcaaattgccgaaaatgtggttcatccgatcttcgaaaacggaaaacaatgttgtcaaagcctttataaatggaaattttttattgttga

SEQ ID NO: 71993 - DNA, 713 bp, Heterodera glycines
  Genomic contig location: Contig_ID=SeqID_9592; Location=1633..2345; Strand=-
  SCN-specific regions: Sequence locations=1-49,71-77,271-341,365-713
atgaaaggatgcttattaatttcttcattatttgcatttttgattaccatcttaattagtaataataatgttggatcagaaaagaaaaaaatggaacaaaaaacatttgacgaaatatttggagaaaaatgggaagaaaaaagaaacgaagaacagaaaaaaagagaaataattggaaaattttatcaaataaaagagaaaattaagcaaaaaggaagaaaatattcagcaaaagaatggagtcaaattgaaagaaaaatagcaaaaaaattgggcacaaatcgccaatatatttatgaatggatcaaagaattgggattaaatcaaaagaattgctacaaatcaaaaactgaagaagaaaagattgaaattatcaataaattcattgaaatgcaaaatgaatttaagcaaaaaagaaaatattcaagaaaagaatggaacaaaaattatgaagaaatttgtaagaaaatcggggttagccttttcataattaaaaaatggatgaaacaatttggaattagccgaaaaataacggagaaagaaaaaatggagaaaatgaaaatttattggcacataaaaaaagaaaagccgaaaatgagtgacaaagaaattggaaaaatgttgaaaattcatataaataccattggcaattggaagaaacaatttgtaaacggactaatggaagattgaaaacggatgaaaaacaaaataaa

SEQ ID NO: 71994 - DNA, 648 bp, Heterodera glycines
  Genomic contig location: Contig_ID=SeqID_44513; Location=35..682; Strand=-
  SCN-specific regions: Sequence locations=1-113,135-294,317-345,367 -367,391-475,502-615,637-648
atggatcaacggaagagttcgaaggaacgtagtaagaacaaattgaaatattatttactacacaaataatcaaaatcgtactatatataagggagttctatgattaaaattttttcttttgctcaaatcaaaaaatttttgctggtaggattttaagttggactatgcctgacattgttgccagcgacccctaacccctatctctaaccctctggcctgggtgctcctacaactttttgttgtcaaaagtgtacaattaagtaccaggcgaataatcaatttttatttcttttcattctaaaattaaatttgatggatttattatctcaaattcaaaaataataattatttcttacaaagtgaaaacaaaatttatatatattaattaatcaggatacatttattaaaatttggatttccttaaaatgataaaatagttaaatgtctcttttgcttataatcaaaactgaatgagataaaaaaaaattaaaaaattataatccaaaattatagtgtttaaatgttgccatttacacgaagagcaaaccgatgtagacttcgcttgaaaattaaatttgggtataattgttaacagattttgtccaaaaattgtccaaattttgtgattttgagccaatttttaataaa

SEQ ID NO: 71995 - DNA, 112 bp, Heterodera glycines
  Genomic contig location: Contig_ID=SeqID_44514; Location=220..331; Strand=-
  SCN-specific regions: Sequence locations=1-112
atgtgtcgatttcaatgcgatcaacaatgttgtcccagcaaacaaacatacacagcaaaggataagctgaaaacggaggagcagcaattctcacggaacaaaaatgtgaaat

SEQ ID NO: 71996 - DNA, 141 bp, Heterodera glycines; identical to SEQ ID NO: 66691
  Genomic contig location: Contig_ID=SeqID_44515; Location=387..527; Strand=+
  SCN-specific regions: Sequence locations=1-141

SEQ ID NO: 71997 - DNA, 572 bp, Heterodera glycines
  Genomic contig location: Contig_ID=SeqID_44517; Location=185..756; Strand=+
  SCN-specific regions: Sequence locations=1-291,314-378,402-533,555-572
ctccgttgatgcccaactgacgaacaaaacggagcagttcaatgaagtaagggacctcaaaagatggaaatactactcaaaacagtgttaaatggatggaggcgtactttgaaaggtgctcccttcaggtcgaaatgcacccaaagtttggggggcacaaaattcccttcggacgttagcatcggatagccgtcgtaatcctttgccttaattgcatttaatgatgacccagttaagcggtcacatcttaaaattccaatgttcaaccaacccgaacattccctgggcttttcgctgtgtctttttgtttctgctggacaccgttttggacaaggaacatcgaatgaggaaatgacaaatccgctttggctgtaaaagaaatgaaatatttcatgaaattccatccccaattttatggtacaaccgccaagtttccgttgctgcaaattggcgagttgcgattggcacacggattcactgttccgcaatgtttccaatttgatgctcacatctaattgtgaggcaattattggcagaaatatgtaaattattttgggtccgataaaacccct

SEQ ID NO: 71998 - DNA, 663 bp, Heterodera glycines
  Genomic contig location: Contig_ID=SeqID_44520; Location=508..1170; Strand=-
  SCN-specific regions: Sequence locations=1-315,346-535,573-663
atgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggagggggggggggggcgaaggcccaccacgaggccgcgaagaggccgagtgagtaccttcggtgcaggaaaattattaaattttaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaatttttcgaaaatctgagtctttcgtttttatttatttgcaaaattaattcataaatattttttcagaaagggttctgaaacgcaccaaattttatttacatgttagtttaggcactctgatgctttttctatcaataatggaggtgaataaa

SEQ ID NO: 71999 - DNA, 565 bp, Heterodera glycines
  Genomic contig location: Contig_ID=SeqID_1299; Location=141..705; Strand=-
  SCN-specific regions: Sequence locations=1-442,467-505,539-565
atgtgcgtcatttgtgaatatttaagaggtaccgatggcttagcaggattcatttcaagccaacaatcccttcccacgctcaatacccttaaggtaaaggggatgatgcttttcattttattttgtcttatttgtttttaattttaaagaaaatgccaccacgtgaaggacagagcaacaacgcggggaatgacgcccccggacacagacaaccaccgtttgctgaacaactggtcaatgatgctcaactgcgagacatcatgaacgtactccaacaacatggcgtcctggtaatttgctcattataatttacaagacatttccataacaatttcttcacaggttggcttgaacggcacgccgcaacaaattgtggaagcattgcgtcaattggcgcaaggacagctggatgatcgccgtcgtcaaaactgatgcttctgcggatgatgatgatgattattgtaaagcggaaaagactgctgattgggaagatgaaagaaaaatgaatttatttaaatttatttttttactaaattttccgattgattgaatttaaaaaaataaa

SEQ ID NO: 72000 - DNA, 421 bp, Heterodera glycines
  Genomic contig location: Contig_ID=SeqID_1299; Location=1345..1765; Strand=+
  SCN-specific regions: Sequence locations=1-29,51-306,333-374,400-421
atgtgttttggtatggtcgaatcccatgctaaaatactccaattgctaatagggtatgacatctgcattaattataattataaccaattattctttaatttttacaaactgaatatttctggggaaagaagggttatgatggaacttaaattatgtgccacatttttgttgtaattcaatgaagcagaatacttgaagctgagacaaaggaaatgatgaacactaaatgagtatgataattgttgacagattaacttagttatggtattgatggctaggaaatatggcaattaattctaaaatatctgaaaaagaatgcaactttttgggtagcgataaaccttttttaagtaagtaactaattattacagccgcaaggattttagaaatgtataaaaacaaggaaaataataaaagatga

SEQ ID NO: 72001 - DNA, 2513 bp, Heterodera glycines
  Genomic contig location: Contig_ID=SeqID_1299; Location=1970..4482; Strand=-
  SCN-specific regions: Sequence locations=1-98,120-350,375-462,484 -1197,1219-1267,1289-1335,1504-1554,1576-2075,2103-2243,2265-2513
atggaatacgtgcttaaactccgtggattgacactcaattatgatgtgatcaacaaccaaggctttagatataaaaacagcaagtcaaacgttatgctcaaacaggagagattgaaccaattaatgtaatatacccaaactttattagacccaatattcgtgatggtggatctgtaatatcaagctctatgcaaaaatgttatcagccttatattgggaagggtattgtaggagccgattataatgttctcaattttggacacactttgtaattgctcacccattataatgtctttttaccattcattgtaattgttcacacattgtaataccttcttcaccaatcattgtatctctctcacacatacacatatgtacccttttgtattttgttcaccatttattgtatctctcttccacacgcataaacatataccccatacacacgtacacaaacatgtaccccttttatttctctattttataccaaaaattgtgttattttgtcgttttattcacgtttttaataaaaatgcatacataattaagcaatggaagacacaatttgtaaattattaagcatttgggaacgtcatttttaggtagaaaaatgcattattaagcgaaagaagttacaatttgtaaataattaaggagttgaagatacattttgattatgtgcacgaacttgtcgtttttaggtagaaaaatgcataattaaggagtgaaaatgcatgcagaattaagcaatggaagttacaatttgtaaattattaagcatttgggaacgtcatttttaggtagaaaagtgcagaattaagagaaagaagttacaatttgtaaattattaaggaatagaagatacaattttaaaaagtgcacgaacttgtcatttttaggtagaaaagtgcataattaaggagtgaacatgcatgcagaattaagcaatggaagttacaatttgtaaattattaagcatttgggaacgtcatttttaggtagaaaagtgcagaattaagagaaagaagttacaatttgtaaattattaaggaatagaagatacaattttaaaatatgcacaagcatgtcgtttttaggtagaaaagtgcataattaaggagtgaacatgcatacagaattaagcaatggaagttacaatttgtaaattattaagcatttgggaacgtcgtttttaggtagaaatatgcagaattaagagaaagaagacacaatttgtaaattattaaggaatagaatatacaatttaacaaaaattaagaaaaataatgattaaatgaaggaattactcaaaaatctgtaaaaattacacatggggtatgtgtgtgtgcatgtgtatatgtgtaagtgtgcgtgtgtgtgtgtgtgtgtgtgtgtgtgtgtgtgtgtgtgtgtgtgtgtgtgtgtttgtgtgtgtgtgtgtgtgtatgcgtatgtatgcatgtgcgcgtgtgtgcgtgtctatgcgtgtgcgtatgtgtgtgtattgtatgttttttcgagcgtgaggataagtgtgtttgaaagttctgcataatatttattaacttatataaaactagttaattttaatcataaacacaaacaatgctccttgcctaattcaacgtaaaataattctaattataataaggaacagacgagaaagggtagataagggctaaatgtatgcgtgaagcaggtcttgtaataggaataaatgaagaaatcatatgaggatattgtagtgcaccatagaatcaatgacaattaataatgggtgtaagagatagagatagagaactcagaaatgtggttgaagagagtcaatattaaatagtgagaatttaatgtgagttagtaaggcaaacattaggtaatgtatagagaagagaatagtttgataaagaacaagaatacgaacacttggaagataacggttcgagaataaaacatagtgttggaagaaaagatattgaaaaatagctaacggaaacgattatttagacaatatgtaggtctgaaattaataaggaataacagtgaaagtaaacagatatagaagagtagagaaagtgtattacagagaaaaggaaaataatccaaataaacccgaaaccaaaatctctaaatattggattttgttaagaaagcagttggcgttagcctctttccatttgttccttttagaggaatcgatttacaggataagatgacgccgtgacctcacccccctctccttcacttatttggtttcctcagctctgcccttcctctccaacacatattcggtcattattgctccttaccatcgcaaactcagtttacccactccgttttccatcctatgcgttttgccaaatcaataggaaaggtatattttattctcatataaattttagaccacgaggataacaatttgcataaaaataaaaattcatagtcaaaagaatgaagttttcagtgtttggtgtcagagccttgagaggtattggttactggcgggccaagcttaa

SEQ ID NO: 72002 - DNA, 367 bp, Heterodera glycines
  Genomic contig location: Contig_ID=SeqID_1299; Location=4708..5074; Strand=-
  SCN-specific regions: Sequence locations=1-367
atggctgagcaatctgcatttcaatcgaaattaatgttactacggttgaagaaggttacccatttaccaattgatactgacataaaaggaaatggtgagaaggaagctgaatttgtaagagagtgcaaagagaaattagagatcttaacccaacaaagatagctgtgaaccaagaagagtaggattgttaaactatgcttgaacaatttgtgcgacatatttctttacgaaattacagcctttaacagactttacttcaataatgatgtacttgattttggagaatatttgggataatcgttcaatagacgtaatggccatcgaggattgaaaggtgtatcatgttttgattacctacgaaaataaa

SEQ ID NO: 72003 - DNA, 700 bp, Heterodera glycines
  Genomic contig location: Contig_ID=SeqID_1299; Location=5569..6268; Strand=+
  SCN-specific regions: Sequence locations=1-292,314-451,495-515,658 -666,688-700
atgctaaacatatccgcttacttctattgcagttctctctgtttccaactattcatccacagaataatgatcaatttgccaagtgttcagttgaaaagttattgatctagaaatatcgcatacaggccgtatactagtcatacattcctttagtacatcaatggatactaaaagacgctgccttcccttaataatgccttagttcctttgagacatcaaataattccctcctaaacgataccagcgctgtcattaaaattttgaatgtcattacattttttctcattaattgcctctgtaaatacaaattttccagttgagaagatagttgtggtagaatttgtacctagacccttcattatatttgaaagatttatgtggttgtttttagtggatggggatattaaataaattgaggagaaaagttttactatttattgtcagtaacaccataaattgaatttaattttagatataatttacttaattttaatcaatactattgtatttattatttttattatattttaatacaactttaatttaattttttttattttatttttatttaacatttattttatttttaattttaatcttttttatttttattttactttttatttgaattaatttgaattttattttactttatttattattcagttaatttaaaggagttgttcagaacctctatcca

SEQ ID NO: 72004 - DNA, 461 bp, Heterodera glycines
  Genomic contig location: Contig_ID=SeqID_1300; Location=1..461; Strand=-
  SCN-specific regions: Sequence locations=1-50,72-150,172-461
  Gene Ontology: Mol. function=general RNA polymerase II transcription factor activity; Cellular component=transcription factor TFIID complex; Biological process=transcription initiation from Pol II promoter
ccaacgattaaaaattgcgtttctgttgtagacctcaaaataccccttgatattgaaaaaatttatttaatatctccatccacaaaatataatccacgtaaaattcatgctgtgattatgaaagtgtataatccaaatgctaccgccataattttctcaactggaaaattcgtatgtacaggagcagctaatgagaaagaatgtaagcaagctgcggagcaggtcaccgaaagaatacgacaatttgggtactacgaggcacgaattcacgaatttgtggtgaagaatttgattgcgacagcagacgttggttttcatatacgcttaggacctctgtccgactttctaggcgcaaaatattgttccttcactcctgaactattccccggtcttgtctatcggaataaaaaccccacagtctccatcatttgtttttcgaggggaaaattgaatataaccgg

SEQ ID NO: 72005 - DNA, 1351 bp, Heterodera glycines
  Genomic contig location: Contig_ID=SeqID_1300; Location=886..2236; Strand=+
  SCN-specific regions: Sequence locations=1-526,548-559,597-741,779 -790,827-850,885-985,1007-1022,1044-1047,1069-1216,1238-1351
atggttaatggcgctcagttggcttttggtacaacagactccacatttcctaaggggatatttatgacactttcggaggcattagttagaaatgcactcaaacgaatgattaatgaccctccgtaggcttaggcttcggcaaaaatgcactcaaaagaattattaaagaccctccgtagactttgggtactcaataggctttgggtctcagaactgaaatatcccgtgggcactgggagtgaaatggctaaacttaaaaaataactctggggctcaaatggcggcactgtaaaaataactctggggctcaaatggctgcgcagtaaaaataaatctggggctcaaatggttgcactgtaaaaataaatctggggctcaaatggcatacgcgagcgtttaaatggcaaacacgcgggcgctcaggtggcatgcgtcccttccctataaggcatgacagctgacgcctatcctctgcctccctttccttctctaataggatttgacctcgggttttatccttcagatgttttttcaattatttacctcttctgggattggatatatttattataggtgttttttaaaggtttaaatttggtactgaaatgtccctttccactgggactgaaatggcggggctgaaaattaagggccaaaatctgcatgggtaactattctgataatttaatttgccatttatgcacatttttatcgaaaatttattttaaaactgaagaaaaatcattgcatttcactttggaaattttatttatttatgagtcgtaatttgatcaattttttctccctttctgctgcttgttgttctcccttttcttccgtttgatatgagtcatttctctctctgtgtgtgatacacagcacatttattggtggaaaatgtggcttaaatcacacacccatttttgttctcgaggctcatcacaatctttgcccgatcagttgcttgctttttgactaatttaccaccaaaacattttctccttcattttttggggttttatatgtcaaaaatatgaataaattcaatagaattatttaaaaatatgtgataaaattcaggattttagctgataaatttatgaaacataaagaatcagcagaacgcctggacaattttgaactcgtcaaccccaacgagttcaggtccttttgtttcaggttggccaaattttccaatttcccggttttttttttaaattttcaaaattttagaggcgaaggttgctgtaatctcgtgatcagtgcaaaaggacgccatgatgggaccaggttggggccaacattttcgaatttggttgcccaattcatccgtaattcattggttttttag

SEQ ID NO: 72006 - DNA, 247 bp, Heterodera glycines
  Genomic contig location: Contig_ID=SeqID_9593; Location=704..950; Strand=+
  SCN-specific regions: Sequence locations=1-247
atgggcttgcctgggttaccttcagactactcttacactcaacaagcatcttttttgaacgatgcacgcttgcttatggatttttttggtgctgaacaatcaaagcaatggacgcctattcaattagttttgcaacaaatacgcaaacttaattctgaccaacgtgcagcatttgaccgaattattactgcattaaatggcaggggcgaacatcgttgcttttttattgagggagccggaggatgcg

SEQ ID NO: 72007 - DNA, 280 bp, Heterodera glycines
  Genomic contig location: Contig_ID=SeqID_9594; Location=48..327; Strand=+
  SCN-specific regions: Sequence locations=1-280
atgggtcttgtgctcagtgggaaacaatgcttttctcacggccaagtgtatgtggcgatgtcaagagtgacaagtatggaaggagtccgtatttgctctccacagacatgcaggggcgaaaacaattatatccataacgttgtgttccatgaattactcgatcaaagtttcaatgcgcctagccaacaattttttcatttagacacacatacagcgaccttacaagaaaaattatgtagtgatgaagaatctgatttgccatgttgaataaatattttaa

SEQ ID NO: 72008 - DNA, 911 bp, Heterodera glycines
  Genomic contig location: Contig_ID=SeqID_9594; Location=719..1629; Strand=+
  SCN-specific regions: Sequence locations=1-53,76-106,140-348,370 -565,587-804,826-867,898-911
atgagcacacaaatttgcgtaaaatttttttggaaaaacgcaaaaaattttcatgaagaaagagaagctgatcgtcaaaatttattgctcgaattgggaaaagtgacttttgatgctatacagaacatggactatgcaggggcgaaaagtcaactaaaaattgaagcaatacaaggccgactcattccgttgcgcgaaaactatgagaacgagaagaaaaaattggatttctattacacattacaaacaccgtaagatggactcttttcctattgtttataaactttaaaaaaacattttttaggactaaacaccatctgaaagcagcagctattcaaagcggtaataatcattgaagtagtattaattctttattttgtcagccgctgtaacgaccgcaggggcgaacctcagccttgaacagaaaaaagtggaaattgaagtcaatgctgaactgcaaaggaactctaacgaaaccacacgtttctgggctatccaacgaatgcctattcaacaattatgcaaggatttttttgaccgttggacagtgcgtggaaatgctgagcttatgcccttagcaaagcaaatgaacagatccaagcacaaaaacatagttgtttattttacgatttttttcatctcataattgttcaggaggaaattttgcctgaaactcaagcaggggcgtcctctgagaagagagtgcgctcggagtctccgaattctgctaaatcagtttcttcagacaaggaagttggcaaagacaatgacacaccgctgaccgaaatttagttattttggcattattccttttcattatggtttgtgttttttaaagtattagtttatttcctaatttctctttactttaaaaatatatattcattatttataattgttaattgataaaa

SEQ ID NO: 72009 - DNA, 1205 bp, Heterodera glycines
  Genomic contig location: Contig_ID=SeqID_9595; Location=467..1671; Strand=+
  SCN-specific regions: Sequence locations=1-393,415-652,674-822,845 -854,911-961,986-1130,1152-1205
atggacgattatggcttatgggatgtgcagcttcaagcaggggcggaggaggatgctgaggcttttccttttattctttcatatataatttttatttttagtttgaacacgattatccgattccgcctgctcttatgttgcgaattgagcaggagctgcacaaccctggacccgcaaggggttgttaccattgcagttcctttgggcatcgtgctcgagagtgtcccagaagtggatcttggagacaagaccggcaagggcgattggtgcgttttggtggccgtccaaaatgctttgtctgtggaaacaattcgccgaatcatcaaagtcaagattgtcccttcaggcacccccactcatatgatggtaaacttacaggttttaaggttttttaaaaataacaagaatttgtttgagccatcagttcatgtaataattgttgggccagtttgcatggccagcagcaatttcgaagttcatgtcctcgctgcaaacagtcgctgcgctgctggaattgcggacatccaagtcaccgacttaaccaatgtaccgaaccgcgttaccaaccgcccaccaacaatacaactcgtccgcgcgaagagcgcggacgagattgaaggcaggggcgcgaagaaaaagcgactgcgttgacatttaatgtttttgattgttgaaatatgtttgatactttttccataactttttattaacttttacatacaaaagttaacttttatttattgctttgttaaaaattaaacattatgcatttacgattgctatagttacagtatgattattttatttagacaaaatctacataaagaaaagaagctgtaaaaaataaaggaagcaaaattttttatttaaagttcaaaattaaagatatttaatatttttcaaattatttggcgcggagcgccccctagagccagtgttaaatagcgaagctatttcaattttaaacaaataataaaatttgtcactttcagtgcccatagggcactggttatccggactaaaatgattattgacactgtttccttgactccgacaatttctcgatgattgtctaaacaattcttttctaaatcctagtctattgctcttaaggaaattttcaagcatatataaaacattttcgtatatttttgaagcatgttaaaaaaccgttgatatccgaaatattggactcaataagaaga

SEQ ID NO: 72010 - DNA, 409 bp, Heterodera glycines
  Genomic contig location: Contig_ID=SeqID_9595; Location=1731..2139; Strand=-
  SCN-specific regions: Sequence locations=1-241,264-409
atgcaggtatttcttttttatatctcatatttattcttcttattagtccaatatttcggatatcagcggttttttaacgcacttcaaaaagatgcgaaaagtttcgctgatattaaagcattcaattaatcgcattttcatagtcataaaaaacaattttttatataaagcgtcgtgggttttttggagttctcaatatggacattattaaaagtagggcatgtgcaataacatcataaactttaaaaattaataattttaatgaaaatacgaaaatgttttatatatgcttgaaaatttccttaagaccaatagactaggatttagaaaagaattgtttagacaatcatcgagaaattgtcggagtcaaggaaacagtgtcaataattattttagtcctgataataaa

SEQ ID NO: 72011 - DNA, 844 bp, Heterodera glycines
  misc_feature (805)..(805): n is a, c, g, or t
  misc_feature (835)..(835): n is a, c, g, or t
  Genomic contig location: Contig_ID=SeqID_44525; Location=1..844; Strand=+
  SCN-specific regions: Sequence locations=1-468,492-528,551-844
caacatttcaatcggactcaacccaacagcattctaatcactgggactcaacccaacaggatttcaatcactgggactcaacccaacagcattctaatcactgggactcaacccaccaacatttcaatcggactcaacccaccaacatttcaatcactgggactcaacccaacaggatttcaatcactgggactcaacccaccaacatttcaatcactgggactcaacccaacaggatttcaatcactgggactcaacccaccagaattccaatcactggcactcaacccaccagcatttcaatcactgggactcaacccaccaacatttcaatcactgggactcaacccaacaggatttcaatcactgggactcaacccaccaacatttcaatcactgggactcaattctcctgcatttcaatcactggcactcaacccaccaacatttcaatcactgggactcaacccaccagcattccaatcactggcactcaacccaccagcatttcaatcactgggactcaacccaccagcattccaatcactgggactcaacccaccaacatttcaatcggactcaacccaacagcatttcaatcactgggactcaacccaacaggatttcaatcactgggactcaacccaccagaattccaatcactggcactcaacccaccagcatttcaatcactgggactcaacccaccaacatttcaatcactgggactcaacccaacaggatttcaatcactgtgactcaacccaccaacatttcaatcactgtgactcaattctcctgcatntcaatcactggcactcaacccaccagcatntcaatcact

SEQ ID NO: 72012 - DNA, 328 bp, Heterodera glycines
  Genomic contig location: Contig_ID=SeqID_44527; Location=51..378; Strand=+
  SCN-specific regions: Sequence locations=1-142,165-328
atggaagaagtgattgccgtcttccaattccattgccacccgaatctccgcggttggcacggacagtacccaatggaatttccgtgccatggacgcttttccgatcagaaagaaggcatagtttcgctgcaaattgagaaattttcggaatttgcacaagagaaagcatggagtagccgattaagcgaaggaatttacataaaaggattgccatggaaaatttgtgcagaaataaggacgaaaaacaacagcactgaaaagtggctgggctttcatcttttgtgcaccgctccaaaaggtgggaataaaagtccaatttaaatataaa

SEQ ID NO: 72013 - DNA, 195 bp, Heterodera glycines
  misc_feature (189)..(190): n is a, c, g, or t
  Genomic contig location: Contig_ID=SeqID_44531; Location=705..899; Strand=+
  SCN-specific regions: Sequence locations=1-195
tatgttccgtggagacaaatcacattcacgggccggctgttcgacgttggtgaaggcagagcgaccacattgctattcttgctcaaatgcttaatttatatggctttggacattgtcatttgggttgcattgacatttctgagctacaaactgttggtttggactttcttcactccctttgaacgaggnntgtaa

SEQ ID NO: 72014 - DNA, 636 bp, Heterodera glycines
  Genomic contig location: Contig_ID=SeqID_9596; Location=3..638; Strand=+
  SCN-specific regions: Sequence locations=1-57,79-636
atgaccaacatgaagacaagtccatggacaacaacaacatgggcaccaatgacgaccaccaggcaaagatggactccaacaaccagcgcatcaacttggacgacaagacgaacccgaatccaatacgtcacgaaatcaagaagccaacaaacggatgcaacgacacctcccaacacaattaaatcggcaaaatcagcgaaaagagacttgggaacgaatcgtgacggcgcggacgttttctggtgttccgacagaggcagcacgatctgggagctcaagggccccgagaattcaccattctgtcgtcctccaccatcactcaccgcggaatggcacagtctcgcaattgaactctacgccaaaagcatcaggccagagcagattgattccgcgtggcattgctccgtcaaacgaactacggagaattattataccaatttgttgggcgacaagtttgtgaccatcgtaaaagaattcccaccggtcaacaagcgcatctgcaagcaaatggcactgcaccaggaatgcccatacgccaagtctgaaatgatcaaccacgagggacagctgtggtcaactaatgacgaactgaacgtcaatttcccaggacccatttccggactcttcaagggctaa

SEQ ID NO: 72015 - DNA, 2151 bp, Heterodera glycines
  Genomic contig location: Contig_ID=SeqID_9596; Location=708..2858; Strand=+
  SCN-specific regions: Sequence locations=1-16,38-1351,1373-1396,1419 -1839,1861-2037,2059-2116,2142-2151
atgctttcgccagtccaccaagtccaaaactgtcaatactctgcggaattctgtcagttgccaaacaacacgactctgatatggaaatcaacgtgctctggagatgaatgcaaaatgtgcgactacgatcgagcggaaatcatcagcggaaaatttaccgcagcttatggagaaacagtagccacgtggatatccgacgatcaccagaaggccttgacattcgccaaaaaggctcccgaactcatcgcctgcgacggcgtacgcatcgtcctatctgaacagaactttgggattgccaaagatcaatacgacgacattgtcagtactatgaggagatggaaaagaggaattcggcccgagcaactcgcatcacaactttcggcttctcaagtagcgacaagcgtggctttgaatcagctctacataagagaatgccaacgaaacacgagagccgcgaacccaacgctacaagccaggaaactgttacggcaagcaaacatccaagctcgttggatcggcgagacgacaatggaagtgtttccatgtgtcaacatttcgctacaggacatctcatacaggccaatgaatgactgtcgcctctacattcccgtgactgcgcactttcccgaccgagctatcgcagctttcctggatccggaagttcgcatcatctcgctgacagcacaacaggcaagctgtaatagctaccggatcaatcatcttcaactgcgaagcaatcccaacatctggttacggatcgactctcgaaccggcacagcacgacgattgccaaaagattacgtgcacgaattgtacgaaacaacgatcaaccaaacaaacagcaacttggaacttcatccgttgatcttccacgcatggcaactcgacaatgagtctgacgcgacacgcttcccgcacatcaacgaattcatcaactcggagcagttcaaggacaagctggaacagcacattacagcaaggactgaagctttgggcgcgttgaagggcggaatagaaggattcaccatgcgctggctaaaaggcctgatcgacgaagcaatcacgtggtggattcgagtcgcctgcgtttattcaaccttcctcatgctgcgcgacattgttctcccatgcactctggcgtatttgctcaatcccatccgagtgactcttctcagcctcgttggagtacgcccgcacccgacattccgacccaccgtttctaaaccactcgggatcgaagagggaatgccgctgcgtgaactgccacgaacccccaaaccaccagcgcgcagggcagagcaccgatccatgtcaccaatcaaattggacatgattgccagaacggctcggtaccaacaaccacgaacacagagccatctcgaccccacagaagactcgccctttgggaggccgagacgaaaagaattctgacgggccccatcctttttcgcgccggaatgtcggaatttttattcctatcgccgatcaatgatcggcggaattaagagggaggaggcccttcaccaatcccccgcccgccgcgcaacatgttttcgccgtttcatccctctgtcccccttttccttcaaattgtcaattgtttttgtgtgttcctcccccgccctgcgcacaaattaatgaccaatttgtcaaaccgcaacttttctgcccccgtccccaatttggcgaatcgactccaaagaacgatgaacctcccaaatttcccgttttccgcccattttgttcattcgttcatttttgtcccccgtttttcattttgtgcccaaattttcggcccattttgttctgctcacatttgccactttttatctaattttattgttatttaagcggccaaaaatgcccccaatttcacaaccaaatttcatttggcaatttttgccgtttctctccccgcccctccatttgcctttaactgtgatggccccccaattgtgatcattctttaaccccccggttattgatttttgttctgtggccccagtgccctccatttcctgtcccatcccggtgcccaattccatttgtgataattccccggtgatggcatttctgtaatcaatttgtgataattcgttcaccatttcaaaattttggtttaattacccaagtttgaggtcatttcccgga

SEQ ID NO: 72016 - DNA, 883 bp, Heterodera glycines
  Genomic contig location: Contig_ID=SeqID_44532; Location=19..901; Strand=+
  SCN-specific regions: Sequence locations=1-187,221-439,461-477,499 -785,810-814,836-883
atgttgctgacagcattgcgatcatctgaggatgcatcgcttcggcaacgcattttgataaagctcgcagcggacaaaaacggcatcacctacgattcaatggtggaagatctgatcaattttcagacgacaattgccgaggccaaattgattgagcagccatccgcatttaaaaatgtgagcgcattgaaaagggggaaggagagggaacaacaacaaatgccatcaaattcgcgttttgccaacaattcacaaaacgcttcaacggcacaacggaaatgctggcgttgtgcaggcgatcaccgggccgacgattgtcgtcacaaattggaaaaatgccccaagtgcaaatttcccggccacatcgcttcacgatgcgaaagcgttcagcaatggcgacgcaaatttgccaaaaagccaattcaacgaaagcaaatcgggagtctcagcgtcggtatggcaaccaaacaaatcaatgccacttcactgctgaaagtcggagttttcgtcaacaaaaagaaaacaaaatttgttgccgacagcggcacggaagtgaacataatcgacgaagacgcctatgacaaaattggccgtccaaaaattcaggaatgcgaagaaaaaggcaaactcttcgacggaacaaaggtcgcattcataggcaaaggagttgccacattccaatttggcgacattgccatcgaccaggagttttacgtcgcaaaaagagggtctttaaatttgctgagcatttcaacgatggacgcatttggcctgctggacgatttaaaaaggaaaatcagcaattccgcgattaatttgtgtgtaaacatcaattcaagtgcaacatttaaatccaaaaccaccaataccatttattagggaa

SEQ ID NO: 72017 - DNA, 379 bp, Heterodera glycines
  Genomic contig location: Contig_ID=SeqID_44533; Location=475..853; Strand=+
  SCN-specific regions: Sequence locations=1-150,172-379
  Gene Ontology: Mol. function=chromatin binding; Cellular component =SWI/SNF complex; Biological process=signal transduction
atgatacagtccattctgcagctgtgcgaggcgccaattgactacgaattcatggacaaactgccggcagtgcaatacggatttccatgtaaggcaaaaacattggcacaccctcaggggtttgtttaattggacccagaaaattatcctcgttttggaaatgctttttcctgacatttcaatttcaggcggttatcggcgcgatttccacgcggaacgtgccaaaattccggaggcgttgttcgacctcaaacacgccacggacatcagcgagacggagcgcgccacactgatgagcgtgtcgcaggtggcgctcacttcctgcaacacttgcgatatcgacatcagaccggtcagcacttaccgaatgcatatttag

SEQ ID NO: 72018 - DNA, 280 bp, Heterodera glycines
  Genomic contig location: Contig_ID=SeqID_44535; Location=162..441; Strand=+
  SCN-specific regions: Sequence locations=1-72,96-146,189-280
atgaaacttttatgtgcaggatttattcattggatgtttttcatatgtgaaccctcaaaaattggcattatgtttttttaatttaaaataattttgtttaagttttgctatttcgaggatcgaacataaatacttggaattggatgtatttattaataaacaaaaatcaaattaaaattaaaatttaagggcgacgggtgtttccaatcttacaaattctttgaaagtcgaaggatggaaatacgtcaaatatttcagattgagtatctactttgtttga

SEQ ID NO: 72019 - DNA, 354 bp, Heterodera glycines
  Genomic contig location: Contig_ID=SeqID_44536; Location=342..695; Strand=+
  SCN-specific regions: Sequence locations=1-354
  Gene Ontology: Cellular component=mitochondrion
atgcgtaaagagacgggatacagctatgtcaagtgtcgaaaggcattggtggcatgtgggggcgagcaaaattatgagcaggcgctgcgatggattaaagaggcggccgtcaaagagggatgggacaaagcggcaaagtgagcgtctaactaatttaaaaacgtcaatctttttcgctactttgtagtacaaatttaaaattatctattttttagattgagcggtcgcaaagcatcacaaggcctaattgggttcgcttcgctttctgacaatgtttctgttctcgttgagctgaactgtgagaccgattttgtggcaagaagtgcagaattcaagaatttggtatttatttaa

SEQ ID NO: 72020 - DNA, 961 bp, Heterodera glycines
  Genomic contig location: Contig_ID=SeqID_44537; Location=180..1140; Strand=-
  SCN-specific regions: Sequence locations=1-111,135-375,398-466,489 -496,520-677,701-766,789-961
cattcaatccctgggactcaacactccagcattccaatcactgggactcaactctccagcattcaatcactgggactcaacccaccagcattccaatcgctgggactcaacccaccagcattccaatcactggcactcaattctcctgcatttcaatcactggggctcaaccctccagcattcaatcactgggactcaacccaccaacattccaatcaaagggactcaaccctccagcattcaatcactgggactcaacccaccaacattccaatcaaagggactcaaccctccagcattcaatcactgggactcaactctccagcattcaatcactgggactcaacccaccaacattccaatcaaagggactcaacccaccagcatttcaatcagtgggactcaacccaccaacattccaatcaacaggactcaaccctccagcattcaatcactgggactcaacccaccagcattccaatcactgggactcaacccaccagcattccaatcactggcactcaattctcctgcatttcaatcactggggctcaaccctccagcattcaatcactgggactcaacccaccagcattcaatcactgggactcaaccctccagcattccaatcactgggactcaacccacctttagcattttaatcactgggactcaacccaccagcattccaatcactggcactcaattctcctgcatttcaatcactggggctcaaccctccagcattcaatcactgggactcaacccaccagcattccaatcactgggactcaactctccagcattcaatcactgggactcaacccaccaacattccaatcaaagggactcaaccctccagcattcaatcactgggactcaactctccagcattcaatcactgggactcaacccaccaacattccaatcaaagggactcaacccaccagcatttcaatca

SEQ ID NO: 72021 - DNA, 194 bp, Heterodera glycines
  Genomic contig location: Contig_ID=SeqID_44541; Location=254..447; Strand=+
  SCN-specific regions: Sequence locations=1-79,113-173
atggctatctatttttttgagaaattttctatgcaacaaacgctctcgaacatgaaacgaagtgcggtgcgccgtggccattttatttttcaaataatttttaaatttaatagatattccagaaaaatggctatctattttttttcgaaattttctatgcaacaaacgctgtggccattttatttttcaaataa

SEQ ID NO: 72022 - DNA, 271 bp, Heterodera glycines
  Genomic contig location: Contig_ID=SeqID_44541; Location=601..871; Strand=+
  SCN-specific regions: Sequence locations=1-79,113-204,238-271
atggctatctatttttttgagaaattttctatgcaacaaacgctctcgaacatgaaacgaagtgcggtgcgccgtggccattttatttttcaaataatttttaaatttaatacatattccagaaaaatggcatctctttttttgagaaattttctatgcaacaaacgctctcgaacatgaaacgaagtgcggtgcgccgtggccattttatttttcaaataatttttaaatttaatagatattccagaaaaatggctatctatttttttga

SEQ ID NO: 72023 - DNA, 1896 bp, Heterodera glycines
  Genomic contig location: Contig_ID=SeqID_9597; Location=116..2011; Strand=+
  SCN-specific regions: Sequence locations=1-522,549-1491,1516 -1540,1562-1771,1793-1863,1885-1896
atggctatgcattattttgagggaagaattaaagcaaatgggttgaaaaacaaagatatgaaaagccttctcataggtttctttgagttttttaattgtttcccattccgtactcatgtgatttctgaaagaggagaatgggaagagagaagacaccataaggaatttccggaagatagacaatctattttcattgaaaatccatacaataaaaggaatgtagcgagtagcgtgcgagaagatgggtttaaaaagatatgtgaggagtttgaaatgacagctaatgaattcggcttaccattagtcagggaagtcaatgtccttgaagaattaggaattgatctggaaaaggaatgggtagagaaaacgtcagtctcatctgatgagaaaagtgaaatgttagaaagggctaaccaaagtcgagagactgaagagctcagtgacgaaatggtcaaattgaaagtcatcttaaatgagcccgtgtctcaacacgagcaaggtaagagaattgaaaaccctgagtctaaacaccacaaacgcatattttggaaccaaagtctccacaattttttatagtttttattttgtccatgataagtacaacaattccaaatccaatgctttgtcatcatagggcacagaaaaattatgtgagaatagatagagacacaacccaatgcaaactaattgccaatttgtttgacgaacctcaacgggaattggaagttgacatttatcaacccaattccgaaccattcacatttaaggcacatcgatgtctaaaggtcaaacaaagtcaaaaattttggaccaatttactaaacgataagttcagtgacccggtcagtgtttctaccctcccaatgacaattgaagattgtcaagaaatgatcaattatgaaaagtgtgaattcggacctctcagtggtcatttaaattagcaatttcatacaaaccaagaattgcaaatagcctattcttggtggaaattcggaaaagacaaatccgaagaaataactgttatcatgcggtaataaccttaataggaaaaccgggatccgaaagtttgggctcacccacagaggaagtgagcaaatgtaagttttcaaaaggttcatgtcgactgggggataatgcgattctaatttggaacctcgattccacggagcatcaaagcgcgtgtctttacaataaagtaacaacagaaaatgggaaattcaccaagagaatgtggatatcaaaaaattcacagttcgctatatcattccaagagaatgctaagagtgtagaatcatgcggtcacacgcttaaattaagcgatcaaggttttgcagtcccctcgtggcaatttaggataattacgggtaagacaacccataggatcaaaagagagcaatggtggccaaaggaaaaaccattagaccagaacgagaaaagctcaacagcagctgcacaattgacagcgagagctatttaccaaaataaagaaacaaaggaattatttcaaaaaatggtgaatctaatttgtggtattttgcaaaatgccaatccaaagcaagatctgagtcacttaaacccaacgcaattaatgcgagaaaagacgggtactgaattggtaaaggcaaaatggatttccccaaatgtacttgaatggtggccgtgctcttaaatgttcattcgaaggactaattaaaagcattagcagaaaaacaacaagcattttcattttagctttagatgtaaaagcatagggatttcaacggaaggacaaaaaatccaaaagaaaccttaatatgacccgaaaattgaaaagtctaaatggagaaaacccaaactgtcgtaaaagtgacaggaaaagaaatttgatcaattttttgaaaatttggaaaagaaaga

SEQ ID NO: 72024 - DNA, 573 bp, Heterodera glycines
  Genomic contig location: Contig_ID=SeqID_9597; Location=1210..1782; Strand=-
  SCN-specific regions: Sequence locations=1-106,128-152,177-573
aagagcacggccaccattcaagtacatttggggaaatccattttgcctttaccaattcagtacccgtcttttctcgcattaattgcgttgggtttaagtgactcagatcttgctttggattggcattttgcaaaataccacaaattagattcaccattttttgaaataattcctttgtttctttattttggtaaatagctctcgctgtcaattgtgcagctgctgttgagcttttctcgttctggtctaatggtttttcctttggccaccattgctctcttttgatcctatgggttgtcttacccgtaattatcctaaattgccacgaggggactgcaaaaccttgatcgcttaatttaagcgtgtgaccgcatgattctacactcttagcattctcttggaatgatatagcgaactgtgaattttttgatatccacattctcttggtgaatttcccattttctgttgttactttattgtaaagacacgcgctttgatgctccgtggaatcgaggttccaaattagaatcgcattatcccccagtcgacatgaaccttttgaaaacttacatt

SEQ ID NO: 72025 - DNA, 286 bp, Heterodera glycines
  Genomic contig location: Contig_ID=SeqID_9597; Location=2410..2695; Strand=+
  SCN-specific regions: Sequence locations=1-59,84-286
atggcaactgttggcaaaagattggctcaacaggaaaaggcatcttatcgaagtatcggagtcaaaaagaaatcatattcagataaagcgatattccgtatcaatcaatcatgcctatcaaatgcaattttcattgaattttctcaatggccttagtgaatatacaacatattgatcatttcaaatcattagctgattttcgatataataataatccaaatttatattttattcagtgtgcccaattttccgtgagtccgcaaaataggtatagttttctcggcga

SEQ ID NO: 72026 - DNA, 539 bp, Heterodera glycines
  Genomic contig location: Contig_ID=SeqID_44546; Location=133..671; Strand=-
  SCN-specific regions: Sequence locations=1-450,479-539
atgcagatcttttatattcaactaattgagcacagggaaattgatccttatcgtattgtggtcttcgacttggagacaatgcaacaccatgcgttggacccgctccagccggagaaaagagaacatcagccaaacttcatcgctgctcgaattgcttgccccggctgtattgaaaacggcaattggagaagagggacagcaggctgtcaaatctgcggtccgcatcgcatggtcgctttctgccagcgccgttttgcggatactattgttgacaaacaaatagtgggcgaaaacccactggaggcatttgtggattggctcgtctacaaactgccaaagaaatacgaaacttatgcctattcacactttggtggtcgcttcgacatggtgctcgtcttccgcgagctgttcaggattggctttaatcccgagatgttgcgacgggtatacatttttaaaattttaacatatatttaaagtttcaggggaacaaaatgtatgaaatgaaaatacgcaaacaaaagcagcgcaatccaaat

SEQ ID NO: 72027 - DNA, 411 bp, Heterodera glycines
  Genomic contig location: Contig_ID=SeqID_44547; Location=1..411; Strand=-
  SCN-specific regions: Sequence locations=1-56,83-185,208-209,235-411
ggttcgatgaaactttttaaaatataagcctaaactttttggcctgtttaaaaaggaattaaaaatttttaaaatatttattcatctcccttttgatagaaaaagcatcagagagccttatttaacttttaattaacatttggtgcgtttcagagcactttctgaaaaaatacttatgaattaattttgcaaaaaataaataagtaatgaaaaagtcagaatttcgaaaaattttaaaaacaacaagcgttggcattttttcaggttaagttagtcctttacaatggagaaagcctgcaaaatttggagagattatatcgattttagtgcgctaggttcgatgaaacttttttaaaatataagcctaaactttttgggctgttttaaaaaggaattaaaaaatttttaaaa

SEQ ID NO: 72028 - DNA, 127 bp, Heterodera glycines
  Genomic contig location: Contig_ID=SeqID_44547; Location=902..1028; Strand=-
  SCN-specific regions: Sequence locations=1-127
agcaattaaaaatttttagattttttattcatctccctttttgatagtgaaagcatcagagagccttatttaacttttaattaacatttggtgcgtttcagagcacgttctaaaaaatatttatgaa

SEQ ID NO: 72029 - DNA, 422 bp, Heterodera glycines
  Genomic contig location: Contig_ID=SeqID_44549; Location=88..509; Strand=+
  SCN-specific regions: Sequence locations=1-334,356-422
atgaacaatcgtctatctttaaaccccaatgattttccgaacacgatggagtttgtcttgttcaatgccgttcagcagggcaatgtcgacaaccctgatattgaacgactcctggagcgccttagaaatcgccaaccgcctccgtctccattcaagaacgaccgactcctgtgggatgtattcgatgacccggaaatagccaacgcaccacaaatgacaattaaagtaatatcggcgttttaaattataatttaattgtgaaatcagtaaaaatttcattttaaagggaaagttttcaaaatatttaacttttcacctatttttaaaatagtcctttcattttgttgttttaattaggcagagcggtatcagcatgggtactgtttccgtctgattattttaaaagttaaaaagtagtgtta

SEQ ID NO: 72030 - DNA, 554 bp, Heterodera glycines
  Genomic contig location: Contig_ID=SeqID_44550; Location=1..554; Strand=-
  SCN-specific regions: Sequence locations=1-554
aaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagccgaaaatccaacgcagaattaaagtacgggctatagggaagctattcccgaaggattcggtctccccataaatctgggcgcatcggttcggggggactgccccgaaaacaaaaaaatcgattttttcaagtgtccatttggggtactcaaacaattatggggagca

SEQ ID NO: 72031 - DNA, 817 bp, Heterodera glycines
  Genomic contig location: Contig_ID=SeqID_44551; Location=56..872; Strand=+
  SCN-specific regions: Sequence locations=1-1,28-141,165-196,253 -253,343-348,412-425,455-491,519-735,768-776
atgtaccgccccagtcaaactccccgcctgacactgtcatcggcgcgggtcgccgggccaccgggtggcccgacttaacaccaaaatggacaccctttcgggcgcactcccgttttaccgattaagtaaggaatcgatgaaagtagtggtatttcactggcgccttgcggctcccacttatgctacacctctcatgattcttcacaaagtcagactagagtcaagctcaacagggtcttctttccccgctaaatttgccaagcccgttcccttggctgtggtttcgctagatagtagatagggacagtgggaatctcgttgatccattcgtgcgcgtcggtagttagccgacgaggcatttggctaccttaagagagtcatagttactcccgccgtttacccgcgcttaatcaagtttccttggcttaacattcagagcactgggcagaaatcagacacggtcaacgtccacaaggaccatccgtctcctctgttttaattagacagtcggattccccgagttcgtgccagttctaaactggtcgttcagcgccaaccgaagtgcataccctgacgagcatacacgcagctgaagcgctccacaagcagctctcaccactagtccacgcaccatccccgaaagaacagcacgcagccacgggcaaaagccgcctgtttcacgcaacagcccggctgacccgacctttagagccaattcttttcccgaagttacgaatctaatttgccgacttcccttacctacattattctatcgactagaggctgttcaccttggagacctgctgcggatatcggt

SEQ ID NO: 72032 - DNA, 4914 bp, Heterodera glycines
  Genomic contig location: Contig_ID=SeqID_9598; Location=396..5309; Strand=-
  SCN-specific regions: Sequence locations=1-145,171-700,722-843,866 -1526,1548-1718,1740-1821,1856-1863,1885-2277,2299-2710,2738 -3093,3115-3646,3671-3689,3794-3888,3953-4682,4707-4764,4807-4914
  Gene Ontology: Mol. function=carboxypeptidase A activity; Cellular component=secretory granule; Biological process=proteolysis and peptidolysis
atggcacttcagctcgacttttggaaagcgccgacaaatgtcggttcatttgtcgacgtgatggtggcgccggagtttgtcagctcgttgagcgaattgttggacaaacagcggattcaatacaacacaatcattgaggacgtacaaaggtgggacaaaaagggattgggttacagaaatagtgctgtcttgttactgtattcccaagggtggccaaatacataataatgccgaaatattgtatttatgactggttacagtattccaaaaatcttaaattatttactatattccagaaaatagaacacggtaatgacatagatttgaaaattcattaacagtaacttaccaaaaacaataaaaaaattttcatcgaggggaaaaacagctgattgagaaattcacgccattttttattgtcgctacgcggtttttaattactttttaattgcctaagggcaaattaatgggatggaagttttaataaatgaatgacgacaaaaattattattaatgcggttaattgatgataaatgataaactgccatcaattcaaagggaactctccgtgagctattttttatgtgccccagtgaagagtggctatttaggagagacaattatctaattaattagtcacggtcaattaaccaaaacctgttgaacggatggcataagcaaaaattgggatcaactgatgaatgggagaggaggattaaatgcgcaattgcagaaaatgaaaatttaaaaaaatttcgctggtttttcaaataaatgaaaagatgtgtgccgatatctctagaagtaaacaagattacagtatgactgtttacagtatgattgttcaacgggaaaaggcaaccggcggacggcaccatcaccacaagggcaacctcagcgagtcgttgctgctcagccagttcaagctgttcggcaaacggatgcgtgacgatgcgtcgccatcctttgtatcgaggaataaagccgtttacggattcggtgggtgcaatattagcgattcaaaagccctgccgtcaatgacgatataaaatagccccaatataatttgatagtgatcagtccacaccaaatgatcaatgtcaaaatatgtaaatgaccagctggtactgatttttccatgtcattgatcagatatagaagaataaaagaattaaatcgtcaactttgatcagaagacgatttgagaaaaaatactgatcagaaaatgtcgatattttgctggccatttaaagttatcatttttattttttgggaaaatttatgagaatatttaaaatttaattgcgtcaaaactgcaatagagcctctaatttgattttggacagccgtataattttgtgtgtcctcacaaaataggcgattaccattcgtacatcgaaatgctcacttggatggatgacattgagcgcttttatccgcaactggcaaaaaccttcacaattggcaccacatacgagggccggtccatccgcggcataaaggcaagccgagtcaaaagagcggcatgacaaagaaaatcgggaaaatattcgagaaattactcaacccggcacaacgggcatatgtaaaaaacagcaaattaggggaaaacaacattgggaaaattaaacaatttaagtcggggaaaagccgcgaaaatccgaagggtttgtcaaaacagaaaatttcggattaaaatttaaagcgaatttttttgaaaacattgagtgacatttttctatttctgagattgctgctgagaccaattatctcaccaagataagaagattagcctcaaattgaccagttgatagaccatggctctcctccctcctccatcccttttaaaaatgaaagcaaaattaatttaaaccaaattaacggcttttccctccgctcacagattgggagcccagtttcggacacaaacaagcgcattgtttggattgacggaggtaatgggagggagaggaggcgggatttttggaaaaacggtcattaattttaattaatttcaggaatgcatgccagagaggttggtcattgttgtcaatcgttggcattttttgtggctttttgggcgcattcaaaaaaataggcgacatctatgggaatagagcctccctgacattgaccaaaaattgaaaatttttgaattcttggaagatatttccaaataggaattttaaaaaaatgccgaatttatggattttcacaattttctttggaacaaatttcatattttggaaattaaaacttatttccaaaatccttaaaaaactgatcttctaaattgtttaaatggcattcgaccagttcttgggtgataaaagggatttagtaaattatgactttatcccgtgccagtcgcttaatcccccgcctttcagtgggcttcaattcacacggcactttggttcatcgatcaggtgattgattattaaatctcttgtgattatttgtgtacacttttgtagctgatctcactgtatggagtggacccgcaagtcacagcttacatggacacgttgaacttttacgttttgccgttggccaacccggacggatttgagtgagtgccaacattttcaaatgaaagaaacgattggattattgacaaacataacttgatcagtaattaaatttaaatgttggaacatcgattagggcaaagttgtgtgatcactgatcagcaatcatttccacttgattgactaattaattaattaattgtcacagatactcgcgctctgacgtcaacccgcagacgcgcttttggcgcaagaaccgaggccagcaagtgtgcaagaaggaccgctggagacgggaacgatgctgcggcggggtggacctcaataggaacttcgacttccactggggaggtacggaatggcatggcacggggggtgatggttgttaggactgctcgagactctcggtctccttagttgttgagtttttcaattttgccgtttgaggattttttgggaaactttggaaaaatgaaaagaaattagtgacaagtggtgcgctaggcgtggcctgagaaaattgaaattttaattgcccataccggtgatcctactgagtaaaaacaacggaacttgagaggattcttagaaattaaatccttttttatctggatcattgcctcagtatttcaaaaacaggctcactttgaccagtttttcactagaagaatatcgggaccaggattcgggagaatttgtcgggactaggctcgggattcgggtagaaaccctgtcatttttccaagaaagccttggcgggttcggcagcctttaatttttagtccattttcactcattatcccatttatttgcagagactggctccagttctgacatgtgctccgacatttaccaagggttcgttgtggcagaattttaatttaatttacaatttttttcaaatccctgaaatttcagtgcctacgccttcagtgagcccgagtcgcgcgcaattcgcgacaaaatgatgtcatcggaattgtacggcaaagttgacgcgttcctcacactgcacacatactcacagatgtggtgagttttttttcaatttttccccaaatttttggggtttttttttttatcaaaatattcttttaatggtttcataagtcatcatttaattaaaattatttaaaaaacagggtttaatttgctgcgatattttgtttttttaatttatttaatagaattgatcatttttagaatgtttaaaatgttaattaatttaaagatttaaaactgattttttaaatttttttattcaatttgttcattcatttgtctctttaaggatccatccctacaaccatgaacgcaaatcattcccaaatgacattgaagatttggtcagtgggagaaattttaaaaattctactaaaattaaaaaaacaaaaatgcataaaaatatattctttaaatttgaatgtcattaaatcccattaatcgattaattatattccaattttattttctttattgtataaatttacattttagcaagaagttggccgacgtggcgtccgtgcgcttgaacaattgtacggtactcgctaccgttttggtaccggcgccgacatactgtacccgtccgccggagggcaagtgctaatataataatgaatagagctgtcagggcgggataaagtgtcctagtttttgcaagaaaccacatcatatctctgtgatgtgaatttaaattatgcttacatcctctaattgcactgatttttcagttcggatgattgggcaaaatccaaagctggcgtcaaatacgtttatctgttggaactgaggccgggagaggaggaatgggtgaggagtggaccatggttgtactgatattttgaaattcgcatttttcattcggattttaatttttttttaaaccgagtaattttgcactaattatggggccaatttctcattagcgaaattgttgtctcaaacctattggctattattttcaacaaaaactaagtctcacacccaagaacccagaattactacaagtaattgaaataattcatgtatctcgacttacaatttaactcggttttgaatttaggacggttttctgttggaccggcgccagctgatcccgaccggccgcgagacgtgggagggcgtaaaggtcgccacacaaattaaaccaataaaaaatataaattaaattttgcaggtcgtaattgatgccgtgatgcaacgtgccaaggggttgcagccttggcgcagtacgacaacaacaacgaccacgacaacaacggtgacaacgacaccgattccgcagcgaccgccggcacccgtcgtcacccctccggcggcgccgccacgtgccgttctgcccgatttgccaccacaaaccgtgccaacaaatgcgagattg

SEQ ID NO: 72033 - DNA, 189 bp, Heterodera glycines
  Genomic contig location: Contig_ID=SeqID_44552; Location=44..232; Strand=-
  SCN-specific regions: Sequence locations=1-189
atggagaaggcctgcaaaatttggagagattatatcgattttagtgcgctaggttcgatgaaactttttaaaatataagcctaaactttttggcctgtttaaaaagcaattaaaaatttttagattttttattcatctccctttttgatagtgaaagcatctgagtgcctaaaataacttgcaaataaa

SEQ ID NO: 72034 - DNA, 155 bp, Heterodera glycines
  Genomic contig location: Contig_ID=SeqID_44552; Location=337..491; Strand=-
  SCN-specific regions: Sequence locations=1-32,59-131,154-155
taagcctaaactttttggcctgtttaaaaaggaattaaaaatttttaaaatttttattcatctcccttttgatagaaaaagcatcagagagccttatttaacttttaattaacatttggtgcgtttcagagcactttctaaaaaatacttatgaa

SEQ ID NO: 72035 - DNA, 155 bp, Heterodera glycines
  Genomic contig location: Contig_ID=SeqID_44552; Location=671..825; Strand=-
  SCN-specific regions: Sequence locations=1-32,58-155
taagcctaaactttttggcttatttaaaaagcaattaaaatttttaaaaattttattcatctccctttttgatagtgaaagcatcagagagccttatttaacttttaattaacatttggtgcgtttcagagcacgttctaaaaaatatttatgaa

SEQ ID NO: 72036 - DNA, 987 bp, Heterodera glycines
  Genomic contig location: Contig_ID=SeqID_44553; Location=40..1026; Strand=-
  SCN-specific regions: Sequence locations=1-209,244-316,367-491,530 -717,739-828,860-987
atgtcttttgaaaatattcgatatttaaatagcagtgtttcaatggcttctatgaatccaatgcgatatcaatttaagcataaccgtgggccatattgtttccgtatttttggacaaatcttagataaaataaaaatcgcacttaaccctgattctgatgagttaccatcaaatggccaattgtttatcattgacactggtgaagctatgaattttttgagaaaatcaaacccaaaaatagacgacgatttgcttaactctatttatagtttgatcaaatctgaaaatccttttgcacaagcatttataatgatgaaagatgaagaagaatatgaaaaagaaaaagctaaagaagaaggaagagaaccagcggaacttaaattattatttgggttgtcgccagatatggataaaaatagatataaattgcctagagcaaatgaagtagccgttgtttttgtgcctggagctgacggagaagtaccagaatcgaaaattgtagtcagagaaaaaggaaaagaattaagagttttgaatagtcttgacaaaaatgttacaccaatgtgctaccctttgttttttccgagagggacaacagggtggcatcccgaaatgaaacagaaaaatggaattaaaaatttgacgagattacagtatgcaagttattgtattgctgtgagaaacgaatttaatcctcttctttatggagcaaaattatttcagcaatggtgtgttgacgagtatgttaagatcgaaggtgatagaataagatggattagaaataaccaaaaaaagattttagcagattcttataaaaatgttgatagttttttacttaaaaaatcccaagaaacaggacttccaattgacgcaaaattattttaccagctactgttgttggatcaccacgttatattgaaaaacactttcaagatgcaatgtcaattgttcgaagatttggcaaacccgatttatttattacgatga

SEQ ID NO: 72037 - DNA, 448 bp, Heterodera glycines
  Genomic contig location: Contig_ID=SeqID_44554; Location=923..1370; Strand=-
  SCN-specific regions: Sequence locations=65-136,204-339,375-448
tgcatggccgttcttagttcgtggagcgatttgtctggtttattccgataacgagcgagactctagcctactaaatagttggctcattgcttctgtgggcacaacttcttagagggattttcggtgttcagccgcacgaaattgagcaataacaggtctgtgatgcccttagatgtccggggctgcacgcgcgctacactggcaaaatcagcgtgcttgtccttccccgaaaggggttggtaaaccggtgaaaatttgccgtgattgggatcggacattgcaattattgtccgtgaacgaggaattccttgtaggggcgagtcatcaactcgctctgaatacgtccctgccctttgtacacaccgcccgtcgctgcccgggactgagccatttcgagaaattcgggggacggttagtgttcccggcttcggtcggtatgcagactgga

SEQ ID NO: 72038 - DNA, 759 bp, Heterodera glycines
  misc_feature (36)..(36): n is a, c, g, or t
  Genomic contig location: Contig_ID=SeqID_44554; Location=846..1604; Strand=+
  SCN-specific regions: Sequence locations=1-151,187-322,390-461,537 -544,572-574,697-759
atgatccagcagcaggttcacctacagctaccttgntacgacttttgcccggttcaagccactgcgattaaatcggttccagtctgcataccgaccgaagccgggaacactaaccgtcccccgaatttctcgaaatggctcagtcccgggcagcgacgggcggtgtgtacaaagggcagggacgtattcagagcgagttgatgactcgcccctacaaggaattcctcgttcacggacaataattgcaatgtccgatcccaatcacggcaaattttcaccggtttaccaacccctttcggggaaggacaagcacgctgattttgccagtgtagcgcgcgtgcagccccggacatctaagggcatcacagacctgttattgctcaatttcgtgcggctgaacaccgaaaatccctctaagaagttgtgcccacagaagcaatgagccaactatttagtaggctagagtctcgctcgttatcggaataaaccagacaaatcgctccacgaactaagaacggccatgcaccaccatccaccgaatcatgaaaaagctatcaatctgtcaatccttacggtgtccgggccgggtgagtttccccgtgttgagtcaaattaagccgcaggctccactcctggtggtgcccttccgtcaattcctttaagtttcagctttgcaaccatacttcccccggaaccggaagactttcgtttccgggaagctccccaccagggcgaataaatccgccggcggatcgctag

SEQ ID NO: 72039 - DNA, 168 bp, Heterodera glycines
  Genomic contig location: Contig_ID=SeqID_44556; Location=200..367; Strand=-
  SCN-specific regions: Sequence locations=1-168
atgttttcatcatccaaaagtgccgcagttttgcgaatgcgcggcgccaccggcgcaatggcacggcggtggaagggcggtgacgagcagaaaaatgtgccagtgccgagccccaaagaaatggcccagcggccggcggagtttgacgagctgacgcacacgggacag

SEQ ID NO: 72040 - DNA, 959 bp, Heterodera glycines
  Genomic contig location: Contig_ID=SeqID_44561; Location=169..1127; Strand=-
  SCN-specific regions: Sequence locations=1-41,98-225,247-251,273 -380,408-959
atgaaagtgctgcagaatatgggcgatgggcatatggtgagttttttaaaataattttaattaaattttaaataaaaataatatttttaaatttttagatgcgcacaaaaccgtccgattccgatgaaggaggtgccgggaagggcaacggtgtgatcgactcgccctttctgttttagtgatcggagattttttatacacatagaagaatttgttgatttctattatttttaacaattaatgctagaaatatttaatcaaattaatttttacaatattgtcagttaaacgggatttttgaatgcaatgttggaaaattttttttttagggaattaggctcctgccgttttacacagataagcaggcgccgctaggaaattttgtgaaaaatttggattaatttgtgcttaaaatttgtcaaattactaatgaactgagtaaaaagagttttcgggataaaaattataattatacgttgacaaattttggatctattaaaatatacgcagctaacatttatttaatgagctattgacaccgccaattatttatgtatttaaaaattttacatttcatttatctatttaatgttttccagcccagctctaagctctccgggaccaattatcaatcatttgtaaaattttcgagtgatttaaaaaaaaaaaaactttccgatcacataaattcatatatgggtgtgaaattaataccgtcaatattccatgtaaaaattcaaattagttaataattaatgcatttgttttttactcgcttccatccgccagccaatgccaacacattattcaacaagctttaatattggacggacatttcatgtaagtgagcgtggcgcctaaacgaagtaattagcacacaattaaaaaattgcaagtaattagcgctgtaattaattaattatcccccagggaattaggttcttacgcatttgaataaa

SEQ ID NO: 72041 - DNA, 570 bp, Heterodera glycines
  Genomic contig location: Contig_ID=SeqID_44562; Location=321..890; Strand=+
  SCN-specific regions: Sequence locations=1-236,259-436,458-570
atgaccgtcacatccaacaccgaattccgactcatcgaatgtgtgccaatcctcgaggaagttgctcgtgaatttggctgtattacgccactaccaaaccttgggtatgtttctttcgttttacaacactaactccagcatacagtagccatcgtgactatcgtgtaagcggatgtatgatgattcgcacgctgacatcgttgaatcgactctacattttcgatgctgaagactgtattgaggttaatggaaaacatgtttcatattttattgctattttaggtgaagggtttcttaaggcaagaggacggcacgagccaaaaagtggtcaacgaatattatgaaaaatatgatggactaaacggatttactgaatttcttcggaattgggcttttaactttttctgtttacatgcctttgatgatgatgacgacacatctgatgaacactaatttcgttaatatttattgtatgctcttggttacaaatcgataaacaaacgcatcagggttatttgaacgatttaaaatttgcataacattttcgaaacccaatccgacggacataaa

SEQ ID NO: 72042 - DNA, 512 bp, Heterodera glycines
  Genomic contig location: Contig_ID=SeqID_44563; Location=214..725; Strand=-
  SCN-specific regions: Sequence locations=1-361,386-512
atggccaccagcgccggaagtgcttggctgttgcagttgctgctgctgatccgatgcggcggatacgtcctggctgatcttcttgccgctcaacacaatgctttggggatgctaaaaaatgtttttttttcttcaacaaattggcgccgagaatgggagaattttacggcacgccattgtggagaggaacgtggaaattaaaaaaaaatgccaattttggctatagtatcatctggtaataaaatgcaataaattttcagacattctccgctagtgcccgcaatcttttgtttgtgcacagcgtcaaaaagtgataaaaaaatgaaaattcttttcagagccattgagaggaatggagacatttttaaaaaatggcatttttggcgctatagaatcatctcggaaccgctcagttcggccccggcacgttatctagaaaaacataaaaacatttcccgatgggggggggcccgacctgagaccttgtttttttttgctatttaaccaataaa

SEQ ID NO: 72043 - DNA, 317 bp, Heterodera glycines; identical to SEQ ID NO: 71782
  Genomic contig location: Contig_ID=SeqID_44570; Location=296..612; Strand=+
  SCN-specific regions: Sequence locations=1-317

SEQ ID NO: 72044 - DNA, 636 bp, Heterodera glycines
  Genomic contig location: Contig_ID=SeqID_9601; Location=828..1463; Strand=-
  SCN-specific regions: Sequence locations=1-410,433-474,611-636
atggcgtcacaagacacaccgcccggcgacgagaacgttgcggatgcgcagcccttcgacgacacgctgactgtgtacggcggcgacgagaacgttgcgcaggcgcagcccgtcgacaacacgctgactgtgtacggcggcaacgagaacgttgcgcaggcgcagcccgtcgacaacacgctgactgtgtacggcggcgacgagaacgttgcgcaggcgcagcccgtcgacaacacgctgactgtgtacggcggcgacgagaacgttgtgcaggcgcagcccgtcgacaacacgctgactgtgtacggcggcaacgagaacgttgcgcaggtgcagctcggcaccactggtaaggaagcaggggcggggttcggacaaaaaagccattatggatattggcaaaagcttttgagttttattttacaaattaaaggtttctccctttttaaaggcgtggccgtggcggaaacgaccaaagaaaaggcgaacgaaaagaaggacaagaaagcggacgaaaagaaggacaagaaagcggacaaaacgaaggacaagaaagtggacgaaaagaaggacaagaaagcggacgaaaagaaggagaaaccggaaaaggtttccaaaaaaaatgttgagaaatag

SEQ ID NO: 72045 - DNA, 1143 bp, Heterodera glycines
  Genomic contig location: Contig_ID=SeqID_9602; Location=1058..2200; Strand=+
  SCN-specific regions: Sequence locations=1-603,625-668,691-1143
atggccgaaaaaatgagcaagggctcatataatgcatgtgacgcggaaactgtttttggacgtgaaaatgtatgtgataggacgcgcttaaaaccgacaagaaccgcctttatttcttccatattcaatgccgaccgtgatggcatgagattgaattttgaggatttgaagccctacaaccaggaaaaaaccgtggaggaagtgttggaccgtttggacgtggaagtgtgcccgcaaatggtctacaggatgggcaggagtagtgacgaaaagaggaaggggccgcgcttggtgaaggtggtcctgccggcgtccaccttccaacgcttcgcgctgatgcagtgggggcgtcgtcggacggagctgaagaagagggctggttgggagcgtcttctggtcaggtcatccctgacgaaggaggagctggaaattgaacgtgaacagcgccaaaagaagtggatggaatttggacagaagaaaacggatgaaaacatcacgacgcgacgcggaggcaatgaaaaaaacttttgaggtcacctccttttttaaattgtttatattttaatgcacgaagtttggcgaacaaattggacaagttaaggtttttgttattagaaaataggtttaaaatcattgctgtatctgagagttggttgagtaacaaaatagaaaacccccaaattttggaaaatctccactattctataataagatcagatcgacttaacaaaaaaggtggcggtgttgctttcataatatcgaatttaattccttttgaaattatcaaaactgcaaaaaacaaaaattccgatattctttgtgttgacctattctcacctcttaaccacacaaaaacacgttttattttgatttatagacccacttcacatgaaaaacaagaagatgtcgaaaaattggtcgaacaactctctggtttaatctcggcttccgaaaaatgcattttgttgggtgatttcaattttcctcttttaaaagcaaaagactttagcatccaaaatttcgaaaaaagatacaatcaccttgaatcatttttcatttcctttttagagggatttaaactaagattaatggtaaactctcctacacggggcaataatctattagatttattatttacaaaca

SEQ ID NO: 72046 - DNA, 664 bp, Heterodera glycines
  Genomic contig location: Contig_ID=SeqID_44573; Location=702..1365; Strand=-
  SCN-specific regions: Sequence locations=1-313,344-533,576-664
atgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggagggggggggggcgaaggcccaccacgaggccgcgaagaggccgagtgagtaccttcggtgcaggaaaattattaaattttaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaatttttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaa

SEQ ID NO: 72047 - DNA, 346 bp, Heterodera glycines
  Genomic contig location: Contig_ID=SeqID_44575; Location=211..556; Strand=-
  SCN-specific regions: Sequence locations=1-59,92-221,245-346
atggttgaaagcgggacagacactcctttgctccaattgtgcaattctattgaaaaatgtaaatttttatttatttatttttgttattatagtatcctttcttggttttcccaggtttgcaacatcttcgagctctcaaaaaccatgtgattgtcgctcataatttgctatccgagaagatggcacttgcaacgcggacagaagaaccgagccaaattgactttgaaagtgttaaaaatgtgttggaaaaggctggcgttcaaattgctgacgaatacaagtaaaaaatgatcaacgatgtatttacaattaatataatttgaagatgttaatcaattaaaataaa

SEQ ID NO: 72048 - DNA, 47 bp, Heterodera glycines
  Genomic contig location: Contig_ID=SeqID_44576; Location=15..61; Strand=-
  SCN-specific regions: Sequence locations=1-47
atggcgattggcacagccctccgtctctacgcaagcgcttttgtgag

SEQ ID NO: 72049 - DNA, 304 bp, Heterodera glycines; identical to SEQ ID NO: 51570
  Genomic contig location: Contig_ID=SeqID_44576; Location=284..587; Strand=-
  SCN-specific regions: Sequence locations=1-304

SEQ ID NO: 72050 - DNA, 228 bp, Heterodera glycines
  Genomic contig location: Contig_ID=SeqID_44576; Location=916..1143; Strand=-
  SCN-specific regions: Sequence locations=1-228
aaatttatcaaaaaaagagatagccatttttctgggataacctctaaatataaaaatcctctgtgaaataaaatggcgattgtgcacagccctccgtctctacgcaagcgcttttgtgaggtataaaatttctcaaaaaaagagatagacatttttctgggattgagtataaatttaaaaattccctcaaaaataaaaggtctattgcgcaccgccctccctatcatg

SEQ ID NO: 72051 - DNA, 976 bp, Heterodera glycines
  Genomic contig location: Contig_ID=SeqID_44578; Location=176..1151; Strand=+
  SCN-specific regions: Sequence locations=1-7,29-263,286-309,331 -415,438-976
atgccaaactcaccgtcctcctcttcggcatcgatgccgcaacatcagcagaacggaggtgagtgttaacgcgaagagagagtcggaaagccaatcatatgagttttaacattttcgagttttttttttgagtttccgccaatgtcggcacggaacttcgtttggatggtaccaacgccgtccaacagcagtcgtccgccggctcaaacagtgcccggttgagtccggacgggtcgttgcgaaacgctgcagccgccggatacgcagcagcagctgccacaatgaacggactcggcggcgcggtcccttccgcgtcgacgatgaacagcgcggcactgatgcactcactgggcgcggcacagcaaatgcattacggcatcgacccatagtgagtggggctgggactgttttggggtgtgcttcttcagcacttatatctctcctcgattcagctttggcatgtcccaagcggacttaagtgcgtacagtatgctaccgtcggctgcccaatacaatttcaatgtttgcctttttctgttgggaatgctaccgtaactttctgttaagcgttaccgttacccaccaaacattcaccaaacgacggcgactgcgtccgctttcccaactccgcccgtcagtggcgcagcaatgcctgtgccgggtgagaagggcaaagtgacaatgccaggaaatcggtgctttttcccaggctccggactgagtctacaggtgtccgtgctggccggacaacactcagccgcacatttgcacaatctgagcaccaacgaatggggcggcacttcgacggtggaccatccaagtcagtattggccccaatgaccgaacgaagggacaaatagcgaacggagaaagcgaaccgaccgatccatggacaaatcacaaatcaacagttgtttaccaaagattttcaaaaggtcatcgattcattcacaagcgtattgtgcttttcatatca

SEQ ID NO: 72052 - DNA, 142 bp, Heterodera glycines
  Genomic contig location: Contig_ID=SeqID_44579; Location=619..760; Strand=+
  SCN-specific regions: Sequence locations=1-45,67-142
agcgatctgtacgaattgaagttggcaatgagctgaagcagcgttgtgagaaggaaatcaagacaatttggctggaaattgttgaccaacagcgcattgatgagctgtccatggagagtcaattgtaagaaaaaatcagtta

SEQ ID NO: 72053 - DNA, 210 bp, Heterodera glycines
  misc_feature (197)..(197): n is a, c, g, or t
  Genomic contig location: Contig_ID=SeqID_44579; Location=1231..1440; Strand=+
  SCN-specific regions: Sequence locations=1-210
atgcgcctgtttccgttcaactatttggacacgtatcgtaccgtgacggagattatgcacgaattggagcagttccagcaacacaaccaaccaccgacaaaaattcatggccaacaaattgtgtacacggtgaacatcagctgcggcgagctgaacgagcagtccagcgaagtgataagtgcggccatcgagaatgngctgagttttcag

SEQ ID NO: 72054 - DNA, 403 bp, Heterodera glycines
  Genomic contig location: Contig_ID=SeqID_44580; Location=550..952; Strand=+
  SCN-specific regions: Sequence locations=1-277,320-403
atgcgcacccgtccgatctggcaagttaagcaacgattgctgactagccaaaaggttcggtgccgtgatgaaacgaaccagcactgcttaccccgcggcacccgaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatga

SEQ ID NO: 72055 - DNA, 1068 bp, Heterodera glycines; identical to SEQ ID NO: 44581
  misc_feature (937)..(937): n is a, c, g, or t
  misc_feature (964)..(964): n is a, c, g, or t
  misc_feature (984)..(985): n is a, c, g, or t
  misc_feature (997)..(997): n is a, c, g, or t
  Genomic contig location: Contig_ID=SeqID_44581; Location=1..1068; Strand=+
  SCN-specific regions: Sequence locations=1-328,352-384,407-604,626 -986,1059-1068

SEQ ID NO: 72056 - DNA, 266 bp, Heterodera glycines
  Genomic contig location: Contig_ID=SeqID_9603; Location=689..954; Strand=-
  SCN-specific regions: Sequence locations=1-6,50-266
atgagtggaagaggaaggaacggaggaggaggaggcggatgtggaggagcacagcgaaccggcgctggagagaatggaagcggcggccaacttctcgatcaattggctcatgaagttcgtgtcgtggggcgcggagcaggagggcagcacgtccatggtcatcacgagaagagagtaggcgttgaacagtcggaacaacgacggagagaagacggaagcggacggattggaagcggaaaagaaaacggtggaggaagcgaagatgg

SEQ ID NO: 72057 - DNA, 1602 bp, Heterodera glycines
  Genomic contig location: Contig_ID=SeqID_9603; Location=1366..2967; Strand=+
  SCN-specific regions: Sequence locations=1-363,386-484,506-886,914 -1137,1159-1169,1191-1397,1423-1429,1451-1602
atgagctattacagtgatcagcagcaaaatcagaggatgagcagtggcggaaacgccgaaaatggggacaaatccgcggatgacggaggggcggcagagcgacagcggaggacattccgcgaagtgcgcaaaagcattgtgcaagcgacgcaacggcacggctccaaaaaggtcaccgacttggaaatgcaggtgggcaaggcaatccggcaaaaccgggcgatcagagtcgctaaccatggatgatttgcttgagatggttgcctgatcagacagtttctgtccgatcactcctgatcaattccccattgcgacagccaaaacatattcacacctgtgtttttgaattgtctgcgtgtcttcatcatggtgatgatgatgatgcggcgtgtttatctgtatttgattgatcggtcgatcaatcattcgcggacattgcgtctgcgccacacctctcccgtggggttgggcaaggacaacacagtccatggggacccaacccagccgaaatgtgagggcatattgcctgggtaataataataataagtggagaatatagacggataattaggagacttgttttgacaatgatcgatccaattcttaaaggaaatgaattgattcgttagttgattaaatcaattattctttaaaattgacccaaaagttcttcataaaatcgcttattgctgctatgtattagattgatcagaaattttagaaagatatgacaattttcaacttcgagaaacaagcggagaataattaattagaaaataagaaaatcattccccaatcagtgatttgttagtgctgctgctatttcaagcaaatccatcccgctgatctctgctctgatcagcaccatttcctaccgccgatcaaattcattttgcttatttctgatcactttcagctgctccgccacttgacctgcccgcagacggccgttctgcgcccgctgcgtcctttccaccacaaaaagcggcacttcctctcccggcccccgtcgccccaactgttcgacatcagcgaggagaacgacgagcagcaacagtaattgccggaggacagtccgatcgatcggtcgatcagtgatcagccgctgcttctgatcagtcagtctctccaatccccgcaaccaaccaccacgaggagcagcatcagcagttgttgtttgttgtctgttgctgttgactacatccttcttttgtctgaacaaagcgccttcgtgtaccttctcaagcgctactgagtgatgatttataccaacacctcatttgcttattattaacaagcctccctcattagttaatgatcattaattattttctacccgacgtctcccaaagtctctcccctcctcggcagctcacaattcaaatttatatttgccctttcttgtgtctctatttccttcacccggcgggtaattaatgctaataacaatttggataacactcactcattaggccgtccaaattgcgtttgtttcttctaatcacagacacttaattatgtaatcactagagagagattacttttgtgacgcctttttaacatttttctcaccatgttgcgctgctgttctattttggccta

SEQ ID NO: 72058 - DNA, 147 bp, Heterodera glycines
  Genomic contig location: Contig_ID=SeqID_9604; Location=1..147; Strand=-
  SCN-specific regions: Sequence locations=1-147
caagaatcgcccaaaaatgatcaaaacgaagcgatgtcgaagaagttagaggacatcaattctctgatgacgagactaacccttcacaaccgttctttagcccaattattcgcattgaaccaactgggtctcttttttagcattttc

SEQ ID NO: 72059 - DNA, 564 bp, Heterodera glycines
  Genomic contig location: Contig_ID=SeqID_44584; Location=125..688; Strand=+
  SCN-specific regions: Sequence locations=1-564
  Gene Ontology: Mol. function=ubiquitin-protein ligase activity; Cellular component=proteasome complex (sensu Eukarya); Biological process=ubiquitin-dependent protein catabolism
atggatgacggcaaagacatgttccactggaaggccgccatcaaaggaccgcccgagtcgccgtacgaaggaggcaccttccatttggacatcgttttccatcgcgactacccattcactccgccagttgtcaaattcgaaacgcccgtttaccatccgaacgtcaacaagcagggtggcatttgtctggacgtcctgaagacgacgcattgggcgccgtcgttgaccatttcgaaaggtgaaagcgacgcgacaaagagcagataaaacgccgacaaatatcgacaagacaaaatggcccaattcaaaacgaccgccaaaactgtattttttgtaaaaatgccgatattttgtcgtgtgaaaatgggatttttcaaattcggaaatgccgttttaattcattgtcccccctccatttcagtgctgctctccatctcttcgcttctctgcgacccgaatccgaacagtgcgctggagatggacatcgcgattatctaccgcaatgaccgcgagcagtacaaccgaaatgcccgtgaatggacgcagaagcacgcgatgaaatga

SEQ ID NO: 72060 - DNA, 100 bp, Heterodera glycines
  Genomic contig location: Contig_ID=SeqID_44587; Location=87..186; Strand=+
  SCN-specific regions: Sequence locations=1-100
aaaattccctcaaaaataaaaggtctattgcgcaccgccctcccctatcatgctcgagagcatttgtatgtgtataaaatttatcaaaaaaagagatagc

SEQ ID NO: 72061 - DNA, 304 bp, Heterodera glycines
  Genomic contig location: Contig_ID=SeqID_44587; Location=341..644; Strand=+
  SCN-specific regions: Sequence locations=1-111,133-304
aaaatcccctcaaaaataaaaggtctattgcgcacagccctccctatcatacgcaagagcatttgtaagtgtataaaatttatcaaaaaaagagatagccatttttctgggataacctataaatataaaaatcctctgtgaaataaaatggcgattgtgcacagccctccgtctcatacgcaagcgcttttgtgaggtataaaatttctcaaaaaaagagatagccatttttctgggatagactataaatataaaaatcccctcaaaaataaaaggtctattgcgcaccgccctccctatcatg

SEQ ID NO: 72062 - DNA, 189 bp, Heterodera glycines
  Genomic contig location: Contig_ID=SeqID_44589; Location=410..598; Strand=+
  SCN-specific regions: Sequence locations=1-27,49-189
ttacgtcgaccaacacgtcgtccaatttctccaccgcattcgccgccttttcgactccgtcccgacaaacctttacattgcgaccgccgctttggccgaaactgtctaccgcctgaagcacttcgtccgcagttgcgaggcgattcgccaacacattttgccgctgctccgtgccaatgtccgcgccct

SEQ ID NO: 72063 - DNA, 330 bp, Heterodera glycines; identical to SEQ ID NO: 69563
  Genomic contig location: Contig_ID=SeqID_9606; Location=168..497; Strand=-
  SCN-specific regions: Sequence locations=1-262,285-330

SEQ ID NO: 72064 - DNA, 560 bp, Heterodera glycines
  Genomic contig location: Contig_ID=SeqID_44595; Location=9..568; Strand=+
  SCN-specific regions: Sequence locations=1-232,254-257,301-406,429 -501,523-560
cagtacagcaacaacaacaagttcaagcagtacagcaaccgagactccggacggtcagggacgaccgccgctacgaaatcgccgctatcgtttgttcgcgccgcgccgcagatggtcaaacgcgtgaattgaggatccattgccggtcattctcgtatcactatgatacatatgaagcagaagcgtcaatccaaagggtaaaatttttttttaatttgtgcataaaaataagcattaaaaaataataattcagcaagcgcctctaatccacgcggcgtggctccaggtccacgaccttgggaatacgccgccgcacaattttcaattttcgcgtcgtcgactttttgttaaataaattaattaaacattacttcgtaataattaattaattaatgaaagatgcgcaagcagcagcagaaggagaagaagcacaaaatttggcggaggcacgaggagaagaagcaatggaagaggacgaccaccaaaaaaatttgcaggggacaccagcagcagaagaagcagccctaatttttgatccgatgcagccgcaggctgcgtag

SEQ ID NO: 72065 - DNA, 434 bp, Heterodera glycines
  Genomic contig location: Contig_ID=SeqID_44596; Location=47..480; Strand=+
  SCN-specific regions: Sequence locations=1-318,341-434
atgtttgctgttttgctcatgcccattgaattgaccaacggattcactggggagcgattgtcactgatgaaactgaatggcaaatatttggtgatccgttgtccgatttcacgcgatgagaccaaatggaagaaatgggaacaggaggccattgaatgtgatttagataatcagttgaacacaattcatattggaatatgtgatgacgacatcggcgacgggtgagtaataattaataatgctctaagaatctcgactcgataatctcgggtttttttttggctcgatcacgagtatcactaataattattactaatttgaatgataacattttaatgggtattttcattttcgcttttagtcttctcgatgatggaactcccggcccaagtgatcagcagaacagaattgtggagaatgaccgatcaacgtga

SEQ ID NO: 72066 - DNA, 546 bp, Heterodera glycines
  misc_feature (8)..(8): n is a, c, g, or t
  Genomic contig location: Contig_ID=SeqID_44596; Location=527..1072; Strand=-
  SCN-specific regions: Sequence locations=1-162,203-426,448-488,524-546
atgcctcncagtgacagttcagtacaaccagcagttgattcatcagcattgacagcagcaaatggcgcaccagcagcaatcagtgatcgaaacgtgaacaacgcaaattgcattgatcagagaagtgattgtccatttttggcaagtattggtaatacattcatttattatatttttaaaattaattgttaattatattttaggcaattgtgagtccgtgttctccacttctttcatgcttgtccattgtgcgcgaacgtgccgaaaatgtggtggcatcaacgacaatgcatcatcgtcatcagcccaacagtgtgatgatcagttgccaatgtgccgacgatgggcggcaaacggcctttgcgaactgttcatatttcaacaatatttgctcaacaattgcgcattgtcatgtggggggtgttaatttgtttgaacattttttgacataaaaaatgtcattttatttttttttgtaattatggcaattaaaagttttaaaatttctagtaaaatattattttgaaagcaatctttaaaaataaa

SEQ ID NO: 72067 - DNA, 521 bp, Heterodera glycines
  Genomic contig location: Contig_ID=SeqID_44600; Location=342..862; Strand=+
  SCN-specific regions: Sequence locations=1-61,83-178,209-397,419-521
atgaccgtcggtggagttggcggcggcttcccgcaactattcttgaatcgagattggtgcccaattgatggcttgaaaggcatagtcggatcgacggaagacgtctttgattcagtgctggtggaaggccatgaattgtccggcagagttggctttgattggaacagtggcggtgggggcggaggaggtggtggaggaggaggagacgccaccgaactcgccgctgttagcaccgactgtctttgctgcggagatgctaccgaactcgccgcggttggcaccggtggaaactgctggggaggcgccggtggactttgctgattatgggaaaattcaaatcggccatccacccaattgtaaaatacttctttttgctgttgaataaccgtcggtggagttggtggaggcggggtttcacgcgacttttcttgacttgggattggtgcccaattgatggactgtcctcccaaaaccaatccctgctgctcatcttaatgttgctaggggtaactttgtattaa

SEQ ID NO: 72068 - DNA, 255 bp, Heterodera glycines
  Genomic contig location: Contig_ID=SeqID_44600; Location=52..306; Strand=-
  SCN-specific regions: Sequence locations=1-255
atggccgatttgaatttttccataaatcagcaaagtccaccggcgcctccccagcagtttccaacggtgccaaccgcggtgaattcggcgaatgaaagcaaatacccaaacgaaaatattggaggcttttcacaaaacacaccgttttttgcacaaaatccaacattggctactcggcatcagccacccccaagaccaccgccagttaccaacaatgtcatgcattctatgaacgatttcggatcacaccaacag

SEQ ID NO: 72069 - DNA, 376 bp, Heterodera glycines
  Genomic contig location: Contig_ID=SeqID_44600; Location=424..799; Strand=-
  SCN-specific regions: Sequence locations=1-40,62-250,281-376
tccatcaattgggcaccaatcccaagtcaagaaaagtcgcgtgaaaccccgcctccaccaactccaccgacggttattcaacagcaaaaagaagtattttacaattgggtggatggccgatttgaattttcccataatcagcaaagtccaccggcgcctccccagcagtttccaccggtgccaaccgcggcgagttcggtagcatctccgcagcaaagacagtcggtgctaacagcggcgagttcggtggcgtctcctcctcctccaccacctcctccgcccccaccgccactgttccaatcaaagccaactctgccggacaattcatggccttccaccagcactgaatcaaagacgtcttccgtcgatccgacta

SEQ ID NO: 72070 - DNA, 381 bp, Heterodera glycines
  Genomic contig location: Contig_ID=SeqID_9607; Location=1050..1430; Strand=-
  SCN-specific regions: Sequence locations=1-381
gcatttaccaatgcttcatctcccgccaatttcattgtcgtcatttggtttccgtcgtattttgatcagtcgtcggttgagccatttgatctgaccaacgaattgacacgcgaacaattggcattgaaaaggactaacaataaccgccgttttctgctgatccgttctccaattgcgcgagatgtgaacaaatgggcagaatgggaggaggaagcgattggatggaaatttattgatcaatgtgatcagattgacattcaaataaatgatgagcacgaaatcggagacgggtcagcgaatgcttatttaaaagcttaaatttattgtgttttctatttttaggcttctcgccacaactcccggcccaagtgatcagcagaa

SEQ ID NO: 72071 - DNA, 117 bp, Heterodera glycines
  Genomic contig location: Contig_ID=SeqID_9607; Location=188..304; Strand=+
  SCN-specific regions: Sequence locations=1-117
aaattagtcaaaatacatttcagattcgtgattagcgacctttataaccccggataaaaaattatcatggttttttatcttaaaaaaattttgcaaaacaaaagggtcccccctttt

SEQ ID NO: 72072 - DNA, 320 bp, Heterodera glycines
  Genomic contig location: Contig_ID=SeqID_9608; Location=57..376; Strand=-
  SCN-specific regions: Sequence locations=1-320
atgacagacaatcgaaaagaagcggcggaggaagaaatggcaaaagtggaggcaaaaatggaaaaagcaatgtaaaattaaaatgccaattttaaattttgtttcccttttcagctttatctctggtgactgttggctagccgtgttcgatttgcttccggcttatcaacttggcctcagaatttcgatgatcagccaccgttttaacatctacgtggacgaacacttcaaaacccgcaaatggggattggattttcttcgaattggaagcaaaattgacgagaatggcaccaaggagatggaaattgtcaattacgatg

SEQ ID NO: 72073 - DNA, 1370 bp, Heterodera glycines
  Genomic contig location: Contig_ID=SeqID_9609; Location=110..1479; Strand=+
  SCN-specific regions: Sequence locations=1-535,557-915,947-1021,1053 -1370
atggagaaaccggtaaaagtgagcaaagaaaataagaaaggagagggaaagtcaaaggaagtgaacaaggaggaaaatgagtacaacgaattctgcaagtcaacgactaaaaacattgacgagtcaatagtccatgtgcaattttttgctgaatttgagagctccttcaagtccattttttacgtgccggaaacgttgaccgcagacgaattccaaaatcaaaatttggcattttcatcagggacgatggaaaattcgagggaggagaagaaaattggcagcagcgagacggacaagaaaaatggcctaatgagaatttggcgatttgaaaattgcagtgtgaaagccgacggacgaatattagcggaccgtgcaaaatggctcaaaacgtggatcttcatcaaaattcccgataaaattcttttggacaaaacacattaaaatttttcgaggacaagaatgacaacattttttaaagccgtcacgtcactagctgaaaaccttgaaccccaccattcggatgccgaattcgccgttatttttacttaaagacgaggggaccgtctttcttagaggccggggatgtggtattagtgactctttgaccctttatttgattgtttgaatttgtttggcataatgtttgatttgaattgacccaaattgtttcgtttttcttcagttgtgtgggtggatttttggttatcgtcggtgataattttaggcgttttgttggtcgtcgatttatttgtgttttttattaatttgttgttgattgaattttatttattttggattgtcttttaattattggttgcataaatttattttgtttggtgttggatttttaaagcaggttttgccaaattcatagactattcgtgcaaaatttagaagtgtggcaaagaaacccccgacaaattgcttcttcttttccaacatttgtgccaagttttgttcaaagggggggggaaggcccacccgagccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcattatttatttatttttttacagaaattaattcataagtatttttacagaaactgctctgaaacgcaccaaattttatttacatgctagtttaggcactctgatgctttttctatcaaaaagggagatga

SEQ ID NO: 72074 - DNA, 461 bp, Heterodera glycines
  Genomic contig location: Contig_ID=SeqID_44603; Location=1..461; Strand=-
  SCN-specific regions: Sequence locations=1-56,83-185,208-209,235 -390,416-461
ggttcgatgaaactttttaaaatataagcctaaactttttggcctgtttaaaaaggaattaaaaatttttaaaatatttattcatctcccttttgatagaaaaagcatcagagagccttatttaacttttaattaacatttggtgcgtttcagagcactttctgaaaaaatacttatgaattaattttgcaaaaaataaataagtaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaattttattcatctcccttttgatagaaaagcatcagagagccttatttactttt

SEQ ID NO: 72075 - DNA, 147 bp, Heterodera glycines
  Genomic contig location: Contig_ID=SeqID_44603; Location=580..726; Strand=-
  SCN-specific regions: Sequence locations=1-94,140-147
aaaattttattcatctccctttttgatagaaaaagcatcagagtgcctaaactaacctgtaaataaagttttgtgtgtttcagagcacgttctgaaaaaatatttatgaattaattttgcaaaataataaataattaatgaaaaagt

SEQ ID NO: 72076 - DNA, 183 bp, Heterodera glycines
  Genomic contig location: Contig_ID=SeqID_44604; Location=318..500; Strand=-
  SCN-specific regions: Sequence locations=1-183
tgttaccgttccacctacttttgacagtttcgacattggcggtgagcaatttctgtgccagtctcgaaaggtggaggatgccggcttcaccgaagtgctcagttggttggccgtcccggaaagcaacacaaaggcgatggacgcactttccaagctttcaattggggacaaacttcggattaa

SEQ ID NO: 72077 - DNA, 567 bp, Heterodera glycines
  Genomic contig location: Contig_ID=SeqID_44605; Location=424..990; Strand=+
  SCN-specific regions: Sequence locations=1-71,93-317,340-464,487 -500,522-567
ctcgtcttcggctccttcaccatgtccgcgttgtacgccgattcgaccaaataccttcacttgggaggtgtgagaaataaaatactaggaaattttgttgcggatgattcttttttgctcatgcatttttttcaaaaaacttggtgaaaatggtatccgtcagttttacaattcccaagaaatacgggcctgaatggggaaacagcaatttgaggttataaattcccctatttttacaggtatcctctcatctgcactgttttgcatgctgatcgtcctgtacgttttcttttccgtttcagaaaattacaaagaaaataaatgaaattttttggtacattcactaaaaggagatgtggaggggggaactcgacaagaaaatcaacgactttctttgggcggaatgaatcgtactttttccagaattgttccgcaaaattgagcaaaaaatgcttggagaaaccaaaaaatttggaattttgaattcggaaattataattctctattcttttttaggcttttcgccccgtacactccgttcgaacgctcgttcatgctctgggccgg

SEQ ID NO: 72078 - DNA, 359 bp, Heterodera glycines
  Genomic contig location: Contig_ID=SeqID_44610; Location=449..807; Strand=-
  SCN-specific regions: Sequence locations=1-359
atgacaattcatttttcatcgttctatacattttttgatcactctgtgctaagtttgaatcttttctgatcatttggtgatctgatcggagtgaaatttcatttttcggttaatgaatgtccaatcatttattttagtttgctaattaacagatttttccgataagtttatgtccaaataaccaacttattttaggtgttggagtgtcgaattttgcatttttccgatcagtctatgcccaatttgtcactttcgaacgaattctccacctcattatgcaacagggatgggccaaatcggaaaataaaatgagagaaatgcgaaatttgcgaaagtaaaaaatgcgaaatgaaaataaa

SEQ ID NO: 72079 - DNA, 337 bp, Heterodera glycines
  Genomic contig location: Contig_ID=SeqID_9610; Location=60..396; Strand=+
  SCN-specific regions: Sequence locations=1-10,33-84,132-337
atggtcattctgcttttcttggctgtcttcttcggattcctaccatttcttcacagcttagacaaagcatacgtcaccgaaccgtaaaattaaaaaatgtttatttaattttcaaatattttaaaattttagctttctcttaacgggtggaaaaattggaaaattttccgtgccatactttgcgtttgaccaatgcaagccgtaccacagcatcactcatgacctgaaggttgaatcccggaactttggtctgtattttatgatgaagcatcgaggtggacactgtgatgaggggtaaatttttgaagaaatcataataattacaaattaggcctaa

SEQ ID NO: 72080 - DNA, 951 bp, Heterodera glycines
  Genomic contig location: Contig_ID=SeqID_9610; Location=646..1596; Strand=+
  SCN-specific regions: Sequence locations=1-233,277-386,408-472,510 -736,759-951
atggcgtggcatcaaagtgtacacgaaactgacaaactcatcaaatccgctttcggcacgagaaatgatcctggagacttcattgacaaatcggaggtagaaattttgggtaattagggttaattaatagcatttttaaatttaagttactcctttgagccaatgactcgtcaactttcgcttaactttggcaccagagtttcaatgttcacttgggtcacaactcattttggtatttaaatttaaaaaatatatttaaatatatttttaaatttaggacaaccatttcatgacgaagaatttgatttggctgaacagtacgccaagcaaatgggctatggaccattcttggaacaacatgtcggactttggttgcttggcatggacatgttgccatggatggccgaagagtttgtgagtctgtacgtctaccgtaactgctcttgtacgatggacgcttgggtactgtacctttatttgaattttctataatttatatattaaaaaaagttcacccggccaaccgatgagaatgacccaattgagccgattgtgccatcggccggctcatcgcaatgcccgatgaagcaaatggacgaaacttttgaacttggccaattggacgcgcaacatttgcaggctgatcttgtgttcactgtgctgacggatgaaaaatggcaaaatttcacagtggaattattacaaggcgaaaaaggtgtgagctgacaaattaaattttgattaaatcaattatatttgtatttaatgaccgttgaatgggggaaggaggcaaaacaattagggtggctaatgaatggtattggaattaatcatttatataggaggtgtgaagacagtcaatgttggcctgattaaattttggttagatcaattaggcacaagtaactaaatcagtatttggattaatgactgtgtatgggtgggaatgga

SEQ ID NO: 72081 - DNA, 1008 bp, Heterodera glycines
  Genomic contig location: Contig_ID=SeqID_9611; Location=154..1161; Strand=+
  SCN-specific regions: Sequence locations=1-23,105-240,262-342,365 -405,503-504,526-596,675-809,837-1008
atgggaaaagcagtaagaaaagcataaatatatttaaataaatttttattaaatttataatcaaaaataaaattaaaaatagtcgatttaaaaaaataattttaggtgatgtaattgatcagacggaattgaacatcgaaattgagaattttgagacaattgaaatcactgcttcttatgtaatatttaaatttgtttatttttttgaaattagctaattaattaagtactctggatggaataaaacatataaagtggaaagaacaaatacgacaattcagactacaaatagcaacgtatttgaattttttttgaacttcactgatgtgattatgtttaatggagaacacattttacaaaattacactgatgacataccattctgtcatattaaatatgttaaggtaataaatatttattattattattttttaaatttaattaatcaagtaaattagtctgccaattaattaattagattatttattttaattattttattttatttttattgttttacaaaattgaaaatgttgattttttttttttatattctagtatttatcaaattataaccagtaaattagttagcgttctaataatattaaatatttaactattgttattattatatttaatttattaattagtttaatttttttttttattattttgataattcattaggtgatttttcattctgttattatatatttgtaatcaattaatttaggtcactggtgatgccattttattagattcgccaaagctgaatgtgccaccaccaattgtaagtataaataattcttttttattttattttatttttttattttctaggtaaaaaagggagaacaaattattttggcagtgaaagaatttttaaatttcggcgacctaattgttattagtaattataagcaaaaggccaacgaaacaattgttgtcaaattgttgcacggcccaccggaatgcagcaaaaattgtaaagttttgtcatatatttaa

SEQ ID NO: 72082 - DNA, 260 bp, Heterodera glycines
  Genomic contig location: Contig_ID=SeqID_44613; Location=67..326; Strand=-
  SCN-specific regions: Sequence locations=1-137,159-177,199-207,236-260
gcaaaatatttcaacgatgagaaattaagaaaaatgaatcaatattttgaaacgattgaaaagaacccaaaaattagtgataaaataattgccaaaaaattggaaattggaagtgcaaatttgaaaagatggaaaaaagaaatttgcttcaatttggaaaaatgattttttaaggaatttctaattttggatatgtgtctctgtttgttattttaaaatttattttattttaaatgtttttgtttttttgtgtgattaaa

SEQ ID NO: 72083 - DNA, 834 bp, Heterodera glycines
  Genomic contig location: Contig_ID=SeqID_44615; Location=59..892; Strand=-
  SCN-specific regions: Sequence locations=1-43,66-172,194-453,493 -629,660-834
atgatcgctaaaaatattcagatttgggacgtggcatcgcagaaacagttggaggcactcccctacaaagtgcgcgtggacggtgaaaattcaatgattttaaaggatttagggatgagaatttcgaaaacaaaatctactatttttgaaatccatgaaatttacccccaaatttggcgtttcctttttccccgatttcatgtccatttttttgacaggaatcccaggtgaacaacatttgcattacgcccgacggtgcccaactgctcgtcggcgcatggcaaaacattcgtttttacgatttgcaatgtccaaccgcgcaaggactacacacattttcgtaagaaacgcaaaaagggaacgcattgtcaatttatgataattttgaatcgtttttcgttttaaaattatcacattccttttaaaaatggtcaaaaagtcagacaaattttgaattttgtgcacaaatttgttttttaccgtttaattgtacactaattaaaagcaaaagaatgataaaatccaactcgtactgcgatttgcaatacaatttctgtttattacacaattcggggtatcaatacgaatttggaagtccgagtttagtttcgtcccaagaaatattgtacaatatttttctaattttttctgcagtgtccatgagaaaaatgtgacttcggtgggcttccaagtggacggtgcgtggatgtacacgggaggggaggattgcatggccaaagttggacacaaaatccgcaaaatttaaattcggcaatgttttttcagatttgggatatgcgcaacaatcagctgaattgccagaggatattccaa

SEQ ID NO: 72084 - DNA, 370 bp, Heterodera glycines
  Genomic contig location: Contig_ID=SeqID_44617; Location=181..550; Strand=+
  SCN-specific regions: Sequence locations=1-370
atgcacacgttttgcgctcgagctattcatcatcgggcttgtcaatccaaagcgaaacaacaaagatgctgttttgaacgaataaagggcataggttattttgaagaagtgtcaaagaacatgcagcaataagcctgcaaaatctaataagtggaaaatacatgagtatagaatttattttcagaaagtgtcaacagacttttggaaaaatatatttgcaatttatcaaaaattttgagaagtgagatagaaatgataaacttcacgattcaaaccaattttcggtgctctaattaaccgcgataaaaacatccgaatcaattaaatagcttctgagataataaggtttatcataaaatttcatttaaaa

SEQ ID NO: 72085 - DNA, 869 bp, Heterodera glycines
  Genomic contig location: Contig_ID=SeqID_1301; Location=267..1135; Strand=-
  SCN-specific regions: Sequence locations=1-13,35-869
atgaaccgacggtaattaaattaaaagtcacaaattcgtcgtttatttgattcccatttcagttggatttgcaacgacgtttggatggacattttcccatcctttgaccgtcctcaactcggcctcaaattggcacttctttcgccacgtttcaatgcgttggtggacaaacatttcaatggaaaagcgaattgacaatttggagatcaatcggaattagcaaggacaaaggaccagaaccgaagctggacagtgtaacaaacccgaaactatctgtacgaatcgatgacaaatttgtggaatttccattgccggacgaccgtccgttgcccagcaaaatccgttttaagagccttgagatttagtaattaaaaatcaaagctttatggcaataaaagcattccttccattttcacagttacatcgatcactccgtcatcgcttttcttcgtttaaatcaccaaattttcgacaaaagaggcaccaatttacagttgttttggatttcttcaccacacaccacggatggccagcggatttgggatattttgacacgtgaaatttggcccattttttcgacaaacattcgctgtttgggcttttcccgtggtgatcatttggacaatttgcttcgtcaaatttcgccgacaattctcatcgatcttaaccaattggtttcaatccattcatttggtcggttgcccgctgcgattggtgacgattttgatgggccaaattcaacaatttctgctggccaagcattgtccaaatggttgcactctccgagaaaagatggccaacccaagcgattgcgttgcgaagattacaacgcacaagcgaacactgattggatcaacaatttcaaggag

SEQ ID NO: 72086 - DNA, 2391 bp, Heterodera glycines
  Genomic contig location: Contig_ID=SeqID_1302; Location=107..2497; Strand=+
  SCN-specific regions: Sequence locations=1-1714,1736-1944,1966-2391
atgcgccactattcattgtataaacgtgggacaattacccaagacagatggcggtggattaacaaaaaccaaaccacggttcttcaacaaaaggcgctgcaactactccgcgaggcggggatccctacaacagagacagagtacgacgcggaagtttatatacatcaagtgcaagggttgtggaacgtcaagtatcccggcgagtacaaaatatttatttttaatgactaccagatacgaccaatcaccaaatctgatgtcaccgactaccaattccccattcttctctaccacaacaacaatcactttgatggcatcaaaacgatctccaaatttttcaacaaaaagaactactgtctctcctgcgagtcgccgtactacaagaaaatcgcacattcatcaaactgctcttcactctgtcacgggtgccgtgaggtgggcgttgactatccctgcgagccacaacaaggatacatcaaaaaatgtgatcactgtaacaacaccttttacaacaacagctgttatgagcgccacctccacaaggatttgtgcaccaaatttcagcgctgcgaagattgtggggtaatttataacattatggttcatgggagtgttgggcataaatgtggggaacagttttgtaaactttgcaaacaattccatataaaagaagacgacgacgacgggatgaacccctgcacgaaatgcttcatccaacccctgaagcaacaacgaattaagccatacaggatcatcgtgtatgactttgaggcgacacaggacaaaaaagtggagaaccggttcgagcatgaagttaactttgcagcggctaccatcatctgcaccgactgcattatcaacggcgactggaacaaatcactgcaggggaaaaagtgccaaatttgcggtcctcaccgctcaatcaccttttcaccttttgactacatggagacaacagtcgaccaaaaagtcgtcactcagcaaccgctgtgcgaattcgtccagtggcttcttttcgaccacaacaaaaagtttccaacagtcgcgtttgcacactttggggggcgctacgacatgacgatgatcataaaggaggttttggcgcaaggaattcacaatccggacatcatcaaacaaggaaatcgcctctacgagctgaaaatcagggaaaacgagcatggccccctcaccatctttcacgacagctacaacctaatgcccatcaaactatctggtctcatcaaatcttttgggcttcatataaaagataagcagcactttccccacatgttcaacaaatcagctaactacttcaacgtcctaccacaccttcctccacgtgatgactactgtcccaaccaaaagaagaaggcggacctgcagaaattcgacgactggtacaacaacaacctgtgccaaaaattcaacttgaaagaaaaattgcccgaatattgctgcaacgatgtaaaaatcctcacccacgccctcgtcgaactacgccgggaattcaaacaacttacacaacggaacggaaaacacggtggaatcgacattttgtggcaagccatgaccatcgccagcgcctgcgtcaaaaattttgcactcaaccatttgaagcccaactcgctcgccatcgtcccggagaaaggctacacgccacaacagaaccaaagtgcacttgccatcaaatatcttgactggtactcccacgtcaacaacgttaacatccaaactgctcactcccggtacggcgaatatgtgtttaagcgtgaagggcaggtataccaagtggacggctacatcaaaggaacagacgggaggcgggacaaaataatcgaggtgaatggttgtctgtggcacggttgtgaggagtgttttgatgacttgggcgacgaaacgaggatgccgaacggaaagacgctgcgggagattagggagcgagaagagaagaaacatgaaatattgagcaggtacgtcgacttggaggttgtttgggagcacgagatcaacgagaagctgaagaaggacaagcagatgagggagtttttcgccaactggaaggaccactcaccaatcaaaatcagagacgcgttccacggcggacggactgggccaatgaagctactccacacagctaagccgggacaaaaaatcagctacaaggactttaccagcctctacccgtggaccaactttacgacaaactaccctcttggccacccaaaaatcgtcagtgtcccaccaaatgagcagacggtcaactggcgcaccccatccgacaatccctacaaaggccttctcaaagtgctgcttctacctccaaacaacaacgtcagcgtcacggttatgcccgtaaaatttgatcaacgcctcctcttcccccctctgtga

SEQ ID NO: 72087 - DNA, 1247 bp, Heterodera glycines
  Genomic contig location: Contig_ID=SeqID_1302; Location=2721..3967; Strand=+
  SCN-specific regions: Sequence locations=1-1191,1213-1247
atggccctgaaaatccacgccaccggcttcccgtcaacgtgcggcagtgagaggcaaaaggacgaatacattgaggagtgttggcgaaattttggaattcatctggagaaggagaagatgaaaccggagccgggaaagcgctacatcgccaagctctgcctcaactcgctttggggacgattctccatgaggaatctactttccaaggcggtaatcaacaatgacccttgcgtcctccgccaatacactgacgacaagaaaattgacctaatggacattgagctgatggatgaggacaacgacgtattcatgctcacctacaaaccaaaggaggagtttgtcgacgaaaacaaatactccaatgtagtcatatcgctctacacaacatcaatggcgcggctctatctctatgaagtgttaaaaaaagtggccaacacgcccggatgcgaaattctctactacgacacggacagcatcatctacgttcacaccgagggtaacgacccactcccgacaggaaagggtcatctcggtgagctgactgacgaaaagccggaccacaacattttggagttcatcagcgctggctgcaaaaactacggactgaagctggaacgtaaggacaatggggaaattgagtacgacttgaagataagggggataacactggatgaacaaactgtgcaaactatccattatgacagtgtgaaagatcaaattatgcgttatgggtccgatgaccccgcggaccccattattgtaacatacccccattttattcgccctaatctaatccaaggcaaagtgtacactcaatctctaactaagcattatcaacctgtcttcacaaaaggcattattaataacgccttccaagtcctcgaattcggctaccgtaattcacgtttgtaaggattgtgcactctcacactctcttttattatcccgttttccactatttttttcaatgcactgcaggacggaatgacccctggttgatcctccccagcactccaggccctccatctgagatgaaggtggacgagctgctcattattgtaatgcgcagcctggtgcgtgagtgtttgggttggggaccgaagggcgaagccgattcacgggtgcagacactttttccatttagtaggttcggaatcataatttattttctgagaacgttcttccgtcaattgtatatatataatttatttcgttattatatttatcacttgtatgttgtgattgca

SEQ ID NO: 72088 - DNA, 1501 bp, Heterodera glycines
  Genomic contig location: Contig_ID=SeqID_1302; Location=4683..6183; Strand=+
  SCN-specific regions: Sequence locations=1-269,291-533,556-588,610 -816,838-860,882-1165,1190-1236,1259-1354,1376-1501
atgggtgtacatgtgcacagagggccacccacagatgaattgctgagctctctaaagaagccgctcttattgattctagatgaccttttaacaataattgatgagaaaagtctatccgaattattcattaaaaaggcccaccatttgaatattggagttatatttataacacaaaatttgttcgagagaaaggtgaaggtagcccgaattaattctcaatatattgttttaatgtcggcaccgaatgccgcgctacaaatacgtaatttgggtgtacagttgttccctaagaggctttccttcttcctaagtgcctatagagatgcaaccgcatcaccgtatgggtacttacttttggatttacaccctgcttcgagcccattactgagaatttgcacgaggatatttaaagaggatgacgagaaaactgtgtatataaataatcaaaatgactaactacataccacaaaacgtagttggaaacttggaattcctgaagaagttagcggcaacaaagtcttataaaaagagacaacaaatatttaaagaagcgaccagtgaacaaattgcattattagtggaaatttgctataatatattaaagggatacttcccactaacgaggcaacaaaaatttcgtcttgtgccttacgtaaatattgtgagaaaattaggaagagttagaactgagaaaggtgcaaagaaaattattcaacaaaacggaggcggtggtttccttaatttggctccattactattaccagtcattattgccgccttaaaatatggagaataaatttatactcgttccatctgacttgtataaaaatttattaaagcctgacactggggagattaatgttgaaaatgctaaaaataaattgaactcacttttgaagcagcgaaaattagattcgggtacaaaaaatttactttataatcaggaattgaggcgtttcttgaaactaaggaaggaaattgaagacaaacccgtaaaggttgagctcaccgacggctcattgatggtgtttaatccaaagcagcgcgaaaggaatatgaaaataattcctacacaaattgttaatgacgaaggattggatgaaacgggctccatgccaacgcttgaagacccttacactactgctgaagagagtgatgctgagttgacaacaacaacaacaccaaaggcgagaccactgttaaggcctttacgagttgggacaagtaaatttcgtcaaaaacaaaaatcttttatagttaggaaacaacaaaaaattatgtcgattataaatgatgaccctgagaaatttggtatcggtgctaaaggacacatacttagagctaatggaacggcatatttaaaaagtaatgttaatcaagcgctagagcgaatattgagacggtcacccgagaatgctccatcgccggttggtacaaaagtgttagagcaacgactgagaaacgacccgaggaccagcggaatattaaaacaaaactttag

SEQ ID NO: 72089 - DNA, 1124 bp, Heterodera glycines
  Genomic contig location: Contig_ID=SeqID_1302; Location=6238..7361; Strand=+
  SCN-specific regions: Sequence locations=1-454,477-1124
atggataaaaagaagttactgaacaaattatataatgaccctaattcacctgcgtgttatgcagggcaggaaagactttatgaagaggcactaaaatatgactcttcgattacaaggaaagacgttgaacactttctcgagggagacagaacatatacattacataaacctagacgtgttaggtttaagaggtcacgaacagtgcctgctggattcatgactgatgttcaggttgacttggcagattttcaaaaattatcaagagaaaatagcggattcaattatatattgttgggtattgatgtgttgagtaagcgggtctttgctgcacccgtaaagtcaaagaatttcaaacatatgagagaagcgcttgacaacttaatcagtcaaatgccaatggttcctcatagaattttttcagatcggggaacggaattcgaaaatagagaaatacataaatatttcaaagatatgaacatacaaaagcacaaggctcacactagtacggttaaggctgcactagccgaacgctgtataaggacacttaaacaacgactataccgttattttagtcaaaaacatacaatcaaatgggttgacgtgttgccaaaactagtgaatgctttaaataactcaaaatcacgaatcaccggaatgaaaccggtcgacataaacccggataacgcgcaaaaaatttgggaaagagtatatggcgatgaacatgcacaaacaacatatagaaaaccaaggttcaaggagggtgaccatgtgcgactcgcaaagtataaatccagctttgaaaagtcttaccttcccaattattcggatgaaattttccaagtttacgatgttaaaagggggaatcctcatcggtatggaataaaggacgacaatgaagagccgtttgacacccgcttttatgctgaagacttgaccaaaaccagaaaggacgcagagacaacatacagaattgagaaagttttgaagactcgcacaaagaagagtgggcagaaagaacatttggtaaaattttacgggtacaaagaaccagagtggatcaaagacagagatattgagcgatagcaagtatttaagtgtatttattgtctatattttgtgattaa

SEQ ID NO: 72090 - DNA, 562 bp, Heterodera glycines
  Genomic contig location: Contig_ID=SeqID_9612; Location=129..690; Strand=+
  SCN-specific regions: Sequence locations=1-46,69-562
atgagcatcaaaaatgatcagaacagaataatttgtccaatttattatatctcaaaaagaaagacaactcatatttcaattaaaaatggtaatgctgctgttgttgaggcggacgatgtatttagactagggtaggtcgggaccgggaattttcaagttgaaaacctggatcttttggctgggaaaaccgggaatttcccggatcggtactcaattgtccgtgttttggtcccggtcccgaccaatctttttttcagcaatcagaaagatgtgtccctgcgattgtcaggggtgctgttcaagaatccggcatggcatcaatttctaacatattgtaaccccggacccgaattctaataggaagtttataaaaattttcgcatttcaaattttggatcaaatttgtacacggaacgaacttaaagtgcattaatgcttcatttaaactatttttagactaaacatgaaaaatgacacatttgaattaccacttttttttgttcgaattgacccggggtccggaattgatcgaatggatggatgccggattcccgatcggtga

SEQ ID NO: 72091 - DNA, 290 bp, Heterodera glycines
  Genomic contig location: Contig_ID=SeqID_9613; Location=1545..1834; Strand=+
  SCN-specific regions: Sequence locations=1-118,152-262
atgaaattaccgttaccggtttgtctagtaccggtaccgccggtaaaaatttgcactggtaagaatgggggtctgggtgagaaaagagtagggaatggtgaaggagaaattttttgagaaaaaaaaattaaattatttattttcatttaaagcatttgttcatatgcataagtggtcaagtggctaaaccttctgattttattatttctcgcttgggttcaattccccacttggatagaatatttctcacattttctttaccattattttaattaaaattttaattttaa

SEQ ID NO: 72092 - DNA, 2525 bp, Heterodera glycines
  Genomic contig location: Contig_ID=SeqID_9614; Location=80..2604; Strand=-
  SCN-specific regions: Sequence locations=1-3,180-203,378-476,600 -666,688-1104,1142-1193,1215-1236,1258-1379,1401-1620,1642-1728,1750 -1852,1874-1981,2030-2142,2164-2525
  Gene Ontology: Biological process=N-linked glycosylation
atggaagagaaagtggaagaggaacagaaagtggaagagaaagtggaagaggaacagaaagtggaagaggaacagaaaatggaagagaaagtggaagaggaacagaaagtggaagagaaagtggaagaggaacagaaagtggaagagaaagtggaagaggaacagaaagtggaagagaaagtggaagaggaacagaaagtggaagaggaacagaaaatggaagagaaagtggaagaggaacagaaagtggaagagaaagtggaagaggaacagaaagtggaagagaaagtggaagaggaacagaaagtggaagagaaagtggaagaggaacagaaagtggaagagaaagtggaagaggaacagaaagtggaagagaaagtggaagaggaacagaaaatggaagagaaagtggaagaggaacagaaagtggaagagaaagtggaagaggaagtcagagcagcaagagcgacaactcgaaaattatttattttagaattataacatttaacaaaaaatcttataaaaaatcacaagcatataaataaaaatatcgcatttaaattaaatttaaaacaatatcgtttttaaattaattatttgttcatttccaaattctcatattcctaaactatgaggatcgcttagcggccaatagatactttttgcacgccccaaattatatctcccactagagccagcgttgaaagcgcccccggcgctttcacagggcccgcagggccctggtttagaaaagagttaaatgataagtagggatggtaattatatggaaatccatatttttttcctggaatgtgggaggcctgaaacgcacgaaaaacatgtttttagcttggtttgaagcttctaggaaggatttctatatccatattttccatatttttccatatttcgcgatttatgtccatatttccatatttttccatattttggcattttggtccatattttatgtccatattttggcatttttcaaaaaaacctctattagaacggccccagcagctaaattagcctttttgagcccaaaacccgaaaaatttttcaaaaaaatcattttttcgccaaaatttctcgagaatattgaataaatttaaattttcttaaaaattaataaatttatgtcaaaaataagcaaaaaagcgaaaatttcgcttttgttgttgattttgcgctaaaaaaattaataaattttagcttttatgttttttttcatttaaaatgattgcacgtaattgccgaaaaaattcgagaccaatttccgaatgttgaccgactaattgcaaaacgaaagccgtctttgtcaaagcgccttaccgagtcaaaaaatttggaaatgtatttcatatgcaatttcaaccaacaaatttgaagaaattttgcacccaattttgaaaaatttatgtccatattttgacatttttgccatttatttccatattttgagatttttgccattttatgtccatattttgcgatttttagtccatattttatggccatatttcgcgattttatatccatatttttaccatccctaatgataagtagggctgggaatttaagtaaaatgacttttttttgctgactctaaatggccttaaaatgacttaaaaagtgttctaaactttgtttgaagcttcatcatgcattttttggcgctagttacaaagcgtggcgttttgaaaattttttcactttttttttgactaattttttttaatttaaaaagtcctgaaacccaagtacccgggggttttagaggtcgctgatcgtggatacgacaattatttgggcctattaagcaaatttggcgctagttataaagtgacagatttttaattttatcaaaaacaatatgggggaccctattgttttgcaaaatttttttgagataaaaaatcgtgaatatactttttattcgttttaattgtcttgttaatgcttaatattcatcataatgtataaataaatttaaaaaaaaattatgtcaaaaaaatgaaaaaaatttcaaaagaccccttctttaaactagcgccggtaaatgtatcggatttttgatgctttttaaatgtttaggtatttgaagctgatcatctgcgacaaagtagactaatgaaaatgaatttaaaaaataacaaataatgtcatagtttaaaatgatggactttcaggagttttacgaccaatgcagcctttctgtcaagcaacaaatttggattagaaacgaaagtcttttttcggaggccattgaacccgttctcgacgcatacatttacgagaaggagcgcttattactgtcagctgcgaatggcaccgataaacaaacaaatttctttaccagcgaaagttggaaggggcggagacagaaaaaacacatccaaggcaattgcagaggaagaatgggattgactttctcgacagcatgggattcacatttatctttccatttttcagaattggtttcaatggtcggacaacgcgacattctctacggcagaattacg

SEQ ID NO: 72093 - DNA, 213 bp, Heterodera glycines
  Genomic contig location: Contig_ID=SeqID_44622; Location=88..300; Strand=-
  SCN-specific regions: Sequence locations=1-213
atggtcaccgattccaaagaggacattgtgttctttgccagagtttgtgagaaggcacgacgctacgatgacatgaccgaggcaatgaagaaggtgtggtcgatgattgaaagcattgcatttgatttgttttcattttttattttcagatgatccaagcagacgccaatttgaacagagaggagcgcgagttgctcggcaccgcctacaaag

SEQ ID NO: 72094 - DNA, 78 bp, Heterodera glycines
  Genomic contig location: Contig_ID=SeqID_44623; Location=115..192; Strand=+
  SCN-specific regions: Sequence locations=1-78
gctctgtatttgtctcgccccactacagtttttacgccgtctttgcatactcttttttgcgtagttcaaaatctgaaa

SEQ ID NO: 72095 - DNA, 69 bp, Heterodera glycines; identical to SEQ ID NO: 67430
  Genomic contig location: Contig_ID=SeqID_44624; Location=817..885; Strand=+
  SCN-specific regions: Sequence locations=1-69

SEQ ID NO: 72096 - DNA, 573 bp, Heterodera glycines
  Genomic contig location: Contig_ID=SeqID_44627; Location=317..889; Strand=+
  SCN-specific regions: Sequence locations=1-91,113-235,257-281,303-573
atgactgtgttattaacggagttccgttccaaaaggtagacttcatctcatcaccttaccaatttattcatctagcatgatagtgattattcaaatccggacaaatttggtcctgaaacgcattttcacctcttttttaaaaggtttatgtcagcgcaaaagacggcacttgacccattggcattttgacttttggcattggtccccgaaattgcattggaatgcgttttgccaaattaaaattgacatttaaaaataaccactttgctttttagcttaataaacccaaccttaaaatcaaggtgtgatccatttaccaataattagtgctatttatcgccattttaaattatttatgcttctttaattcattatttttttgttttttgaaatttcagaacaattctcattgagagttttaaggcttcatgcccctatttttggatttctaaaatgcaaatttcccaggctacatcgcgtcgcaatgcgaaagcgttcaacagtggcgacgcaaatttcaccgaaagccaataaaatttgacatttaaaatagccgattggctttttagctta

SEQ ID NO: 72097 - DNA, 1292 bp, Heterodera glycines
  Genomic contig location: Contig_ID=SeqID_9616; Location=50..1341; Strand=+
  SCN-specific regions: Sequence locations=1-311,345-387,409-427,503 -1025,1053-1082,1262-1292
  Gene Ontology: Mol. function=protein binding; Cellular component =axoneme; Biological process=eye photoreceptor cell development
atgttttatctgccttggtatttgtttaaaacgaaagtggttagaaccaaggacattctggtggcacaggtcaatggccatctgttgccataccgtaccattgaacaaatggtaggcaattggcactaccaattcaaagcattgatggaagaggaatggcacaatgccaatgccgaagagaatgccaatgccaacaatgacgaggaggacgcgcagttggaacagcagttgcccaacccatgtgaagaggcaaagctcagagtgaagaagtgatggctgctagatcaattacaatagtgaaaaatttcgacaaattttttaattttttatttaaattaaattttcgggctgccatcgaaaattttcaaaaacatggactgacttattaaagaaagattttgggagcaattttggctctaatggaattcctccccccccccctacctccctctccccctgtacccttcccctccgcgctcctccttcccccttgccctccccccttcgcttttcatcctccttctcaccttggcttcttcgcggaacattcccttcagctggcaaatggaggaggggcaaaacgtcaaaatgttcggaaatggcgcggacggaataacgaagctgaagggggacaaacattggaaaatggcggaagagcgaaagagtggaaagagggggggggggggggggggagacaacaacttggtccgatcagtgcttttttacatttcgatcccccgcattattccatgtgaagcgcaagtgggaaacattctcagccacgcggtaagggaatcggatggaatattcgttgatagcgcctgctgagacgtaatccatccgagcggaaatacctcaaaaatgtaaagattggaagttcatcaatgatgaaagaaaacgggaaaaaagccgactgaccaagggtacgctgcatttcctcgttggaaatgtacaaattgaaggaacagcggacgaacaccgggaacaaactgacaatgaggatgaccaatttggagatgagaaacggaagggagggggaggaggaggagaagtgtgacgacgaggcacagggacaggacgaggaagaagaagaggaagcggaagatgaagcggaagaagaagaggaagcggaagatgaagcggaagaagaagaggaagaagaagaggaagcggaagatgaagcggaagaagaagaggaagcggaagatgaagcggaagaagaagaggaagcggaagatgaagcggaagaggaagcggaagatgaagatggaggggagaaaggaatagccgca

SEQ ID NO: 72098 - DNA, 116 bp, Heterodera glycines
  Genomic contig location: Contig_ID=SeqID_9616; Location=1505..1620; Strand=+
  SCN-specific regions: Sequence locations=1-73,95-116
atggaaatcgacggcattttccctggcataatactcaccgccccctctccccttagatgtgccaagcgtcgcctacattttctctcgctctctgcaattgctccgccacacccttt

SEQ ID NO: 72099 - DNA, 750 bp, Heterodera glycines
  Genomic contig location: Contig_ID=SeqID_9617; Location=90..839; Strand=-
  SCN-specific regions: Sequence locations=1-318,381-556,579-708,730-750
atgcaactgataggccttaaggaagcagagtgtgggagagaatgggataaaggcctgagaggatctctgaagagtcccgtagctcagtcggtttgagcattctttggtatgggaagggcgtgggttcgagtcccactgggcgagtaaccttttattttctattcaataattgcccaaattgactggggatgtttttttttacaatttttcaacaactccatgtttataggttcgcactccgccgcagcagaggcagcgcaatgtgtggccaaaattttcaccaaaatctcacgcgccacaatatgtcatcagagcgcgtaattttaaattttaaaatttaaataaaaagcaattaaattatttttatattttaattttttcagagtcttctaccattaaattcaaacatcatcaacaacagtattcttcgtcttcctccgcttcatccgcttcatcatcttcgttgctctacaaacaacaacaacctctgctggagcagcaacagcaaaacgaagtgggttgtcagcagagaacggcacttttggtggtttgcagagttttggcacttttggtggctttccgatttcaatggcatttcgtccccgcatttatttatcaccactttttttttgttttattttgttgtccctcgtggagcttaagggcagaactgaaattaatttttgacattgaaaagcgacaatgttctttcattttgaagactgaattttcttcctttttttcattaaa

SEQ ID NO: 72100 - DNA, 893 bp, Heterodera glycines
  Genomic contig location: Contig_ID=SeqID_44634; Location=221..1113; Strand=+
  SCN-specific regions: Sequence locations=1-200,222-227,249-505,584 -637,660-699,721-816,838-893
atgattacactgactttttgtattcattcgcgccacggccgacttgcaaatcggccggagggtgcggatcaccgtaagcaaaaatcaaattattaatccaaaaaaatcatttcccattcagctatttgttctgcgacaccacgaccaatggcactgcgttttgctgtgccaaaattaaaaggggaggaaattgtgccaaatttcaaaagaacagtaaaagaaaagcgaatttttaattatttggaattataatgttaaggcgaagaaccgtgctacgattctttttgcattaatgggcaatgccatgaagccaattatggcaaaatggtgggaagaatttcaatataaatagcatattcaaatggaatatttagctaattgttaatttagcactttttaaatgttgtccattcttccgaccaatcgttgtccgatgagccaagcagttctttcattggcacctcaacattacctggatttgttgcggatggaaccgatgtaaaagataatttattgaatattaaaaaaaaaattaaaacataattaattattaaaaattactttttaaattgttattatatttctgtaattgcaatgcttgttcccgcttttaagcatcacataaacttcacaacatcaaaaccttcatcaccaacaccttttcttcgggcgatgaaactgatcaaacaacggcatcttttcaactttcttccaccacttcaggtcaacaaacattactgtatgacgaaacttcaactgtatcgaatacagtaggaaacaacactgtggagctgcttaccaacacttcgccaactgttatttttaaatttaaaaccaatgaattttgcgataaaattaaataagctttttcaaagaaggcataattcaattta

SEQ ID NO: 72101 - DNA, 398 bp, Heterodera glycines
  Genomic contig location: Contig_ID=SeqID_44636; Location=301..698; Strand=-
  SCN-specific regions: Sequence locations=1-188,210-236,258-282,311-398
tactgggagttagcatcatagcagtgcttttccttgtctttttgatgctctcgcaaaatctggttcgcttctgataagtttataaaaaaaagttaagcctaaaatttttcgcatatttaaaaagcaattaaaaatttttagattttttattcatctccctttttgatattgaaagcatctgagtgcctaaaataacttgtaattaaaatttgatgcgtttcagagcagtttctgaaaaaatatttatgaattaattttgctaaaaaaataaaatagtgaagctttaaaaattaataaaaaattttaaattcagaattactggtgttagcatcatagcagtgcttttccttgtctttttgatgctctcgcaaaatctggttcgcttctgatcagtttct

SEQ ID NO: 72102 - DNA, 304 bp, Heterodera glycines
  Genomic contig location: Contig_ID=SeqID_44638; Location=294..597; Strand=+
  SCN-specific regions: Sequence locations=1-304
aaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgcgcacagccctccgtctcatgcttaagagcatttgtgaggtataaaatttctcaaaaaaagagatagccatttttctgggatagagtataaatttaaaaattccctcaaaaataaaaggtctattgcgcaccgccctccctatcata

SEQ ID NO: 72103 - DNA, 114 bp, Heterodera glycines
  Genomic contig location: Contig_ID=SeqID_44638; Location=801..914; Strand=+
  SCN-specific regions: Sequence locations=1-114
aaaattccctcaaaaataaaaggtctattgcgcaccgccctccctatcatgctcaagagcatttgtatgtgtataaaatttatcaaaaaaagagatagccatttttctgggata

SEQ ID NO: 72104 - DNA, 793 bp, Heterodera glycines
  Genomic contig location: Contig_ID=SeqID_44641; Location=70..862; Strand=-
  SCN-specific regions: Sequence locations=1-718,745-793
atgccgacccggttgtcgaccttttggacaaaagacgcattttccgttcgcgactgttccgcgagtcgtgcgtcttctacgagggcaactacgtcaaggtgggcaatgatgtgaccaattatagccaattagcttttaattacttatttttcaaaattgttttttactagaaaaagcctctaaaattttttaaaaaacaaagctgttttttaatattaggttgggtattttttttaaactttaatattttcaattagtaaaattatgaatttgggattgtcggaatcccccttttaattgtcgttaaactgcttgtcattgtgcccccgtatttccaggacctttcccggttgggccgcgatttgcgtcgggtgattatcatcgacaattcgcccgccagttacgccttccaccctgacaattcggtgccgtttttgttgttgctgttggcactttgctttgtcattatataacatttcccctttcagatcccggtccgcacttggttcgacgaccccaacgacagggaactgctcgaacttttaccgttgctggaggaattggcacgagtggacgacatttacaaggtgaacatggaaaagggaaattcgaaaaaacaaaaatgtcaacaattcattttgggtaatgatggcacgatgctaatgcaatacagcttggacaagtgggaagatcacaacccgctaaaaaatatacacaattttattagtttgattttacctttagcggcaacatttttttatcgtagcggtttttctttcatatttttattaaa

SEQ ID NO: 72105 - DNA, 605 bp, Heterodera glycines
  Genomic contig location: Contig_ID=SeqID_9621; Location=385..989; Strand=-
  SCN-specific regions: Sequence locations=1-61,114-133,156-158,264 -327,349-371,462-605
atgaaatccccttctcccggattcagcttagcttatttatttgtatttttagcgtttttagtatttattttttcttgttaataataaatgataataataataatgtttaatttccattttttcgtcaaaattgtgttatcaagtttttaaattaagcattctatttatataactctttttattttgcatattttgatttctatttaattatttttgattttaaagtttaaattagaaattacttatttttattattattcttaagtttctcgtcctagcgttattttttcggacggtttttgtttgattggaaaaattcgaaactgaaaatttttaattttgtaattgaattttcgtcggaaatttattcgtaaataatttaaatagatttatttttaatatttcttcaatttaatatgaattttataaaaatgattaatcattcatatatttttaaatttgctatggtaataaccgaatatatgaaatacatatttagttacatttcaggattgtattttgatttaatttttcagatagaaatagctgaaggaatatgtttaaatgagaaaggcctaacatttttgcagattaaagatgattga

SEQ ID NO: 72106 - DNA, 340 bp, Heterodera glycines
  Genomic contig location: Contig_ID=SeqID_44642; Location=428..767; Strand=+
  SCN-specific regions: Sequence locations=1-178,200-242,264-276,298-340
atgaagaatgtgaaaggactcgcaaggttaaattatcgcacagtgtcaatgctcaaatttaaatttgatgccattgacgtggacatttcttttgtttcgataccggacaagaaaaaattgccgaatattttaagcgaagaatttgtgcaaaaatatttggacaaatttaattcggaagaaaatggcaaatttgagaagcaaaatcggagtttatccagtaactttattacaaaatcaaaaggaaattaataattttattttaagattaccgaaaaattatatttgcaattttaatttgattttgaaccgaaaattttgggttttcatataaaattaagaa

SEQ ID NO: 72107 - DNA, 566 bp, Heterodera glycines
  Genomic contig location: Contig_ID=SeqID_44643; Location=206..771; Strand=-
  SCN-specific regions: Sequence locations=1-142,166-566
atggaacgaatgaaggattggagcaaagcggaagggcatgagccaatttcggcgtttgtcgaatggattttgaaggcatgggacaacaagtaccaaacatttatttgggtgagttagcgatcgtttcaacatcatttgttgcataaaaatatatataaatattttctaggcccacaacgcttcgagatttgatggccactttgtgttaaaatacctcggcgagaccaaacgacgacctgaagtcatcatgaatgggctcaaaatttttgagtttcgtctacaacattctcgacgccactcaaaacttacatggcgagactcatgtctactgatgccaattcgtctggaagaaatgccgaaaaccttcagtcttagctgtgccgataaaccattcttcccctacgctttcaaccgaaggtttgtatgtccaaatgagggtaatttaaatgattatatttctcagagaaaactacaacgtgcatcttcaaaatttgccggacaaggaggattactgccctgggtcaatgaagcgggacaaatacgaaaaattcataaaatggtgttag

SEQ ID NO: 72108 - DNA, 287 bp, Heterodera glycines
  Genomic contig location: Contig_ID=SeqID_44645; Location=27..313; Strand=-
  SCN-specific regions: Sequence locations=1-126,151-287
attttctaagaaaaaataggagttttgggggcgcgacggtgccgataggcgccgccggggaaaaaaattggaaattttgatcatttataaacagtttttcactgaaaattagccaatttataggtaaaattttgaaaaattttatgggaatttaatccaattcttaggggtgtaaaagtcgcatttcgcgccaaaaagcgaaatgtgaaaagcgaaatgcgaaacgccaaaaaatgcgaataatgcgaaaggcgaaatgcgaaaagcgaaacctaggcccatccctg

SEQ ID NO: 72109 - DNA, 494 bp, Heterodera glycines
  Genomic contig location: Contig_ID=SeqID_44646; Location=1..494; Strand=+
  SCN-specific regions: Sequence locations=1-494
ataaaaacttagaaaatacactgtaatggaaggactacggtaggtttccatcctccaacaaattacgctgcaaattgcagagattgtcctcataccgtatccatttaaaaaacacacagtatcactgacttatactttctgctttcccaatttcgctttaaggaattcagtgtttagcagccattccctacatttttcttcccattcattagtggtgcggtgggaatgccattttttgcttttgcgtcgcctttgtcaccgccaacggcgccgcctctttttggcaatccgtcgctctttgctttcccaccatttttactcttctcaaccgctgtcaacagttctttttgtgcctgaattttcattaaattcaatgcataattattattttttattcatctaaaaaaatgaagtgatcggatgaaggaagtcccggaactgagagggaattttcctgggacatttttacaatagcccaagatagggactgtatc

SEQ ID NO: 72110 - DNA, 365 bp, Heterodera glycines
  Genomic contig location: Contig_ID=SeqID_44647; Location=41..405; Strand=-
  SCN-specific regions: Sequence locations=1-15,130-131,173-194,216-296
atgtgtcttaatgtcaatgggaagaagaaggacaaaggaaaaaagcaccatggtactgaacaagcggaagatgatgtggaagaggaagaggaagaaaatggagaagggaaagggagaggtaaaggaaaatgttaatcaattaactaattaattaaccaattaacgaattaataggattaattattaaaaatgggaaaaggttttttaagctattcaacagattacgtattatacaaaacattatgattatttttgggaaagcattaatataataatgaattctatgaataattgtgtaattatttaatttttaactttatttaaagaacaaaatacatttcataaaatatattttaattaataaa

SEQ ID NO: 72111 - DNA, 491 bp, Heterodera glycines
  Genomic contig location: Contig_ID=SeqID_44651; Location=551..1041; Strand=-
  SCN-specific regions: Sequence locations=1-26,48-491
atgccgtttgttcaaaagacgacccaaaaaacagaagctgataaatcggaattgccaccacgagtgatcgccgaactttacgcatgcctgaatttgacatgtcttttgcattattttggggggtatgctgggcaataaaagcacggtcagacagacaaaaaattcatttaaactgtgcaaatttgggccattaggaagcgcgagactgagacctcccgggaccgatcccgtttaggtatttctaaaattttgagtctcgagaatcacttgtctgtcaagaaaccaaacatgtatgtcggttaaaatgcattgatttaaggcgaatcgtcggcaccagatcagtgtctcatcagccagaatacgaactcaaataaccgccaaaaacggaaaagaaatcaacgatattttggcaaagcattgcgaatggaataccgcatgctcagtgaccaacaaaggcttcaatttgtaaattcaatttaattttgaataaa

SEQ ID NO: 72112 - DNA, 661 bp, Heterodera glycines
  Genomic contig location: Contig_ID=SeqID_9622; Location=754..1414; Strand=+
  SCN-specific regions: Sequence locations=1-404,426-661
atgatttcaccccacctcagccatatacccccacactactcgcacgttaacaaaatctccaacccgactcctcctcctcctcctcttcgtcaactgcgtcagcagcggttggtggcggcagttcagcggaagacagaggcgacagcggctaagggccgttggctctacgaattggacgccaaaaaatatgccaagaatgctttgcgtcagcagcgcatcaacctgaaaaatgggcctttgtactgcgccggctgtcatgcactgggcaaccacgtcatatcggactgtccaatggacaaaggtgtttttgttttgcttgataaaaaaatatgctaagcaacttttttaggaagatatgccgccgcctcagaagacgcagcgcaccaggctgaggattgtgtgcttttttgccgctgtcaatgctgcaagctgcggggacacaaacccaaggactgtgagacccttatggcctggcgtaagtttccatccatttgtatttacatctatatatatacatataattgtactattcaggggaacacttggcaatggcgtcagccggcaaaaagcacacattccttctcggacacaagcggttcagctcaagaacctacatggaggagcatgccgtttccgctgcgtcagcatgggaaggtcatgg

SEQ ID NO: 72113 - DNA, 432 bp, Heterodera glycines
  Genomic contig location: Contig_ID=SeqID_9624; Location=688..1119; Strand=-
  SCN-specific regions: Sequence locations=1-149,281-432
atggtaccgaaaaatattggcagtgagacccaccttggcaatgaaacgacccctgcaattaaacgtctggcaatgaaacggcgggcaatgaaacggctgacaatgaaagggcggcagcgaaacggcggcaatgaatcttcacctaccggaaaatgggaagaaaaacggaatgatcaaaatcaaaataaagaagaaacgagagaaataataatccgaaaattcaacaaaataaaagagaaaatcaagaaaaaaggaaaaaaatattccacaaaaagaatggaataaaattgaattgaaaatcggaaaaaaattgggcccaaatcgcaaatatatttataaatggatcaaagaattaggcttatacaaatgccacaacaaatcaaaaacggatgaacaaaaaattgaaattgtgcaaaaatttatggcaataaa

SEQ ID NO: 72114 - DNA, 1300 bp, Heterodera glycines
  misc_feature (1209)..(1209): n is a, c, g, or t
  Genomic contig location: Contig_ID=SeqID_44652; Location=85..1384; Strand=-
  SCN-specific regions: Sequence locations=1-114,136-173,203-356,399 -405,427-525,555-661,853-1272,1294-1300
atgcgctcacactttggtggcacacggaaccaacaaatcggcagatggtgagaaaattgagttctaataattttatgccggaaattttagttcatgccctcgggcgattttctctaaatttattttaattttttagaatccactataatggagtgtcatctgatcaattaagctataaaaactaaaaaataataattaaatagaagaaatttacgcgaagcaatcggtaaatttactgacgactactaatttctttaattggaaatttcaaattttcgtcaccaataaagtgcatttttttttctgattcacgtttattggtcaaattttattttttcaaacatacataaatcaagaaaatttgttaaattttctaaaatttaatttattaataaatagcacttcaaaaatgcttccaatttaaggatcaatccaaagacaatttgcgggcaagcagcaccacagtttcagcaagtccttatgcggccgagggatttcgcttgctttggtgaaaattttagtttctaatttttaaaattaaattcaaaaaaattgttgaggtcgtcgtttcggcacgcgcagaaatgtcggcacaattcaacggatgcaaatggtgcggaatggcaagctgaattcacatgtgaaacaaaaaggtgagaacataataatatttttattttcatctaatttaaataaaattatttatgggttttttttaaatttaattagtttaatattattttttgaataaatgttatcaatttcttaataaaattattctaaaactttcttttaaaaataaataattgatttattatttttcaaaattattattcatttattttattttttgagcatcactaattaaaaaaaatattgtaatttcgacaaattaattcgcatttttttaaacaccaatatcgaaaatctcgactttgaattgttttgaatttttttgtaggcacaaaacgccaacggcatcgtcgccttatgagaagcagccggagaacacggaggaatgcatcccggcaccgctcgcctgcaattcatacgcggactgtgccgacaatgaagccgatttgcaccccaggcgacagctggcacacgggtgccaacgtaagcttattcatattccaataaattcaattatggcaaaatgaaacaaaatgccaaaaatttctgtcataagtaatttttttttcaaatttncccaaatttatcagcaatttatgtattgtattcatttttatattcgtattctatttaatacaggtaattttatttgggaaagtctaataaa

SEQ ID NO: 72115 - DNA, 558 bp, Heterodera glycines
  Genomic contig location: Contig_ID=SeqID_44655; Location=120..677; Strand=+
  SCN-specific regions: Sequence locations=1-192,216-332,354-358,380-558
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatctattttttcaagtgtcagtttggggtactcaaacatttatggggagcaaaaatccaacgcagaattaaagtacagactatagggaagctattcccgaaggattcgaggctccccataaatctggggggcatcggatcggggggactgcccctaaaacgaaaataaatcttattttttactgaggtcgtttgaggtgactcaaacaatgtatggggagctaaaatccgacg

SEQ ID NO: 72116 - DNA, 1016 bp, Heterodera glycines
  Genomic contig location: Contig_ID=SeqID_44656; Location=136..1151; Strand=+
  SCN-specific regions: Sequence locations=1-60,85-281,303-305,329 -581,603-816,838-899,923-1016
atgcccaacactttcaatttgtacgtaaatattcaaatgtttaatggattggacagtaagtaatttatattatttttattatatgccaaaaaatgtttgaaatgtgaaaatgactgaaaactaaacgaactgagaaaaaaaaccggacgaagtgcagagacggaatttgctgaattgtattggacattggcgagatcaatggcgaatgattattaacatatagcaaagtttgtttatgaaaagcgaatgtcagtagaaaaggaagtgatcggtcgaactcgaaaaataaaaaataataaattcgttggcacttttccaaatataaaaagactgtccgatcgatcacttcccccacagttaaagaaaggttaatgattcggggaacagtgctttttgaaacacacaatcagacgaggagtagcggagtggttacggagaaattggcatccgccaaactgtcggcatttgggccgggcgaagcggaggaagacggacaccagaaagactgggcattgccaacacagcctttgctaaggggaaaaatcaaaagtgaaagaaaaaggcattgtgattttggacacggacttaaatgggtttttgagtccatccgaagagagttggaaatacgcgtaacggtgcgcatttagtcgttcattagtggtgacggcggcgagaatctgaagaaaaagggaattaattaaacggaaattgaaaattaagaggacgaccgatacttggtaaaattggatgcaaagcaaagcggtgacgaagaaaaagtaattgacggagaaaaagcccaaaacggtgacaaaaggcatgcagaaaagaacatttgtggcggagatttggccacagaaatcgcgccaatctttggggaaacattcgaaaaagaaaatgtgaaaaacatttacagaaaagacatccggagaacacgagaaggcaggagaagtcgagaacaatcagataaacgatgaaagcccctaaaatggagagaaattggcatttgtaagcgccaa

SEQ ID NO: 72117 - DNA, 573 bp, Heterodera glycines
  Genomic contig location: Contig_ID=SeqID_44659; Location=572..1144; Strand=-
  SCN-specific regions: Sequence locations=1-156,178-253,275-344,366-573
atgcctgatttagtgcacagtggtgccgaagtaatatcaattcagtcaacttccgaagactgtgaaagacaatcaaatggttctgtatgtagagtcagtggaacaaccgaattaacaatattacccgctggacaaaaagtttcattagcattaaaagatgataaaggaaaaataatgggttcattagaattaattttacaatttttacgattacactgtaaccaacaaactttaaaatggttacgatcatataaaataaatgttatttcaaaaagacgctgtccaacaatgggctcatgtacaaaaagtaaatgtaaaaacattaaaatggatgaaaaaattccagaaatggaagattatgaaaattttccaggaaccaatttctgtaaaaaaggagacgcaatttggggtcataaatgcgcactcccatcatcggaatgtttcttttatagaacttacgcagaaccaacatcaaacacaatttgggaattaattagatgtaccggatgggattatgaattaaaaatgaggttaacattaacaatcggaaacgatacaaaatctaaaatttga

SEQ ID NO: 72118 - DNA, 898 bp, Heterodera glycines
  Genomic contig location: Contig_ID=SeqID_44660; Location=26..923; Strand=+
  SCN-specific regions: Sequence locations=1-318,340-371,395-499,524 -571,620-680,702-705,727-898
atggagatgcaacattttcttctcaatgcattggtctatgagcatgattcaacagtccggcagcaatcagctcaaatggcatttaagattgccacggattgcgttgattttaaatcaaagctgatcactttattcaacgaaatggcaccaaaagtgaaatatggaattgtgcatttgtaccgtttatttttatgtttaaaaattgatcagcgtgaattggatttacaatttattggaaatggtaatttttttttgaatatttaaatggcaattttttcgtttttgaatgtttctgtttgcaattctactaaataggtcattcttctataacattatttggggattgccgtttaatacttaattactgaagcaattatttttaataattattttagatgatggactgaaaattttgtttacccgcaccaaacttgaacaaggggaattgtcaatattatacaaaagtgaacttgttgattttctctcctactgtgttgaagttaatgagaaattgcttcaatttggtggcagtgattgcgaggcacaatgtgtgacagtttcgggtgcttgcttatattttaaaaatcaaattttcattattttttaaaataaaatttttgatttttgtaaacttttactacatatcaattataaattttactttttcagaattgcatttgctttttgagaacttttcttcttccactgaagatggtgaaaatgatgacgaatttctgttctggagcgacacacaaaagaagcaattgtccatttattcaaacggaattattgtaaacacttggcatttctaaaatttattagttgtataaacttgctcccggggtcattggtcacgaatctgaccccatttcgaccagtttcgaatcctaaatccgaa

SEQ ID NO: 72119 - DNA, 895 bp, Heterodera glycines
  Genomic contig location: Contig_ID=SeqID_9625; Location=263..1157; Strand=-
  SCN-specific regions: Sequence locations=1-77,168-180,202-584,609-895
atgtggccgaacattgacccgacggaatggcaaacgatgctttggcatttcgaccaaaatttggcgaacgcagcgatggatgcggaggaaggccaaaaagaggcgaatgaggggggaattgaggacggaaaaggggagggggaggaggaggaggagcaaaatgaggaccaagaaatcaaattgctgagagaattgggggagaaagagggccaaggccgggcacaatttggggaccgggaaagacacgccgaactcggcaagaagttcagtctgttgaagaagtcgactaccaacgacggagcagcccatgggatggtcaacttttgtgttatctatcgaccatttctcgtgttcggctcacaatcagtggacattcttttgttcatcagggtaattaattaattattaattgagcaattaatttttgattgttggcactttttcactctccagggccttttggaaggtcatttcaatgcaaaaacaatggacgactatttggagaatggcaagtagagaccggcgcaggacaggatcctgcgcaggattttgcaggatcccagtccgcaatcctgcatattttgggaaaatacaggatttgcaggattaatcctgccggatcctgtcctgtaaaaaattttgaattctaatcctgcaacaggacccgcaaattagatttttatgcaggattcagcaggatcctgcattgattttttgaaaatttttggtagccgcagaaaaaaatagtaatctacaaaaatggggaccgcgaccgggggaaggccaattccaattaaaaaattcacaacttttggcttggtgaccacataatttttgaaaattttatctattttattaacatattttgcgccaaacaaaaaacatatgcaataaa

SEQ ID NO: 72120 - DNA, 373 bp, Heterodera glycines
  Genomic contig location: Contig_ID=SeqID_44663; Location=792..1164; Strand=+
  SCN-specific regions: Sequence locations=1-35,101-211,233-233,258-324
atggttaattcatattatttttatgctcgcctttcttaattttaaaataaatgaaattatttaattatttataatataaattaattctttatttaaatttctgattatttctttcatttttttgcgctttgtttttttaggaaattgtcgagggccatcgttggcttgaagaacagcgggaaatgatcacagccgaacgcaaagcatttcaagtgaaaaaagaaaacaattagaaaattaaattttatttatttttaggaagaacaatcgctgattttggattggattgagcacaaaaagacggaaattgaggcgaacaaagtgaaaaataaataaacatttttattaaattttgaaaacaaaaaaatattta

SEQ ID NO: 72121 - DNA, 347 bp, Heterodera glycines
  Genomic contig location: Contig_ID=SeqID_44667; Location=325..671; Strand=+
  SCN-specific regions: Sequence locations=1-293,315-347
atgaaacgcaccaaattttatttacatgttagtttaggcactctgatgctttttctatcaataatggaggtgaatacaattttaattgctttttaactttgggaaaaagtttaggcttaactttttagtgaaagtttgatcactcatatttttttagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatatactcaaaccggttcagaattca

SEQ ID NO: 72122 - DNA, 410 bp, Heterodera glycines
  Genomic contig location: Contig_ID=SeqID_44668; Location=560..969; Strand=+
  SCN-specific regions: Sequence locations=1-107,134-198,239-263,290-410
atggagaaggcctgcaaaatttggagagattatatcgattttagtgcgctaggttcgatgaaactttttaaaatataagcctaaactttttggcctgtttaaaaaggaattaaaaatttttaaaaattttattcatctcccttttgatagaaaaagcatcagatagccttatttaacttttaattaacatttggtgcgtttcagagcattttctgaaaaaatatttatgaattaattttgctaaaaaaataaaatagtgaagctttaaaaattaaaaaaattttaaattcagaattactggagttagcatcatagcagtgcttttccttgtctttttgatgctctcgcaaaatctggttcgcttctgatcagtttataaaaaaaaagttaagcctaaaatttttcgcata

SEQ ID NO: 72123 - DNA, 235 bp, Heterodera glycines
  misc_feature (74)..(74): n is a, c, g, or t
  Genomic contig location: Contig_ID=SeqID_44670; Location=747..981; Strand=-
  SCN-specific regions: Sequence locations=1-235
atggcattttgccaaaattgctttgttgcgtgtgctaaagcagcaaatgccatgcaaacgaccattgtgatgancgcattttcgcattggatttacagcggaagaccaccattaaatggggctattgaaattgttcatttttggattgaactgttcagcaaaagaacggcaacaaatgacatcagacgaatgtgccgatggcccgaaatcgataagaatcttttccggcgaatcg

SEQ ID NO: 72124 - DNA, 459 bp, Heterodera glycines
  Genomic contig location: Contig_ID=SeqID_9626; Location=55..513; Strand=+
  SCN-specific regions: Sequence locations=1-375,404-459
atgaatgttttttggttagtaggcgagatgtcgagtaggcgaaatgaaggtttttggcttagtaagctcaatgaatgttttcgggatagtaggcgaaatgaatgttttttgcttggtaggcgaaacgaatttttttggcttagtaggcgaaatgtcaataggcgaaatgtcggtaggcgagatgtcgagtaggcgaaatgtccgtacaccaataaaaaatcgtgaaacttttaaaaggatttctcggattcattgatcattttgaccttatggtgaacatttttgaaacattattttttgaatttgatttagtggttgttttttttcagtttgtttatttggtttttgtgttccttgcgtgaaataattatgccgatgcttaggcttaatgtttaattgttattagatctttgtttttttgtctaatttttctgatttagccaaaattgaagtgaataa

SEQ ID NO: 72125 - DNA, 2165 bp, Heterodera glycines
  misc_feature (43)..(43): n is a, c, g, or t
  Genomic contig location: Contig_ID=SeqID_9627; Location=159..2323; Strand=+
  SCN-specific regions: Sequence locations=1-216,238-303,325-968,990 -1382,1404-1549,1571-1602,1695-1765,1787-1844,1867-2134,2156-2165
atgtggagtggacaagagcacgggacaacccttacaaattgtnctctgctcaaggtgtgggtgatccctccgcggaagtgcgatgtgccagtgctgcccgtcaaagtcaacgaacggctgtgcttcccgttgtgcatgcagtgttgtcttgactacccaaaaggaggcgttgattttgactaccattgtgaacacgacgaccaacaacgcggctgggtaacaacatgcacatcaattgaattggatgctgcgcttaatgagggctaccgtgtgaccaaagtgttccgggtgctaaggtacaagcatggcgacgacaagctattccgcccatacatcgctgaattcatgtcgcaggaaattgaagcctccgggtaagagttggagcagcagttcatcacgaaactcggaatttcaattgacaaggacaacatgaaagttaacaagggaaagcggtcgttggcaaagctgtgtctcaacaacctatgggggcgcttctcacttcgaaactttggccttgcccagacgctaatcaccgacgaccactctgtgttaacggaatacttggataaccgtacagttgacgtcacttccgttgatgagctggacgacgaacaccttttgatcagctatgtacagaagaaggaatgggtggagaagcacgattgcgccaatattggtgagattttttcattaatttttgcataatttttgaaattttttcagtcatctaactctggacaacatcaaagtcacgccttctgctgttgaaagcgatgcagaaggtgatgagaacgcctggatgctgactgctgtacactgacaccgactcgttgattttcgtccatccgatcggcatgaatccactggagacaggaccacatttggggcaattcatcgatgaataccccaagcatgaaattgtggagtattgtagtggcggagcgaagcaggttaatttacccttttaataattcataatttattcatttcagtatggactcaaactccgggtaatgggcaggacgaatttgtactgaagctgaggggcatcacactgaactacgacgtgatgcagaaccagtccctctgctacgacacattcaaagaagaagtgttgcggtacgcccaaaccggagaatatgagccaatcaatgtgatgtaccccaactttttgagacccgacattaggagtggcggacacgtcacttcaggccccttccaaaaatgttacgttcaccattcattgtatctctcacacacgcataccctatacacacacacacacaccccatacccacgtaccagggctggccgtgatcacggatcacggaaatcacggggtttttggggtgccgtgatcttggatcacgggtcacggattttttcaaattttccgtgattttgatccgtgattggcattttatatagggaatttttattgagacgaaaataggaaagtggtgtgaagaattttttgagaaaaataaataaattcttttctgcttacaaattcgaaagtaaacatatatatgtagtctggtggttaagccttctgtctttcgttgtctgtcccttgggttcaattccccattgggataggacaatttatatattttgttttgataattttaattgaaatttaattaacaagaaatttcataacattgaaaattatttttctttattttttaaaacgtccatataccaataaattaaccaatgattggacatattttggacaaaatctgtcaacaaattcactcaaaatttcaaaatttttcccggcggcgcctgtcggcaccaccggcagacggacccccattttaccgtatttttgaaattttgaccccaaaatggcagaaaaattaccatttttggcatataaactgctaaaaaccctatttcttctctccgtcgcttaaatttaaaacgacaggcctaatcaaaattttcagaaaattttcccaaccctctaagaattttttctaaaattttcctgactttcagtatcttttggggtgttcagatcgtcatgaaggactgagcatgttggtccaaaagatttttttcagcatcaaaagttagcttacaaattagaggaaatttttttctctacataaatagatttttggttaaatttaagaaaaatttgaaaaattttctta

SEQ ID NO: 72126 - DNA, 89 bp, Heterodera glycines
  Genomic contig location: Contig_ID=SeqID_9628; Location=504..592; Strand=+
  SCN-specific regions: Sequence locations=1-89
gtcccgatcccggtcccggtttttggaaaaacagaaatcccggtcccggttttgccagtcccggtcccggcgggactaaataagcactg

SEQ ID NO: 72127 - DNA, 819 bp, Heterodera glycines
  Genomic contig location: Contig_ID=SeqID_44674; Location=566..1384; Strand=-
  SCN-specific regions: Sequence locations=1-207,229-371,393-506,528 -659,686-768,811-819
aaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattccggaaggattcggttccccataaatctgggcgcatcggttcagggggactgccccgacaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagact

SEQ ID NO: 72128 - DNA, 190 bp, Heterodera glycines
  Genomic contig location: Contig_ID=SeqID_44675; Location=93..282; Strand=+
  SCN-specific regions: Sequence locations=1-190
cttttaattattcagtacaatgcttttaagccccgccgtgaggcgggacagttccaaaattttgtaccacattttactgtggaaagtccaagtaccttattggacaactacgtgtcaatgagcacagtcgcctttggccagttgtgcactatttcgtttcaaaattgaatcattttttttgtcttttgaa

SEQ ID NO: 72129 - DNA, 683 bp, Heterodera glycines
  Genomic contig location: Contig_ID=SeqID_44681; Location=115..797; Strand=-
  SCN-specific regions: Sequence locations=1-231,267-329,353-393,415-683
atggaaacagaaaatgatgccacggcatcgccaaatcggccattgtccgccgccagtgtggccacgtcgaccgcgctgcgcgatggcggcgaagcggacaacagtgacgcacaacagcaccagcaggcgacgcgcgagctggacgaagcggtcactttggcagcgggccgaggcgcccgcatcaccgacttggacaggtgaacagtttggcggtgcggcagttgccgccggtttctgattttactgtttttagggtaatttgggtttggaggctttgaccaatttttcaattgcaaaattggtttaacatggcattaaaaccgagttctaggccctagacacccttaaatcagtccaaatttttgatttgccaacttccaattcacaggcctctcaaaagcgcccacattttccaatggtttcatcaaataaaggatttctaggcccctcgaattgcccacgaattttttcattatcaatggctcgtttttatggttttgtttttatattttagatacctaacaaattttgattcaaaaaaatttgccattttttttagacaaattgaaactttaatgcgctgtgaatgcctaaccgagcaggaagtgaaagtgttgtgtgccaaagcgcgtgaaattcttctccaggaaggcaatgtgcagcgaattgatgcgccagtgacg

SEQ ID NO: 72130 - DNA, 2631 bp, Heterodera glycines; identical to SEQ ID NO: 9630
  Genomic contig location: Contig_ID=SeqID_9630; Location=1..2631; Strand=+
  SCN-specific regions: Sequence locations=1-407,451-661,683-1015,1037 -1082,1104-1787,1827-1927,1951-2344,2373-2631
  Gene Ontology: Mol. function=muscarinic acetylcholine receptor activity; Cellular component=plasma membrane; Biological process =synaptic transmission, cholinergic

SEQ ID NO: 72131 - DNA, 1079 bp, Heterodera glycines
  Genomic contig location: Contig_ID=SeqID_44682; Location=1..1079; Strand=-
  SCN-specific regions: Sequence locations=1-945,968-1079
gcagtgcagcgtcaaccgattgttgcgctggtcactcattttgttggcctatgacttcaaaattgaatacgttaaaacgacggattttggacaggcagacgcactctcccgactcattgcaaaaggcggagaagaggaaaacgaacgcgtcattgctttggtcaccgccgaaccaattttggaagaaagtctccattcagcttcgaaaaatttgccgatcaaattcgaggatttggtcatcgccagcaaaaatgacgcaaatattcaaaatgtcatcaaattcatccgccaaggctggccaaccgaaaagcaaattgagaaggaatcggaaatcattaaacttttccatcggcgcaaaagtgatctgaccattttgaaaggctgcctcatgtatggcgaaagagtggtcattccgaggatttttcaggccaaaattctccgattatttcacaaaggccaccccggaatgaagagaatgaagcagctcgcccgccaatacatattctggccgaaattggacaaagaaattgaggattatgtccaaaactgtgagccgtgccaattggctgcaaaggcaccgatcaaaaccgatctccattcatggccaaaaccaactggcccgtggcaacgaattcacatcgactttgctgggccattcttcggcaaaacatttttaattgtcgttgattcattttccaaataccctgaggtatttgagatggcaaattcatcagcaacttccacaatcgaaaaattgcgctatttattcacacgccatggaattccagaaacaattgtttctgacaatggcacgcaattttcaagctcagaattcgccaaatttgttgcagccaacggcatcacacatttattttcggctccatataatccaatgtcaaatggacaagtggagagatttgtcgacacatttaagagagcattcagaaaattaaaaggggaggggaagccaaacaaggagatcatcgacatttttctgatcagctatcggacgaccccaaacgacacacttcccaatttgaagggtcccgctgaactgctgctcggtcgaaggccaagga

SEQ ID NO: 72132 - DNA, 1019 bp, Heterodera glycines; identical to SEQ ID NO: 44683
  misc_feature (7)..(7): n is a, c, g, or t
  misc_feature (949)..(949): n is a, c, g, or t
  Genomic contig location: Contig_ID=SeqID_44683; Location=1..1019; Strand=+
  SCN-specific regions: Sequence locations=1-169,191-1019
  Gene Ontology: Biological process=DNA replication

SEQ ID NO: 72133 - DNA, 455 bp, Heterodera glycines
  Genomic contig location: Contig_ID=SeqID_44685; Location=199..653; Strand=+
  SCN-specific regions: Sequence locations=1-71,99-150,172-455
atgcgcaaattccgctcgccccattctctgctcgtcggcatcgccgtcggcgtttttcttggactttgcatcagcttattagacaataaaagcaaaatttacatcgcttttactgaagaagacacacaaaaaggtaaaagcaatgaattatttattttaaagaaataaatgtatgtatttagtgacaatttattcgaatttgccctcccatttaatgcgaatgggcaataaaaatgcgcaaacattgcattcactgaacatttggctacgttgcattgttttgttggcatcagatgaacaaaattggccagaaaagaatttgatggccattagagacacgtgggcgaagaaatgcaacgaaagtgggcaaaaaatgaaaaaataaatcattaccccaatcatttacagtgaaaaggatgctgtccagacctaccaactactgcgcgacacgatag

SEQ ID NO: 72134 - DNA, 304 bp, Heterodera glycines
  Genomic contig location: Contig_ID=SeqID_44686; Location=588..891; Strand=+
  SCN-specific regions: Sequence locations=1-304
aaaattccctcaaaaataaaaggtctattgcgcaccgccctccctatcatgctcgagagcatttgtatgtgtataaaatttatcaaaaaaagagatatccatttttctgggataacctctaaatataaaaatcctctgtgaaataatatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatg

SEQ ID NO: 72135 - DNA, 56 bp, Heterodera glycines; identical to SEQ ID NO: 52733
  Genomic contig location: Contig_ID=SeqID_44687; Location=467..522; Strand=+
  SCN-specific regions: Sequence locations=1-56

SEQ ID NO: 72136 - DNA, 327 bp, Heterodera glycines
  Genomic contig location: Contig_ID=SeqID_44690; Location=16..342; Strand=+
  SCN-specific regions: Sequence locations=1-120,143-150,172-327
atgtgtgcaaatataagttatctctgggaccaggaacgcataattgttgaaatagaaaaattggtggcgttacatggaacaaatcaccgggaaagtcgcgaagtggatttcgattgaaattgtaataattaataaaaatcacaaattaattttcgttttatttgttaaatttgaattgttcaggaaaatgtgtggccatttgaaatggagagacaggcaaaggctgcacttggaattgtggaaatcacggacccttacgcatacaacaaaacagcgaacacaatcaacagcgcagtttctgaacgcggacctgaaaagtatttataa

SEQ ID NO: 72137 - DNA, 244 bp, Heterodera glycines
  Genomic contig location: Contig_ID=SeqID_9631; Location=569..812; Strand=-
  SCN-specific regions: Sequence locations=1-120,144-163,190-244
cgctgacccacaaaatgtccagcacacgaaatgtccaaacgaatttgagttttttgttattcagatgggcctaaggttagacaagggttaatataaagggtatattcgtattcagcgaccccgaaaaccctaaaaatcctaaattagactcattttgtttttataaattttgaaaaattttggacatttcgtgggtttttactcttttggacatttcgtggcttggacactttgtgggggtgcc

SEQ ID NO: 72138 - DNA, 786 bp, Heterodera glycines
  Genomic contig location: Contig_ID=SeqID_9632; Location=15..800; Strand=+
  SCN-specific regions: Sequence locations=1-638,661-786
atggccaatgatcttcttaatgccaatcaagcgtttgatcagttgcgaagtcaattggcgacggcaccggcaaatgatttgaacccaaaaattaatcatgcaaaaaatggtcttaatgatgatgaagaagatgaacgcttcagtctcattgaagaccaagaatttccaccacgggatggttttgatttggaccaattaagcgctgttgatcggggtttaatcaacattgcctctaaactattcaaatttctgccaagaattgctggcaaaattgggcagcttttttccaaaaatgttcattacatcgtcaactcggcgtccaatcttgtgattttcaaattgaatgaggaacaacaaaaaaagtacaatttgccggaacgattagaagtgccattgacaccgggcaagttttttattgcattattggcgaaatgttcaaaaataaatcaaaaaaagaaaattgaaaaaatagaaaaatatttttcaatgtttcaaaaaaaaaggaaatttgattctcttaagaattttgtgtttttaattattcaaaattatgacctaatttgaataaatcattcattttattagaaatgcaacaacaaattgaaaatggtcaaccattacaacctccgttagaagcgcaacaacaaggacaacaacaagtgcagcaacgttccttgcttccatctactgcggattatgaggaacatgatgatgatctgatgcgaaacaatgctgaacgttttttgtttctttttcagcaccgctgtggcaaaaattgcagaatga

SEQ ID NO: 72139 - DNA, 927 bp, Heterodera glycines
  Genomic contig location: Contig_ID=SeqID_9633; Location=165..1091; Strand=+
  SCN-specific regions: Sequence locations=1-137,181-765,788-803,826-927
atgatcaaaacattctcaaaagtgttcagagttataaaaagaatgaaactgatcagcaaaagagagaaagaaaaagtgataaaaattgaactaaatgaacgaaatgagaactcacaatcagcagttgatcaaatgggtgaagaaatggaaaatgacccaaatgatcaacaaaaaacagaaatcattcaaaaatttgatgcaattaaagaaaagttgagggaaaagggaaaatttgaatggaaaaatcaaagcaaaattgagagaaaaattgcaaaattattaggaacaaatcggcaattaatacaaaaatggaaaaatgaattaaatctaaataaaaacaaaataaaaaaggaattttatgagatgaaaaagagtgaattcattgaacgatttgatgaatttaaagaattatatggccaaggcaaacagaaagaatttgcgaaggaattgggcatttgtgaaaggacatttcgaatatggaaaaaagaattggcacaaaaataccataaaagtcaaagtaagaattattttagtgaaattaaattgtactttttctttaagaacatcataccaataatgataaattgaaaaagatgaagcattatttgcaaataaaagaagcaaatccaaaaattagtgacgaattaattgccaacaaattggggattggatggacaactctgaaaagatggaaaaaggaatgctctcatccatttgatcaatgatttttagttggtcatgattgttgatgacttttatagtttgaaaatttacaaaaatatttagtcgaaactctaaaaagtcattttttattcttttaaaatgcaactaaattttttcctaattttacataaaaagatttttttcgaaagttggttcttatgagcaacagattgtgaaaccaaattaaacaaaactatttataaa

SEQ ID NO: 72140 - DNA, 1177 bp, Heterodera glycines
  Genomic contig location: Contig_ID=SeqID_9633; Location=1733..2909; Strand=+
  SCN-specific regions: Sequence locations=1-218,240-555,578-610,632 -701,723-1177
atgacaacatggacacgcgagagactagaggaagaacgccgactccactctgtcgtggtcgtgaacctgccggaaagtgaagaaactgtgccctctgctcgtgtcaactccgattttgtgaatgctcaatcaatgctcgacacttgtgagatcgaatgccggccatgtcaggtttaccgaatgggaaagaagtccgaccgcccccgtctcatgaaaatcgaattccccaccaaaaaacacgcccaaaattttctgcggaacaagacaaaactcaaaaatcacaataaatttaacaatgtcttggtccgcccatctctatccaaacagcaactcgctgaacgttcccgacttattggcatttgcaaaaatgaccatatgagtaatcccaattcgaattctctcatttgtgccggccatgttatgtttgcctctgacattccccgttacaaatccaaccccgactcttaaatgtatttgtcatgtgcataatgttgatgactcttaatgtgtaattggtgaccactgtaacacgaaatctcttaaaacgcaagctcttttacaaactaatagaaaatatgaaccccccataaaaaatccaattaccttaaacaaaaaacaaaatcttttatactcaacattgatcaatacgcaatccctaaataataagctagaagaattttctgctatcatagctctaaaagattttgaattggtttttgtaactgaaacttgggcaaaagaaaaaatacctttccaaccatatatcactaacaattacaaaatatatgaagctagcagaagcggtaaaaatggtggtggagtaatgatcttgataaaaactaacctaaattctttttctgttttatcctgttctaaattcaattgcgaaatccaaattatccagataaatggagcaaaaagattaagaatagctctactttacagaccaccaaacacttctgctagtctcactaaaaagattctgaacctcattggtaattatttagaagaaaattttatcattatgggagattttaacctaaatgcaaaagatataacctggaccagtggaacaccttttgctaaatcggaaaagggaaacattttttgtgaattttttaatgtatggcttattccttatgacgaacggaccaactcgaggcagtgcttggcttga

SEQ ID NO: 72141 - DNA, 438 bp, Heterodera glycines
  Genomic contig location: Contig_ID=SeqID_44692; Location=602..1039; Strand=+
  SCN-specific regions: Sequence locations=1-438
aaaatggtgtaagtaaaaatcgtaattacgctcaaaaagctcctcaaacaattttagcgcttccaattccttctacaatcgcctttatacatcccattatgagcgctaaaattatcagagtgccgaaaatcgcatgtcatctaagcctagcaaaaaatggtgtaagtaaaaatcgtaattacgctcaaaaagctcctcaaacaattttagcgcttccaattccttctacaatcgcctttatacatcccattatgagcgctaaaattatcagagtgccgaaaatcgcatgtgatctaagcctagaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgc

SEQ ID NO: 72142 - DNA, 504 bp, Heterodera glycines
  Genomic contig location: Contig_ID=SeqID_44696; Location=369..872; Strand=+
  SCN-specific regions: Sequence locations=1-170,194-381,419-504
atgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcttaaattttaaaattttttaattgctttttaaatatgccaaaaaatgtaggcttaatttttttagtgaaattcgatcactcatattttttgctaatgagcagaagcgtaccaaactttgcagggatactccccggtaaaggactaacttacactgaaatgagcgccgagctagctggctcaaaaaaatttttcgaaaatctgagtctttcgtttttatttatttgcaaaattaattcataaatattttttcagaaagggttctgaaacgcaccaaattttatttacatgttagtttaggcactctgatgctttttctatcaataatggaggtga

SEQ ID NO: 72143 - DNA, 506 bp, Heterodera glycines
  Genomic contig location: Contig_ID=SeqID_44697; Location=11..516; Strand=-
  SCN-specific regions: Sequence locations=1-506
atgaaaaacttccaaagtgttgacctttctctgtttgcgcgtccaaataaggcaaaggcacgcgagccttcgctttgcgctcctcctcactcaaattcaagccgaggtcaaacggaagtgtggacaaaactgttggacggtccctcagttggatattgttcatactctgatgagcaatatgaggggggtggcattgctgtgtttgaggttgttggagctatagtccaacgttaatctgcggccgaaagtcagcagtcagtcaaacagcgggttatgagcatttccggcaagaaaagttgacagatgctattttggacaaggtaaaggtgacaaaagcggattcatttcgtttttggctcaaaaaatggttagggtcagcttcgttttgaaaagggaaaatggacgccagtccggttttgggtatttatacttaaaagaagtcttttgaattttatcaaaaacaaaagggggaaccatggtgttgtgcaaaatttttttgtaataaa

SEQ ID NO: 72144 - DNA, 263 bp, Heterodera glycines
  Genomic contig location: Contig_ID=SeqID_44698; Location=268..530; Strand=-
  SCN-specific regions: Sequence locations=1-58,80-263
accgggattcccgactcttgattcctggaaatactccccctgtggttataaaaatattgtatattttcaatacagcaaatgcgacgcaaaggaatgattcggaagcgaatgatcggcgacgaagaaacggaggaggcgcaagggacgacgagtggcacaaacgcagcaacagaaggcattcggagcaaaaagagggcaaccaaaggcacactgttgtgattgatgatgatggacggatgaaccaattatttgcacaattttaa

SEQ ID NO: 72145 - DNA, 548 bp, Heterodera glycines
  Genomic contig location: Contig_ID=SeqID_44699; Location=1..548; Strand=+
  SCN-specific regions: Sequence locations=1-83,106-317,340-430,452-548
cagcatttcaatcactgggactcaattctgcatttcaatcactggcactcaacccaccagcatttcaatcactgggactcaacccaccagcattccaatcactgggactcaacccaccagcatttcaatcactggcactcaacccaccagcatttcaatcactgggactcaattctgcatttcaatcactggcactcaacccaccagcatttcaatcactggcactcaacccaccagcatttcaatcactgggactcgattctgcatttcaatcactggcactcaacccaccagcatttcaatcactgggactcaacccaccagcattccaatcactgggactcaattctcctgcatttcaatcactggtactcaattctcctgtatttcaatcactgggactcaacccaccaacattccaatcaacgggactcaaccctctagcatttcaatcactgggactcaatccaccagaatttcaatcactgggactcaacccaccagcatttcaatcactgggactcaacccaccaacatttcaatcactg

SEQ ID NO: 72146 - DNA, 651 bp, Heterodera glycines
  Genomic contig location: Contig_ID=SeqID_9634; Location=230..880; Strand=-
  SCN-specific regions: Sequence locations=1-21,43-154,176-182,205 -238,266-460,484-542,564-651
atgccatcatcccccaaacattcttctttgccttcatcacccaaacatcattcttctgaggatgaaacggaagtgaagcaatcaccacctcatcatcattcatcttccgactcggaaaaagaagaacgtttgtggggcctggggaataattattaaataaattgttgaattttttatggcgtcccttttttaatttaacataaaatggaaaaaacgccattttgagcatttaaaagtgtttaattaaaaattaattttaattattgtttcaaaattccagaaaaacttcatgcctgattcataggcaccagaaccagttggatttgaacagatgaatttgagaagtatcatctgctgacgacaaatagggaaacttttttcaaatattaccattttacgaatttccacctttttaacacacactttctatcttttatatcatagattaatgatatggaaatttttattctatcctttaaaaattgtgtcgtcttgaattgttatgattaataactattttaaagaaaagatttgcacttaacccaagtacagcaaaaggtgggactaaaatttttcaatatttttgaagattttttgtttgtaattatttgaggccgcgtgggaatcaaacgattccaagaaattaataaa

SEQ ID NO: 72147 - DNA, 464 bp, Heterodera glycines
  Genomic contig location: Contig_ID=SeqID_9634; Location=1010..1473; Strand=+
  SCN-specific regions: Sequence locations=1-144,301-335,358-431,456-464
atgtttttatgtaattttttttaaatgattcattaggtttttgcttttccttttatgttgataaattgtaggttttttgcctatttattacgccctttttttttatctattttgtctaatgagcgaataatcgtaagaagaccctaattatattgaaaatttaattatttcgtcataaaaatatttaaagtatttttataaagattaaaaataaatcagaattaataaataacaaaaaaaaatcctaactctacttatttaaatatttaaattgataaaaaaaaactttctataaaaaaacctcgcaacaaactttcttcattatcagcgtcatcggaagaagatgaagaagaatgtttgggtgatgatggtttcactgctggtgatgatgaggagggatgttgcggtgattgtgctcgtccatggacttcaaatttttttattaaatataaaaagtagaaaaa

SEQ ID NO: 72148 - DNA, 1871 bp, Heterodera glycines
  Genomic contig location: Contig_ID=SeqID_9635; Location=809..2679; Strand=+
  SCN-specific regions: Sequence locations=1-67,122-164,204-262,309 -557,582-1124,1206-1346,1379-1549,1633-1721,1743-1772,1835-1847,1869 -1871
atgcgcacttttctgttcatagctgtagtcgggttggtgttggctgtcatcatggagagtggtaatcaaatatttaaaaaaaaagattttaatttgtcataaatttatttatattattttagtaaatgcgactgggaataattcgccgacaaagggtgatgacgataaattattatttactataattaatgtaaatttaataagcaaatcctagaggaacatttttgaaaatctaaattcttaggtgttagtgggagagtggtaattttttatttaaaataaaatttatttttcgttattttataaatgcaggtagtccgaaaaagccgacaaaacaaacgggctcagggaaattattattagaaatgcaatttttgaaaatcgttgggtcagaaaaatgggattttttttgaaaatgttcatataaatccaacaatcttggtatcatttgaaagctcttaacatgctctaaagtgatgttctttggttctttgatgcggaagagcaaaagatcaacccacggtgggactcgaacccacgaccccagctttccgtgctgtgctctaaccaactgagctacgcaggcatccgctccattgctctcttctctctcctatcttaggaggagaatcactctcttaatctccttcactgccgtcttggcacaaggggagagagtgaccgcatttatcacactattatccttacaaaaaacaaaaaattttattttcttgcaatttcttagaaaaagtttctaaaaagttatagtggaaaaacatgctggcgcacaaccgtacgcgcccaactgagctagaccgccccggggccatggcagtgatggctcagcaaaactgaatttagcggtgccccaaatgcctactataatcctgaccaattaaaataaatttttaaggatgttaaatgaattttcaaaaaaaaaaaaaattggttatacggaagcttatttttcacgattttaggacaaactccgcctggcagtccgaaaggtgggcacggcagcaacaaatcgccaacgacgccgcacagtgccggttcgccacacggcacgcagcatggtaaccaacagaaccatgctaccggtaacacatttattcagcaatcacaaaatttttatctaaaattaacatgaaaattagaaaattttataaatatatttaattattttatataacatatatatttatcagaatggcataacattttactcaaataaaagtgaaatttctgtttttttttgtttcgctccaaatgtgtccaggaccaaaatggcggtgcataaatggcaccgaatcattaaaataaaatgtttaacggtgttaattgaattttcaaaaaacaataaaaattggttgttagttagtaagcatatttttcacgattttaggacaaacgccgcctggcagtccgaaaggtgggcacggcaacaacaaatcgccaacgacgccgcacagtgccggttcgccacacggcacgcagcatggtaaccaacagaaaaatgctaccggtaacacatttattcagcaatcacaaaatttttatctaaaattaacatgaaaattagaaaattttataaatatatttaattattttatataacatatatatttattagagtgccacgggaccgggaatttttgccaaaaccgggaccgggacttgccggaacctgagaagccgggaccgggacctcgattttttttcgggaccgggaccgggaccgcaagaaaaaccgggaaccgggaccaaccgggaaattttaaaaattcaaaaaaattttaaaaattaaaaaaaaaattcaaattttaatttatatcaagtgaaaataatacaaaattatttggttttttata

SEQ ID NO: 72149 - DNA, 59 bp, Heterodera glycines
  Genomic contig location: Contig_ID=SeqID_9635; Location=2618..2676; Strand=-
  SCN-specific regions: Sequence locations=22-59
aaaaaaccaaataattttgtattattttcacttgatataaattaaaatttgaatttttt

SEQ ID NO: 72150 - DNA, 162 bp, Heterodera glycines
  Genomic contig location: Contig_ID=SeqID_9635; Location=3606..3767; Strand=+
  SCN-specific regions: Sequence locations=1-14,38-162
acgcttgtactcgtagagaaacatttgtgagatgtaccaacgttcgctggcaagtatgtaattcgatagacagcaattgtacctttcgacacttttacaacttctatgaagttccccaacgtcgtacaaatttgcattgaaaaaaaggaggaaaaaagaaaa

SEQ ID NO: 72151 - DNA, 780 bp, Heterodera glycines
  Genomic contig location: Contig_ID=SeqID_44707; Location=89..868; Strand=+
  SCN-specific regions: Sequence locations=1-359,405-780
atgcacacgttttgcgctcgagctatttatcatcgggcttgtcaatccaaagcgaaacaacaaagatgctgttttgaacgaataaagggcataggttattttgaagaagtgtcaaagaacatgcagcaataagcctgcaaaatctaataagtggaaaatacatgagtatagaatttattttcagaaagtgtccacagacttttggaaaaatatatttgcaatttatcaacaattttgagaagtgagttagaaatgataaacttcacgattcaaaccaattttcgttgctctaattaaccgggataaaaacattcgaatcaattaaatagcttctgagataataaggtttatcataaaatttcaattaaaaataaaccctcaattattggtatgaacgatactttccaaacatgcacgcgttttgcgctcgagctatttatcatcgggcttgtcaatccaaagcgaaacaacaaagatgctgttttgaacgaataaagggcataggttattttgaagaagtgtcaaagaacatgcagcaataagcctgcaaaatctaataagtggaaaatacatgagtatagaatttattttcagaaagtgtccacagacttttggaaaaatatatttgcaatttatcaacaattttgagaagtgagttagaaatgataaacttcacgattcaaaccaattttcgttgctctaattaaccgggataaaaacattcgaatcaattaaatagcttctgagataataaggtttatcataaaatttcaattaaaa

SEQ ID NO: 72152 - DNA, 1008 bp, Heterodera glycines
  Genomic contig location: Contig_ID=SeqID_44708; Location=116..1123; Strand=+
  SCN-specific regions: Sequence locations=1-91,114-236,268-312,337-1008
atgagaaataaaaacgatggaagcgctcctttcagaaatacacaaaataggtattcaattgagtttgcgttcgctaaaagactatgtcggcagaataaaaaaggtctcaacttatactaatttcctgataagtacgtctttacataattttcaaggtttttcagcttgatgagactagtcaccgttcagtatcagaccaatcggagcaaactatgccaaatacccaaaagttgtccatttttttttcttaaattattttaaaattaagtccgttaattcaaccccgctatgtaaagtgcttttcaaaaaaagataatgaaattgtttatctaatcggagaggaaaatgtgtggcgcaaatttatgtcgacaaatttcgtggaaccaatatataccttgtatgtactggttgcaaagaaatccaacgtttaaaaaaatcaaggttaataacatttttaggttataattttttcaatcattcagaacccctataatagcacgtgctattatacgagacgacaaacttttttttacaaaagctgaacaccataatgattgcatggctcatagtttagaatttctagaatctgaacaaatagagttatctcagcgacggaaaatattagaatgcacagaaatatggcaaaatgttgatccaaaatccctatgggccgaggttagatcaaatattaaagtccaaaaaaatacctaaaatcagggtcgcggaattgcgatgaagaaggacgttgagctaggaaaagacatagaaaatgatacatcttactcgctgaattacccaacttggcaaaatatacgtcgcacttacttgcgtagaaaagacagagcaattgcgcatggtcagacagtaaaagaggatccatttgacatcccagaaaaattacaattaactcggtttggaagtctaaaactcatgcttggaaaaagcattgcttctaacgatttgtacgattactttaaccagggcttcccatgtaaaattataccttag

SEQ ID NO: 72153 - DNA, 576 bp, Heterodera glycines
  Genomic contig location: Contig_ID=SeqID_44710; Location=278..853; Strand=-
  SCN-specific regions: Sequence locations=1-263,285-416,443-525,568-576
gtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagact

SEQ ID NO: 72154 - DNA, 304 bp, Heterodera glycines; identical to SEQ ID NO: 53844
  Genomic contig location: Contig_ID=SeqID_44711; Location=197..500; Strand=+
  SCN-specific regions: Sequence locations=1-304

SEQ ID NO: 72155 - DNA, 979 bp, Heterodera glycines
  Genomic contig location: Contig_ID=SeqID_9637; Location=49..1027; Strand=+
  SCN-specific regions: Sequence locations=27-80,104-139,402-814,843 -859,916-979
  Gene Ontology: Mol. function=phosphopantothenoylcysteine decarboxylase activity; Cellular component=nucleoplasm; Biological process=regulation of transcription from Pol II promoter
acgaagaagacgaggaggatgacgagatggaaaacggtggcggtgcgggcagccaggcggcctcttcattgtaccaccatcgcgcgcgcgagaacagcagcacttccatggaccggttgcagcgtgagcggaccgcgtccggcggtggaagcggacggcgtggcggcgttggcagcagtgccgcggaacggtcgacacaggcggcttcagcggttgcagcggcgtcagccgctggcgacgatgacgacgaggaagaggaggcgatgggcaccaacaacgaggaggaacaggagcaacagcatgacattggggcggttgaggatgaacatgacgaggaggacgaggacgccaggcaagggggggggggaaggggcgactggggtggtagggaggaggaagagcaagcagttcatttgttttgcaaatcgttgttttcctcccgaaaatttggtatttctgaaatttttgggggaaatccggaaacttataaaaataaaaaaagatttaacttggttgaaatcatgaaatttcacattatctggaaaggggaacctagaaatttgggcgaatttttatacattaaattccaaggaaaaaatagacaaaaaaaggagtttggaaacatggcattatcacacccgtctccattgaaagaataagtaaaaatgcttaagtcttggggcggactcgaacttccactcttttttttcaaaacccaccgagccaaatagaattttgttttgaactcgcgcaattttttttttttctttatgacaatttttaattattttttcgacaattttgcagtgaacatgaaatggaggaggatgaagaggatgagccctattttgacgtccacgatgatgaggatgacgacgacgatgatgatgatgatgaggacgatgacgacgatgacgcgtcatcggtaaaaattttccaaccctcggaaaaaaattttcatatttatgtttttttctaa

SEQ ID NO: 72156 - DNA, 1109 bp, Heterodera glycines
  Genomic contig location: Contig_ID=SeqID_9639; Location=202..1310; Strand=+
  SCN-specific regions: Sequence locations=1-188,210-347,388-776,799 -832,869-967,992-1109
atggtttccccgtgggcgggcactgaacgtgacgaaatcggcggtgcacaaccatccgcaacaggaacaggcggtgcacttggcagcaccagcacatcgaccacaacgaacgcaattgatgctcaacaacaatttccgggcggaggagtgagtttttattgggaatgttttttagattggcatttttgaaataaaaatttaaaaaaaaacaaagaaaaaattcgccatcagtcgggcagattcggacctaatccatgacaaaaaaaattattagtttactttcaagaaaaataggcaatttttttttttgtaaattcaaattgtaagcaattttcttaacaaattgcattaaaatttacaaaaaaaaaaataataatctttttttttgcaattttttatggcaaataactggtcattttttggcgaaaacgctacaagcttctgcttttcctcgactttcctcctccaattttttttattttttggctacggcccgtgtcccgacatttgcgcctttttccaaaattgagttcaaaattatgtttttttgattcctgatcgcataaacagctttaaataagcgattgaaagtgattgttttattggtcctaatgaaccaaaaagatcgtgttttcttaattttatgctgttaggttatcagggcttgaaaaaattcaactttgagtccgatttggacataggcgcaaatgtcggggctccctacggccttgatcggttataatattgccctaaaactttgcaccaaaataaataaatctataattttccatcccaaaaaattcagcaacaccgtccgatcagtcgtcatcctggcacagggcccggcgcaggcgtcgcaggaggcaccggggcgacaaacagttcaattgcggctgcagcgattgcggccgcgactggcgcggatacagctgcggcccagcagcgacgcttccgcaagaaaggggacgcgggcggcggtggtggcggcggacgcaaaccgccgggtgccagcggttcggcagacagtgacgtggcggaacacggcgcggcccgtgccgacttctttgcctacttcatgtcgttgatgcgcagctattccgcagaaagtg

SEQ ID NO: 72157 - DNA, 290 bp, Heterodera glycines
  Genomic contig location: Contig_ID=SeqID_44715; Location=911..1200; Strand=+
  SCN-specific regions: Sequence locations=1-290
atgactcagcggacgccggtgaagccgaagactgtcaacccgttgttccagagcaaattcaacttcttcgtcaaacagcccgaggggcaggaactgaaaatccgagtgaggacgaaatttggcaaaatccacgaaaaataatggaataaatttgcaggcggtggacgaagggacgaaacgcgacattggcgaattgtccattccgttggctgccgttatgagagagccgatgatggagatgagccagcagagcttttacctgacgcatggcgtccattccagccccaatt

SEQ ID NO: 72158 - DNA, 902 bp, Heterodera glycines
  misc_feature (50)..(50): n is a, c, g, or t
  Genomic contig location: Contig_ID=SeqID_44716; Location=1..902; Strand=+
  SCN-specific regions: Sequence locations=1-902
  Gene Ontology: Mol. function=chaperone activity; Cellular component =nucleolus; Biological process=nucleocytoplasmic transport
aggtggaacagcatgaggacgatgcaaacgcaacgaccgtttcaagcagnacagaagaaacagctggtactgcaaagctcttagagcaggaggacgatgcaaacgcaactactgcttcaagcagtacagacgaaacagcagtgactgcaaaggtggaactgcaggaagatgatgcaaacgcaacgacagcatcaagcagtacagaagaaacagctgttactgcaaaggtggaacagcaagaggacgatgcaaacgaaacgacgggatcaagcagtacagaagaaacagcagtgactgcaaagattgaacagcaggaggacgatgtaaatgcaacgacggcatcaagcagtacagaagaaacagcagtgactgtaaaggtggaacagcaagaggacgatgcaaacacaacgacggcatcaagcagtacagaagaaacagcagtagctgtaaaggtggaacagcaggaggacgatgcaaacacaacgacggcatcaagcagtacagaagaaacagcagtgactgtaaagttggaacagcaggaagatgatgcaaacgcaactacggcttcaagcagtacagaagaaacagcagtgacagcaaagatggaagaacaggaagatgatgcaaatgcaacgacggcttcaagcagtacagaagaaacagcagtgactgtaaagttggaacagcaggaagatgatgcaaacgcaactacggcttcaagcagtacagatgaaacagcagttactgcaaaggtggaagagcagaaagatgatgcaaatgcaacgaaggcttcaagcagtacacaagaaacagcagtgactgcaaagatggaagaacaggaagatgatgcaaatgcaacgacggcttcaagcagtacagaagaaacagcagttactgcaaag

SEQ ID NO: 72159 - DNA, 77 bp, Heterodera glycines
  Genomic contig location: Contig_ID=SeqID_44718; Location=238..314; Strand=-
  SCN-specific regions: Sequence locations=1-77
atgcacgggacttttattcaatcggagcaaaacgaggaatgcaaatggggacgatctcggcgaatcatgactcatca

SEQ ID NO: 72160 - DNA, 2946 bp, Heterodera glycines
  Genomic contig location: Contig_ID=SeqID_1303; Location=1419..4364; Strand=-
  SCN-specific regions: Sequence locations=1-33,55-106,129-453,475 -1037,1059-1773,1840-1911,1946-2703,2725-2946
atgccggtcaaaagcggaagatcagaatcctttgaccaggcggaaatcgacacaaactgcacaatcgaatgcagtggaggaaaatcgaaattccgtgtgaaaggacatttgatatatgtcccaatccagcaacaaattgaaatgggcgttcggatttccgacacgttgaaaagtccaaaaggcattggatggcctgatctgaatttcgattggattgacattatcagattcatggctggattcccgaacataatcgtcataatattggcgggaatcctcgcaggtgccgtgatcatattgataatacgttgtaatccagcattcatcgtatggagaagaatagcaagatggattatgctgattctgatgatacaaatgatggaagagagccgggaatacggggaaaacgaatttcttaaagtaccccccggtgggatgggcgtggcccatcgaacattctcgaacattaaatacgtggcggagtctgattggttagaggtgcctttaaaagggcatggaaagaccgatcctcactcattctattctattctaatattctctccgaaaatgaattccaacatctcctccgattcaaatttgctttacattctgtcgcgacacgtcaaaatgcaaccacatttgcttgcccgtgccattcgcggaattcctggaacgaggacccaaattgaagagaagctggaaagtatccaggaaagtggagcgaaattggtcaccacgcatttgaaaccggagaatgcaaacatgattctcttcggcacgaccattacggcacacggtgccgatgaattgggtgccttcaatggacgaggcccgactgtcatccaatactttcggactcggcacaaccggaatttgatgttcccggaggctccatgtctgtgtgagaaaggagggcgaaaccatgtgagctactacccattggaactgatcgaagtacgagaaacgttcgatcgcgatcccccgtttgactttggaacccgaatgccatgggatgacaatccagaaactgtcaacacgggaccccaagagggagaaaaatccccgaaacggttatccataagcagcaaggggagttccattactgtggaatatcatggcactccacagtcgggggcgggtaatccaatggaagggatctcaccggataaccactcggtgattatccaagaaattgactctaatagtccgacgggaaatccggtggaaatgcgcggagatccaccgagatcggaggaacgatcaattgtgatgaatgttccggcgaattcgaagattgaattgatcgggccgcttaaatgcaaaataattttgcttgtgttgtccgcatttattatgattcactcggtcggcgcaaaagaattgccatcggcgctgattcatttgccttcccgcggtccttcttcattgaaaatgcgagaagcgccgatgaatcagatctttctgcacggcttcggcggagatgtgcacccgggaagcgaagaagaggcggtgaatcatgggccgatgagcgctgttgatggagatgcttccttccgaatgaagggaacgaacatgagtcatccgtttttgtgcgcctatggcatgaatcagggacacaaaattgtgtcctctgccctctggcggcagctatataaggaggagggaaatgggcaaaaagtcacttacatttccttattcctgccccttatatcaacggaactcctaccgaacatggatattgaaaagttattggatgaaagcgaagaattcgttcagcagcaacagcaacaccatcaacaacagcaacaacaacaacaacagcagcagcagaaacaacaagtcgtccgtttcgtaaaaattgatgaagaaagtgacaacgaagcgcttcgaatcgacatttcggagagtgagtcggaggaggaggacgacgacgatgaggaagaagcggcggcagcactcgaagcagcggtagccagtgccgcaccatcgccggttgtccaagaggccaaaaagcctcgaattcagggacctatggaggcaccgaagaccaaacgagtggcggcagctgagggaccattcgtgaagcgagcgcgcatagaaggcccgctgaatgcgcagaaatcgcgttgcaacaaatgtggattgcttggccatttgtctggcgacgaggctcgctgcccaaagaccaatgccctggtcaaagcggagatggatcgaaagaaggcggcagcatttgccaaacgcgcggaagcaactatggaatgctcggcacctccgatcattcaactgccagtcaaaggtggtggacaggcacgtgcggccagagctggaggcgttgctgcatcaatggtcgccggtggacgcgcatcagctgagggcgcatttcgcgcatcgaaggaaagagcgcgccaagaattgatggccgcaatggaaaaacccaaggcggcagccatcagtttggcggaaaagaaggcggcagcccgaccgggtctccaagtgccaatggagacaaatgccgtgctgaatggactcagcgaaatcggggcacgaatcgaccgcgagcgagacaatcatttgagcatggctgaggaattgcaacaacgtggaaaacgcgccgtggcagcactcgacgaagtcatcgctcagggggcgcaaatcggacaaatgtacgtggagtggacgcgcaaattgggcgaagtgctgaaggccaacgaacaggaaagagccgaccgcgacgcgctggaacatcgccaggcggcagcattcatgcagtcgttgcgcctcaaaatctcggttctgcgtcgtgaactttcgtctccgcccggagtgtcgccgctggcgactgaacgcgtggaaattgggggacagcccggaggatcgctcggaggacagcccggaggaccgctcggaggaccgtttggaggaccgcccggaggaaagaaatga

SEQ ID NO: 72161 - DNA, 502 bp, Heterodera glycines
  Genomic contig location: Contig_ID=SeqID_1303; Location=262..763; Strand=-
  SCN-specific regions: Sequence locations=1-124,153-292,314-387,409 -424,446-502
caagttttttacaaccacttattgccaatttaatttcttgcagatttaaagccatccattgcctgccggttctcggcacagcaaagcactaatacggtgtttgactcacttcaaaaaataattcattacccaaaagttttttacaaccacttattgccaatataatttcttgcagatttaaagctatccattgcctgccggtctcggcacagcaaagcactaatagggtgtttgactcacttcaaaaaataattccatacccaaaagttttttacaaccacatattgccaatctaatttcttgcagattgaaagccattcattgcctgccggttctcggcacagcaaagcactaatagggtgtttgactcacttcaaaaaataattcattacccaaaagttttttacaaccacatattgccaatctaatttcttgcagattgaaagccatccattgcctgccggttctcggcacagcaaagcactaatagggtgtttgactc

SEQ ID NO: 72162 - DNA, 2784 bp, Heterodera glycines
  Genomic contig location: Contig_ID=SeqID_1304; Location=2209..4992; Strand=-
  SCN-specific regions: Sequence locations=1-669,691-985,1009-1230,1252- 2464,2487-2547,2569-2574,2605-2784
atgacttcatgcaaagacgctggagaagtcttaaagaagtatcgagaagggaaagcattgtttgctgaagcacaaatgaacctgagggaattaatttgcaactcaatgaaagcgatggagcaaattcccgaagaggaccggcttaataaaccagggactaaagtactgggcatcccttgggacattcaaaaggacgaattgagcattggattcccaccgacgaatgaagccgggaagatttcaaaacgcattgttttgaaaacattagcaagcatatttgacccattgggaatggtcgcaccttgccttctccaagcaaaattgttcctacaacgattgtgggacagaacccttggatgggacgaaatcttaccagctgatgaaacagcagaatggtttgctgtcatcagagaatggaagaccgaaccattcaaatttccgagacgatccgtgctgcaagatgaaatggtccaactccatgcatttgtggacgcgagcaaggacgcttatgcagcggcacttttcataaggtctcagaaaggagaagaaaccaatgtacagttactctatgcaaagagtagactcaagccccggaaagctgaagtaacaattccaagaatggaactcttggcaatgctaattggggcgaggatgctgaaatttgcggaaaatcagctgagaatcccaataaatgaaaaatttatttggggagattcaaaacccgtcttgagctggattgagtcaaaagattcccagcccagatttgtggagaatcggttgagagaaatccggaggatatcagaaaatgccagatttctgcatatcagaacgcacgaaaatccagcggatgtagcatcaagaggatgcactccagaagagctgagatcccatcatctttggtggaatggaccaacatggctccgagaaccaatgaaaagttggccgatcgacttcgaggtcaccccaaagggagccatgaaggatggacaagaaagttcagaattggacaatgtagttgcagtatcagcaacaacgagtgaagacaatccatggattgacccttgtcgatttagcagttggactaaactacgccgcactgtggtttggtttctccgtgcaataaacaagatgaggaagactcgaatattcgagatttcagagggtgttcctatgagcagtgaagattaccagtacgccgagatcttacttgtaaaaatggcacaaaaatgttggccaatgtggaaaaagcaaccacaagaacttgtaaagacatcgaggaaaaatggtcttgtccgactgtcaacacggctcgcaatgagcaatgcatcagaagatatggttaatcccattatccttcctgagaattgtccaataacccgactaattgcacagtcggtacatgagtcccttgcccattctggagttgaatccactttgacagaatttatgggaaaatattggacacccagagcgagactgaccataaagaaggtcattcgagcatgcggtcgttgtcgcaggatccaatgcccggcatataaattgccgacgatgcctcctcttcctgaggaccgcgtgaggcggacggcaccatttgaaagcattgggatcgattatcttggaccaacgaataccaaaattaatggtgagcttcagaaggcatggattgctttgttcacttgcctaagtacgagggctatttatttggaaccagtgcttgacttaagcgctgaggcattccttcaagtgttccgtcgattcactagtaggagaggaactccaaaaagaatcatcactgacaatggcacacaatttgtactggcagctaaagtagcggcagcattagaagctgggaagacacccacatgtccgctcgaagagcacctggccaacgaaggaatcaaatggcgatttaatccatcactaagaccttggagtaatggatttcttgaacgccaagtcgctggagtaaaagcggccttcaaaagagtccttgggcgtcgaattttgccctatgaccaattgagaacgtttgtcgcagaagttgaagcgacaataaatcaaagaccgatcacctacgttgatgaaggaccaaatgctgtccagccattgagaccggtcgatttcataatgccaaaggccatattgagtttggatgtccggaggaaccaacaatcgtcggacacggagttcgaaaatgaacctaaaaatctccagaagcaattgcagatgcgctgggaaggtactctagccacattggatgaattttggaccagatggaaaaaagagtacctgttaatgcttcggaacagattacaatgggagcataaaggaccaagaagttgcctggcggaccaaccaaaaatcggagaggtagtaattatcgaagaagaaaaaactccgaggaactgctggccgttgggcagaattgttgaactccaaggatcggacaatattgtgcgaagtgccaaactcaaaataccaaaggcaaatggcgagcgaatttcatggcgtgaaatttcgcgtccgataaaccgtctgtataggctcgaagtaccaaaagttgacgagtctgaagaccaagaagaagaagaagttccgaacggaaaaataggacttcaagagccaatcccaaaaaaggatgggaagcaggcggaaagagcgagaaatgtccaacaaggacagatcagaaaccacggaatgatgaccaggtccatgacgaaagcagcttccatcttgggattaatgttcatgctggtgatttggacaacatttgttttgtag

SEQ ID NO: 72163 - DNA, 1065 bp, Heterodera glycines
  Genomic contig location: Contig_ID=SeqID_1305; Location=147..1211; Strand=-
  SCN-specific regions: Sequence locations=1-34,57-627,649-700,723-1065
atggagatgtcgttgataccagggattaccttcaaatggaaggaggtgaaactgacaccagttgcggtatcacaagcaccagttcctatcttagggcataagttcctgtcagatggaacatctttctcaatggtggaccaagttaatacaaatcttctctgccaagatagagaaatagcaagcaatttttccggctgtactttgtcgaaagaagcgtgcccgaaatgttgggtcgatgaagaggcccagagagttgattgccaatgccgcgactcaatccttgagaaggaattcaacaacccggaaaaaaggctaccgttaagtctgcgcaatttgaatatccgatacaaagatggcgaaattttctcggaaacccactacacaccaatacaagtgatggtgcaattcgagggtctccgtcttggcatcgaggaagacttcaccaagtgttgggcacaaacaaaaacacttaaaggttgttataagtgtcagtcgggagcccaattgaagcttagatgttggacggaatacggttcagcattggcagatgtctactgtgttgatggaacacgtttcacggtaccatgccggtcaaaagcggaagatcagaacgtgatattatcctttgaccaggcggaaatcgacacaaactgcacaatcgaatgcagtggaggaaaatcgaaattccgtatgaaaggacatttgatatatgtcccaatccagcaacaaattgaaatgggcgttcggatttccgacacgttgaaaagcccaaaaggcattggatggcctgatctgaatttcgattggattgacattatcagattcatggctggatttccgaacataatcgtcataatattggcgggaatcctcgcagttgccgtgatcatattgataatacgttgtaatccagcattcatcgtatggagaaaaatagcaagatggattatgctgattctgatgatacaaatgatggaagagagccgggaatacggggaaaacgaatttcttaaagtaccccccgggtgggatgggcgtgggccatcgaacattctcgaacattaa

SEQ ID NO: 72164 - DNA, 655 bp, Heterodera glycines
  Genomic contig location: Contig_ID=SeqID_9640; Location=161..815; Strand=-
  SCN-specific regions: Sequence locations=1-150,174-287,378-507,530-655
atggcaaaaattcttggcgaaatgcaaaacgccaaaatttttgtgcgcccatcggaccccaaaattttactttcagttttattgcttttgaccaatcgaaatgagcaatttacggaagaaacgcaaatttcggtgaaagaaaattattgcagcttggcaaattttgtgaaaaatttattggaaaaggccaatgtagtggaatatttgcaaaaaaatgatgaaaatattgagcatttttttattcggtattcgactgaattgtgcacagtggaacggtgagagatttgaaaaaaataatacaaaatttaaaaaacttgctttatttttcattatctatttaatttaaaaaataaaagttaatatttaaaataaaatttcaaaaacttgagatcttccgacccgaacatttgacgaaaatatagtcggaagacaaatttaatatttggtttttacaacatggaaattcattcttttggtttttgtatattttttttttgaaaaagcgacgaaaatgagaaaaaattcattttcccttaattaatgtttgttttttagaataatgcatgaattcagcaacaatacgatagatgcgaatttttttgaacatatagaattcaatttgaaccttaccaatggtattgtgtgctgtcgttga

SEQ ID NO: 72165 - DNA, 492 bp, Heterodera glycines
  Genomic contig location: Contig_ID=SeqID_9640; Location=2262..2753; Strand=-
  SCN-specific regions: Sequence locations=1-375,402-492
atggccggcaaactgatcgtcaccgtgttgcccagctcgggcgagcgctatctgtgagctattaattaatcatccatttaaaagataaatgacagatttcatgaaaattttattgatatttttgattttttcattttactgtacatttttacagtattccaaagattgttttttgtatgattgcctgaattagctgcccttaaggttccacattttcctaaattttccagtacttccgccctttactcggacattcgcgcagaaatggaggccatgtcgcatgttgaaacgctggaggacaatttgaagcgtcttcttaaagtggaggatgccaacagcaaacagtgatgaatttagcggaaatttttttaccggaattaaaatttaaaaaattaaaatttggctgtttgttttttttttgcctaaagctctgcccttctataaaattttgaaagaccatgtcaatgtttgttttttggcattttaaataaa

SEQ ID NO: 72166 - DNA, 2594 bp, Heterodera glycines
  Genomic contig location: Contig_ID=SeqID_9641; Location=1..2594; Strand=-
  SCN-specific regions: Sequence locations=1-78,100-120,143-652,674 -690,732-912,936-949,981-1061,1083-1243,1267-1341,1404-1556,1600 -1679,1702-1819,1844-1885,1916-2104,2126-2134,2156-2255,2336 -2482,2541-2594
  Gene Ontology: Cellular component=mitochondrion
ctgcgacaatctgtcagctaacaaaacacttccgccgtgctcaaaacagcaaccaatcattcacttttcttcttatttttgtgtttacaaatcgataagaaatctagaaaattgatgtgatcgaagcaaagactgaaatggaaattatctgatcaattaaatcagaagaataagaaatgccctgccaagggagggaaaggttgcgaaagtcaccgaaattggcgaattgtttcaatttcaatttccatatttgacagaatttatctgctttaccatcagttcattcaatgccatttctttatttgctttatcagtccattcgaatctccgacaaaagaatggcaccgaagcaaaagagcggcgcaaagtgcgccatttggcgacgaatttggcgggaggggggagacgatttatgatttccaatgagtgagtgattcggcatttcatccttactgtccaatcagtgcccggttaaaattcagacaaaattttcttttttcatcgttattttttgttttttaattttctaagaagaacacttttgtgataagcttatcttttgagtgcattttatcaattcgaccccccgaaaaaagggaatttgggggaaagcccaaacaaaaaacaaaacgaatggaggacatttgtgataagaagaggagaaaaggaagaacaaatggaaggaccgacaaaacaaaacccatccaaagctgactttattaatggaaattgaaaatgattaaagaaataacttttgtttaatatttatatttttggtccccgttttaaaatgatttccccacgccccttacctcccaaatgtccaagtctcgaatttgagttttttattattcagatgggcctaaggttaggcaaggggtaatataaagggtatattcgtattcagcgaccccgaaaaccctaaaaatcctaaattagactcattttgtttttataaatttgaaaaattttggacatttcgtgggtttttactcttttggacatttcgtggcttggacactttgtgggggtgccggaaaatgatttaagaatctcccaacaaaaaatttaaaattataattggtatttattgggtttacgggagacttttaacatacattttcagatgcctataaatgtgtttttgaaattaatgaaaataagttttaaggggtttttaggatcgctgatcacgaatccggcatccatttttgccaatttcgaacccctgacccgaactcgaacaaaaataaaattagaaaatttgtatggatgatatcctcattggcattttgcccatgaggataaccttggtataagaagcataaaattcgaaataccaattataattataataataaaatcagtactattttttcatcaaaatttttttaaattaaattgtttttgttaaagcgtacacttttgcgtgctttcaatgccgagttggtgctcaccgatccggcacttggcgtcaaaggctctgtggagcgtgccgaacaattagctgccgccattcctaactcattcattccaatgcaggcaaagcgaaagacattttttaaataaatttaaattaaaaatttgaaaattaaaataggcgctaataatctttcaattccctaattaataatagtcagtcaaagcattaattaatttgttgatttttttcgttttccttttcatcttaattaggtttcgatactgattaaaatgtattattttcagttcgccaacgaagcaaaccccgaaatccattatcgcacaactgggcccgaaatttggcgtcaaactcatggcaaggtggaagaattctggcatttttgaaatttttgatgctttttcatttatttatctactcaaatcggctttgaataaatgtttcattttttatttaataaaaataattaaatttgttttttcaggttgacgcatgcgtttttggcataggcaccggcggaacggtgaaaaaaaaaattactaattttctttaagttaattagttaagatcactgggtcaggccgttttctgcgtgagaagaacccagcaataaaagtgaaaatttgagaatgaactaaaatttcttttaatatggcaatgaacaaaaatttttataatttaattggataaatgttgttgttttttaaagttttatgcggttgaaccggtggaaagtccggttctcagtggaggcaagccaaatcctcacaaaattcaaggtgaatttcagcggaaacaaaaaccaaaatggttcataaattataaattttattaaatcaaaataattttttttttaagtattttaataataatatcttttttatttaattttaaggaatcggtgctggcattgtgccgcccattttggacacaaaaatgtacgaggaagtcgttttggtgcactcggacgaggccattgctatggccaaacgattggcacgcgaagagggccttttgagcggtaatacttaaaactttttgaaaattaattatttttgtaaaatacatatatataaaaatgaatttattttatttaaaacataattcagagtacgtcattaaatatgtgaccaactttagttatctgcattat

SEQ ID NO: 72167 - DNA, 218 bp, Heterodera glycines
  Genomic contig location: Contig_ID=SeqID_9641; Location=1560..1777; Strand=+
  SCN-specific regions: Sequence locations=1-55,87-100,124-218
ggcacccccacaaagtgtccaagccacgaaatgtccaaaagagtaaaaacccacgaaatgtccaaaatttttcaaatttataaaaacaaaatgagtctaatttaggatttttagggttttcggggtcgctgaatacgaatataccctttatattaccccttgcctaaccttaggcccatctgaataataaaaaactcaaattcgagacttggacattt

SEQ ID NO: 72168 - DNA, 96 bp, Heterodera glycines
  Genomic contig location: Contig_ID=SeqID_44722; Location=498..593; Strand=-
  SCN-specific regions: Sequence locations=1-96
ggaatagtgggaccccgtccagacaagcagcggcaccaggaaaacagaacaaaaatacgccggaagcaagaaccaatgggcaatctccgaaaaagg

SEQ ID NO: 72169 - DNA, 659 bp, Heterodera glycines
  Genomic contig location: Contig_ID=SeqID_44724; Location=1041..1699; Strand=+
  SCN-specific regions: Sequence locations=1-313,345-533,576-659
atgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggagggggggggggcgaaggcccaccacgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatga

SEQ ID NO: 72170 - DNA, 231 bp, Heterodera glycines
  Genomic contig location: Contig_ID=SeqID_44724; Location=803..1033; Strand=-
  SCN-specific regions: Sequence locations=1-60,82-231
tgaaaaaaatatttatgaaacaaaaaaatcgattttttcaagtgtccgtttggggtactcaaacatttatggggagcaaaaatccacgcagaataaagtacaggctatagggaagctattcccgaaggatcggtctccccataaatctgggcgcatcggttcggggggactgccccgaaaacaaaaaaaatcgattttttcaagtgtccgtttggggtactcaaacattta

SEQ ID NO: 72171 - DNA, 474 bp, Heterodera glycines
  Genomic contig location: Contig_ID=SeqID_44729; Location=15..488; Strand=+
  SCN-specific regions: Sequence locations=1-474
agccacgatgcttatgaactatcatactcgggcgataagatactcgaaggcgttgtgggaaaattggctacagggcatggcgtgagcatactggtcagcgatttccgtggaagcgatggtactggcttcacgcttaaaaaacgacctcgcctggatgccatcaatgatttagtggatagattaactgttgcggataaagggaaagatacaggaatactggccttgagtctaacgggtgatgattccgttcaaatcagaaaaattttaaacagtattatcaataattatctgcaacagaatgtcgagaggaaatccgaagaagcgggtaaaagcctggaatttcttaaggcacagctaccgcaggttcgacaaaacctcgatttagcagaaaacaaactgaaccaatttcgtcagcagaacgactctgtagatttatctctagaagccaagtctgtattggatacgatggtggcg

SEQ ID NO: 72172 - DNA, 57 bp, Heterodera glycines
  Genomic contig location: Contig_ID=SeqID_44731; Location=802..858; Strand=+
  SCN-specific regions: Sequence locations=1-57
tgtgcgtttgtggtactctcacaattatggggagcaaaaatccaatgcagaattaca

SEQ ID NO: 72173 - DNA, 2913 bp, Heterodera glycines
  Genomic contig location: Contig_ID=SeqID_9642; Location=432..3344; Strand=-
  SCN-specific regions: Sequence locations=1-11,36-140,162-2030,2052 -2126,2175-2339,2361-2368,2409-2491,2559-2685,2737-2751,2774 -2791,2813-2913
atgccattgggcgtcagcagcagcagcgactccgtggtcacttcagtctccgatgaaactgtcgccgctgcttctccgtcggcatcctttgtggacaaacttggcaaacggtggacctttttggccaaattggccgtcttcggcggcgccgccggcggcggatcctccgcatcaccgccaccaaacttcaacaccagtggtggcagcagaagcacacgaagtatgtcagcagcggccgcctcggcaccccccgcggcattggcacaaacatcgccgccgtcgtttgcaccacccagagcggcagtgccaattccgctggaacaacagttggagcagttgtgtgccgagcggcacctgtcgcgtagtcgtctttcctccagcgcaacgcgtatttggctccattgcgcgcagcagcgtcagccggacgtggcgtgcccataccgcgtagttgttcacatgccggagggcaccgtgtaccatcgcctgcagcacaaccacccagtgccttacagtaagcacactgaaagctaaaccaatagcatgagggaggggctattcgtgatttaactctcgaaacattccgacactcttgaacaaaccgcttacccaactggacggtaaatttgaatatgcacattcataggcccggaaaattttggcgtgatatgtgacctatgcatgatctactgatcagtcggctggggtcaggattagagaccagaacagggcctagggtttctcagaccctccctgatcatgtttaaaactatttaatgttggaatccggtccaggtcaaatttctcgaatcccgatcaagaaattttcaaaatttcggtccctagtcaggatggtctaatgaaactgaaacatttctgagggtccgagatttctcttctgatcatttgggatcgttgatcccctttaatttctgctcatttttgaatttccaatcactaaaagcgtcgacattcagatttatcgccagaaagagatcataaccaaaatgggcacaatgccaacgaaaacaacaacacaaacgcaaatcgatgctcatccgccgtttcaaaaagcttttcatcaccgccttcgccgatcagcagacgacggcccgagacgcgttcaatcgccaaaaaattggctaaaaatgtccggtccattggcactgccgcccgccgacggcacatgcgtcggcaggcatttgtcaaagcgcgtgccgcaatgttcgaaacgggagcacagcggcaaaatgaggagggggcaaaccgccattatggggaggaggaggaggtggacggcatcgacgaagaaataacatcattatcatccacaggtcgttttgctaatgagttcttggggaggggagataattaattaatgatcggcgcattaattaattgactgtcatcggatcgaaaaaatgatcaaattgaataactcaaatatttacgggctgatctgcccaaattattttgtttatcacttatcaactttttttgagtgatatgtcagcaattttttatggttcaatcaaatatttttgatcattttctaatctgatcacttcttcatctatcattcaaaaccaatctgattggtttttgactgattgatcgcttttcattctgcacaattttttatttgttttttttctctccagacactgatcaatccgcctatgactccgatcactccgctgcatatcgaccacgaaccaagcggaccgcctttggcaacaattttgaagttcggatcaagcgcagtgcttttgtcaaggcacgcgcctcaatttcgagcggagttcaagcggaccaacagccggagctgaagattgtgaccaagacagacgaaggggtaagttgatcgattcagctgatcagactttcagctgatcagcacagtttaaataaagccattcctatcagttttgggggtatttcaaatttacagagtccgtccgtttacaaatttgccagcaaaaattggcactttttgacggacagcatttggaacaaaaagtcgctgaccgacttttgcaaggagaacatgctccgagttgcgggcggcatcatcaccaacacttaccgtaatcgcctgctttgtgtgcgggtgagtggcgcaaaattgcttattttttaaaatagtttcttaataaattaattttttatattttaatccggcttcgttaagcacggaaaatgcaatttcgatttttataatgcctatttgtggccgtaattcagggttttcggaaaatttcttagcataaagtaaataaaaatccaaaaatatacctaccaccttagaattgccaaatttaattgtcctacgaaaatcttccaaatatgtatttaaacaatttcgtttacaattgaaatataactaaaattttatattttatgggctttgctcccaaaaaagagttaataaaaagttgcttattcaatgccttttttacaattttctgctttttatttttgccatttttatgcctaaaaatgtttaaatataatattttttataaattaaaaataataacgataaaaaatatttttaaattcactacaccgaagtttcaatttttaattttcacagagcggctgccccttccgcgcactttggctgaaccgccagggattggtgtacggtttgcgcaagcacaaccattcgatgaccccaaaaagtgcaaaaaataaaaataaaattattttaaataattaatatttattttttattttcagttcctcctgttgtaaaagaagagctcattgatggagaattcaaattggcagatttggagaaggaaatccaggcattggccaaacgtctttcattgcttttccgtattgaaaagtcagttaaaatttggcatttgaattaattaagaaatcggttaactaattatattaattaaa

SEQ ID NO: 72174 - DNA, 836 bp, Heterodera glycines
  Genomic contig location: Contig_ID=SeqID_9643; Location=419..1254; Strand=-
  SCN-specific regions: Sequence locations=1-81,168-255,277-283,305 -317,339-368,390-423,449-756,778-836
atggcacgggtgcgattcagtgatttgtgccataaaagttccgaggacgaaaaatttgaaatggaagagaatggaggaaaagagagggaagaagaggaggaggaagagaggacaatgttggaggaggacatggaagaggaagaggaaagaatggaggaggaggaggacaatgccaaggagcaaattcggccgaattcgacggcacgacaacggactccaaagggggctgtgcgcggcaaaaaagtgaattttccatttaaatcactatttaaaaaagcggtgcaaaatattttaaaatttaaaagaaacacagtatgaatatatttttttaatttaatggcattttcccggggctcacagtttgagaaatttaaaaaattgaagtaaatttttgcaaattttgtcctggatatggcattcatgccatttttcaaaataaaattttggtccggttctactttaagcatggaaaattattgctgctgctcgaaaccggcgggttcttctctaaaaaaaacaaaaaattgaaattcaaaatgcccaactagcattttaatgagatctctaaaacaaaaaaacttgaaagaaaatttcagcgaaatggccattttcggtattggcttccgttgggaaaaatcagtggcgccattgacgaggtgtgccgcgaggtgtgccaattgcattacgtgcacaagagtggcattgcaaaaaacggcaaattctacttcagatgctcaaatgtgaagtgcaattacaagtgggttttgggaagacctcaaattgagagagagagagagagttatctgatcaatttttgttgccaaaacaatcggtga

SEQ ID NO: 72175 - DNA, 304 bp, Heterodera glycines; identical to SEQ ID NO: 51570
  Genomic contig location: Contig_ID=SeqID_44734; Location=88..391; Strand=-
  SCN-specific regions: Sequence locations=1-304

SEQ ID NO: 72176 - DNA, 304 bp, Heterodera glycines
  Genomic contig location: Contig_ID=SeqID_44734; Location=594..897; Strand=-
  SCN-specific regions: Sequence locations=1-304
aaaattccctcagaaataaaaggtctattgcgcaccgccctccctatcatgctcgagagcatttgtatgtgtataaaatctatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatg

SEQ ID NO: 72177 - DNA, 414 bp, Heterodera glycines
  Genomic contig location: Contig_ID=SeqID_44736; Location=349..762; Strand=-
  SCN-specific regions: Sequence locations=1-166,239-258,351-414
atgtggagtgttggtgtgctggcgttcattttgctgtccggtctgtccccgtttggtggtgaaaatggcgacgaaccgttggagaatgtgaagaaatgcgcctggaacatgatcgatgtgtgaatactgttcctgggggggggggggggggtgacagagatttttcaaaaaaaaaaaatttgtaaaaaaatttagtttttttaaattttgagaggagggcggggagggggaagcggggacgtacaaaccgcgccgcagaaattaaaaaaaaaaattcaaacaaatttttcaagaaaaaacagaaattttttttataagaaaacataaagaaaaaaatttttgaaaattttcagcgattttttttttgaaatttgatgataaattaataagttttttcgaaaaatttttaataaa

SEQ ID NO: 72178 - DNA, 580 bp, Heterodera glycines
  Genomic contig location: Contig_ID=SeqID_44738; Location=74..653; Strand=+
  SCN-specific regions: Sequence locations=1-251,275-335,367-408,430-580
atggcattcccgcgccggcgcattttcgtcttccaacttggctacttcgagttcgaacagatcgctgatcagaagcccgacctggtggactacgggccgtggatggccgacatggacattcaggtgagccaaattgcacattttctaacagttttaaagtgggacaaatccagaaaatttttaagcgcattttactagggggtttgggcaaaacattttttaaatttttttttgaaaccccttcacaaccgaaatttttgttggaaataatatttttgatcaaatttttctatttcacattactgctacgcactcaaacagtgtttgttatcaccaaaatttcccaaaaaattttgcaaaatttttcctcacatccaccaaattaccaaatttttttttgtgtgaaatctattaaaaaatatgcccaagaatttcagaggcagtacccctctcgaaaaccaagccggaattctgggaccgtcccaactttttacgcttttcctctatcctttcgaaaaaaatatttaccaaaaattttcagacaaaaaagtcctcaatttttggattggaatttttttaa

SEQ ID NO: 72179 - DNA, 58 bp, Heterodera glycines; identical to SEQ ID NO: 51629
  Genomic contig location: Contig_ID=SeqID_44740; Location=326..383; Strand=+
  SCN-specific regions: Sequence locations=49-58

SEQ ID NO: 72180 - DNA, 1522 bp, Heterodera glycines
  Genomic contig location: Contig_ID=SeqID_9644; Location=1082..2603; Strand=+
  SCN-specific regions: Sequence locations=1-433,456-610,643-712,734 -979,1001-1132,1154-1522
atgtcggacattcaaaaagcgattcaggcactggaacgagaatacgccgaacagaaagagctgttcgaaaaatggaagggttcgctttgcttttggcactttgctttttgggtttgcattggacgcagtctctcctcccgtcctttccccttacgtccatttgtatttgtcattcgtttctttaattagtccttggagattcacacatttcctttacttacatattctgtgctttagaagaaaatgcatccgaagctgatactgaaccatacaatgcatatgtagagcagttccgaggatgggagaaggatgtgatggacaatttgaaggaactgcgggcatccatcgcccgacagcccgtggcgccggagcccgagttgcccatggtcgacctggacactcagctgaacaagtgctgcacttcctgcatcgattttacattgtttttattttcaaatagcttgttggaccgtgtcgatactccgcaattcatcatggcttttatgagtatgagccaacaggacccaacgtttttggcaaaggcatttgaggtcattcatttgcgacaaataaatttttatttgggttctgtttggattagaccctgggacaatgtcaaggattttgttttcacaatattttattaggttgtgatggaagagtgtcgtaccaccggcttctccaatccgattttgccccaaagtgccaccattccatctcttcggcctgtccaccgtctgcccactccgctccaccaacaaccgcccggcgtcccttccgcttcgtcgtcagcgcggcatcaatcggcgagaagtcctggctctttgtacctgccgcctccgctgcagcccaaagcgtatgtgcaaggctcatccctgctggggccatctcggccaacttccaccgtttcttacacgcaaattacgccgtacgccgccatccccgaaagtgagtttatagtgagtgggtattccaatcattttccttttcttaggttgggttgtcgacgcaccgatacgaaaacagccgaagccgagttcaccggcccgggaatatcgcaccccagtgaatttaccgttcaaagacttcagtcaatcatgatgaaaggtatttttattttttcattgccttgacaaaaaatgtttgtttattgtgtctattatgtgttaattatttcaatcagaatttgcatcttttctgcttacttatccatttagtcacatttgattaatgaccatttttaaccgatcagcccaatgttcgacttccatcaattcatgggtttgggcggtggtgctgtcgccacttattcagtgcaattgcgtgccttttctgcgccatttttccagcgacacgatgaacgaagaatcaacgaactcaattacggcggaaaggtgggggatggaaccacctttttttgcggtgcgctttttccaaataccttttaatgaacggggggggggggacggtagtatttacaaccggtttttttcagtacttatgtactttacagatcatcaaa

SEQ ID NO: 72181 - DNA, 342 bp, Heterodera glycines
  Genomic contig location: Contig_ID=SeqID_9644; Location=163..504; Strand=+
  SCN-specific regions: Sequence locations=1-342
gagccgcggcaatgatggctattcgcattctgttggaccacgacgtgttggaggaggacatcgttttgctttctttgctgatggccgagcgcggagttcattcgttggcttacgcttttcctcgagtccaattgttgacgatttccgtggacaaacagatcaacgagcattaccgaacagtgcttggagtggacgattttggtgtggtttttcgcatttcaatttgagcctctttctatgccagatgagaattgtgttgggcctgattgtgaggtggttcagttggttgcttcggacgacgacccggacgaagacggcgatgacgactcgtcctcttcctga

SEQ ID NO: 72182 - DNA, 1124 bp, Heterodera glycines
  Genomic contig location: Contig_ID=SeqID_44742; Location=22..1145; Strand=+
  SCN-specific regions: Sequence locations=1-517,539-561,583-1124
  Gene Ontology: Mol. function=extracellular matrix structural constituent; Cellular component=secretory vesicle; Biological process=cell proliferation
atgtcgaacagttcttttgtgtttttgcctagtaatgtgagtgattaccctgacaatcagccgaataaattccgtgttcggcttccaaaacctttacattttaacggctcgtgggtgtgcggactgcacagtatcagttacccctactcatggtcaaccattggcacattggatgagcaatggattgacattcacttcaccgaccgcagagcgaccgatgaggacagacagcgagtgatcagagtgccggtgcctaaggcatcgcatagtcgggttgagcagttgagagaatttttgtctgtcactttgaggaatcatagcggtgcaaaactacaacctctccctcgtgaggtggaagagaatcggaatcgtacaacaacaaagcctctcggctcgccaccgcctttgaaaagacagaaaagagatacggtgtttgacgcgaatagaaaacagattgcccctcctccattgcataatgatggcgagaagaaattattgcccctccaccaccgcatcatgaaaatgatgacgatgaagaaattattgaggagtcaccacctcatcatgaagaagatgatgaagggccgattgaggagtctccgccgcattacgatgaagagcaaaatgatacagtaacagctcctgtcacaccaaaagtgccggtaccagcacctgtcacaagccctgcgaaaccaacaacagtaaaaacaccagctactccatctgtaacaacaccagcgcctcccacaactgcaaagctgccagtaaccgtcccttctccaaccacaaaaccaataacaccgacccctcctcctacaacaaccacacctacttcaaccacaaagttaacaaccggccctccacctaccacaaccacacctactccaaccacaaagtcaacaaccagccctccacctaccacaaccgtccctccagcaatcacaaagccatcaaccggccctccacctaccacaaccgtccctccaccaatcacaaagccatcaaccggccctccatcaacagaaaagccaataacaacggtgcctgcaccgccaaagacaacaacaacaagtacgccagcaatacgtgcagttcctagcccatctgttaagccgacgattccg

SEQ ID NO: 72183 - DNA, 223 bp, Heterodera glycines
  misc_feature (146)..(146): n is a, c, g, or t
  misc_feature (161)..(161): n is a, c, g, or t
  misc_feature (177)..(177): n is a, c, g, or t
  misc_feature (189)..(189): n is a, c, g, or t
  Genomic contig location: Contig_ID=SeqID_44747; Location=900..1122; Strand=+
  SCN-specific regions: Sequence locations=1-41,63-223
tgatttgtaaaatttccaattttctctatgtccccttcggctttgttcgtttgttttggcactcggcagaaaggaggacgcaaaatgccgtgcacaaattgtatggcggaatacacacgacgcagaaaagaagtgggagaactttngtatgatccaaatgngaaaaaatgccacccnaatcagatcggntgtgcccgtcgtcgtttcggcttttgcgagcgat

SEQ ID NO: 72184 - DNA, 787 bp, Heterodera glycines
  misc_feature (26)..(26): n is a, c, g, or t
  Genomic contig location: Contig_ID=SeqID_44748; Location=372..1158; Strand=-
  SCN-specific regions: Sequence locations=1-129,152-308,330-787
caaacggaagagttacatgaaagacnagatggaacgcaacggcaccacccagtgcccaacagtttgtgctgcagaatccgaacgcgtgccgctgcacgccgtccaaattccggcatgtactacattctgttcagtgcctcctccagcttctacgttccatatgtgatagtcatttttgtgtacgtccgcatttataaggccgcaatgaatgccaccaaatcgacatatggtggaatggttcaggtgggtaaagggggaatatttctggaaaaaaattacctgacttttaaggtcgctgaaaatgcaaacaaaaagaaggcggaaaaaacggcaaccaacggactgaacgacaaaaattcgccctgctcaagattgaaactgccaagattgttcatttctcggactgctcaattgcgcgaaaaacaccatttggaaatgtgtgccgttttcgcttgattcgccaataacatgtgcaattttaaggcaccgtttcagcatggacccgccgcgcactgtgccaataagcatcaattgtaactcatctccaagtgtctatgcgcaaatcaatgggagctgtggcaatttggatgttgccaacatcaaattgtcagccgattttgcgcgcagacgcagtgaagaccaatgtttgttggaggacaggtgaagcacttttaagccgatcgatcagtgagtgctttctaatcaattgcattttttgaaggtccgaggcgagccaaaatttgacaagtgaacggcccagcgaaatgatctacgaatcgcaggacag

SEQ ID NO: 72185 - DNA, 151 bp, Heterodera glycines
  Genomic contig location: Contig_ID=SeqID_44749; Location=33..183; Strand=-
  SCN-specific regions: Sequence locations=1-151
atggcgctcctgggtggatcccttcaacacttccgggaccactggaccaaggagtgtccaagtccgtcggtgaagggccaaggagagcccgagggaccggtcttccgagggaggcggaatgtgatgccagaaggaacggagaaaggagaaa

SEQ ID NO: 72186 - DNA, 304 bp, Heterodera glycines; identical to SEQ ID NO: 51570
  Genomic contig location: Contig_ID=SeqID_44750; Location=463..766; Strand=+
  SCN-specific regions: Sequence locations=1-304

SEQ ID NO: 72187 - DNA, 449 bp, Heterodera glycines
  Genomic contig location: Contig_ID=SeqID_44751; Location=229..677; Strand=-
  SCN-specific regions: Sequence locations=1-80,102-138,181-296,320-449
atgcatttgtctgctgtcctccaacgctcattttccgcccctttcattggtacgaaattagattttccaaaattcggatgattcattttttgcaaaattttattcatccatattatggtgtttcttaaattccgggtcatttaatttctattgttttttacaaaatattaaaaaaattatgctcataaaaaatacaaaaatgtgattcaggtcacctcattttccgtgacttaatttgcacttccaatgaagtgataacgaacgttcaacagcaatattgctttggtatattcatttttgggacaactgtctgtataagccgttataccgactaaaccagggttgccataaaggttcaggcgctactgataggcacagccagaaaaaaattggaatttttgtacaatttaataacagattttgcaccaataatgctataagttaataaa

SEQ ID NO: 72188 - DNA, 1459 bp, Heterodera glycines; identical to SEQ ID NO: 9646
  misc_feature (1391)..(1391): n is a, c, g, or t
  Genomic contig location: Contig_ID=SeqID_9646; Location=1..1459; Strand=+
  SCN-specific regions: Sequence locations=1-15,38-375,398-835,858 -1245,1267-1407,1442-1459
  Gene Ontology: Mol. function=protein binding; Cellular component =intercellular junction; Biological process=regulation of protein activity, epigenetic

SEQ ID NO: 72189 - DNA, 339 bp, Heterodera glycines
  Genomic contig location: Contig_ID=SeqID_9647; Location=707..1045; Strand=+
  SCN-specific regions: Sequence locations=1-23,106-158,180-193,219-339
atggcgcagaaaggagcaaaagcggaaaaggaagaggaaaagcaggaggacataaagcaggaggagaacactccgacggaggagggcgaggagagggagggggagcaattcgagggtcacccgatgacattggcacgcgaacttcgcattcggacgaggtccggtaatagtgaagctggtgcctccccccccctatttttatttatatttttaatattctaaaaacatggttcttagggttttcggggtcactgatcatgaatataacatccgttaaatgtagtcaaaaacaattggaacatcaaaaaatggtaattttgtacagatacgaatataaaa

SEQ ID NO: 72190 - DNA, 907 bp, Heterodera glycines
  Genomic contig location: Contig_ID=SeqID_9648; Location=1012..1918; Strand=+
  SCN-specific regions: Sequence locations=1-25,51-175,210-519,546-907
  Gene Ontology: Cellular component=26S proteasome
tctgtgtttgatcttgatttttttagtattgacaattcggaatggatgcgaaatggagaccttccaccaacgagattcaattgccaacaggaggccgttcgcgcacttgtccttcttaaattgagaaataaccctgaaaatgctgtcgggcttctttcgttggcggagtattaactttaaagaattttaaaaatttaatttccctttcatttagtatcaaaagaaattcgtcattattttttcaatttgttttttagtcgtattgatgtgctcaattcacttactaccgaagatcgcaagttgatggtccgtcttcacagtcttgaaattcttgtaatttttttctttttttcatttccacttctttttcctaattagggcgtttcgaaagttttcgatggaatcagaaccgcatacttggcactcaaacacaggaagaatcgcaaccatcgtcagcgtattgtcgtattcgtgggcagtccattagacccgttgcttgaagaaaaggaaacggtaaacgttttaaaaaataaaatattgtatttaagaaagtgttttaagtttataaaattcgctaaaaagctaaaaaaggaaaaagtgagtgtcgattttgtcttgtttggggaggccaccgccgagaataacaaaatcattgccgattttgtcgaccttcttaacggggctgaagagggaaattcgcatttgttggtcgtgatggttggagacaccaaactgtatgatgttttgctccgttcgcccatttttgcgggttcgggggctgcattaggcgcaggcggagaatttggcatcaacgaggaggacgacccggaattggccatggcattgcgcatttcattggaggagcagcgtctccgtcaacaacagcagcaaggcggcgaaggaacgg

SEQ ID NO: 72191 - DNA, 630 bp, Heterodera glycines
  Genomic contig location: Contig_ID=SeqID_44754; Location=138..767; Strand=-
  SCN-specific regions: Sequence locations=1-72,254-630
  Gene Ontology: Biological process=N-linked glycosylation
atggaagaggaagagaaaaaagaaagagcaatggaaaaggaaaaggaagagcaaatggaagaggaaaaggaagaggaaaaggaagagcaaatggaaaaggaagaggaagagaaaaaggaagaggaaagaaagagcaaatggaagaggaaaaggaagagcaaatggaagaggaaaaggaagagcaaatggaagaggaaaaggaagaggaaagaaagagcaaatggaaggggaataggggagtaaagagaggagggatggagcggatgagaaagggggtgaaatgatgggtgatgagaggtgttggttgacaaactgacgacgcgacgtttggacggcggcggaaggggaaaagggggggggggggaaacgtaaccgacgaagggatggggtgggtttgtgttgtgatacaattcaacggagcaaatgtggccgtaaaatagagaaaggaacgaatggaaaggatagtgggaaatggatgaataatcattgcctcaaagggaagcgaactgcgcgaaaatgggcaaaattgcgggggaaaggggggtataccaatcattcatcgattactgtcgagagcagtgaaagtgaaaagaatttgggcattgaaatttgaggggagggaaaaataaa

SEQ ID NO: 72192 - DNA, 1070 bp, Heterodera glycines
  Genomic contig location: Contig_ID=SeqID_44755; Location=67..1136; Strand=+
  SCN-specific regions: Sequence locations=1-250,273-293,316-717,752 -794,818-1003,1060-1070
atggtcgagagtctcggtctcggggttctcgctctcgggttccggattttggtctcgggcctcggggttttcagtctcgggtcttggggttttcattctcaaactcgaggatgaagcttaatttcggggtcaagtctcggtttcgagagtgtcgggaaattttcggtctcgaactcactaatcagcacccaccaccacccgactaaaaagcgaccgaccgatgctcgagagtcttgagagagggtttggggtttgcgtgtgtgttgttgtgttgcccccccccgcccctcggtggggcgggaggagggggcgggaaggccaagatacctctccccccgtcggcgctctcaaattttcccatttcttcgttttcgtcccatccttccgtctcccatcattttggtcccctaacagaccatcatcatcatatatatcaccaccatcagcagagtcatcagtcatcattccatccgcgattatacgaaatttctcacttctattcgaattctgaattgtacatccatttggtttgaagccgacctcgaattcatagacccaaaaaaaaccttaaaattttacggatttcccaaaatggcttaattgttgatccatcatcctatattacctatctataaaataccaatttttcaatttatttacacttttttttcagctttcatggcctcatctttcatatatcgcggaagacacaaaggcaaaaataaattaattaaaatttttcatttattttgccaaaaattttcagggcaatattgttggctatgttttggacaaaatggaagaagaaatggaagacgacgagccccatggacacatcacttcgttggctgtcaagcgtacctttcgttgactcgtcttggcccaaaaatttatgaaccaaacggcacggtcgatggtagaagtgtaagtgtgcgaattcaagcattagtgtaattattcacctaattcaatggaagtgcagaagaattaaaattccaataagaattaaattttaaaaaaatattaaaattttactgtaaaatctaaataatttaaatagccgtttttca

SEQ ID NO: 72193 - DNA, 416 bp, Heterodera glycines
  Genomic contig location: Contig_ID=SeqID_44757; Location=23..438; Strand=-
  SCN-specific regions: Sequence locations=1-416
gatatgtccatcgcccgtagggttttgttggtcgctgaccttcactccatttcgacaggccgacatgaacctgcccaagtgactgctgacaatgggggggggggggtcaattggtcattcccattggtgcgctgtttcagttgcggttgaactgctttcgcacattggccacactgctcgcttgtggggtaagcattggccgttgagtcaaccaatccctgaatgttcaatttgtcggtcgattcggagaagactttgctggtccaacagagtcgtttgcccgaacacaccgaactgatgtggattttgggttcaactacgactgtggttggtctgtcgatgctcaccagtcaaatgaggaaatgttaagacgagtttgacctcgatgtcgcaaaaggagggcaaatccagagggt

SEQ ID NO: 72194 - DNA, 564 bp, Heterodera glycines
  misc_feature (8)..(8): n is a, c, g, or t
  misc_feature (10)..(11): n is a, c, g, or t
  misc_feature (13)..(13): n is a, c, g, or t
  misc_feature (16)..(16): n is a, c, g, or t
  misc_feature (21)..(21): n is a, c, g, or t
  misc_feature (26)..(26): n is a, c, g, or t
  misc_feature (33)..(33): n is a, c, g, or t
  misc_feature (48)..(48): n is a, c, g, or t
  misc_feature (51)..(52): n is a, c, g, or t
  misc_feature (58)..(58): n is a, c, g, or t
  misc_feature (73)..(73): n is a, c, g, or t
  misc_feature (79)..(79): n is a, c, g, or t
  misc_feature (85)..(86): n is a, c, g, or t
  misc_feature (95)..(95): n is a, c, g, or t
  misc_feature (104)..(105): n is a, c, g, or t
  misc_feature (137)..(137): n is a, c, g, or t
  misc_feature (146)..(146): n is a, c, g, or t
  misc_feature (151)..(151): n is a, c, g, or t
  misc_feature (161)..(161): n is a, c, g, or t
  misc_feature (187)..(187): n is a, c, g, or t
  misc_feature (194)..(194): n is a, c, g, or t
  misc_feature (265)..(265): n is a, c, g, or t
  misc_feature (282)..(282): n is a, c, g, or t
  misc_feature (284)..(284): n is a, c, g, or t
  misc_feature (286)..(288): n is a, c, g, or t
  misc_feature (290)..(290): n is a, c, g, or t
  misc_feature (292)..(292): n is a, c, g, or t
  misc_feature (295)..(295): n is a, c, g, or t
  misc_feature (314)..(314): n is a, c, g, or t
  misc_feature (322)..(322): n is a, c, g, or t
  misc_feature (325)..(325): n is a, c, g, or t
  misc_feature (332)..(333): n is a, c, g, or t
  Genomic contig location: Contig_ID=SeqID_44757; Location=765..1328; Strand=-
  SCN-specific regions: Sequence locations=1-114,136-564
gaacacgngnntntcngcggntcagnaaacggncgccttccatacgcnaanngagccngaggccccagcccanaacggnaaaacnnaaacgaagncaaggacannacaacccccgccaagaaacccaagaaagaggnggacaaggncggangggccaccancgcacaaaacgccgcagcgcaggaanccaacanggcaaagcagggcaaaaaagcgacagaaaagcacccacggacacaaagcgaaggcaagcggcagcaaaaancgggcaaaaacgggcgncncnnngnanacncaaaaccgagaagcgccancgggacgngcnaccaccnnaagcacttccatcctgtatactcaattttcagggattttcctgcaaaatttgctcttcccaaattgccttcggccaaatgcgtcgctccgtctgtttgccctgcggtcactgcctctgttccgattgtctgctcactctctcctcgaaagacttgtccaacgacacttcttcggtcgaatgccccttttgtcgcatcaaatgcccctcaaatcgaattgtgttccctttga

SEQ ID NO: 72195 - DNA, 627 bp, Heterodera glycines
  Genomic contig location: Contig_ID=SeqID_44760; Location=217..843; Strand=+
  SCN-specific regions: Sequence locations=1-16,38-168,190-230,252 -513,535-627
atgtttcggattgaattagaacaaaataaatattatattcggaatctacgcctcaaaaaacccatagaaagtaaccaaacaccactactacataagaatgaaaaaacaaattactttatttaataaaaatttggcaaaatggttaaataattcaaatttgtatgttttttgtcttttctctcacgaaagaattccattcttagggttctatatttaacccgaccccgagtcggggttaagggttggggttgtcgcggctgggagcgtcggtgtcggggttatccccggaaaatgttcaaaaaagtcggggcggggccggagtcgcaaccctaggctaaatataaaattttcaacacatttccatttgagtagagagtcatcgaccaaaatgtgatcgcttgtctcaaccgttttggccagcttgtcgccaaatgtccgattatatttttccatcaatacgtgcagtgatcgcatgttgcacttatgatgtgcaacttttacctcaagcactagaaaaatatgaatgtcacggatctgaatgtcaatgatgcgctcgtttagagacaaattacttctgctgccattatggacagcattggcccattcgaaatgacagaaggcagacga

SEQ ID NO: 72196 - DNA, 1406 bp, Heterodera glycines
  Genomic contig location: Contig_ID=SeqID_9650; Location=302..1707; Strand=+
  SCN-specific regions: Sequence locations=1-1004,1026-1118,1140 -1146,1168-1313,1335-1406
atgatgttttctgacttgaatcaaccatccgacgaattcacgaaaagcgaggccgagttcaagctggtcgcctgcaccaaacaccgggccgatttcatcgccgtttgtttctcctgcgacgaattgttgtgcaaggactgtgtggacagcggggaacactacgcgcacaaatggtcatttctgaacagcgaagtggacattctctgccgacagacactgcaggagttgggccaacaggcggagcaaaaggtctgctgcttcccgccattttctgacatttttcaatattttccgtttccttacgcctgccgcctaaggggtttttgagtttttcaacatttttttttgtgccaatcactcaaaaaaaaagatgttcagccaattggcatttgcgcaaggcaggcgccgggccttgcccaaaccggaaaaagctctgaaattgggattggccggcccgactcggggcgtcaaaaaagtccgtttatatgggctgccaggccctcgccatttgatgacatgttcagaatgtcaaacaatttttttgttgttataaaaggctgataaaaaagaaatcagtccattttatttcgtcgcgcaacccaatttccgaattatcttaaagtttaactaattcgaattcattcaccggaaatcgaccttaaaacgttttgtccctttcagaccccccactccaaaattttttttctttttattgtaaaattgtgaatctcagggtaaagcgacgctcgatgcacgggagtccattccggaccggaaagagttgctgcatttgtcgtccaacaaatgtcgcgagaaaattgaggaggcattcgtgtattatgtgcacgtgttgagcgaggtgaagaaccaactgttggccgaattggagaagaaccgggacgagaaggaggagtacttggacagtctgtacaagaagatcgacatgcaaacgtcgaagttgcaggacgcactcaggttcacaaacatggatggcattaggaataaaaatggaattttttgggggttcggtaggaccgataacggcattttctatggctctactgccgtttaaaatgtttactagactattcactgcaaaaacgggcagtttaaaaagcgtttttaaaggcaaaaaagggcaatctatttttattcactgattttattgctccgacataatactaaaacgctcgaattaatttctaaaaatgttcgaattttgatttttgcattttttaaattactaacagcattcattggattcatttttttagatacacaaactgtttgctggagaagggcactgtgacggagctgtgcctgaacaagaacaaagtgcgtcagcagttgaagctgttgattcattcgatgccggacgcaaacgcggaagtcgacttggactttga

SEQ ID NO: 72197 - DNA, 1239 bp, Heterodera glycines
  Genomic contig location: Contig_ID=SeqID_9651; Location=194..1432; Strand=+
  SCN-specific regions: Sequence locations=1-194,217-664,695-753,775 -831,853-931,954-1239
agtcgctttggcgccgactctttcccgggcttccgaactccgactggcggtggtctgacttcgccagacgcgatggtgatgggtggccaacaattctgtgacccgacaaatccaatgtttccggacaccaacaattatttgtccggttcacaatccaaactatgggcaggggtcagtttttgggggttttatgcatttaaattaaaaaaaaaatttgggaaacacaaatttctgttccttcgactcattcattaccaattcagcagttcaattcgccctccatgttctcacaatttgactccacgcccgcccaccagcggccccgtgagctaatggagtcgcgcttcaccatgggagagttcggcgcgggcggttacggcaacagcagctgcgacctgtcggccggcatgcgctcgcgttcgtcgctgtgcaacacgccgtccatggaccaatttgtgaccgcgtcgagcatcgcttcgcaacaggtggtgttaaaaaggcgaaaccatgagttaaagtgtacaatttgaccaggacttccttgcacttggcaatggggccggtggtagtggaggtggtcgtgctcatcaacagtttggtagcggctcgcccgcaaacgatgtgcgtttttagagggggggggggtgaattttgaaaattttgcattaattttaacattttatttatttataaaccatttgctccatcttctaacatctgccacctctttaaaatcaagaattttttttatggaatattgcaagaattgtaaaaatattttgagcaaaataagcaaaacaaaagtttttccgactgcttcgatataggcacaatgcgaattttgttttttgattttcaataataaattattttgtcctacgtatacactataaaacttatttatatctaattttctttgtgccatttttggcatttttcatatggcattcattcatcactttcagatgactctctgcaaacatttcaatgccgacaaaaacaacggggcggacactttcaacacgccgcagggcatttgcttgggcttggattccgaaattgccatcgccgataccaacaaccaccgctgtattgtggtcaacttcaacgatggtttgtactgggcgtagacacaaaaacaaaaatataatcttcacattttctccatttaaaggcacttttgtgcgcagtatcggaagttccggaactgaagaagggtccgtttactacccgaaaaag

SEQ ID NO: 72198 - DNA, 669 bp, Heterodera glycines
  Genomic contig location: Contig_ID=SeqID_44762; Location=432..1100; Strand=+
  SCN-specific regions: Sequence locations=1-141,211-356,378-622,644-669
atgccgcaacaacaacagcaactgtaccatcagcagcagcaacatcatgttttgtcgttgccatcttcagcgacagcgggtggccgagctgttcagcaacatcatcaccgacgttctgccgcttctcctgcggtggtctatcaacaaccgcaacagcagcagcagcatcagcaacactaccaccacaatcagcagcgatcaacagcagcaaatatgatgatgagcagtggtccggctaacatgaacatttcagtccgtgaattcttgagcaacaacaacgcggccagcagagggggagaccgttgatgatctgattttttttgattgaatttctctctttcttttttttttgcttgtttctcctttttgctcttcttcaggctttgatatgagacgcgcgcattgattgattattgatcatttaatcattatcatcttattatttgtgttcccactttgatcgtttgaaaatgtccgttttgttattttacctatttatttttcattaacggcaccgactgaagacacaaattttttcagtggcaattttcaactcactttattgccctttgctcacaacacacacacacattttattttacaaacatacagacggacattcatttcataaccaatggcatggcattggttagtttctgattggactca

SEQ ID NO: 72199 - DNA, 273 bp, Heterodera glycines
  Genomic contig location: Contig_ID=SeqID_44766; Location=342..614; Strand=-
  SCN-specific regions: Sequence locations=1-149,171-273
atggcactgattgagcagagaaacgagcggaaaaaggccatccgaacggagaaagtgttggaggaagctgaaaaagtgaggggggatttaaatttaaaaattagaaattcgtatttataaatcaattaagaattgacggaaatttttttatgttgaaaaatctcgaaatatgtaagaaaaatttacaaaaacccccaaagatgtgccaaaataagtgaataaaaatctttataatattatgattttttagacaaaaaattcttagaaaataaa

SEQ ID NO: 72200 - DNA, 72 bp, Heterodera glycines
  Genomic contig location: Contig_ID=SeqID_44768; Location=373..444; Strand=+
  SCN-specific regions: Sequence locations=1-72
atgtgttccaaaaatgattcatcagtgcgcatcgacttgaagcgatgtccatgcattcactcattggctcag

SEQ ID NO: 72201 - DNA, 886 bp, Heterodera glycines
  misc_feature (29)..(29): n is a, c, g, or t
  Genomic contig location: Contig_ID=SeqID_44771; Location=159..1044; Strand=+
  SCN-specific regions: Sequence locations=1-1,28-143,167-198,255 -255,345-350,414-427,457-493,521-737,770-778,822-886
atgtaccgccccagtcaaactccccgccntgacactgtcatcggcgcgggtcgccgggccaccgggtggcccgacttaaacaccaaaatggacaccctttcgggcgcactcccgttttaccgattaagtaaggaatcgatgaaagtagtggtatttcactggcgccttgcggctcccacttatgctacacctctcatgattcttcacaaagtcagactagagtcaagctcaacagggtcttctttccccgctaaatttgccaagcccgttcccttggctgtggtttcgctagatagtagatagggacagtgggaatctcgttgatccattcgtgcgcgtcggtagttagccgacgaggcatttggctaccttaagagagtcatagttactcccgccgtttacccgcgcttaatcaagtttccttggcttaacattcagagcactgggcagaaatcagacacggtcaacgtccacaaggaccatccgtctcctctgttttaattagacagtcggattccccgagttcgtgccagttctaaactggtcgttcagcgccaaccgaagtgcataccctgacgagcatacacgcagctgaagcgctccacaagcagctctcaccactagtccacgcaccatccccgaaagaacagcacacagccacgggcaaaagccgcctgtttcacgcaacagcccggctgacccgacctttagagccaattcttttcccgaagttacgaatctaatttgccgacttcccttacctacattattctatcgactagaggctgttcaccttggagacctgctgcggatatcggtacgatcaggcaggagattcaaatagcatccgtcgcattttcaagggccgtgtggagcgcacgagaca

SEQ ID NO: 72202 - DNA, 525 bp, Heterodera glycines
  Genomic contig location: Contig_ID=SeqID_44775; Location=27..551; Strand=-
  SCN-specific regions: Sequence locations=1-73,105-159,181-405,427 -431,453-525
atggctgatttaaagaaaatgaaaagagatacagaggcagagaaaacgtgagtaaatagagcaaagttaggactataaaaaattataagaaaaaaattttattacttcaaaaatgaattattggagggccgagtctaaaaatggtctccaaaaacggcatttttcaagaccatcaaataacaaaatgttttaaaagtggttttcgaaattccgaatttaattaaactaagtaaattgaccacgctgagtccgaatatggctttagatttggtctctgggttctcaacaaacctgtacagctccaacttcatgcatggagttggagcagtacaagctcagggttaaaagataggtcagatttaaggccatattcggattctactggtctaatttgtacagaaaaccttcttttttgttatatcaggttacttttttgaccataaaaaattcgagaaaaattagcgggccaattttcaatttttgcatggtcgggaaaaaatactaaaaaagggagaagcaaataaa

SEQ ID NO: 72203 - DNA, 771 bp, Heterodera glycines
  misc_feature (171)..(171): n is a, c, g, or t
  misc_feature (269)..(269): n is a, c, g, or t
  misc_feature (271)..(271): n is a, c, g, or t
  misc_feature (296)..(296): n is a, c, g, or t
  Genomic contig location: Contig_ID=SeqID_44779; Location=261..1031; Strand=+
  SCN-specific regions: Sequence locations=1-39,82-93,115-297,319 -330,353-434,456-771
atggatataaggagagaatttgatgagaaaatttttgagaataaaaatggaagttggggatattgtaattttatttattttgtggtgagtgataattaaatttttgattaattgataagaaattatgaagaattaagtaattgatggaagtaagaaaaggattttataatnaaaatgaggataaagtgagattggaggttgatttgattgtatataatagtaaatatggtgaaataaaagagattcagtaatttgtataataatatctngnttttttgaaaatggtattggaaaanttgttaaaatattataataatggatggggacaagtaaaataaagcaacgaacaacggaaaatttctaaaaaatttttcctattttatagtttcaattttttttttcaattaccactaaacacgaaattctcttgaataaaaattccaggtcccggttttgcctataattcccgcgtctcgtacaactgtaattgcgtgaaatctatcataaatagggatcggattcttagttttttaactattttttctgcggctttaactcgacgagaaatgcacgaaaaacacattctttttcgaaaatttttcgtttttagtgccactattcatcactaggaatcactattttggagcttcgccactaaaaaaactatttcggaagttagccactaaaataattttttgccactattttggcgtttcgtcattatttttgccactattttggcattttttggaaaatttcccaaaaaatgca

SEQ ID NO: 72204 - DNA, 406 bp, Heterodera glycines
  Genomic contig location: Contig_ID=SeqID_44780; Location=473..878; Strand=+
  SCN-specific regions: Sequence locations=1-59,83-406
caaaatttgcctacagcgtttcaccgagccttacaccactgtttgcggccatactttttggttggtgtgaaaattggatttttgaaaaaaaagcgaaaggtttgagccgtaaatttaggcaaaaaatggtggcacccctttttcgaaaaaaatcaaaaaattttcccatgtaaaatctttttattcagctcggatattttctgacacccatttcttgaaatcggactcgaacataagccgagaaaccgggctttttctatttccaaattttcgatctacacaaggcattaaaatatgaaaaaatatctgagtatcataccaatactgcgcagtaatgggactttgttcgagtcccgtttcaaacgccgaattgggtcgaaatgaaagggctccattttttaggcaa

SEQ ID NO: 72205 - DNA, 383 bp, Heterodera glycines; identical to SEQ ID NO: 51114
  Genomic contig location: Contig_ID=SeqID_44781; Location=215..597; Strand=+
  SCN-specific regions: Sequence locations=1-20,42-275,297-383

SEQ ID NO: 72206 - DNA, 914 bp, Heterodera glycines
  misc_feature (12)..(12): n is a, c, g, or t
  Genomic contig location: Contig_ID=SeqID_9653; Location=249..1162; Strand=-
  SCN-specific regions: Sequence locations=1-258,280-568,605-914
atgtgcctcacntacgctgcgaaaggagcggaagctatgaacatcgttgctaatcatttcatcttccttctgacggcacgacaccttgactacgagatagccgtacacttcaaaaacgtcaagaagatcgatgggtcaatggctgagacgattttgacccgctttgagattgttgaccagagcaacaaggcgaaggaacggccttcaatctgcgaagaatctttcgtcatcgacatcacggcgatcgagagcggaaagcagaggaagaagctggctggcaaagggaggagacccgacttcaacatcccgtacagcatctgcgatgggacaactttcgagctgacaaacaatgacaacttttgtctcttccgggcgtttgagtttctacgtgtgaaacatgagctacgggatcgacatcagcgatttactgaatacaaacgaaacagtcagtggcagctgaatgatattacgactttgtgccaaacctgtgaaattaatatgagactgccattctactcgattgaggaatacggagagagaattcaggtattttcaggaaaaaaacaccaattttaacataaaataataataatataataattaaggcttattatgaccggcttcacccggacacatttcgtctgttctgttttgggacatctggaaaaatgaagcctttgtggaaagcggacgtgaacaactaccaaaaagagctatgcgtgctctttacagaaggagaagatggcggcgccggtcactacgaccctataaaatcaattggaaaagtctttggaacgaggaactactgttttggagtaatattaaaaacaaaggaaaaaatgataataaaaattttttagtgtgaaatgccatacagccaccaaaaccagcacaattctaaatgcaaatggtag

SEQ ID NO: 72207 - DNA, 1719 bp, Heterodera glycines
  Genomic contig location: Contig_ID=SeqID_9654; Location=186..1904; Strand=-
  SCN-specific regions: Sequence locations=1-129,162-332,354-983,1018 -1190,1212-1236,1262-1423,1445-1512,1534-1719
atgtcgtccgatgacgaaatgcctcctgtcctcgacgggccatacacgcccgtgcgagatggcgatgagccctttgaggaggctccgccccttgtggaagtaattaaccaattgcctaatcaacgggtgaaaattatttgaaataaaataatattattaatcaatgatttagattttggaggatgttaaaggaaaaaatgaacacgggatcaaggagcgattaaacttggaagaatttaatggcgagcatttcaaatgcctagatgccgcacaagcggagagtggaagatttaaaggttgattaattttcttcgagcaattaaacaatttacatttattttttgttttcatttaagcctaccgttttcttggacgatttatgctggactacatttggaatgccgactaccccgaagctgttttgaagagcctctttttgatgtgcctgtcatacgctttgaagggagcttcggctatgaacatcacggcaaaccatctgattttcctcttaacatcacggcatcttgactacgaaatagcagtgcacttcaagaatttcaagaaaattgacgacaaaatggctgaaacagttttaacacgctttgaaattgttgatcaaagcaacaaggccaaagagcggccatcacttcttgaggaatcgtttgttattgacatcacggccatcgacagtggaggaaagagacagaagatggcggggaaaggtggacgtcgccgtgacttcaatgttccgtacgaccttctggagggtgcaacatacggattggagaacaacgatgcgtattgcttgttccgcgccttcgaattccttcgcatgaagcatgtgatgccacatccgagattttctgaatataaacgtgatgaaggacaacaacttaacaacgtgacttctttattccgagagtgcgacatccaaatggggttgcagttttattccattgaggaatatggaaaccaaattcaggtaatttaaaataaataaatttaagattaaaattacatttaaggaatactacaacgaaatgcaccctgggatgttccgtctcttctgctttgacacatttggcaagatgaaacccgtttggaagtccgccatgagtgattaccggtatgagctctgtgttctttacaaggagggagatgatggagctgttggacactatgacgcaatcaaatcaattggaaaaattttcggctcaaagaattactgtttcggggtatataaaaataaataaataattatccttttgtttaagtgcaaagttccatacttccaacaaaaccgacataattcaagctgtaaatggaagtgtcacaactgccagcgtgtgggcaatagatttcgagaaaattgcaaaaactttgatgacaatttctttgagtcatgcttgggatgccataaagtaaacttttaaaatttgtattgctacattatttttttagactttccaaagcaaggagtgctacgaccatcacaagaaaattacgccgtgcaaagtgaaaaagggaaaagagacaaaaacaatcgagaggtgcatctgcaacacctcaaaacgttgcaatgcatgtggtgtgggctacatgacatttcgcctactcgacatttcgcctactaagctaaaaacattcattttgcctactaacccaaaatcggtcatttcgcctactgtcatttcgcctactattcatttcgcctactga

SEQ ID NO: 72208 - DNA, 480 bp, Heterodera glycines
  Genomic contig location: Contig_ID=SeqID_9654; Location=3511..3990; Strand=+
  SCN-specific regions: Sequence locations=1-294,317-480
atgtcgcgcacccctgcaataggtttaggcttgcagaaaaaagtcgcgcaccccccctcaataggtttgggttttcaaaaaaagtcgcgcaataggttttggtttcagtactgaaaaagttggcgctcagttggcccgcgctcacccggcggcgctcagttggccgtgcacccctcccataggtatgggctgctaccgtacccgggggaatcttcgcccctaactactaaaaagtatttagaaatttgaaactttaattaattcttagagcattcacggtttttgatgattcaatttaaaaataaaatggaattttgttttgtgcctttttggaccaaaaatttaaaaacattaagcggattacaaggaaaaaatcgtcttgcttttttagatgttgatttaactaaaaaaaaataataacggaattgttaatttgcagtgaatttcctttcgaaaaaggcaataattttgaagaattag

SEQ ID NO: 72209 - DNA, 1099 bp, Heterodera glycines; identical to SEQ ID NO: 44783
  misc_feature (48)..(48): n is a, c, g, or t
  misc_feature (126)..(126): n is a, c, g, or t
  Genomic contig location: Contig_ID=SeqID_44783; Location=1..1099; Strand=+
  SCN-specific regions: Sequence locations=1-99,121-193,215-407,429 -745,768-832,855-1099

SEQ ID NO: 72210 - DNA, 244 bp, Heterodera glycines
  Genomic contig location: Contig_ID=SeqID_44784; Location=79..322; Strand=+
  SCN-specific regions: Sequence locations=1-244
acaggcattaattccattgcttcaaatgtggtacgagagattgcccatgattatcgcggccgttagtatccccgcattttgtaccagcgactattacccactgcattggtatgggacgaatggctgcaaacatcatcgagttctgaaaggacatgagcagtcggctctccttatccgtgacagagagttgaccggctacgaatacaatttgatgggcatcgactcaattccggaggaggattaa

SEQ ID NO: 72211 - DNA, 282 bp, Heterodera glycines
  Genomic contig location: Contig_ID=SeqID_44785; Location=439..720; Strand=+
  SCN-specific regions: Sequence locations=1-282
atgatcatcccatttaaccggttttaccaaagaacagcaggccaagcaaaaaactgtcctttaaggacacattacttctcaataaaatttactgcccgggttagttgaatacacagaacaataaaaaaaattttgcccattgtttacttttgtacgtcacagacgcctgcaaacaactacccaacaaatgccaaaacggcggatatcaaaaccccaaaagatgttcaagatgcctttgccccggatggttataggggaacatactgtccattctttctatag

SEQ ID NO: 72212 - DNA, 47 bp, Heterodera glycines
  Genomic contig location: Contig_ID=SeqID_44787; Location=1356..1402; Strand=+
  SCN-specific regions: Sequence locations=1-47
atggggcatttgcaggcggagtgcgctgagatgctcggagtagctgc

SEQ ID NO: 72213 - DNA, 49 bp, Heterodera glycines; identical to SEQ ID NO: 51181
  Genomic contig location: Contig_ID=SeqID_44788; Location=62..110; Strand=-
  SCN-specific regions: Sequence locations=1-49

SEQ ID NO: 72214 - DNA, 624 bp, Heterodera glycines
  misc_feature (576)..(577): n is a, c, g, or t
  Genomic contig location: Contig_ID=SeqID_44792; Location=55..678; Strand=-
  SCN-specific regions: Sequence locations=1-102,129-624
  Gene Ontology: Mol. function=receptor activity; Cellular component =plasma membrane; Biological process=cell surface receptor linked signal transduction
atgggacctgcccggtcgggcaccgcaattcacattgacccgctgggcacatccgcgtggaacgcactgattgtgggacaaaaaaggtggtgaaaatagttgaaaatttatatttttataaaatttttgggcatcatagcttatgaaaattccaccaacatttgtcaaatttaattttgccttcgttgaagtcccaaatcaagtgttgccactcgaaactcggcatttttctcgtccaaaatcccgcgccgaatttttttgtccttttcaatccaaattaaattctccaaaattttcttgcattattactgaattaaccccagtttttgcagatggtgtctcatccatccaagcacgcccaaacagttggtcaaaacgctgaaggaggagcgcaattttcattcagatgaggcgatcacatggtaaccaatttatgtcccattttttttttcaaaatattgtttcgacgctgctataaaaatctttttttgttcaggttccataccgttttccggcgtgttatctctccgcattggcccaccgaccgttacccggtcattcacgcgattcaaaagnncgggcgaaggttgaaaattcatttttttaatgcaaaaaaaaattaaa

SEQ ID NO: 72215 - DNA, 945 bp, Heterodera glycines
  Genomic contig location: Contig_ID=SeqID_44796; Location=115..1059; Strand=+
  SCN-specific regions: Sequence locations=1-338,379-445,468-552,587 -618,640-695,888-945
atgctaattacgtttgtgagaaatgatcataaaatgcaaattagtgaatattcaaagcagaaatatggggcatatcttggcattgtgtattttataagaaagaattggcaatgtgacaaaattagcgaggaacttgaagaatataaacggacagaatatcaaaaaaatcgcagatatttggacattttgtacgaatatttaagtagagaatatgctggatttccaacagtgaagccaatatttgtcattaaaaatcgaattgaaattgaagcaccaataatttatgcgatttattgtttggtccgaatttcgcaattttgttttaaatcaaaatggggtaatttttatgaatataaattaaataaattctttaataatgattatgaaccaaaaatgctgaatgaggagagattaaattatgcatttaaattggaaaatgaaccaaaaatgccaattaatgaaataattttgcaattggcaattgacacagcgaatgaatgtcaaacaaatgaacgtttagatggaataattagacaaaattttgacgaatttctgagaaaaatgtttaaaaaagcggagggaagggtaaaaaattacgatgatcggttgagagtcgcaaaaataaataatgacaaacacaaaataattgtgggttcgaaattcgatgataaatggacatgggtgagatttaacatttaattagaattagtaaattaaaaatttagaaagttaattagaattaataaattcaaaatttagaaatttaattagaattaataaattcaaaatttagaaatttaattagaattaataaattaaaaatttagaaatttaattagaattagtaaattaaaaatttagaaagttaattagaattagtaaattaaaaatttagaaatttaattagaattactaggaggaaatttagaaagttaattagaatta

SEQ ID NO: 72216 - DNA, 862 bp, Heterodera glycines
  misc_feature (5)..(5): n is a, c, g, or t
  misc_feature (47)..(47): n is a, c, g, or t
  Genomic contig location: Contig_ID=SeqID_44799; Location=232..1093; Strand=+
  SCN-specific regions: Sequence locations=1-60,82-151,174-526,548 -677,716-841
atggnaaggtgtttgaattaaatgtagaaatgtttgtttttattatngttattaatttaattaagttcatttctaaattatcagtccgacactgttcgtgccgagtttttgcatgcgcttgccctcagacatgagcaagaccgggacgatgccaacaaatacatcaaacggaatccaacaccacgaaatgttagcatgaattttatacataaaaaacactggcaattttacattaaaaatctggcataatttaatattttagcaaaaagagccggcgaaaacagaaaattacggctttccctatgattttcattcaattttgcattatgctgctgtgaaaacaagcgggtcagttattttaaaggtataaatgaaaagaaaataatttggcaatgaatcagctattacgacatgattacgctgaaccgtttttaccaacgcacaatgtttcactcaacatatgaactttcgtttaaagacgccgccattatcaacaaaatttattgcgacggtaaatcgaattaattcattataaaatagagtgaattaatttaagaaaattgcaaaaacgttgaaaacaaatgccaaaagggaggatatcccaacccaaagaattgcaaccaatgcctgtgcccggtgggatacggtggagaaaaatgcgaaatggtcgaaaatggtaaaaaaaaaattaaaatgataaaaattattaatatttcagatggaaattgccaaactgacagggcaaatggaattgaagcagattggcaaatcgaacgttgaagccaaaagtgagctgcacaaaaaggatgagtcatgtggatgccattggcaaataaggcaacatttatatgaaatataaaaa

SEQ ID NO: 72217 - DNA, 933 bp, Heterodera glycines
  Genomic contig location: Contig_ID=SeqID_44800; Location=28..960; Strand=-
  SCN-specific regions: Sequence locations=1-432,460-933
  Gene Ontology: Mol. function=pre-mRNA splicing factor activity; Cellular component=spliceosome complex; Biological process=cell cycle
atgtccctacagcagcagcgccaacgactgcccatcgcaaagtgtcgcaaccatttgctatacctttgcgaacacttccaaacggtggtcgtcgtcggtgagccaatccaagcggaaaagtcgaaatgagacttcttttccgggatttctccgttgcgcacctctacttttaagaatgtctaaaacacgcaaaagttgtttggcgagcaattacaagtcatcaaagcagcaatttaagccaatggatgtattatatttcttgggaactaaccaaatggcgtttatttgtttgtccgatgccaaataacttagaattgaaaagtgaaaaccgttagcaattcggtttttattccgtagttctttaaacccacaaatcctttcaatttcaggtgaaaccggatcaggcaaaagcacgcaattgccacaagtaattgaagaaataacaaacaaacagaaacatggcctattctctgatcacttttgagtggtcgtctactgtttttttcagtatttgactgagtttggttgggccgaaaatgggcgcagaatttgcatcactcagccgcgacgggtggccgccatttcgctggcgagtcgcgtggcggacgaaatgatgtgtcggctgggagacgctgtgggctattcggtccgatttgacgagtgcatttcggcacgcactcacattaaggtgtgtttggcatgccatggcaatttttgaacgggtccgattgtttgttcccaatctgtccatgccatttcttgcctcttcttcagttcgtcaccgatggaattctgttgcgtgagctgatgagcgacccgttgctgcaggcgtactccgtggtcatcgtcgacgaggcgcacgaacggtcggtgaacacggacctgatcatcggcttcctgcgcaaaatcgtcgccattcgcgacgacctccgc

SEQ ID NO: 72218 - DNA, 1364 bp, Heterodera glycines
  Genomic contig location: Contig_ID=SeqID_9656; Location=51..1414; Strand=+
  SCN-specific regions: Sequence locations=1-39,62-223,247-820,843 -1170,1192-1364
ttccaaccgatgtgttaacagagaaagaattgctcgccatttatcagttccatgcccttccaaattgtatttgcatttccaatggattttttccaatgcaatttccgactaatggacgaatttctgatcggaaagaaggcacacttttgctggacattgaaaatgtgtccgaatttgctcgagaggcggttgggaacagtcggcacagcgaaaaagtgtacataaatgcatttccatggaaaatcttggcacagataaaaacgaaaaatggaagcactgacaatgagaaatggttcggatttttcttttcgttcgatactacgaaaaaaggtgctaattaactgttaattaatgctaattaacagctacaattaatcaccacttagattcgcattggcgctgctgcgttcgctccgcaacatttcgaattatttcacatagaaaaaaagcggagaattccaatggcacattttgtgaccgtgtttttgacaacaaatcgacaggctggggatttgaaaatttcatttcttttgcagtgagtgccaatttaattatgttcccttaattgtccaattatgacaaattaaggaattgttggacccgaggaacggcttttacagcgaagaagattacaaagtaacattggcaattgatgtcattcttaaagatgaaaaaatggaaaaattcattttgaatcaaagcgaagcgaaagggaaacttttcatggacattgaaaaagtgtcggaatttgcacgagaaattaaagggagtgaacggaaaagcaaaattgtgcacattaaaggatttccatggaaattatggacaaaaatagaaaagaaaaatgaaagcgctgacaataaagagttgggcatttatcttttgtacgatggtccaaacgaaggtgcaaattagttgctaattaatgttaattgtgtaattaattgccattaagacaaaaattggagttgcaaatgttcgacaacttttctaattgtctctcaaaagagcgatgtgccggatttcagaagagaattaagcgaagaaagaacttttaacagcaaatcgaacaattggggatttccgaattttatttcatttacggtgagtgccaattcagttatattcccttaattgctcaattatggcaaattaaggaattaatggacccgaacaaaggcttttacgacaaaagcgaggacaaagtgacattggccattgatgtcactgtgaaagaagcaaaaacagcggaaaaatcataaatatccaatatgatctgctgatctctacatttaattatcaccctattgacctatttttttatactttttctttttttactgctttttacaaaactgatttatgga

SEQ ID NO: 72219 - DNA, 640 bp, Heterodera glycines
  Genomic contig location: Contig_ID=SeqID_9657; Location=300..939; Strand=-
  SCN-specific regions: Sequence locations=1-531,553-640
atgagaattttattgcaattaattgcattggccatgagaaaatttctgtccaaaatttttgccaatttgttgaaactcgtattcgacttcagttggaatttgacattaacaacagagggacgacaacgaattggcacatttatccggcactgttcgaagaaacatgcaaaatcgctcaaaaattggaggaaattccaactaaaaaccggtagacaatacaaaaaaatttatagaaattatcgaaaatattttacgttttattttaatttcgcaaattttttttttttgcaattttttaatttctccaattttttcagctccgatttccaccattgcaaagtatggctgattggcactgatcagcagttagtgaatgccaatgaaaaacgactgattaatggcaaattgctcaatttcgattgggccataaaaagagatttccttaaatttaacggcaaattgtctaacaaatccggcggcaatgacaataatgaccaattccaacagatgggactcaacttgaagtccgtttttgtaccaaatatggcacatttgttgaaaagcaattagcagaaaaatagctaattgattgattgttcaaatgtttttttttgtttaatataaaagtttcttcaataaa

SEQ ID NO: 72220 - DNA, 722 bp, Heterodera glycines
  Genomic contig location: Contig_ID=SeqID_9658; Location=760..1481; Strand=-
  SCN-specific regions: Sequence locations=1-273,296-406,447-481,503 -519,573-722
atggaaacggaaaaatcggaaaatgcaatcatttgggttgacatcatggcaattgccaacgaaatagaagacaaattaaaagtcattgagcaaattggaaaattgaactttgtaaattatgattttatggagggaaaattattggaaaatttaaaagaaaaatggcaaaaaataaaagaaaatgaaaattatgaaaaattaaaacgaaaaatgttcaaatttttaaatgaaattttaattcattccgaaatgagaggacactttattcagaattgtgaagaaaattcagaagaaaatgaaaatcaaaaattattgggcagaattcatcaaaaaaatttggcaaatgccataaaaaaggacgaatttaaacaaaaatggcacggaatggccactggagataaggaagaaaaattaattcatttattcaaaaataatatttttattatctcgaaattggaaaaacatgcaattaatgcgcaaaaaatgatggcacagattgaaattggtgcgataaattggaaatatttaaataaaataagaaataacaatttaaataaattaaattatttttagaccaaaatttattaaaccaaataatggcaaatggtttaacaaatgaattcgcctgttgtttaagcccctccttccccaaaatttcgcagcaattaattcgggacgaattcgacgaacaaaactctcaaatagtagctaactggccttaa

SEQ ID NO: 72221 - DNA, 450 bp, Heterodera glycines
  Genomic contig location: Contig_ID=SeqID_44806; Location=4..453; Strand=+
  SCN-specific regions: Sequence locations=1-359,421-450
atgcgatggatcgggcgaactgtgcactcctcggcggatgcattcggcggaggcgtcgccaaaaggtgggaaaaagacaaacctcgggaaagggccatttctttaattatttactcatgaaaaattcattttaagcgcctttggagaggccaaaagatcattcgcctttttgggccatgtccgagcgttggcttattccctccttggcttcccaaacacactgactgcggatgacatgaacgaactgagccaaatgatcaaacatttgaggctgagacgaaattccgatgggagcgaaggagaggacagagacgaggaagagaagtgagagagagcatgaaaatggggtgggggaaagaagggagagaaagggagggagagagagaggggggggggagagacagacagcgaaagagaaaggaatttattagcttttaataggctaccgta

SEQ ID NO: 72222 - DNA, 181 bp, Heterodera glycines
  Genomic contig location: Contig_ID=SeqID_44809; Location=391..571; Strand=+
  SCN-specific regions: Sequence locations=1-181
atggataggcaccgccagttggacaggtcttgcaccttctctggagccccggtcaagggaaacttgaacaagcgggccaacccaagctcacggtctatacgctacacctcgcaaccccagaggagctgcgattcagcgctggactcttcccagttcactcgccgttactacgggaatcctc

SEQ ID NO: 72223 - DNA, 1147 bp, Heterodera glycines
  misc_feature (567)..(567): n is a, c, g, or t
  Genomic contig location: Contig_ID=SeqID_44811; Location=60..1206; Strand=+
  SCN-specific regions: Sequence locations=1-167,189-208,231-327,349 -371,393-918,962-1101,1124-1147
taagagaatttataaaaaatggctaaatacccttggaattaagactaaaccgaaccaatcatatccagtaacatatcttgaaaaatcacgtcagtttggacccttctgtacaaggccagagcccgtggtcacggatttgttattagtatttgaaattggcaaaacttttccattctttgggcagctggacaacaatgacaaagtacagtaaaataaaaaataatttttatgataccgtatttcttgaaatatagcccccgggggcttgatcttgggggctttgtttcaggggggctgtattcagggggtatctaattctggaagggggtctctatttctaaaatttttaaaagtgagtctttatttcatggggtgtctgatttagaggggggctttgtataggaaatgccgtatttatcgatttaatttttatataatcattagggttataatttgtatgattttgcatatttttctgcacagctatgaagaaaggggctcaaaaatagcatttctgcgttaaaattttttgatttggtgaaggtttttagtgcatataaaagcatnattttgggggtttttgagaataagtgcatatttggccattttaaactttgaaaaccaaaatgttttacaattgtctaaaaaactctccttaacctatgttttggagtttttaaagtcaatctgaatttttacacaattttggtatttttttgaaggtcaaaagccattttttggcagtttttaaggcatattttattgcatatttgggcatttttcgggttttttagggcatttttgggggatttttagtgcatattttatgcgcatatttggaattttttagtgcatacaacttataaccctaataatcattcactttgaaaagattgccttgtgcattcagtgtgagtgaattattattattaaacttaatattatttaatttaatatttttggaatttcagtgcatgccattcaaatgggtgacaaaatgatgcgttattccgtgcagccatttgcccgtttaaaactgatcaatgaagaatttgtttttgctcgggcgatcatttactcacacatgggtcaaaatgaccctccattttttaaatgttttattattttaagtgtcgccaaggcttag

SEQ ID NO: 72224 - DNA, 498 bp, Heterodera glycines
  Genomic contig location: Contig_ID=SeqID_9659; Location=875..1372; Strand=-
  SCN-specific regions: Sequence locations=1-76,99-108,130-227,249 -387,467-498
atgtgccggctgcgctggtggcccaacttcctctctattcctgcattgcaattgtggtgagttgagtgattttgatcagtggcaatttgaatgacatcattaatcattcttcccctctttcttttccttagactcatcatggccacttgaactctggccattactgctcgtttgtgcgtgacggcttcactgacaattgggttttctgcaacgacgacaaaactctcgtaagaaaacaatttcgaatcaattaatgccggcttttcatccattctttttaggccactgaaagctgcaatgtggacacgcgaaatgcatacattgtgttctaccaacgcgcaaattcagtcgctgccaaatgagatgaaatgagaggataaacattgttgtatatatgtgtataattgttgttgtatatgtatgtatgtgtatattatcgtatgtgtatattcatttgtatgtatgttcattagtattaatgatgtgttgatgaataaa

SEQ ID NO: 72225 - DNA, 393 bp, Heterodera glycines
  Genomic contig location: Contig_ID=SeqID_9659; Location=1101..1493; Strand=+
  SCN-specific regions: Sequence locations=1-24,46-143,165-174,197 -300,322-393
atggatgaaaagccggcattaattgattcgaaattgttttcttacgagagttttgtcgtcgttgcagaaaacccaattgtcagtgaagccgtcacgcacaaacgagcagtaatggccagagttcaagtggccatgatgagtctaaggaaaagaaagaggggaagaatgattaatgatgtcattcaaattgccactgatcaaaatcactcaactcaccacaattgcaatgcaggaatagagaggaagttgggccaccagcgcagccggcacatcgggcgaaaagtatttgctcaggctgaagttgtccaacgggaacgaaacgggcacgtgctgtttgatgtatcggcgctcaaatggttcatagatgaagcgcttgaagcaaatgatctgtga

SEQ ID NO: 72226 - DNA, 532 bp, Heterodera glycines
  Genomic contig location: Contig_ID=SeqID_9659; Location=1540..2071; Strand=-
  SCN-specific regions: Sequence locations=1-38,102-532
atgttcaacgacgcaacgacaagaaacgccgattcctccgaaaacgaagaagaaaatgatgacgaggatgaagacgatttcgacgaggacgacgatgatgaaccatccgacgaggagacgctgcgcgacattccgctcgacaaaattgacatttggtgcttcatgcggttgttcaaggacaaggacgaagatggacagggcgaccgcctgatttgtatcagcctggcccaggtggggagttcaagcagtaccaggaggacaaccctaaccccatttgacattttgccgctttttttagcgcttcactgatgaatcgcattgcattatgggagcgtcggacgctggtcaactgcccatggatgtgccgctgatctccatcaaccattgtctcgcggatttcatcaaaccggaagacattgaaggctcacgctgtgcacagtgcagcaacgcaacgccaccgccgtctgcgccaccaacgcttgtcaagcagctgatgttcacgcgattgcccgacattttggtgattaattaa

SEQ ID NO: 72227 - DNA, 1229 bp, Heterodera glycines
  Genomic contig location: Contig_ID=SeqID_9659; Location=2147..3375; Strand=-
  SCN-specific regions: Sequence locations=1-30,52-142,164-240,262 -525,548-683,705-870,898-899,921-1031,1053-1127,1150-1182,1206-1229
atgagcacaccatcaaaagcagacgacaaaaagaaggaagtgggcggaattctgaacatcggcaacacatgctgcatgggcgctgcactccaagcattggccaacgtgacggcactcagcaattttctgatgaaaaagtgggtgccaataatgccaatgtccaatgccatcaatttatgttttcacccctctttcagcgaaaaccgactgtccaacatcaaactcgtcatggaatatgtgcaaatgatcaaaagcattttggtgttgcgacaaccggcggcgccattcgaactgaaggtgtggtgaacagtgtgccgtggtgatggtggtgttgcgtttcatgactcgcagttttttcaggaagtcatctccagccttaccaaattgttcgctgattcgttccaacatgacagccaggagttcatccaattctttgtggacgcgctgcacgagttgatgaagggcattctgcgcggtgttacgcaaggcgtcagctgtgacatgtacagaaatgacggcgcgggactgcttctgctggtgctgctcaacgtgacgaccaaatttggcgcaatgcaatcgacgtaatgccaaattttgtgatttttttgtaccgtttaatttggcattttcagcattggagaaacgaagtgctcgcaccaaagaaaggcagcgtggtaagaaagaggagaacactcaattctgaaggcattaaacaatggcattttttcagattttcgacttgttcgccggacagtccgtctccgagctcagatgcccagtgtgttcatattcgtccaagacgttcgagctgttcacaatgctgtcgttgcaaatcccaattccggagaacaccgcaattacattcaacggcatgcaaaaaacaaacaaacattggcattttcaaataaattttctccccttttttcagtcatctctcgagaaggagaccccatcaaatgttcgtcccatgaaatacgccttccactcgccatgaaactgagcaaagtgaagaagatcatctgcagacgagcttacatcagcgtcagcaaggccatgttcatcacgctcaacaagaacaacaaagactacaatgtacagccatcaccaacccaattcaattttcggcacaaatttttgttgagattttgtccgtttttttgagtccattttgaaagcggaaaatttaaatgacaatttatgaaaaaagcgcggacccaaattcaattaaa

SEQ ID NO: 72228 - DNA, 415 bp, Heterodera glycines
  Genomic contig location: Contig_ID=SeqID_9659; Location=4218..4632; Strand=+
  SCN-specific regions: Sequence locations=1-271,294-415
  Gene Ontology: Cellular component=AP-3 adaptor complex; Biological process=ommochrome biosynthesis
atggttaagatgcaattggtccctgatggcacttttcgcaaagtccgtaacaacattgaccgattgtttgacaaaaatttgaccgatttaatccgtggcattcggaacaacaaggaaaatgaggtgatgattgattgactgaatgcaaaagccatttgtacatttacaatttgggcacttttgctgggcctctgaaaaaaaaaattcaagggctcaaccaattacaaatccttacaaaaaagcccccctttggaattttctctcgtgggcctccaacaacagccaaagtgccataatttatttacccaaaatgttctaggcccgttatattgcggcatgcattgacgagatcaaagtggagctacgccaggactccatttttgtgaaggcaaatgccatcgaaaagttggcatat

SEQ ID NO: 72229 - DNA, 702 bp, Heterodera glycines
  Genomic contig location: Contig_ID=SeqID_44812; Location=10..711; Strand=-
  SCN-specific regions: Sequence locations=1-85,107-702
atttggtgcgctttagagcactttctgtaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggagggactgccccgaaaac

SEQ ID NO: 72230 - DNA, 673 bp, Heterodera glycines
  Genomic contig location: Contig_ID=SeqID_44814; Location=179..851; Strand=-
  SCN-specific regions: Sequence locations=1-56,78-673
aaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcgtggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagtgaagctattccggaaggattcggtctccccataaatctgggcgcatcggttcggggggactgccccgaaaac

SEQ ID NO: 72231 - DNA, 387 bp, Heterodera glycines
  Genomic contig location: Contig_ID=SeqID_44818; Location=10..396; Strand=-
  SCN-specific regions: Sequence locations=1-20,42-275,297-387
atgccaaaacaaaacgaaatcgttttaaaatattcctttctggacttgacttggtttcttgatatcgaagctgttttctacgctatttctaaaacggttataccaaacctcagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagtcatttctgggactttttcagaaatcagaattaattctccaatgaggcccaaattttaggcccccagccacagccccttgcggggggggttttaagtcttggatttgtcaaataaa

SEQ ID NO: 72232 - DNA, 1077 bp, Heterodera glycines
  Genomic contig location: Contig_ID=SeqID_115; Location=368..1444; Strand=+
  SCN-specific regions: Sequence locations=1-18,41-769,791-1077
gtagagaaaattttatcgaaaatttattttaatttaaaatctccggcaagttttgctggaattcaaaaaattttaaatgaggccaaaaagattgacccgaaaattacgaccgatgacgttaataaattcctagaaaagcagaaaacatacacgattcacaagcccatcaggaaaagattcccgagactaaagacgataccaagtggcttccataccgattggcagtgcgatttgtgcatatttgaccagttgaaaaagcataacgacggttataaatatttattggtctgcatcgacgtgctgagtcgaatgatcttcagtgcaccggccaagtcaaagaagagtgaggacatgatcgaggcttttgatcgggtgttcgaaaagtctaaaattatcccgatgaaaatatatagtgacagtgggcttgaattccaagcaggaaaaatgaaaaaatattttgaggaaaaattcatcatcaaaaatgtaatgtatagtcctgatctgcacgccggagtcgttgaaagggcaaatcggacaataaaggagcgcttgtacagatattttacaaagaaagacactcttcgatgggtcgacgtaatagacaaaataataacaaacattaacaacagtgtgaatagaacactgggagccaaaccgtcttcaattaattttgaaaatgcccgtgcgctctgggaaaaattatataaggagaaggaatttaaaatttcgaaaaagaaaaaatttaaaatcggtgatatcgttcgtattaccaaggaaaagggaaaattctcaaaggggtacctcccaaactttaccgaagaattgtttaaaatcgttgttgccaattcgacgacacccgattcatacaggatcgaagatttggaaggaaatttaataaaaggcatattttataaccaggaattagtgaaaacagatggatgatttttacattgtactaccttcgaacacaccagggcaggagaacactacgtcaaaattcacagttcgactccccgagactttggaattgggcacaaattggtcagtagctctctcatcaattatttacccctactc

SEQ ID NO: 72233 - DNA, 399 bp, Heterodera glycines
  Genomic contig location: Contig_ID=SeqID_116; Location=338..736; Strand=+
  SCN-specific regions: Sequence locations=1-260,282-399
atggatgatttttacattgtactaccttcgaacacaccagggcaggagaacactacgtcaaaattcacagttcgactccccgagactttggaattgggcacaaattggtcagtagctctctcatcaattatttacccctactcattcaccgcactcggtataaacggtcaagagtttattaaagtatgggaaaacgacatcagtgtccctactcaagtttatttaccggacatgaattttaaaaccgccgggggcctgggaaataaaattaatgaggcattcacacatcattacaaaatcaaaaaacaacgtggaaagagagaagccaaggctgaagataccaagattcaaaaattgatgtcgcaaagagggccgcagaacgcgccgggagagacgtag

SEQ ID NO: 72234 - DNA, 780 bp, Heterodera glycines
  Genomic contig location: Contig_ID=SeqID_116; Location=856..1635; Strand=+
  SCN-specific regions: Sequence locations=1-308,331-588,610-780
atggttgagatgggaaccgaaattcaaacatcccgaaatgaacttaaatcttttcaagaagaagtagataaagccaaaaacataacattggagcatgtggaaaagaatgacatgaaagaagcaaagaaatcagccgacgtcgcaaagggaatcgccagacaggcaaagaccaaatatacatcaactctcgaggaatataatgataaatcggaaaagggttttagcgggatggtggttaggcttaacgaggcgctcggtgagcattttaaacgtaaggaaattgaaaataaacaagtttcagaagctgaaaaagggccgcaaaaaagagagagattagccaatgaggatgttcaatttaactacgacagtattgatcaaaaatttattgtctatctttcctctgccgtcacccatatagatttgtcaaaacacctcgcatatgttctggggtttaagaatacaaggctatttcacgcggaagaggcgacttatatgccggatttgacgggaggtgtaaggcagctatacatttatgcaccaaatttaatcgaaaacacaattatcggcaaccagatggccccactcttaagaatagttaacgtcgtcgatgacccgggatcaattagtgaagttatatatagcaccgagtattttcatcgtctacagtcgaaacgaatttcagaaattacaattgaaattcacacaccgtttggtgaattcgttaaatttcactggggaagttgtattcttacattacattttaagaaaagtatattttaa

SEQ ID NO: 72235 - DNA, 2044 bp, Heterodera glycines
  Genomic contig location: Contig_ID=SeqID_117; Location=4277..6320; Strand=-
  SCN-specific regions: Sequence locations=1-75,97-304,328-492,517 -1184,1206-1343,1365-1682,1704-2044
atgaatgatagtattttaggattaatcggggagggcgttgagacttttaacgggattccggacatgaataagattaaagaacaggaaaaacccattttactgatacttgacgatttaatgcttaatatgcagaatactttcctcgatctactctttaccaggggctcccataattggaacgtaagcgtaatttttgtaacccagagtctctatggtagggacatcaaaacggcaagagcgaacgcccattatctggttttaatgcgtaacccttcggacaattacaagtgaggacactggggtcacaactgttcccaaaaagactgaattatttcatggatgcatatcatgatgcgaccaataatcaagctgaagggggacaaagaaatgcaggaatttttcgacgacagggggaacgagaaagggccgatcgatccgaggatggcgtatgcgggaggaagaacagggcctctgagattgtttgcgcagtccgacgagaagaagaagatctcggtgtttgatatcgtcagtttgtatccgtcggtgaattatgggacagcgtaccagattggagtcccggagattgtggtaccaaaaggggattagatcaatgtggagtggacaaagcctgatgatttgcagtacagagggttgtataaagtgagggtgataccgccgagggcgttgtgagttcctgtcctgcagttgaagtgtgatgagagattactatttccgctgtgctggaggtgcgcgtcgatgtttaagaaggagactacaagatgtggccacaaatgcccccatgatgacgcacagcggagatatgtggcaacgtatacaagtttggaattggtaaaaaacacccattaaacgtatttaaaaatttatgtttaggcaaaagcatttgaatgtggttacagggtggacagattttgccgggcatggcattacgaagcgacggatgatgatttattcaagggatatgtgcggctattcttgaagttgaaggaggagtcaagcggatttccgaaaggagttgagagcgatgaacagaagaggcaatgggctgaggaatacaaggaaaagtacggaattgcgattgaactgagcagggtgcagaagaatccggggttgcggtatatcagcaagcttatgctgaatagtttatgggtatgaaatacgaattcttagatctgataaaatgttaatttttaggggaaattttcgatgagaaattcattgagcaagaatgcggtgattgacagagagtctgccttttacgagttggcgtgtgatcataaggtggagttgtgtgacattgtggagtactcgggtgacgcgatgcgggtgatctacagggacaaggaggagtttgttactgagcacaagtcaagcaatattgtggtcagcttatggtaagtttttttttgaaaaaaagcgagaaaatataattttaacaggacgacgagcatggcgcggttgaaattgctggagtttatgatggaggcggaaaggaatggcggggagattttgtacacggacacggatagtatattcgtgtttcatgacagaggagtggagccaataacgacggggaaataccttggagagatgagtgaggagtatggaggttacgaaattgaagaattttgttgtggtggggcgaagcagtatggtttaaagatcaggagcaaggagacgggagaggtcgattacgtgatgaagattaggggtgtgacgtttgatgtggacaaccggaaggcgttgcattacgatgcgtttaaggagatggtgctgaattatggaaagggggaagtagaccccgcattctttgtttacaaaaatgattttgggtatgttttttgaaaatttttttaaacaatctcatattattttagtccaacgcgggagtcgaaggtcgtgacgagggagaggcacaagatgtacaagccggtctgtcagaaggggattattgatgaagaattgaatgtgatgccatttggattttgttaattttgtattttatttttgttttttgttaaataaa

SEQ ID NO: 72236 - DNA, 2955 bp, Heterodera glycines
  Genomic contig location: Contig_ID=SeqID_118; Location=75..3029; Strand=-
  SCN-specific regions: Sequence locations=1-444,467-626,687-1487,1519 -2374,2398-2661,2683-2928,2953-2955
atgtcttttaaacgcgtgaactctgtccaacccactgccgtgccaatggccaaaaaatgggacttccgctcaatcgggtaagtttaataaacaataacatataaatagctaatccgttttagaaataatttcccgatggagccctttaaacttattgaccaccaaactacaaaatgcgaaaaatttggtttcacgaaaaacataacggaatttgtgatcaacccggatgtggagcgccccgatgaaacactgcgagaagcgatcgatatcatgataaagaattccatatcgaagacggaggagacaatggggcgcaaagtgaaaatgtttggtgtggcattgactggggctggacttggacacccaatttggctgccgtaccgacccttcccccaaaacaacgcggatgttgtcatggaggaaatcaataaattggggcagagcggaggagaagaaggggaggaggacaaaagaacaattctgctttcggaatcaataaagatgaaggtcacctgtgtagcgctgccagctggagagggaccgcgaaatgtgcataaattcgattttggtttcaaggaacagcagcgaattaagtaggcttgagtgatcttagattaaattaaatgaataaaaacaaaaaaaaaacaaaaaaaacgaaaaaattaaggatagagaacaatgacaaattttgcttgttttatgcgctgctggcggcgaagaattatctgatgatggatcgtttcgcttttcaacgttttataaagaatatttcgaggcagagggaggcagcgtttgaacttttgctaaattcgggagtgcagaggaatgaaagtggctatggacttgagcatttggtgatggttcaggctcattgggttagttttggagaaatgatgagaaaaataaaagtaattttaggacgatttgaatccgggaaagtacaggattgtggcatttgagaaatctgcggatccgaggaaatcgattcgcgtgctgtggaagggaccgatggcccgggagaaggtggtgccgatatttttggagggaaatcattgggacggattgaagaattatgtgagctttttcaaccgagggaggaagttttgcattgattgcgaatgtttttattcaacggaaagcaaacatacgtacgagtgtagggcccggtgttattactgcaaccgagttgggggcgtgccgtgtgtgaaggatgttggagtgaagattgagtgtccacattgccaccgctttttctacaaccggcaatgctacgattaccatcagggacaccaaacttgcatgttgtggaggcgatgtgtgatatgcagtaagacctatctgcataacccacagaagctgcatgaatgtggggagatgttttgccggctgtgcaatgtttgtcatgatgtggagaggggatgttacatcagaccgatcaaggagagagaggacaaggacatttacagaattgttatttgggtacgaagagaaaaaattttttagttttcatttattattcaggattcggagacttcacaggacacaatttacaaggaggatcaaatggagcatgtcatcaactacatttcggttcgagtgacatgtacggagtgctgcgacgacaaggagaggacaaattgcaacatttgtggggaggagagggaaaaggattggagcgaggctgaggggcatgaaccgaccaaggactttgtggagtggattttgacggcatttgtgaaatacgacacctacatttttgctcacaatgctgggcggtttgacggtaatttgatgattatcctgattttgaaaccctccattttagggcattttgtgtttaattatctgtgtcggaccggcaggactccgataccgctaattaatgggatgaagatctatgagttaaagtgaagaattcgaagaagcattctttattgatatggagggattcatgtttgctgatgcccgtcaaacttgaatcgttaaagtcgacgttcaatttgcagtgtgaggataagcccttcttcccctactattacaacagaagggagaattatggagttcgtttgccgcatttaccaccgatggaggattattcgccaggatcaatgaggaaggaaaaatttgaaaagtttgagaaatggtaaggtgaaaatgtgaaatattgatcacccataattttaggtataatgagaatatggaaacgtcgttttacttgcccgaggagttgaagaattattgcaggaatgatacggaaatattgttgggtgcggtcgttgagttcaggaggatattgataaatgagataacgaaaggatttgacccgttgccgaggagctgtacgaatgctggcatcgccatgaatatcttcaaagcgatgtttttgttggaggaacaactgtcgattgtgccggaacgggggtatgagcggaacgatcgcgcgagtgtggtggcaataaaatatttggaatggcggagcaagagggatgccgtagagataaggcatgcgggcaacggcggggagatgaaaatggggaagtacaagctcgacgggttcatttcacagatggacgggagagacaaatgtatcgaagtgatgggctgttacatccacggttgtttgagctgttatgacccgtcggcggatttggttggaggaagaactgcgcaggagctgaacgatgagacgcaagaaaggttggcggaattgcggcaaattctggatgttgaagaaatttgggtgagtaatgaagaatattttaaaaaactggccaattattttagggatgtcaaattgagaaagagctgaagggggacaaagaaatgcaggaatttttcgacgacagggggaacgagaaagggccgatcgatccgaggatggcgtatgcgggaggaagaacagggcctctgagattgtttgcgcagtccgacgagaagaagaagatctcggtgtag

SEQ ID NO: 72237 - DNA, 302 bp, Heterodera glycines
  Genomic contig location: Contig_ID=SeqID_1306; Location=292..593; Strand=-
  SCN-specific regions: Sequence locations=1-302
atgaacgcaccaccgtacgaaggcgacagcgattatgggccgacgccaaaaagacatcggccgatgccattctttgaggaggaaaactttccgatcggtggaagcgacgacttaagacaacacacacagagatttgatcagtcatttgatcagagtccgtacgagcaacaagaaggtgccgaattaacgagaaaaatatacggtggagttaacgaaggaagcagcatccataagcttagcttattttaattatcaagccaactcttgcaattggtggcattcgaagctcgacgtaaaataaa

SEQ ID NO: 72238 - DNA, 327 bp, Heterodera glycines
  Genomic contig location: Contig_ID=SeqID_1307; Location=354..680; Strand=-
  SCN-specific regions: Sequence locations=1-183,205-327
atgacgggttcacatgagcaaagtgacaaaatgggagggaattctgcgaacgatgtcgaggaaggagagttgccagaggagggcgaaatcatggacgaagaagaacagcaacacaaggggaaagtcattacgatgaaaactgaagcggaagagagtgaccgagccatgccaacgccgcaacagcagaacactccatcgaacagcaaaacggaaagtggcagcaaagactctcgaggagatgccggagggtcttcgtggcgcagatgtagggacaaaccgaacagcaaggaacaaatgataaatcaaaacatccgtttccagcgttaa

SEQ ID NO: 72239 - DNA, 1084 bp, Heterodera glycines
  Genomic contig location: Contig_ID=SeqID_1308; Location=842..1925; Strand=-
  SCN-specific regions: Sequence locations=1-180,203-329,352-705,727 -741,771-1084
  Gene Ontology: Mol. function=actin binding; Cellular component=actin cytoskeleton; Biological process=female meiosis chromosome segregation
atgcttcgcgaagcggacaaaatcgcatgccgcgaatttgtcactgccgacgatgtggccaagggcaactacaaactgaaccttgccttcgttgccaatctgttcaacaaattccccgcccttcccgagccgggcgctgatgaaattcgtatgaaaaaaatgagtaaaaatgtgcgaatggctttttaattcagcacaaattaccgaagtgacggaagagacgcgcgaagagaaaacttatcggaattggatgaacagtttgggagtggacccttttgtcaaccacatttactcggatctgcagaatggcctcgtgatttttcaagtgattttaacttttaattcaaagcattatcggtcagagtatattttacgttctgtccaaaatgtgtcagttgtacgaatgcattcgtcctggaattgtccagtggaagcgggtggtgaagcagttccgcaagttacaaagcatgatggaccaaatacaaaactgtaactacgcggtcgaattgggcaaacagttgcgcttttccctggtcggcattcagggcaaggacatttacgacgcgaaccccacactcactttgggtcgacactctttgtattctttttacaaaaagttatcttttagcactcgtctggcagcttatgcgggcgtacactttgactattttggcacaatgcacacaaagcggcgaaagtttggccacagaaaaagaaattattgtttgggtcaacaaaaaattggaagagtcaggcaaggtttgtcgggctgcaactaattgacatctatttgaagtggggtttattttagacaagccgactgaagagtttccaggatcagacaattgcggatggaagagttctgatcgatttgatcgatgctatcaaaccgggaacgatcaactacgacttggttaagaacgatgtgtcagccgaggtttggagaattaacctttatgagccagtttgtaattatatacaaatttagagcaatttggaaaatgcaaaatacgccatcacttcgggacgaaaaattggagcgaaaatttacgcattaccggaggacatcgttgaggtggattga

SEQ ID NO: 72240 - DNA, 73 bp, Heterodera glycines
  Genomic contig location: Contig_ID=SeqID_1308; Location=6372..6444; Strand=+
  SCN-specific regions: Sequence locations=1-73
atggctcttcgtattgtcaatgttttgctgttcgccgtcacttattttgcttggttttgtgcatttatcgcag

SEQ ID NO: 72241 - DNA, 878 bp, Heterodera glycines
  Genomic contig location: Contig_ID=SeqID_1309; Location=273..1150; Strand=+
  SCN-specific regions: Sequence locations=1-383,424-481,505-772,794-878
atggccaaagtgaatgaaaatgtgacagatcaatttgagttacttgtgccaataattgaaactattcacaacgattgggacggggactggcgagcggacgaagttttttttttttttggctatttccatctaaaaatgttaaaaccaattaagatcgaaattcgggtcgctttccgacacaaaacaaattcgaattcttcgccgtcattttcgcttaatttcaccgcattttcttatgcattgttttttgatgtaaaattggagaaaagaacattagttgaggtgattgtgaaaaatattatgccacaaattctatctttcagctcaaagggacgccaatttttggaaaaattcaatcgaaaaatccattcaacgaaatacagtaagaaaaaggaatgtttctttaatttaaattacttttatccattcaaatttttagtgtaatcggctcaatggattttgttcagcgtaattttttgccagcctttggaaatttaacttttgctcaatggtccgcacaattttctgcggatggatttccttcaaaatcctcaccagaggaaattgactggcaaatgcgcaaatggtcgatggaacagaattttagcattgttttgggcaggtgaaaacacttaaattataaaacaaaaatatgaaaaaatagaaaaattgaacgcgttcggatgacaactcatcagagacttggcggtggcattctttgccaattcgtttttcatattcgaataagcgaacagaccctacagtacaggtttacttggaatttggtacttgattacataattttcatacagaaccaatgcttgggagatggtcaaatgggcgtgggtacagtacttggctctgtttgtcgttgtacg

SEQ ID NO: 72242 - DNA, 2182 bp, Heterodera glycines
  Genomic contig location: Contig_ID=SeqID_9660; Location=63..2244; Strand=+
  SCN-specific regions: Sequence locations=1-613,636-666,688-991,1014 -1482,1505-1566,1609-1881,1905-2036,2059-2182
atgttggatcggtacgagttcgtcaacgacctttgtgatttgctgcccgaattcgcaaatttctccatggaacagccacaaactttccgcgcgttgctcattctgatctcccaattcctcgacgttgtcacccaaaaccttttcattgctcgtaaagttgcccacattttgtgtgctcggctgaatcagtataaaaaggaccacgagcgcatcagagagtcgggaatttagagcgtttttgactccgttctcaacccttttcagtaccacgctcaaagaatctgcaaacgaatgtttcgaggacttggtcaattgtcaccatcacagatcgactgtcctcacaatctttggcattcttcatgcgattgtcatcgactgtccttcggcattggtttggactccatttgagtcgaacgaactggccgaggggcttcagtcaaagtttaagccggacagaaatggaaattccaaatccatggagagagaaagcgtacaaaatagcgttgcctgggtaagttatgcggggtaatagtccagtttagctcttcccctatttttcaaaaaataaaaagttttgtaaaatgcctttcctggccgcattttgtgattgctgttttgtgtatttgaatctgaatcattaacttgtaccgttatgtctgaatgttaaatttgccttttgcttttccttagctttgtaagtcgcctttggacaatcttccatgcgaattgagcgtgaccactcagcatttggcggcacacgccaaggccgaactcgaccaacttctgagcatccgaagtgaagagattaaacagcggagtatggccatcgaacagcggtggctgcacatcagtccgacgaacacgcggtccggactcggtgagccatggattattgcattaaacggaggacatttatttcatttaattgacttttctcttttttaatgtgccttaagattcggtcgtcgagaattgtctggacgttctctcctttatggacaccgtcgacctcggggcagtcgatgcgctattagtcctttacaataacatttttagcgaagaggtaaggtattcgggtctctgctattcatccaacttttaacttaaaaatggtcgtgctttatccttgtttatacaaagcaaaccatgataaacagcaaattaatgggtgattttcagaatgactgtttggatattaccattcgcgtcctcatcaattgggctgttaccagtgagcgtgaaggcactcaccgcggacttatcgtcgctcatttgctcaaaatgcacgtcaactttgctcaaaatgataacaaaaagcctccgtttggccatggcttttcgtctctgcaggaacttttggtggactgtttgaacagagagtgggcaaatccgaatggaaaggcaattgcaaattcggcggttagggcggcagaatttgccaatttgatgctgctcttctacgaattgcaacgtttcggtaccaatttgcattattttaaatttgttgctactaaatttgctttttaggtcttttcagccacgacaaatacgtcaaaggttatacagttcatcaggaccgtcttcgcattttatttacattatttatttagcactgatgcgcgacgggactctcgacagtcgtggccttttccttcgtctgaatttgcgttcgatgtccgttgccgcccctaatgtcggtaaatcggcgcctcattccgtcgacgaacgcacaaatcgacgtcaaaacgtaccgaatgcatcgcaaaatgcacaattagcagccgtacaaagtcaacccgagccgaacataaaacaggcgagaaaactgataaagaaccaatggacgatggctaatttaagttgttattggtttaggagcctcaaatgattatttcattcattccgatgtccaaaccaaccacgacgcactcatcactcaccagcactaccgttgaacatcagtttaacggcactttaccaccaccaagtcaacatgtaccaaattctcaaacaccaaaaccagtggaagaatttgcaaaacttgctcctcaatttgaaactgatagtcatccctttttggaggaaccgtccgcattgaggtagagattagttgtcctctatgacgggctttttggaaactttgggtttgatcgttttagcaattaacttaacagaaaaatta

SEQ ID NO: 72243 - DNA, 1297 bp, Heterodera glycines
  Genomic contig location: Contig_ID=SeqID_9660; Location=2343..3639; Strand=-
  SCN-specific regions: Sequence locations=1-404,426-870,892-1297
atgggcaaatgccaagtgaaaagtgggaacccacaggtcggtgagtgacagtgcgctgacatcgtccgcaaattgttggcggtattcgatgttggtgcccactgaaccggcaccactcggagggaaaagcgcttcaaactcttcactttggccgagaagttggacaacgtcgtcagggccggccccacgcacgttcaatttggagacgagcaaaaggtgacgggcgtggtagacgaacatcgccacggccctgccccaccccgaaccctcgccgccttccttccttcggacggtcaattcagtttcaacgagacggtaaaaatcgtttattattgagcacgcttccggggaatacaaaaaataaaagaaatgttcagccaaatgcgacgcaaggacaaaagcatactaaacaaagggaagggggaattaatgacgaataataattgacaaattaaaaatcataaaaataggtaaatgatacttgagcagaaatagaggcagaaaagagatcggtgttcaattggtttcggagaatgaaacgcaaatggacgagaaggggcaacaactcatgcgcaagagagacgatgttgttgaaggaccggcaaatctaaagaaaataaaagtaacacacacataggaaaggaccaactgattagtactgtaaaagtgagtggtaaatgccaaaaacaacagaaatcgacatagttaggcctcaaatttggtcgtttgccgatgtgcgtccccgccttcatttaccgtgatcattgtgcacaacatgtccaagcactcgtgcgttggcaccgaaacattggcagttggtgccccgcctttgatgctctcttgtgccaattcctccgcttgtttgacaaactcttcgattgagtccaaaaaactttctgcgcaccatccgcagatgaccaattggtcgtagtacgtctgtgcattgaaccgtcccatcagttcgttgagttgttcggaagaacatcgccttttgtagcgaacttccgaatggacgacggagttcggttggagagaaatggtcaattcgaaagtcattttcttctgaagtataatttatagataatccccccccccatttaaaaacccaaattttgcagatttctctagcaattttcctcagttcctgccgtgcactatcacgatgttcggaaatgccgtagagaacaatggcgcgttggttgcacacgtccctattggcttcaatctgttcaacgggcaaatggacgataaaacgttcatgaaaactgaaaaaacgaagaaaattatagagtggtaa

SEQ ID NO: 72244 - DNA, 70 bp, Heterodera glycines
  Genomic contig location: Contig_ID=SeqID_44822; Location=573..642; Strand=+
  SCN-specific regions: Sequence locations=1-70
cggtaggggtcaactccgtctggccaactccgtctcagcaatgttcaaaaagctataacttttttctttg

SEQ ID NO: 72245 - DNA, 621 bp, Heterodera glycines
  Genomic contig location: Contig_ID=SeqID_44829; Location=65..685; Strand=+
  SCN-specific regions: Sequence locations=1-71,102-185,235-240,342-621
atggtaaatcaaaatcctaataaaaatttcgttgaatttcttcgcctcttatttgtgcaaaattttcgaaaaagtaattttctatttaaaattaaaaaattcagaagcaaattcaagaattttttttatttttaaatgcattttttaccacatgaattatgattaaatttttgcgtttcgaattcattttgaaattaagaaaaataaaaattgataatcatttgatcatttttagcgcactttaagcaccgccgttaggcagcgcagttccaaaatttattccatgccacagatattatgggcaggacacgccaagtacctcaaacttgggtaattaaaccaaagaaagaagtgcagtggggaagaatgacgcccaaaatgaaggaaatattcgatgctgtgcgaactctttgtgacccctctctgactctgccaatgcagcagtttacaatttttaccactatttttctctcactcatcgtctgctcgtctctcctttattataagctattttccaaagccaacgcccttcttctgttagtcatttctcattggtgttgacgatccaacattcagtgtacaaatttgttaaacctctcaacattttaaatcaaaatccta

SEQ ID NO: 72246 - DNA, 80 bp, Heterodera glycines; identical to SEQ ID NO: 51817
  Genomic contig location: Contig_ID=SeqID_44829; Location=293..372; Strand=-
  SCN-specific regions: Sequence locations=69-80

SEQ ID NO: 72247 - DNA, 80 bp, Heterodera glycines; identical to SEQ ID NO: 51817
  Genomic contig location: Contig_ID=SeqID_44829; Location=895..974; Strand=-
  SCN-specific regions: Sequence locations=69-80

SEQ ID NO: 72248 - DNA, 371 bp, Heterodera glycines
  Genomic contig location: Contig_ID=SeqID_44830; Location=628..998; Strand=+
  SCN-specific regions: Sequence locations=1-371
atgcacgcgttttgcgctcgagctatttatcatcgggcttgtcaatccaaagcgaaacaacaaagatgctgttttgaacgaataaagggcataggttattttgaagaagtgtcaaagaacatgcagcaaataagcctgcaaaatctaataagtggaaaatacatgagtatagaatttattttcagaaagtgtcaacagacttttggaaaaatatatttgcaatttatcaacaattttgagaagtgagttagaaatgataaacttcacgattcaaaccaattttcggtgctctaattaaccgcgataaaaacatccgaatcaattaaatagcttctgagataataaggtttatcataaaatttcatttaaaa

SEQ ID NO: 72249 - DNA, 403 bp, Heterodera glycines
  Genomic contig location: Contig_ID=SeqID_44831; Location=1..403; Strand=-
  SCN-specific regions: Sequence locations=1-31,53-126,155-258,280 -295,317-357,379-403
caaaagttttttacaaccacatattgccaatctaatttcttgcagattgaaagccatccattgcctgccggttctcggcacagcaaagcactaatagggtgtttgactcacttcaaaaaataattcattacccaaaagttttttacaaccacttattgccaatctaatttcttgcagatttaaacctatccattgcctgccggttctcggcacagcaaagcactaatacggtgtttgactcacttcaaaaaataattcattacccaaaagttttttacaaccacatattgccaatctaatttcttgcagattgaaagccatccattgcataccggttctcggcacagcaaagcaccaataggaaaaagactcacttcaaaaaataattcattacccaaaagtt

SEQ ID NO: 72250 - DNA, 1160 bp, Heterodera glycines
  Genomic contig location: Contig_ID=SeqID_9661; Location=166..1325; Strand=+
  SCN-specific regions: Sequence locations=1-173,196-294,373-717,750 -1160
atgctgtacctagtcaatgtagccacccaattcttcgtgctcaacaccttcataggtcgaaacaacagaatgtggggtttcgaagtactcgaaaatctttttaacggagagaagtggcaggtgaattaattgagtgttttgtcggttaaaaatttagttctttatttagcaacaaaaaattaattatattaaatagctgtattactataaatgtttggcttaccatgctggtttatatctaattcttcaattttgaagggattagttaaaaatgggaaaacttttaatgtttagtttttttataatattgaatgttttttaataaaaattacagtaattttcattaaataatttaaaaaataaaataaaaatcctatttgcttatttccttccaccctttttgtgtgcttttaggactcgccgatttttccacgacagacgatgtgtgacgtgaaaattcatcgcttgtcgggcacaacacgctacactgtccaatgtcatctccgcattaacgagtatttcgagacaatctacctgttcatttggtgattttaaaatttattttacgggttttaaatatcgacttatcatgaataagatatttattttgacaacttacgtcaaatctgaccaaagattagtcaaatttagaagaattttttcatttttaatagttttgcagtttgcccatgatttttaaaataagattcctcttacttatttattttttaaaatattaattataaaaacgtgtcaaaacaattgttcaatatgcttaatacaaactcatttttttggagcagggagagtaaccatatgaagtgccaaaaaatcctgttccttttctccaggtatggccttggcctgatcgtagtgcttactgcagtaaattttgcctactatgtttttgttctgctgctgcttccgtcgacgcaggagagctcggtccgcgacatgttgatgcaggacaagcatcttgaaattttctacaacaacaaacaccatgaacacccacttttcagccgcttttcccagcacgcactgcgcaaggacggagtgagtatgtggcatggtggtgttgtacagtttggatgcatgtgtattaaattttttgcacggcgatgagaaaaaagctattaatgattctgtttccctaaaaa

SEQ ID NO: 72251 - DNA, 235 bp, Heterodera glycines
  Genomic contig location: Contig_ID=SeqID_9662; Location=57..291; Strand=+
  SCN-specific regions: Sequence locations=1-70,124-235
atgatcctacaactttgttttctcaacgaaagaaaacacggaaaaccgatagtgatgcgcgagttgtgtctaattaatttaatttttgaaaatttcacaaaaaattcttttataaatatttttctttagtttgatgaagcatatgaaagtgaatgtggaccgaaattgaaaaaggcgtttttaatttacggcttttgtttttgattttgattatcatttttatttctaatttaca

SEQ ID NO: 72252 - DNA, 388 bp, Heterodera glycines
  Genomic contig location: Contig_ID=SeqID_9663; Location=1433..1820; Strand=+
  SCN-specific regions: Sequence locations=1-365
  Gene Ontology: Mol. function=signal transducer activity; Cellular component=intracellular; Biological process=muscle development
atggccaaatatgtcggtgttcggggtcggggcggggttaaaaccctaaattaaataataacaattcaaagtaatgttacagcgcggaattttgtacgaggacccggattacggtccgaatcaaatccaattgcacttcaccaacaacattgaagtgccaatccaatggttgcgccctcaacaaatagttgatcacccgcaatttataaaccaaatgccggagccacgtgatgtcaaccagggcagtctgggagactgttggatgttggcagctgcatcaatcctggcgcagcatgggcacctgttttacagggttgttccgcccgaccaaggattcgcgatgggatatgccggtaaaaatttcgttttaaataaaaataaaaattag

SEQ ID NO: 72253 - DNA, 174 bp, Heterodera glycines
  Genomic contig location: Contig_ID=SeqID_44832; Location=598..771; Strand=-
  SCN-specific regions: Sequence locations=1-174
atggatgacattgtgtccattgactcagtgcagccgattgatcagctcagcttttggtgtttgactttgtccgccatgctcaaattggtcgccgtgggcgtcactttgttcactttgccgttcaacgaatggattttgctgcagggagcccaatttggcggagtgaaaataatc

SEQ ID NO: 72254 - DNA, 694 bp, Heterodera glycines
  misc_feature (39)..(39): n is a, c, g, or t
  misc_feature (41)..(42): n is a, c, g, or t
  misc_feature (46)..(48): n is a, c, g, or t
  misc_feature (51)..(51): n is a, c, g, or t
  misc_feature (54)..(54): n is a, c, g, or t
  misc_feature (56)..(58): n is a, c, g, or t
  misc_feature (66)..(66): n is a, c, g, or t
  misc_feature (86)..(87): n is a, c, g, or t
  misc_feature (89)..(93): n is a, c, g, or t
  misc_feature (100)..(102): n is a, c, g, or t
  misc_feature (105)..(111): n is a, c, g, or t
  misc_feature (113)..(113): n is a, c, g, or t
  misc_feature (117)..(119): n is a, c, g, or t
  misc_feature (123)..(123): n is a, c, g, or t
  misc_feature (125)..(125): n is a, c, g, or t
  misc_feature (127)..(128): n is a, c, g, or t
  misc_feature (131)..(133): n is a, c, g, or t
  misc_feature (147)..(147): n is a, c, g, or t
  misc_feature (153)..(153): n is a, c, g, or t
  misc_feature (161)..(162): n is a, c, g, or t
  misc_feature (166)..(167): n is a, c, g, or t
  misc_feature (171)..(171): n is a, c, g, or t
  misc_feature (177)..(178): n is a, c, g, or t
  misc_feature (181)..(182): n is a, c, g, or t
  Genomic contig location: Contig_ID=SeqID_44834; Location=334..1027; Strand=-
  SCN-specific regions: Sequence locations=1-343,365-389,418-610,632 -658,680-694
atgcctgcaaaattaggagagatatatttacttgggtgngnnaggnnnganganannngggaaaanatcttgctaaaaagggaagnnannnnngaaggannnggnnnnnnnanaaannngggngnannggnnnggggggattgtttngaaaanaaaaaaanngatnntttnaagggnnagnngggggtactcaaacaattatggggagcaaaaatccaacgcagaattaaagtattaaaaatttttagattttttattcatctccctttttgatattgaaagcatctgagtgcctaaaataacttgtaaataaaatttgatgcgtttcagagcagtttctgaaaaaatatttatgaattaattttgctaaaaaaataaaatagtgaagctttaaaaattaataaaaaattttaaattcagaattactggagttagcatcatagcagtgcttttccttgtctttttgatgctctcgcaaaatctggttcgcttctgataagtttataaaaaaaagttaagcctaaaatttttcgcatatttaaaaagcaattaaaaatttttagattttttattcatctccctttttgatattgaaagcatctgagtgcctaaaataacttgtaattaaaatttgatgcgtttcagagcagtttctgaaaaaatatttatgaattaattttgctaaaaaaataaa

SEQ ID NO: 72255 - DNA, 973 bp, Heterodera glycines
  Genomic contig location: Contig_ID=SeqID_44839; Location=141..1113; Strand=-
  SCN-specific regions: Sequence locations=1-21,43-478,514-648,684 -811,838-934,966-973
aagtgtccgtttggggtactcaaacatttatggggagcaaaaatccaacgcagaattaaagtacaggctatagggaagatactccggaaggattcggtctccccataaatctgggcgcatcgggtcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattccggaaggattcggtctccccataaatctgggcgcatcggttcagggggactgccccgaaaacccaaaaaaaaatttttttgaataaaaattatttaaatgaactgactagataatatttaaaataggttatttctcttcctttcagtatccctgcaaagtttgctgcgcttctgatcagtttctgaaaaaaagttaagcctaacatcggttcagggggactgccccgaaaacccaaaaaaaaattttttattgaataaattatttaaatgaactgactagataatatttaaaataggttatttctcttcctttcagtatccctgcaaagtttggtgcgcttctgataagtttctgaaaaaaaagttaagcctaaactttttggcctgtttaaaaaggaattaaaaatttttaaaaattttattcatctccctttttgatagaaaaagcatcagagtgcctaaactagcatgtaaataaaatttggtgcgtttcagagcagtttctgtaaaaatacttatgaattaattttgtaaaaaaataaataaataatgaaagact

SEQ ID NO: 72256 - DNA, 731 bp, Heterodera glycines
  Genomic contig location: Contig_ID=SeqID_9664; Location=168..898; Strand=-
  SCN-specific regions: Sequence locations=1-240,269-731
atgttcgtcctcccttccgtgctgcttcttctgctggctccctttgctttttgtcaaaatgcgctgctcccaatgcttttccaagctccgccccaaccgcaagagcaattgccgcagaaaacgccgcgagggcacacgccgcacgaaaagatgaaaatgtgttgtgccaagttggatcaggcggacgccgactgcaaaaaccgtttctgcgattggaatgcgctcagttcgaacacagtgaactaattaattagttgattaattaattgggaagggaacaaaaaagggatagacagcagcaattagtctcaattagtagggagttcggtaggaatttttcctgtataaattattacagccccattggttccgtcattaaaaagggcatttttggaatggcacttccgcttaattgccggccaccatccattaaagattctgattttcctctccacgtgcgtcgcgcgtggtccaaccgttggccaaatgtgggactgcgcgtcaagtcgcgccgatcaccgcgaatgctgcagaatcaaaggtcggagaagtgggggaggggggcggcagagaggggaccaatggcactttttgaggaattcaaccgggctgtatgtcctactgcgagacgacaaacggagtgccaactgactacttccgctatttgttttgcctgaacgatttcaacaaaattcgcgattggtcagtggcaattctaattcataaataaa

SEQ ID NO: 72257 - DNA, 913 bp, Heterodera glycines
  Genomic contig location: Contig_ID=SeqID_9664; Location=1662..2574; Strand=-
  SCN-specific regions: Sequence locations=1-8,77-781,803-860,882-913
atgcctttctcctcctcctctttctcctcctcctcctccctcctttgcttcttcctcttcctttttgtcctcccccacttttcctttgtctcttccgccgatgccaatgccaaactcaagaagtgttgtttaacactgaccagcgaaaaggacgacaaagactgtgtggcccgattttgtgattttgatgcgatttcgcaggcgaatgtaagcggagaaagcaatgaattcgtttcgccaattaaattcgaaatgaatttaaggtgttgaacttcatgtcaaagtgcaaagacaaaggcgatacggtaattccaacaaaagtatacgatagcaatgacatgaattattagccttcattcattattactgatcaaacattgctcaaatgattgtgtaatggagttaattcccgtgtttttctcactcaatcgctcaccactttatgactacggttaaccctgtgatacagtatcccctctaggtcggccacatgtgggactgcgcgtcgagccgatttgaccacacgcactgctgcagggtttgcctcagtgattttgcttgtttacaatgttgaaccaaattcacagggcaaaggcgtgtccgacaagtgcatggagtactgtagtgcccaggacggagtgccagaaaattacgtggactatgtgtacgcatttccgactaattacccctctaattgacacgcaaattaattgaccacccaattttcagggcttgtgtggattattttgaccatatccgcgattgtttcaaggcacatttggagaataagaaagaggaaaaatgaatggagcgaaacgccgccgagggaaagtgcccaaaaaaacggacagtgccattttattatttgccaattttaaatgaccctttttaatttatttgccatttgaataaa

SEQ ID NO: 72258 - DNA, 479 bp, Heterodera glycines
  Genomic contig location: Contig_ID=SeqID_9665; Location=1719..2197; Strand=+
  SCN-specific regions: Sequence locations=1-362,386-408,435-479
atgggaaacgttgagaaaattggacggccagcagaagcggtggattacttttgtgtacaacgcggaggagtaccaattcgccgatcagtgcgtccaaaattaaattccgatcgaatgattccccaatttcttcctaagaatgcttccaatccctcgtccactgatgccaaaccgtccggtgaccttttgcacgaacattcgttgccttcacccagagaaacaactcgtggaggaggaagtgaaattagtgttgtgccgagaggacaggtcgagaccaatttggacggccaacttccaaatgccattgagtgaagcggagattgtttagggtggcaaattcaacaagtggtagaattggcatacattttaccatttaccatttatatgaaaggaagccaaaatattcccagacttttttaaattgtcatatttttattttattaatgaatttcatatacatatttgaatgatttagttga

SEQ ID NO: 72259 - DNA, 59 bp, Heterodera glycines
  Genomic contig location: Contig_ID=SeqID_44842; Location=6..64; Strand=+
  SCN-specific regions: Sequence locations=1-59
atgagaaaaagagatagctatttttggtcaagaatttttttgtttgcgtttcaaatatc

SEQ ID NO: 72260 - DNA, 390 bp, Heterodera glycines
  Genomic contig location: Contig_ID=SeqID_44843; Location=850..1239; Strand=-
  SCN-specific regions: Sequence locations=1-157,180-390
  Gene Ontology: Biological process=mRNA splicing
atggtccgtatttccgttgatgttgtcaatgatgcgtaccaggtgggcatcttgttaactattttttgcgaaaatggcgcagaactgaaaatggcaatttaaattttcagtttataaatccgtgtaagcagcgtgaaatttcccttcggaatctgcaaattcctaccattgaaaatctcggagttatcagggtaagacagaaatgctgttgttatatataaagtttaattaataggatcaatttgatgtcattgatttgactgacaataatattcgaaaattggacaatttgccgagattgaaacgtttggggggtgatacgtttaaggatggtgagtgagtgagtgaagtactttaagtgcataatatagtaggaatccaagcaataaa

SEQ ID NO: 72261 - DNA, 390 bp, Heterodera glycines
  Genomic contig location: Contig_ID=SeqID_44844; Location=241..630; Strand=+
  SCN-specific regions: Sequence locations=1-364,386-390
atgccatttgagttccttcgtcccgacgaaaacccaaagtttgtcgccaactccgaatgggaaatggtgccgccaattccggcaaattgtcccattaacgtttcggatgagaaaggaaaattggtggtgaaaagtgccgagcaaatggaatatgaacgcgacgatcaaagacagagcggcggtcagccggcggtcaaagtcagcggcaaattattgcgcgtggcatttcgagtgaaccaaatgccaaaaaacattaccattcaattggaggacaaacagaaaaagcccattctcacactgttcatcggcgcaaaacatattatactcaactcggagcaggtcaatggtgcacgacggcacggcacgagaagggatgggaagggataagca

SEQ ID NO: 72262 - DNA, 261 bp, Heterodera glycines
  Genomic contig location: Contig_ID=SeqID_44846; Location=272..532; Strand=-
  SCN-specific regions: Sequence locations=1-77,101-170,194-261
atgcaaatgaatcgtcaagcaaattcctcagtgttgtgtgattgtgaaactaatccgcctcctgctgttccgatttattcaccaccaccgccgcctccgatgtttttgccgtcaccgccggcgactgaaggagcactcgcgccgccaccgccggcgactgaaggggcactcgcgccgccaccgccgggtggattggtgatcactggttatcccactgctaatccggatggctattttggaaataatgcccacgaagacaag

SEQ ID NO: 72263 - DNA, 398 bp, Heterodera glycines
  Genomic contig location: Contig_ID=SeqID_44846; Location=663..1060; Strand=-
  SCN-specific regions: Sequence locations=1-17,39-303,325-398
atgaacagcaacgccaatggtggtggtggtggttaattttttaattagtttgatcaatttcaagaaaattttattcgcttttctaataatttgtggcaaaactcaatttaaaaaaaaatatttgtacggcatttttaacattttttattttaagatgggcccaccttaaaacggacaatgagtgcgcttggagttgcggctttgacacttggagcagtaccaagtgttgaagctggacgaccacttggaacaataatggtataaatcatggtcgaaaatatttcattttaaaaaggcaattacaattagttgtgtactgtagattaaggaaccgtatcctgtttcttaagattactgtagagtcagaaacagtactggttccagtattttacaataaa

SEQ ID NO: 72264 - DNA, 1441 bp, Heterodera glycines
  Genomic contig location: Contig_ID=SeqID_9666; Location=228..1668; Strand=-
  SCN-specific regions: Sequence locations=1-44,66-171,193-886,908 -1089,1111-1138,1163-1395,1417-1441
atgtgttgggtcattgacattgcactgagtcttcaggttggcccaactttttggctttattttcaattattgttgcctttgtcaaaggacgagtcaatgcccatccacgaattgtacacgcaaatcagaaatcgcataaccgtggcttcgggaatggaggatttggaccggaatggacaggagtttgagccactttttcgtaaaatgtgtgcctcccgcactgaccaggcccgtttcccccatggtcaaatcacgaaaaccataatattcgttagttgttcagctcctggtcgcgcatgtgaaggcgtttgcgccttgcacctccaatttggacccgtacctgcgcaaaacgattcgcgagcagcgcggcggtgaaccgatcattgacctttccgagtcgcaggaggacgacgacgtagcacagcagcaggatccatttggaccactgaaggagaccatcggcccagaggcggaatttgtgtttcaggacccgatggtgtgggcatcggtgcggaaagctttggccaaaatgtccgtcgctgaatttgtggcactcatacgacacttggggattgttaaggtcggcacattagcaaacgtttcgcttaaatatcacgggaattcccttttaatgcaaattgtttaaccaattaaggaaagggaggcgcagctcatcaatgctttttatgagaacaatttgaatgggctcgtccttcacatttgcgacctcaacgaactgaagcaaatactgaaagtgattgatttatccgtcttttgatttctaaatatgccaatttgttttgttcattcgttgtccattttgaggtgccattgggcgattggactctcgtcaaattgttgattgaatctctccgcaaatggaaacccttctccacacagtccctttgctctccgcccgacaccaacagcaactcggtcgccgaccccgtcgttgttgtccaacctcaacaacaaaaacaccttgtacaacaccatgacaatggtgaatttggtcaacagaatgaacaacgcatggcactgttgcggcgcattgaagaggagggaaatgggcagacgatgatgaacaatggcgagacggaggaggagaagcggagaaagtcgacaaaaagtggcgaaaaggaagagaaagagcgaagagaaacggaggagcgcgaggaggagatgaacagcgtggcatctgtggcgggctcttctgagcagcgatcgcttctgaggtcgtccacatccccaccgaaggactgagcagtgatcacagacgaacggaaaacgaaacgaaatgatcatcaatcacaccactttttcattctttctagtcatacaacatatcagggattgtcgcaatctatgcttcatttaaattaaatctcaagcgcatttttgcatttcattaaaaaattggtaaatttgtgtaaaaaataaa

SEQ ID NO: 72265 - DNA, 1765 bp, Heterodera glycines
  Genomic contig location: Contig_ID=SeqID_9668; Location=322..2086; Strand=-
  SCN-specific regions: Sequence locations=1-382,404-836,859-1305,1331 -1765
  Gene Ontology: Mol. function=structural constituent of cytoskeleton; Cellular component=membrane; Biological process=protein targeting
atggggccggctgtagctggcaataatgaaccaatcagcgaaaatgtcaaaattttctactcgaatgatgaatcggattctgtggctgtcccgtcaaatgtctacgagtatttccagtccattgaaaatggccggtttcctttcttcaacaacacccacgtgcacgtctccgccatgcggaacctcaatggcgaaacattacttataaccgcatcacgacttggacatgccgaaattgtggcgcgactggttgcggacattgacgtggaggagacggacaacgacgggtggacggcactgctcaatgcagcccaccatgggcacgcggccgtcgcacgcgcactgctcacagcgggggcatcggtggacaacccggacctggtgatgatccaactaatatacctattttcagggtgggttatttaaaattttattgggtatgaagacaaattcaattggacaattcattctttgtttagatgggatggacctctttaatgtgggcatgttataaaaacagaccgcaagtggtcgatgtgctgctagagttcaatgcgcatataaatatgtttgtaatatccattttaaaattcctataactaatttaaattcaattctttttttagagtcggcgaagaagacgggctgacgccgctaatcattgcttcgggtcagcaaattactattcatttacataaagttttaaattattatttcgagtttttttcgatattgcgtgttctgtttaggccgtggctttactgaagtggcccggcttttgttggcttccggcgcgcaagtgaacaccagcgacaaattcggaagcactgcgctgatttgggccgctcggaagggatttcgtcaaattgtggaacaactgttgaattcgggcgctgaattagacgcagtgggaatgtatggtgagaaacctttacgacaaatgaaagggacgggagcaaaggaatttagtgattttagtaggtttatttgatccctttgccaggttcaactgctctgatgcttgccacgaggggaaaccatgcccatgttgtggagatgttgctgtcaagggacccaaatgtgaacgttgttgactacaatggactttccgcgcttggaattgcttcaagggaaggtgagtgaaaattgttggcactaacaatgagttgtcaactgcgccatgctacttttatatctccgtttccaaattcatcggtgttttgctaattgtaaaatgccatttgcattgtcaggttataccgaaattgcttcaatgctgctccaatccggtgcctatgtgaacacggttgaccgttttggcaattccattctggcgagtgccgtccgctcgggaaaccttcgtttggtggggatgcgccgaaggtgttaaggctgtttcagatgtgaccaattcaaggtgcgtatgttgttggaaaaacatgccgatgtgaacgcgaaagactcggaggggcgcactccgctgcatttggccattgacaaggcatattcaggtcagaaacgaggcaacaaacccatcccaacctccaaagaaaaaagcaaacaaattttgcccaaaaaatttcaagccttaattactaatgagggtcggagaaggaaacgtcgaaacgccagaacaacaattggttacacaatttagaataaaccgttttcagatgttctcctcgctttgctcgacaaaaaaccaaatttggagttgaaaaaccgggacggtgaaacggcactgatcagagcagtgggtttttaa

SEQ ID NO: 72266 - DNA, 710 bp, Heterodera glycines
  Genomic contig location: Contig_ID=SeqID_44852; Location=57..766; Strand=-
  SCN-specific regions: Sequence locations=1-2,191-212,685-710
  Gene Ontology: Mol. function=DNA binding; Cellular component=nucleus; Biological process=regulation of transcription, DNA-dependent
atggaggaggaggaaggaagagaggaagaagaatgggagggaagagaaagaagaggaaagaggaagaagagtgggagcagagaggagaggaagaagagtaggaagaaaggaaggtgggaggaggaagagcggaagaagaatggggtgggaagagaaagaagaggaaagcggaagaagagtgggaggaggaagagcggaagaagaatggggtggaaagagaaagaagaggaaagtggaagaagagtgggaggaggaagagcggaagaagaatggggtgggaagagaaagaagaggaaagcggaagaagagtgggaggaggaagagcggaagaagaatggggtgggaagagaaagaagaggaaagcggaagaagagtgggaggaggaagaacggaagaagaatgggagggaagagaaagaagaggaaagcggaagaagagtgggaggaggaagagcggaagaagaatggggtgggaagagaaagaagaggaaagcggaagaagagtgggaggaggaagagcggaagaagaatggggtgggaagagaaagaagaggaaagcggaagaagagtgggaggaggaagagcggaagaagaatggggtgggaagagaaagaagaggaaagtggaagaagagtgggaggaggaagaccggaagaagaatgggagggaagagaaagaagaggggaccccccgctgtgtgggcggcgtgcg

SEQ ID NO: 72267 - DNA, 779 bp, Heterodera glycines
  Genomic contig location: Contig_ID=SeqID_44853; Location=158..936; Strand=+
  SCN-specific regions: Sequence locations=1-53,75-98,128-538,616 -665,726-779
atgttgaaagtttatttgatagacgacaagaataaattcttagcattcgtcgtttttcaaggtctgtctgttctaaattttttaagtgcaattttctcattattttttttgattattttttttttttgcaacaaattaaataactcgccaaatttttcaccaattagcggcttgctttatgctgctgctgctcccacctataattaaattatgtaattaatttcgtttggtcaaaacatttctgcccaataaaaatgatggaaggcgagtggaaatggtacgaaagtgcgccaaggttacccgcgctctgctgttggcggtgtgtggcgccaattcaaaatttattttgtgtatccgtttaaccgtaaattttcgcttcattttcacccaaggtcatttttgatcggaaattaaacgatttttgaagagtttggcggcccaaaacctgtgtctatttaaatggtcattaatttgttgttaatacaaactacatcagcagtccatttattttttatgctcacattttgattattttgtcataaataaaattatttttatttttaaattttaaatgaaaaatataaattttctaaaaattatttttaataatatttacatttgaaacttgaaatttggcaggaataaacacaaatttctccaaaaagaatatatttttttaattcttagcaaattcattttattaaatttttaatcaaaaatttttaggtaaaaatgaaaatcgttgtatttttgatttttctcgcaaattcgctaattga

SEQ ID NO: 72268 - DNA, 1291 bp, Heterodera glycines
  Genomic contig location: Contig_ID=SeqID_44854; Location=50..1340; Strand=-
  SCN-specific regions: Sequence locations=1-164,186-195,225-266,297 -409,432-465,488-760,782-791,850-986,1008-1291
atgtcgcttagaaaaaggataatcggtgagacaatcattttttggtgagtaagatttgggtttggcagggaattgtttcagttttttttatgaagtgtgccataaatataattaattcaccagtacgagcaaactaactacagatcagtaactataaaaatcaggcaaaaaatactgatcagaagaatcaaaatcataaaaatatttaataaaaatttaaaatacaaagtacaaaatgtcaaatcacaaagatcagaagaatggaaattcataaaaatattaaaaaagaataatttccatagtttgtgcagtattatgaaattgcctaatgaccagtacgaaatacaaggcacagattgaaattttttgtgaatgattggtatttaagcccgaaaacacttcaagaaaattcacttcacaaagtgaaacaattcatcgtcaaactaagatatgaatttaaaaaatctattcattttctaatatttgactttttcaactataatgaatcaaaataattttttaatagaatcttcgttcgaatttttccaaaatttcatcaatgtatcattagcatcggatttacgatttctttttgcttttttgggcctcggaattccgattttcgaaatgactccggtattggttaccggcttttgaaaagtcaagtccaacacccgttacgaaaaccgggaaacgggggccttttcatcaattgccaaccattttcattgtctttttacctaaataatttgtataaattttatgatgaaacttctattattttttgggtgtttaaaaatatttaaatatatatttttttaatttatatgaaaagaaaaaaattaatttcgtttttgtattcatttctaacaacaacaaaaaaaaacaggaatttcatagaaatttttgtcggaattgatgaattttttaagattcgaaagacaaattgacagcaaacttcaatgctttattaaatgtagcaaatgaaataaagcagttgtttcaaaaagcaggagaaaattcaaattatatgacatttttcaattcattggataatgccaatattttttttggaaatattggggaaggtgccaataaaagtcatcacattcaaaaatggattgaagaaatacacaccgatttcaatactcttattattgaaaatgatctgttggaaatttggaatgatattaaagacaaattttcatttcaagaaaacgtgtgtaacaaattggccaagattcgcactgatataagcgacgatgataagggatttatcgttgttcattaa

SEQ ID NO: 72269 - DNA, 957 bp, Heterodera glycines
  Genomic contig location: Contig_ID=SeqID_44856; Location=104..1060; Strand=-
  SCN-specific regions: Sequence locations=1-83,107-715,738-799,839-957
atgaaatattgtgtaaggcaaacttatacaaaaaagttgcccatgaaagcggcttctgtccttagctgttgccttagacaaaacagcaaaagagaacaaagacaacgattagtaattggtacttacgaattggcgacggatgaagcgccaattggcgataagaagagtggaagtgaaaggtgcataatccaaagtacaataaaaatttcttaaactcgggtttttgtggggttgatgaccttgagtgtctaaatttattgtcggcctttgttcgttatgttaggtgtggtggcatttgcattatcgacccaacggatttgttacccattgagcggtacattcgccttcccagtggcgtttttcggcttgtaaaagtgccaacaaatgcaattactcctcttcttacgagtgaagttaatggtaaccgttaacgtttatgtacagtatggtatacaatttaatgtgaaaaaaatatttagataattcagcagcagttgctacacttaccgatggacgacttgctctttttacgactgaccactttgattcggtgagtggaccactatttttttatgattttttattctagattgccgatgattcggctacatttctgcctttttccacgactttatccggtggaatgatgttagattgtgcagtgaattcggatgggcgactgctatgttctgacaatttgggcaatgtataaaattatttatttatctttaaacttttgatgcctgaatcctttctaaagatccaaaaaaatttgagaaattttcctatgaaaaaaaggtttttataaaatattgtaaatattatacatttattatttctgtctttttagctttttgtcctccgttttgctttggatggttttcatccacccgattttcaatggcgtgcccattcatctcaattcggtggaataacggtaaaatcagcaacaataaa

SEQ ID NO: 72270 - DNA, 390 bp, Heterodera glycines
  Genomic contig location: Contig_ID=SeqID_44858; Location=115..504; Strand=-
  SCN-specific regions: Sequence locations=1-390
atgaccatgttcaaggaactgaccaaccgacaattggtcgccattgttatgttggcaatttcgaatctgtgcagcactgtggtggtcagttgcataggaccaatttacccgggcgaagctaaacgaagagggtcacttttgaattcacatgcaaaaagctaacaattacggggcttcagaatgtcagaggctcaaatcgggttggtcttcggtttgttccaattggtgatgttcatttctgcacctcttcttggcaaatacgtaaacatttttttttgatttttttgccattttactaattgaaaacaaaattcagatgcatgtgattggctctaaatggatgtgtatcgctggccttcagatagccagtttggctgcaattgcatttgg

SEQ ID NO: 72271 - DNA, 742 bp, Heterodera glycines
  Genomic contig location: Contig_ID=SeqID_44858; Location=716..1457; Strand=-
  SCN-specific regions: Sequence locations=1-628,653-742
atgacgaaaaaacatttgcctccggcgccgttcgaatacctttcgacgagtgaaagtgaaaatgaaatggaaaattgtggacaaacggaagcgtccaaattggcgcagaaattctccagcagaaaggatttgtcaccctcagaacgaatggcagccattctgaagcttatcagctcaaaatcggaagagttagaataacgggaaaaaagcaataagattatataggaaaagcaattgaaaggacggaattgtaaaaattgggcatttttggtggatgcaaattgggcacgaattatagcaaatcctttcttacaaatttagccaaattcaacaaacggttgtgccatttcttagtgttcccaattttctctacaattttcgattattttttgatggttgtgcctttaatatttacgttctgtccgtcgtcagtgggtcaaacaaacacttttcgttcttttcccccatctgtcccacaaattatgtatttttctacttttcccattgtgtgcctcatcttaatcattgttcatcatgtgttgccaatttatggtattaatcaaaatatgaattgaacataagtgaataaattgtttcagcatttgtttgatttacgttggtcgggtcggttttttattttagaaaaaacaagaaaatacctaaattcatgtcccgggattcgaaattggtacaaaaaatatcagatttatgttcagcgactccgaaaaccattagaaataaa

SEQ ID NO: 72272 - DNA, 49 bp, Heterodera glycines; identical to SEQ ID NO: 57477
  Genomic contig location: Contig_ID=SeqID_44859; Location=301..349; Strand=-
  SCN-specific regions: Sequence locations=1-49

SEQ ID NO: 72273 - DNA, 1156 bp, Heterodera glycines
  Genomic contig location: Contig_ID=SeqID_44860; Location=199..1354; Strand=+
  SCN-specific regions: Sequence locations=1-145,206-249,282-482,505 -1156
  Gene Ontology: Cellular component=cytosol
cgacgcacactcgtgttggacggaaactcactgcaggcgcaagacttggtggactgcatgcatgacaaatgcaagctgcaggtcagaagcaggacaaaaaagaaataattaggcaattaaagtttcaaatggcaattaaaataggaaaataaaataaataaagataattattagaaacaaatgaatattaattaaataaattaaaggaactaaagaaaaaatggtttaatgaaaataggtaagtgtagaatttaattaattcaattttcttatttaattagttggctgagtcttcgcgccagcgtatccgtgaagcgcgtatatttctcgagaaagttgctgccgagcaccgaggtcagctgattaactcgttaatgtttaccaattacctttttccttttaaagttgtctatggcataaccaccggtttcggcacattttcaaacgttgtaattccgccagaagagttaaagtaaaagcggagaaagaatgaatgtatttttgttaaaagaaattcatttttattattatgtgttcaaaattcaaatgtaaatgaatgccatttatccgtctccccctaaggcaattgcaactgaatctgatccgatcccacgccactggccatggctcgccgttggagccggccaaagctcgaatgcttctcgcgttgcgcataaatgtgttggccaaagggtacagcggaatttcgctgggaaatgtggacaaattggtgaacgcatttaatggtaatgagagaaaacaattggaaaaatgtttaagcgactcttttttaattatctttttcagaattttcctcacacaaaaaaaaacctttttttaattgctttaattatttttttgaaatgcctctgtctgtctgtccatttgctcaattgcccccattagccttctgtgtgtcctatgtgcccgagcagggcaccgtcggctgcagcggcgatttgtgtccgttggcccatttggcgctgggtctgatcggcgagggccaaatgtggtcaccgcgtaccggctggaccgatgccagcgatgtgttggcagtgaacgggttggaaccgatggcactcggctacaaggagggattggcactgatcaacggcactcagttggtctccgccttgggggcattgggtaattataa

SEQ ID NO: 72274 - DNA, 505 bp, Heterodera glycines
  Genomic contig location: Contig_ID=SeqID_44861; Location=124..628; Strand=-
  SCN-specific regions: Sequence locations=1-1,23-126,148-163,185 -258,287-390,412-427,449-505
caaaagttttttacaaccacttattgccaatctaatttcttgcagatttaaagctatccattgcctgccggttctcggcacagcaaagcactaatacggtgtttgactcacttcaaaaaataattcattacccaaaagttttttacaaccacatattgccaatctaatttcttgcagattgaaagccatccattgcctgccggttctcggcacagcaaagcactaatagggtgtttgactcacttcaaaaaataattcattacccaaaagttttttacaaccacttattgccaatctaatttcttgcagatttaaagctatccattgcctgccggttctcggcacagcaaagcactaatacggtgtttgactcacttcaaaaaataattcattacccaaaagttttttacaaccacatattgccaatctaatttcttgcagattgaaagccatccattgcctaccggttctcggcacagcaaagcactaatagggtgtttgactc

SEQ ID NO: 72275 - DNA, 896 bp, Heterodera glycines
  Genomic contig location: Contig_ID=SeqID_9669; Location=329..1224; Strand=-
  SCN-specific regions: Sequence locations=1-149,172-190,213-452,476-896
atgagtacccgtcgttcaagtcgtcgttcatctgctgctaaggggtcacgtgagggcagcgtggcggggaagtcgaaaccttcggaaacggctattagcgactcaaagaagccgtcgaattcttcacccgagaaggctcaagaaacagtaagaaatgtaaatgtcaaaaaatttaattaaaatcgaagggaaaaatggaagaggaaaagaagctggaaccagtcaccgaaacagagccagaattatcaacagaggatgaggaaaaatcaatagtggacgaaaaaaagaccactccggaaaagaagcaagaagaagttgggcccgcggtggagcaaccgctggaaatttacggtaaactcattagatgaaagaataaaattacagaacttaagcatatcaaaaattaaagttattattaattttcagttgagcacacagtgaagactgaaaaacttcatggcattgttcaggagcagtcacaggcaaaggattcggccagttctgatgctcccattgagaatggtcaacaacaaaaaaatgaagcgactataaatgaagaagaaatagtcgatgaagatgccttcatcattacaaatgagtcggaccccgctgcaactcacaaaatccaagtctacactttgagtgacagcggaattcccaatgagcaaaaagcaacgcctagcggaagtaaagctttggtatccgcaaaaccaatgctgggtgaagaagggaaaggggatgaaataacggtggtcaaggatgaaggacaacagccgagcggaagcgtggtggatacggttggttcatcagagggaaatgcccacgtcacaaccaacgggcaaaacaaggagtcggcagaaacggtcgtagcaacggtcacacttgacgaagagtag

SEQ ID NO: 72276 - DNA, 1611 bp, Heterodera glycines
  misc_feature (1336)..(1336): n is a, c, g, or t
  Genomic contig location: Contig_ID=SeqID_9669; Location=2198..3808; Strand=+
  SCN-specific regions: Sequence locations=1-36,59-133,155-276,300 -721,743-981,1020-1437,1502-1502,1525-1611
atgggtaaaagaaatttaccacgcaagcttaattgcaaaaaggcgttgaaagagcgtgagaagaagcgggaggagaggaaagcgcagacggccaaggcgatacaagctcgcctggccaagaaaagtgagtttttccattcatttttaataaaatcctaattttccaaatttttagccgctccccagccgaacactgatgcagaaacgccacaaccatccgaagaagagccgtcgacatcagaggcaccggcgcgggacaacgacggacgaccaccatcaactccaacaccgatgacaccgcaggaaatggacgtgccgtcggtggagatggtggacaccgatgtgcaaatcccttcaacgcctgccgatgaagaccaacaagccgagcccgtgccgtcaacatccacggcacgctgtgacttcatggcgacaccatcgacttcaaagtgcgccggtgcctttggtcttgacgatggtgagtgcgaaattccatcaaaaattttgttttttaaattcatttcattattatttttaagtccacatgtttgacgagctgcgacggcgccacgtttggatcgaggaggaactgcagcgacagcgccggtcaaacgccgtcctccgaaaacagctcaaggcacagcgcgatcgttcgacgagcctcgagcgttcggcttcgtcatgtcgtcagcggaaggccctttcagacgtgaccaacaacccgcaggaggacaaaaggctgagcgcggcgaacgatctgctcatcacattggacgcaggcatctccttcaaagcccgtgaagcgttgaagcggtcgttcgccggccagggacatgacgtttgggcaccgacgtgggcagtgaagcgtctgaagagggagctggccgagggggcaaattttgagtgggtgggcgaggaacagactcgcgcacttgtctgcaccgacgtgcgtgcccttgttgagggtcgacttcaagcgttggcaaaaagtggtgagaggaaaataaataatttttcaaatttataacaaaggccgtctgcaactccatcaggaatttgtctcccaaatcgtgttggtgctgacgggtgacaagggggcgccgtcgtggcagcaacaacaaaattggtattactcatccacaacgttgatccaccaaactccccaaaaaatctctccactttcgccatgatcgccgacacgtagacagacagtcagtacagtgtactatttctccctttctccagtggctatgcggaagaaaagaaggaaatagtacactgtctgactgtctggttacactttagaaaaaattgaccacaaaccgggacccaaactganatgcgacgatgaagtttgggcaccgggaagtttgggcaccgggaagtttgggcaccagaaatttgggcaccgggaagtttgggcaccagaggggggatttcaaaaaaataaaacaaaataaataaataaaatgttatataaatcattaaaatttagtaaattttagcaacccttttttcttaaaatttatatgttcttgaaaatcaaaaaatttatgtatgggaacctggcaatcttattatttaatcaattcttacggttgtttaaacgtataa

SEQ ID NO: 72277 - DNA, 193 bp, Heterodera glycines
  Genomic contig location: Contig_ID=SeqID_44862; Location=696..888; Strand=-
  SCN-specific regions: Sequence locations=1-14,40-46,85-171
actccagtattctgaattaaaatttttattaattttaaagcttcactattttattttttagcaaaattaattcataaatattttttcacaaactgctctgaaacgcaccaaattttatttacaagttattttaggcactcagatgctttcactatcaaaaagggagatgaataaaaatctaaaaatttttaat

SEQ ID NO: 72278 - DNA, 882 bp, Heterodera glycines
  misc_feature (853)..(853): n is a, c, g, or t
  misc_feature (875)..(875): n is a, c, g, or t
  Genomic contig location: Contig_ID=SeqID_44864; Location=58..939; Strand=-
  SCN-specific regions: Sequence locations=1-61,144-217,271-278,308 -424,452-457,479-608,644-797,819-882
aaggaaaaacgtaataccgtaatcaaagcattggtcgatgagaaacggaagcaccaaaagcaaaaagaagaattggaagaaatggaaaagaagaagaaggagaaagaggaggaggaggagaggaacaaaaagaagaagcagaaacagatggcagtaaatgagtgggtttttttcaatttttaattatcatttcgtaaattttttccgaatgcaattcaattttataatttttttttaaatgacgttatgtttttttaattaaaaaattttccctctctttaccagtgctttttcagttttttcacgaaaatttttacgaaattaggccccgtgcgaaatttgaaattgacccctctctaaattaaaaaatttttagcgataaatattttcattaatttgaatcattgaatcgtatgaaaggcccaaaaaattaaaatttatttaaatttttcgctattttaattggtttgtttaaatttttcagctgcgtgaaacatgttgctgaacttgacaaggaaatagcgaaaattcaaagtgaacttcagcgttcaagcaacaaaatggccaatttgcatacaggaaaaatgtcgacaccagcgaaaaaaggcaattaattaattattgtaattaactattaattaatggaaattattcattttgaagcgtctgcaacaaattctactccaactgttcttcaaaacactgttgcgcataaaacgggggaacataagctgaaaaaaattcccgtttggagggtgagaaaaaagagaattttctatttattttatttaggctaggatttaaatattttcaaataattctctaccgaatacttgttttaggcaacaaaaantgtgtcccaagtttacttccanaaataaa

SEQ ID NO: 72279 - DNA, 626 bp, Heterodera glycines
  Genomic contig location: Contig_ID=SeqID_44868; Location=466..1091; Strand=+
  SCN-specific regions: Sequence locations=1-49,71-92,115-394,462 -507,529-594,623-626
atgcgaaatttgcgtgttccaattttacttgtgctattgagcccagtgattattttcatattaaaatttttattgcatgaaaatatgccgacaaaaataacaattaaccctgttgcgggaaattttatgcaacgaaggattttgttttttgatagtgacgtaaacaccccaaagttgctgcttggaatgaacacccaagtaaaaatctgaatatttgagtcgaatcataacacatatttcttggcacaaaaaattataaaattaagccattgccaacaaaaagtcactttggcatatttaatgaggattgggacagaatttgtggaagtgatggccagcagcaatgtgtgagaaagtttgatggcaaattccagcgcaatgttgtgtgtttttgttataaaaaataattatgcattgttaaattataacttaaattaaattaattaaatatattttatattcacttttagtttattccgtcgcttaaattggccggctgtttaattgcaaaaaattcaaatgttttcttggagtcgttgttttgctacttaacaaacatgaacaaaattaacacgacaaatatcgattacgaacttttcaatttgtttgtttttaactatttataa

SEQ ID NO: 72280 - DNA, 277 bp, Heterodera glycines
  Genomic contig location: Contig_ID=SeqID_44868; Location=1127..1403; Strand=-
  SCN-specific regions: Sequence locations=1-172,194-277
atggtccaaaagattactggaaactcttttaagaaaaccagaaataaatcgctcaattggggtcacgcactaatgcgaccattttccaaagctgtaattcattggtcaggtcttttgtcattgaaacattgttcacaatctgaaggggaaacgacagagacagacacaacgccaaaagaacaaattcaaatcaaaatacctcttccattggcaattcagcataatacggtgactcaacataacaaaacatcattctaattctcggtctaaaattaaa

SEQ ID NO: 72281 - DNA, 74 bp, Heterodera glycines
  Genomic contig location: Contig_ID=SeqID_44869; Location=1..74; Strand=-
  SCN-specific regions: Sequence locations=1-74
gaattttctggcactgtttgcgccgattgcggtgcctcttgtccgagttgggcttcgctgaatcacggcgtgct

SEQ ID NO: 72282 - DNA, 437 bp, Heterodera glycines
  Genomic contig location: Contig_ID=SeqID_44871; Location=56..492; Strand=-
  SCN-specific regions: Sequence locations=1-437
aaaatggtgtaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgc

SEQ ID NO: 72283 - DNA, 692 bp, Heterodera glycines
  Genomic contig location: Contig_ID=SeqID_9670; Location=673..1364; Strand=+
  SCN-specific regions: Sequence locations=1-7,54-218,242-495,530-692
atgctcattgtttctttattttttgttttctgtcaaattttgctgctgttgacagtaaaaggcgatggaaattacagtcgacaaagcgattacggtagtgccggtgtttccgacggttctccgccgcccatttcttcgggtacagatctgtacaataagcaaaaactgatccaaaataattgaattgtattaaataatctcgttacattaaaacttacaaaaaaaataaaaattttatttaggggctgaaaaaacggtagacgaatttctgtccaaattcgaagcgttgtccgcccgaactgattccgatgatgtcggcgttctcatggcacaactttcccaaaatatttcctccttttttgaattggctcttcccgtcggttctctcatcgcgggggcccttcaaattagcgacaaagtaattcataattatcattcaacggaatatacggtagttcggcgtaatgcatactgtaattgattagaaaagcaattaattaataattgtgccaaaaaatattttgctttgttagcccgaatctgaacaatacaaagcgatggagaaactgcacgataaatttgatgcaaaacttaaagaattggacacgaaaattgtgagatcttggcaaaagattgacgtgagcacgcgaatattcaacagttacgaagatgtaattagctaattatagtaa

SEQ ID NO: 72284 - DNA, 234 bp, Heterodera glycines
  Genomic contig location: Contig_ID=SeqID_9671; Location=576..809; Strand=+
  SCN-specific regions: Sequence locations=1-203
gttcaacctagcagcaaattaattaatccttttcattcacagtacatttatttttacactgcccgttactgtaagaatgaatacggattgtcgaaggaacaactttcaatgttggcacattttgtgccattgttgcgcaaagttcgattgcaattggacagcgattattccaaagaaaagttcgatgaaatggaaccgggtcgaaaattattaattaattataattaataaata

SEQ ID NO: 72285 - DNA, 549 bp, Heterodera glycines
  Genomic contig location: Contig_ID=SeqID_9672; Location=177..725; Strand=+
  SCN-specific regions: Sequence locations=1-549
atggtcacgcgatttgacgccgaaagggacgaaaagcgggcggaaaaagcgaacgagtggcttaaaaagtgccaagaaaacggaacgaagaacaaaacggccgaaaggacaatgagacaattcatcgagtaagctgaaaaacgaatggactaataaaaaaaactggttttggaatttaacttttttaaataatccgcgaatcattcggcacatttcagccaaaattataacattggcaaagtgtctgagctgctggacaactttgagaagcagcactttaacctcaccaacgatgctttgtaccgtaacatcgccattctgcgcgattacggtagcattgaccgatgtgggattacggtctcttcaaatgaccgtccatcggacaatcacacggcaaacgctgctgctatggtggactattacttcgcggggtccttttggcgcgcctgcgaaagttatgccatctatttttacacttgacaaattcggcaccttggcggaggacggaacgccaaaaatttcgattggattatgccatttaaaaaaata

SEQ ID NO: 72286 - DNA, 1351 bp, Heterodera glycines; identical to SEQ ID NO: 44873
  Genomic contig location: Contig_ID=SeqID_44873; Location=1..1351; Strand=+
  SCN-specific regions: Sequence locations=1-178,200-351,373-660,682 -790,814-1351
  Gene Ontology: Mol. function=receptor activity; Cellular component =endoplasmic reticulum membrane; Biological process=calcium ion transport

SEQ ID NO: 72287 - DNA, 196 bp, Heterodera glycines
  Genomic contig location: Contig_ID=SeqID_44875; Location=361..556; Strand=-
  SCN-specific regions: Sequence locations=1-29,55-196
caccgacaacatttctcatgctgctggtgaacaacaacaacaacagcaacaacatgaccaaacagaaaacaaagtcaaatttcaagaacagaaaaaatcagaaaactatgcaatggcatgctttttcttcacgaggctttaccgaaaattggccggaatgttggaaacacccttttatggcaaaaaaccatcaaat

SEQ ID NO: 72288 - DNA, 96 bp, Heterodera glycines
  Genomic contig location: Contig_ID=SeqID_44876; Location=378..473; Strand=-
  SCN-specific regions: Sequence locations=1-96
ctaacctggaattgctggttgatggactacgtgttcacgtcaatgccgctcagccagcagccgtagccgggtgggactggtaccagtcgaccacct

SEQ ID NO: 72289 - DNA, 1062 bp, Heterodera glycines
  Genomic contig location: Contig_ID=SeqID_44880; Location=142..1203; Strand=-
  SCN-specific regions: Sequence locations=1-411,439-819,841-1062
atgaataaattgaaaattttttttgaaaaacttgacaaaaaatacttggaaaagttaaaagagttaaaagagtcattaagtggacatctgttggaaatattgaagaacatccacacggattacacaaaagccagccaaagagaagcaagcaaaaatggaggaattctgttgacaaattacagaaaagaaatgttacgatttggacaaattttatacgaaacaatgaaaaaaaatttggcaaaaaatatggaatatgatgaaaacaaacaattgttaacttttacgctatcatttgccaaacatttgcttgggcggctgtttgaatttgtcgaacggtttgtaaatttgagttttcttggcctaccgtgttccctcgattagaagccccccccccctcgaatataagccgcctaaattttttattttagaaatttcaaagagaatttcaaagtcagtgatgacatggattttgtgcaaacaattcgagcagttgcctcgaataacgaagaattagtggctgaaaagcggcaaaagtcaatttcggctggggtcaatgtgaaattgtccaagttgcttttctcattggcaatccgtttgtgccttctaattgatggacaagaatttcgagaaaaatatgtaccaaaatttgtgttcgcgctgaaaatgtgctcaacaaacactgggtaaaaaggaccaattcccattttaattgaactttacataaaaattccagtggcagggaaattttcaaatttaataatataaaaagccattacggactagggatgtgcgagagtctcggtactggactcgagaaatttcttgggtttttcgcttctcggtctcggatttgtagtctcggaaaccgagaaatttttacactgtttaaggatgaccatgacgggggggggggcgggtcaccggtcggggtcacttcgcctatgttttgttggattgaattgccatttacgactttaatttttgaatttccatggaaatttaaatgataggcattaaatatgcgcaaaaatcctcgaataggcacaaaaataggcaaataaa

SEQ ID NO: 72290 - DNA, 704 bp, Heterodera glycines
  Genomic contig location: Contig_ID=SeqID_44881; Location=338..1041; Strand=+
  SCN-specific regions: Sequence locations=1-672,694-704
gttttcggggcagtccccctgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagtctgtactttaattctgcgttggatttttgctccccataattgtttgagtaccccaaacggacacttgaaaaaatcgatttttttatttcataaatattttttcagaaaatgctctgaaacgcaccaaatt

SEQ ID NO: 72291 - DNA, 1847 bp, Heterodera glycines
  misc_feature (1820)..(1820): n is a, c, g, or t
  Genomic contig location: Contig_ID=SeqID_9675; Location=984..2830; Strand=+
  SCN-specific regions: Sequence locations=1-499,530-623,663-713,735 -768,790-803,830-1679,1701-1847
  Gene Ontology: Mol. function=sodium:dicarboxylate/tricarboxylate symporter activity; Cellular component=integral to plasma membrane; Biological process=protein targeting
gtactggaatggttgcgcaaaaatgcgctggttggcgccacgctggtctcggtgctgctgggcgcactgctcggcaccgttgtacggcaaaattagcaatcgctgattgatcaaaaattaggctttctgatcagttgggctagtccgtaaaacggaatccaaactctgctgatcagcccgaccattggtcggcattaaaaacattttgattcgatgaataccaaaattaccgatgcagattttttggcattttatcgtacaaaattgggaatgaacccagtaaaaatgtcgacaaagaatgtcgccgataaaatttaaactatatttcgaataccaagcatctacccgaattgattgaaatttccaaaaaaaaacgccgatgaaaattttgggtgcagcccggaaattcgaattttaaactggatattttttatgccgtttttaaggggtatggattttccggttcttagggtatgggatatatatgaggtttttatgctaaaattatttataatatatttttttttttgcagattcgttatgccaacccatccttacagaccattatgctgttgacatttccaggagaagtaagctgtggagagagagagagtgtcaaaaacaattaattaattaattaaaataattatttaattaattaaaagacgccaaaaaattttcattgtaaataaatgctcacaacattacaatgcttacagcttcttatgcacatgctgaaaatgatgatcatcccgttaattgtggtcagttattattattctcgaaattaaaatagtctcttaaattaaataattaactaattaattaaatgccccaatttgttaagtcctcgctgatctccgggttggctcagctggacgccaaacagtccggacgtgtgggaagtcttgcggtcgcttattacttggcaaccaccgcaattgcggtgatcaccggcattattttggtaattaacagtagggttaagccccgaccccgagccccccgactcgacccgagacgttttttggacctattccccgacccgacccccgacatgtcgctccccgaggtccccggctcccgacattttgccccccgagggctcggggcttaaccctaattaacagagtcgcatatgcaaaataaccagggaatgtctcggcatgccgatttccgattgccgtaattttttgagcgcattccacacatgtcattgataagattttccaccgctcttcaagaagcaagccctggtctgtgccattgttttgcatatgaatggcatatggcggcgttatttaaatttgtgtcaaaaaaccatcaaaatgagaattttttttgatataattttagtcaaaagcaatcaaatttttattcttgatagcattcgatagcgccttaagtgttttcaattatcatgctgcaaaattccaaaaaatttcgttaaataccaagaaagttatgactaaaaattttcagaaaattttgagtttctcagtgctcataacttttttggaacttaatgaatttttttgaaattttgcatgataatagaaaagcttagggctatcgaaaaatatcaagattttaaaatttggttcatttgggcgaagttatgaataattttttgtcaaaagtttaccatttgatcgttttttgagtaattttcatagcaccggatttccttcatctccatggtccatttgtcaaatccgttggaaaggatcaatgccatgattttaccgggatctttttttttaccgaaatctcgacaattcgaaattttaaatccaataatttccgtgttgaattcgcgnatttttaatccctgtcaagacacaaca

SEQ ID NO: 72292 - DNA, 247 bp, Heterodera glycines
  Genomic contig location: Contig_ID=SeqID_44882; Location=468..714; Strand=-
  SCN-specific regions: Sequence locations=1-97,154-247
atggccggccgggtccaccacgactgtcttgcgcgactgattgttagtgccattggtgtcgcaggcggcggcgaaaattgccacttacaaagggaggaaattaaatgttttttaaaacaattaaaatttaataatttggtaataatattattacagtgttggttttgcaacattcgtatggaaatccgattcaagtagaaacgatccaagaagtactgaacaaatgcacaaatcacaaatgaataaa

SEQ ID NO: 72293 - DNA, 80 bp, Heterodera glycines
  Genomic contig location: Contig_ID=SeqID_44882; Location=662..741; Strand=+
  SCN-specific regions: Sequence locations=1-80
atggcactaacaatcagtcgcgcaagacagtcgtggtggacccggccggccatgttggacacattgacccgcagtgcaat

SEQ ID NO: 72294 - DNA, 276 bp, Heterodera glycines
  Genomic contig location: Contig_ID=SeqID_44883; Location=878..1153; Strand=+
  SCN-specific regions: Sequence locations=1-276
atgcgtctttgggccgcttcacttggcttttacgtttccattgtcatattttgtgaaattttgcgcggatttgcatacagattcgagctgcacacacagattggtggtgaacatcatcaacagtttacatctttgatttatgaggtgggtaagttgaaattaaaacttttttttaaagcctttgttaaattgagaattgaaaaagctcaagttttagccgcttcaaacacttctgatcaacttctttcattctctagatcgatttgtctcatttga

SEQ ID NO: 72295 - DNA, 49 bp, Heterodera glycines
  Genomic contig location: Contig_ID=SeqID_44886; Location=424..472; Strand=+
  SCN-specific regions: Sequence locations=1-49
attgaaagccatccattgcctgccggttctcggcacagcaaagaactaa

SEQ ID NO: 72296 - DNA, 1079 bp, Heterodera glycines
  Genomic contig location: Contig_ID=SeqID_44888; Location=122..1200; Strand=+
  SCN-specific regions: Sequence locations=1-151,174-212,237-308,330 -1020,1042-1079
atggagcccttgtgcccaatacatattatcaatgcatcagaaggggaaccatttgagtatcagagtggcactaatgaaacagaggatacagacgatctagatgctcaaatcaaccaaacaaaacgggatgaactcctcgaagttcacaagaaaacaatgtataagagtaccaaattttgggaagtctttagggatgactatttattggcattaagggaaaaggaaaaggccaaaaatgtggatgaacaaaggtttccaaaaataggacaagtggtactaatcaatgatcaaaaaccgtgtcctcggaataaatggaaattaggtaaaatagaaagtataatcaataacagaactgccaaattaaaaatgcccgacggaaaaataatggaaagggcgacgattttattatacccactggaaatagagaccctcgagtctgaccctaatcccattaatgaaatttcagcgttaacaatggaagacacagttagtttggcaagcatggaggaagagtggtacgaaattttggtttctcaaaaccttcagaaagaattggaaaaagaatggagcggatttttggacatgcaatttaatacccgcccgtatcccgaatttggatgctaaagtttcaactcaaaggggatctctcaagatccaggttggagttggaaacattttgaatggttccggttatttaaacacattcggttggtctctcatggctatgcattatgttgagggaagaattaaattaaaggggattttagagcagaagcaaaatcagttcctcgaggctgaattaagtcaacttggtaaacccgttaaagatcaagtttctgtttttcggggagtgtccgaaacacaccccttttcggaccaatttactcaccatttcccaaaccaggagaagtcggacatcggaacaagtctcaacttggcggagcgaagcgagcaacgaatttgcgacaaggcggtcaacgagagcggcacaattggacgggacggcgcaattgaacgagtgaagaaaggaacgaaggaggatggcgcaaatggagagaaaggagacaacgacgaaattg

SEQ ID NO: 72297 - DNA, 3101 bp, Heterodera glycines
  Genomic contig location: Contig_ID=SeqID_9676; Location=1214..4314; Strand=+
  SCN-specific regions: Sequence locations=1-103,125-261,333-334,357 -358,382-403,425-722,764-1032,1067-1330,1352-1398,1420-1426,1457 -1460,1493-1548,1570-1797,1841-2456,2480-2577,2599-3101
  Gene Ontology: Mol. function=3'-5' exodeoxyribonuclease activity; Cellular component=nucleus; Biological process=nuclear organization and biogenesis
atgagcaaacagttggaggagtacggggagcaaaaatccacttcaattagcaccgcaaaacgattagccgaggtgggaaaagcaattaaaaatttttaattcgtgaaaaattttcaaatttttccagtttcttggcgctgacattgtgcgcagcaagggcagcttggcgtgcagttttgtgatctcccgtttcccgctgggcgactccgtctcggaacgcactgtcagttctttctggaacagccccgtcgttctccatccttaaaattttaattacaataatttacaaaaataaatataaatttctttaaaaaatattttttatatttaaacgaataaatatagaaaaatctttcgaattattttgaaaagaagaaaattcttaggaatttgtcaaataaacaaattttttgagttttaaaaaatttagggttttggcttaaatttaaaaaaatttcttaagtcttgctaaattttcaaaaattaattcaaacggagtggaattaagactcccgtttttgcaaaataagtaaaaaaaaatgtacaaacaataatgtgtcaatgaacatcaacatttcagcttccgttggccattttcgacgcggcgcccaaagagcgcgtcaaattcttgcgcaaatggaccaaagcgaattcgttgggcgaagagttcgggtcggacaaatgtctgaaggaggtgagcttttttggtgtcacctttgtggaattaaataaattaaaaaaacaaaaaataaataataaaaaagccaatttgattttccccgtttttttttgtagctgatcgactggcaatactacattgaacggttgggcagcaccatccaaaagattgtgaccatcccggccgcgttgcagggcatctcgaacccggtcggtcccgaccatttcgcccgatttttttccctcgggttcgaacccggtcgatcccgacgatttcaaccgattttttgccccggggacatttcgatttactttatttcattttcattcctttttcgcgcaggtgccccgtgtgctgcacccgcaatggctggagaacaagcggcgggaacgcattgaaatgcacacacagccccggatcacggacatgttcaaggtcatcagatcagaccaccccgactgtctgtctgacaaccatgggggctaacttacattgataggacataatcctgcggatttatgccgagatttatcagggacttccgtccgtcgacccacggaattgtcggtgcaacgggggtcgggaattcggaaaaatgaacgaatgcccaacaaaatattaatttaaaactccacccacagtctgccaacgcccctgcttccgtcgtcgtccgtccaatgccaacaacgccgggctctgctggccgaaagagtcggggcgcctccgtccatctgacgccgtggtcgttgaagaagaagcagcagcaccagcagcaatctccgctgacaccgacggcggcggcgacgacggcgagtcgacggaagcgaccgttgctggccacaagtgttgatggagatgaacaacaacagcagcaatgtcctgatggtgccagtggtaatggtggtacttaattattattttttttttgtacatgcttggcgccatagtcatttgggatttggttgcgggaattttgttgaacaaaactggcccgtgaaaatttagaaaagaaattaaccaaaaaaaaaacttggaaattattagaaaccaagatattctaaaagattttacgaaatttatgatttattgagtattcaaaagttttttagtttttcttgacatacaatttgacagaaaaaattttctaaaagggcttttttcctgaaaaattcttcaattcttgtctatgtgtattcagtttcatcaaaacgcatttgtgcatctgctgatgttgttgttgaactgctcgaggacgaggaggctgaaaatgcggagaaccgtcgaccaccgcctgcccaccagccgacagggcccatggatttggtcgcgttggacacactgttggagcagcagggtcacaaccaacagccggtaattaattattatacaattgattaattaatatccatctttcatgctaattgtaagtgtatacatactgtaatgaccgtattttagcaaaccgaacaagaaaggcgcgcggaagcagtgcaaaaaacggcaaaaatggacaagaaaaagagcgctgcacagctgaaaaggtgtgccaatcgaaaatgttccggaaaaatttcggaaaatttaaattttccagggaggcaaagcgtgcggctgttctgcaacatgccggccgtgcatttccccggcgctgttacgccgcaatgagtcagccgacgaaacggagttggcacagcgacggatttatgccatgggttggtcggaaaatgcatttttatgcctttttaaatttattttttcaacatttagctcgactatctgaaggccaaatggcttctgcagcgacaagcgcggaccaccgcgttcaatgaggcaaactttgttcaattttcaatttgggattttaaattcattttaatccaagattatcattttatatgataattttatatgtaattgactcgcgaaaactgttttctaactgttaaaaattttcatttatgctcggtctttttcggattcactaagaaatttaaaaaaagaagtaaaaattttcaacgatttttggaaaattttttgaaaaacagtatttcatcataaaattttgaaaaattctctagtttgaaatttaaacaaaaaaaaattccggggagagagaacgaacaaggaactgcttccgtctttttcagtccctcgggattttaaatccccatttaaaaaaaaactaaaaaatgtttaggcacttttggagcgggccatggaagcggcggatgatgcccaagcagcagctggaacagatgccgattccgacgctgttcgcatcggcacttccgctggtggtggtgccgtcgtccatctgtcgactgccaccgccgcggcactttcgttggcacgccgggagagcacttggcacattttgcaggtacacaacgcacatacacagtcaaaacactaccgtacctaa

SEQ ID NO: 72298 - DNA, 231 bp, Heterodera glycines
  Genomic contig location: Contig_ID=SeqID_9677; Location=420..650; Strand=+
  SCN-specific regions: Sequence locations=1-231
atgccaacgtgtgcagcacgtacagtcccatcagtgcaccagcgagaaggaagcggcacggcgcgtgcacgcgctgctgaacgcgttgaaatgggcgcccacggagccggtgctgctgtgcacgctgaccaaccgaccgacgcaggccgagctgttcaaggtgttcaccacagcgtttgggggagcatttttacgaggaaaaacggggacggaacaaaatctcgtcgttga

SEQ ID NO: 72299 - DNA, 205 bp, Heterodera glycines
  Genomic contig location: Contig_ID=SeqID_9677; Location=1044..1248; Strand=+
  SCN-specific regions: Sequence locations=1-72,122-140,168-205
atgcaacactttttcaacagtttcacatttttgaaggtgagtgagtgaaaatgcgattaaaaacatttttcctaattttcataattaaataaattaattctcaaattttaaatgattttttgtttgccatttaattcgataattatttttccaaaaattaaattttcagacgaaatttaaaaatgcaattataattattatttaa

SEQ ID NO: 72300 - DNA, 664 bp, Heterodera glycines
  Genomic contig location: Contig_ID=SeqID_44898; Location=124..787; Strand=-
  SCN-specific regions: Sequence locations=1-260,282-664
atgactcaacattttcattgtggtatgaacgatacggtcagtttgtggaaaaggatggtcaagccccttccgacgatatgaagatccggttagttttgggtaaacttccggcgactgaattcattcgtaatgagcaacaagtgctccccaaaaaaactgccgaattaagttttcaggaaataatcaccaatcttaaggctctgttttcagacacaaagtcagtgtttgttcgacgttttgtgtgtttccagcggacgtgttcaccaggacaggacattctcgactttggagcaacactgaatgccaaatgcgagcgtgccgacatgaatttgtcaaaggcggaaatcaaatgcctcatctttgtcacaggtttgggtgaaatgcatcgggacctccgccccgaatgccttcggcaaatggagaatgcgcggaagacgacaccaccacgtgacatcaaattggagctattgttggaggaatgccgttcaattcaatcattgcaacactcagctgcggccctcgcaaatcctggtcaagttcatgctattccgagtaagccaaagatttgagtgacagagccaaaaattggccatcaaaaccaattcaatttcaaaaattttcgggcaacaacaattatggaagaaataatggttttcaaaataaa

SEQ ID NO: 72301 - DNA, 565 bp, Heterodera glycines
  Genomic contig location: Contig_ID=SeqID_44899; Location=93..657; Strand=+
  SCN-specific regions: Sequence locations=1-94,144-409,432-565
atgggcggaccggtgggaatcgcggccggctcattggtggcagggattgcggcagccgtagggggcgcttttgcaggttttttggaatttcctcaattttattactatttaataaattcactatcaataataataataataatcgaatttgtgccggactgacaatttgaaaaaccctttttttcaggcctttacggagggcgtgtgctgcaacggaaagtgaagcaaagtacagcagtcgactcgcagcaatcagttgttgtcggcaacggcgcagcacagaatgccaacggtcgctaaaaatggacttgcgcaggatttgggtaaacaaacagaacggggaaaagattcgtcaagccgatgactctgtcgatgtttgtctgactcgcttttcactcatttcgccgggtttttcttattttggcttatttctatttcttacgacccttcaaaatgtataaatttatcagacataaaggacttatcataaattttctttaatactagtaaaaacaagtttaaaattgtttgctgttcacacctttcgaaagagagagatgaacca

SEQ ID NO: 72302 - DNA, 315 bp, Heterodera glycines
  Genomic contig location: Contig_ID=SeqID_44900; Location=25..339; Strand=-
  SCN-specific regions: Sequence locations=1-125,225-315
atgcgttgtccacgatgttctgggccacatccgattggatacccatgttttatacaacctctgaaagatgaaacttcgagcggaagaagaagtgagagaagaatgcgacaaccaaatcatcatattgataataataataatgatgatgctgataatagtgttaacgatagaggccatgatgatgatgatggtaatgaagtggaggaggaggagcaggaagatgatgatgacgcaaacgagtcaaaaaaggcagtcaggctttgtttttttgatgctgaaacgtcccaggatttaccacttcaacttcgcaccaag

SEQ ID NO: 72303 - DNA, 273 bp, Heterodera glycines
  Genomic contig location: Contig_ID=SeqID_44900; Location=490..762; Strand=+
  SCN-specific regions: Sequence locations=1-162,184-273
cgcctttctggaaacaatagttaatctgacagaacatgtcaagtctgcctggatgtcattgggtgaggattttgcctaggaagcgcttgcacatttgaaacgccttgtcatcccgcattgattcaacaaattaatgaactccgaataatgtgccaccaattattaaacaatttaaaaaattgacatggctttttgactgtaatggattattatttggtgaatcaaacaccacaaaaattaatactatcagaatatccaagaacaaaaaaaaaa

SEQ ID NO: 72304 - DNA, 666 bp, Heterodera glycines
  Genomic contig location: Contig_ID=SeqID_44901; Location=268..933; Strand=+
  SCN-specific regions: Sequence locations=1-53,75-666
atgaaacgaagcaacacgacaaaagacactcctcctcaaccaaaacgctcaatggcatctgcaccggactcgggcccaaacactgcggcactcgctgagcaagaacgccaacgcacattggtgctcattggcctcccggaaagcaatgctgttcgcccatcgcagcgtgttaaagaagacagggaagccgtgactaaaatcttggaccatcttgatgttgaggctgaaccaaccgccgtctttcgactcggccggttcaacccacagcgaacaacacctcgcccgctcaaggttgtcatgccaacacccacacatcaacacatggcacttggaggatggaagcgcgagcgtgctcaactccgttctcaacaaaacctggcccgcttgttcgtccgcccagcactgaccaaagaacaactcaaggaggaaaacgaagcgcgcgtccgaaaacgtcaacaaatcccagctcccatggcgccggcagcgcagctcccacagacaaatgttccgactcccgtcaatgaaaatgggtcagaacagaaggaggcggcaaatggatacatttccaaaccgcagaaccccgttgaagaagaaatcctcttagacaaagcaatcagccaaatgcaatccttccgaaaacaattccctcaattatttaataaatag

SEQ ID NO: 72305 - DNA, 425 bp, Heterodera glycines
  misc_feature (414)..(414): n is a, c, g, or t
  Genomic contig location: Contig_ID=SeqID_9678; Location=15..439; Strand=-
  SCN-specific regions: Sequence locations=1-143,173-425
atggttttaattaaggtgtggaatttgacaacggattaaataaaattaatgggttgagacagcggatcaacctgctaaaaaggaagacgagaagatggaaaccgctgaagatgaggtgcacaagattatgcagagaccgttactttattatatttaatttttcttaaatttagatcgatgctgaaattttgcaaatggtctacggaccaaattcgggagcggtcgctgttgctcgacaacgaaattcgcataatgcgcagtgaaattcagcgcattaatcacagtattcaaacactcaaagagaagacaaaggaaaacaacgaaaggatcaaagttagtttcattcgaaatattcgaataattgagttatcaatccagaaaaagggtgtaccttattatagctctgcgcttatnaatcgattaaa

SEQ ID NO: 72306 - DNA, 1207 bp, Heterodera glycines
  Genomic contig location: Contig_ID=SeqID_9678; Location=3529..4735; Strand=+
  SCN-specific regions: Sequence locations=1-235,257-1064,1086-1207
atgatccatctgagtgtgttggaggtcggccgcgtgggcaacgacggcgttggcattgtgcaactgcacaacactttcgacttcggcgcgtcggacgcgcggcggacctgcgcttgttgtgccgttctgtgtgcttccgggtgcgggtgcggccgtttgctggcggaaggcaagtgccatggcatcggaagatgggctaatgctttaatccatcaaccccaattttaagagaccatcttcaactacgcaaagaatggcatcgctgcaaagtttgggagcggaggccgaggatttgggcggagatttggtcgcaaatggcgcaagaatggaagggacggacgcctcgaaacgattcgcgaagggacgtacggaagagacacggcaatcgaacagaacggagagagggcgggacacgggacggtgcagagaggcggcagaagacgaggagtgaccgtcagaagaaatgagatgcagcggcaggagcaatcgatcggccagagcgacttccgtcttaaagcgatcagtggacaatgcgacttccaatggcaaccgatcggatgggacgacgtctttcagcgagaaatcgccagaggcaactcttttgtgacgtcatttggaagaattgacgaagaacgtgcagaaaaaccgcagcagtcggtccgtggaaggggaggaggacgcggacgaagtgcaaacggcggacgggggagacgcggaaacggcgccgggcgcggatggtctcgcggagcatcgcgaaactttgaccaaggtggacggactgatcactaattagtgctaatccccccccctcccttcagaatggcagatcgatggtccaattgtggcaggcgtctcaagttccaagtcgggcagtggcactcacaatgcgcgttttgtccgtcgtgaattgcgcagggactccgtcggcaacagctaccgtaacgacagaagggacgagcccaaactcatctaccgtagccgtaaagaaaattcgaacgatcacttttttcactaatattcggcatgaaatgttatgtcaccttttaatattccgtcgttttgttcatattatttgtttctccttatctatttgttgttactcatcggcagtaatctttaccctttaatcattttttcttattgtttgtctctttttgttttatccgtttttttcacttatcaccactaatcaacaaaggagaggcga

SEQ ID NO: 72307 - DNA, 214 bp, Heterodera glycines
  Genomic contig location: Contig_ID=SeqID_9678; Location=1027..1240; Strand=+
  SCN-specific regions: Sequence locations=1-91,115-214
aaagagctgcctaggacttgagttataacgtgatgaacatttgaaactctcacaacttttttctgagatgtcaaattgcttagcattcacttagaaaaagattctccttttcaaaatctttttttagataccaaatttgttcatttttgttgggaatgaagcgtattatggctgatcaaaataaaaaatacaaaaaaggcatttaccagtgtaa

SEQ ID NO: 72308 - DNA, 599 bp, Heterodera glycines
  Genomic contig location: Contig_ID=SeqID_9678; Location=4925..5523; Strand=+
  SCN-specific regions: Sequence locations=1-367,390-460,482-557,579-599
gttctgtcattgctctgctgattttcggcataatttgcctttgttttggcattttctctctcatttttgtgcccaaattggtcaacaaagcgatcagagaagttggccaagggaattaaatttcaaaaaataagagttttattaatgcacagaatgtttttgttggtcggtttccaaacggaagtgataatttcgcaatggaacagtacagagacccgaaatacgacgtaaagtgagtgaaaaagtaaaggaaacaacggcagaagagaagtctaaccaccggcggcggtggtttgttcatctaccgtacccccttccccgccccaaacgaccgtacccacgcgccaaattaacacatttattattattcattaattaccatttgctccattaaatcaacagccactttaggatgcagatttgggtcttttctgtgcaaaaccctaacgaaattgtgaataaaggagaaaaagcgaatgtgacggagttgggtccgttcacttacgagtgagtgccgccgggcggtcgaatttaagtccaatttttgagtattcgaatcaaagaaacaatgtgaagtttggctccaatgactcgcgact

SEQ ID NO: 72309 - DNA, 1161 bp, Heterodera glycines
  misc_feature (1138)..(1138): n is a, c, g, or t
  Genomic contig location: Contig_ID=SeqID_44902; Location=1..1161; Strand=-
  SCN-specific regions: Sequence locations=1-73,95-662,685-760,782 -894,960-1161
  Gene Ontology: Cellular component=mitochondrial matrix; Biological process=2-oxoglutarate metabolism
caaatttaaaaattttcaagagtccccaattccccgagctattgtcgtggggtcgggggataaaaaatcggaggtagggggcttggggtcggggagcaaccctattataaacccccaaaataggtgctaaaaatggaaatgagataaaatattttaaaaatcaaaaatgtagtcaagtaaataaattttgaatatgaatttttgataaaattttccatttctcaggggtgtatttttcgtttttattgcatttttgttaataatttttttcaaaacagcagaaaatattttacaaaaaattcttcaaaatgaaaaagagcacaaaaaagcaataaatttattattattaacaggttatatcgctccaatttgattcgggttttttcggtcaaaaaccgaaaccgaaaaaaaccgaaccggtccgatctctattattaactatccgaagtctctgtttaatttcagatcgttgctgatcatttggtggaattaaagaaacatttgtcgccgatcgctgctcaaaagggcctttctaaactcagttttatgcccatctttgtcaaggccacttcgctggcattgaccaaattcccccgtcttaatgcgtcctttgacccgtcacacgagcaactcattttgaaagtaaatattatgggaaattgctaaaatattgccaaatccaatttaagcgtttccacaacatttcgctggccattgatacgcccgacggtctcgcggttccgaacatcaaaaactgtcaaaagaagaccatttgggaaattgcatccgatttcgagaagttgtgctcgcgggctcgggagggacgactttcgctggaagacctttccggcggaacatttgccctgtccaatgttggatcggtccgtctttcgccctctttctttctctgctccctcctcccctctttttctttactttgctgtactttcctcccctttttccccacagatcggtggtacttacatgagtcctttgttactgcccctcacagttggtcattggtgcaattgggtcaattcgtaagattccacgttttgacggaaatggaaatttggtggctacgcatgtggtgactttttcttggtcggcggcccaccgggtgagtgttggttgacanaattggacgaaaattcactttca

SEQ ID NO: 72310 - DNA, 156 bp, Heterodera glycines
  Genomic contig location: Contig_ID=SeqID_44904; Location=755..910; Strand=-
  SCN-specific regions: Sequence locations=1-156
  Gene Ontology: Cellular component=cytosol
atgttcatcgcgttcggccccaccatgggcaaaatttggttgccggtcggctgcgagctttgctccactcggacttgaaccgatccgagattgccgaatcgcaccggcactgcggcaaggtgcaggacgcgtacacgttgcgctgcgtgccccagg

SEQ ID NO: 72311 - DNA, 771 bp, Heterodera glycines
  Genomic contig location: Contig_ID=SeqID_44909; Location=297..1067; Strand=-
  SCN-specific regions: Sequence locations=1-120,295-393,415-594,637 -653,675-771
atgattagaagaggtacaccagagatcagaagaggtacaactgtgattggaagaggtacaacagtgattagaagaggtacaacaatgattagaagaggtacaacagtgattagtaaattcattaaattaaaatgaaaatattttttaacaaatttaatttaaaaaatacatgaaattctatcaattaaaaaaataattcatttaaacttataaaatttattcattaaaaaaaaattaatttaaatataattttttatttattaactcaaaaaatattttaaatgaataaaaattgaaaaacacgaaaaaaatggtagaaaaataatgtacaccgcccggcttcgaacttcgccccccccccccccctcaaaatgatgcctcagaatccccaatcacacagggattctgaggccttaacgatgtcaaaagtaaaatctgatcacgtattcgtgatcagcggcccaaataacccctaaaatcatatttttggaatattttggtgaaaaaatttttcaactcaaaaatcctatgctcacccctttggtccctaatcccaaaatcggttttatttttgtaacaattcgtaagaaagtgataaaaatgtaaaataaaatttatattataaagaaaaaaattgcggatttttgtagtattttaattttcaaaaatttcttttcagaagggggttatgaatttttttctgaaaaatcgaaagttttcagaaattctggaataacttgttttctttttaagatagaaatcccaaataaa

SEQ ID NO: 72312 - DNA, 464 bp, Heterodera glycines
  Genomic contig location: Contig_ID=SeqID_44909; Location=1085..1548; Strand=-
  SCN-specific regions: Sequence locations=1-464
atgattagaagaggtacaacagtgattagaagaggtacaacaatgattagaagaggtacaatagtgataaaaagaggtacaacagagattaagaaaggtaaaacagtgattagaagagatacaacagtgattagaagaggtacaacagagattaagaaaggtaaaacagtgattagaagagattcaacagtgattagaagaggtacaacagtgatagaagaggtataactgtgattagaagaggtacaatagtgattagaagaggtacaacagtgattagaagaggtacaacagagatcagaagaggtacaacagtgattagaagaggtacaccagagatcagaagaggtacaactgtgattggaagaggtacaacagtgattagaagaggtacaacaatgattagaagaggtacaatagtgataaaaagaggtacaacagtgatagaagaggtacaactgtga

SEQ ID NO: 72313 - DNA, 331 bp, Heterodera glycines
  Genomic contig location: Contig_ID=SeqID_9679; Location=1663..1993; Strand=-
  SCN-specific regions: Sequence locations=1-107,129-331
atgggaaggtaaaaatcactgaaaaatatcttttaattttgcctcatttttcagctttatcgactttggtttcgccgttaaacagcaaacaaaattggatgaagaaatttttgaccacaaaggcaattatgcatatgaaagcgatggcgagatttggattagcggagaaggcaaaggaataaatgccgaatattcctacggcgctggcgataccgtgggaattgccattaatttgtccactcggcagatcattttcacaaagaatgggcttcgtttgggttggtttgcaagtgtttttcactactcttctgatccatggaaaatgaaataa

SEQ ID NO: 72314 - DNA, 765 bp, Heterodera glycines
  Genomic contig location: Contig_ID=SeqID_9680; Location=7..771; Strand=+
  SCN-specific regions: Sequence locations=1-125,161-765
atgtttgctgaaaaattgtggtttttggaattccgagattccgatcccgaagtttctggtccggtcaatcgccaatcccgtgcaaccctacttcaaatatccagcgtatttaacgtaatttgaacattttattattaaatattagatttaattttattttcaaaagtattattgtcgttcccttgttgctgtaaaacatgttcccgtttcagcgcttcatcgtccaacttgtcaacattcgcctttaatatttacaaaaacaattccaatttgtatcgagaaaaaagatgcgccaattttgagctaatttttcagattaaattcatgttttttttaaaaaaagtgatttcacaccgacagaaattttctaaatttttgtgaatttcgatgattaagccaaagtgagaattattgtaaatctgattcgaaatagtgtggaatttttcatttggtaatgccatcgttccactttctgtggcgcctatcggccattacccgaaaattttcatttgccttcatcatagtgtcacttattttcctaattaaaagtgccgacggaattttcgctccgtgctcctcccataagccaaaaaaacaaaaaacaacaacaattgcttaaatttttattgaatattgagccggatgtttgtaaattattttgaaaaagcatttttatattttagcacctttgaaggttcatcaaagtttggcactttaccatcagcaccagtgcctacgccatttgtgcattcatagcaaagccaa

SEQ ID NO: 72315 - DNA, 208 bp, Heterodera glycines
  misc_feature (95)..(95): n is a, c, g, or t
  Genomic contig location: Contig_ID=SeqID_9681; Location=1712..1919; Strand=-
  SCN-specific regions: Sequence locations=1-208
ttgtttgaaatcaaagtgccgatcccaactttttggcatttcttatgcccggttttgttttcaaaaattccggtcccaaattactcattttttcncaataatttatgtatttttaaatcagacccatcattttttgacccaactgaaccctgcccacccgcgcagttcaaaccgtccgttgcaatcgtcgggaatcagcggatttttt

SEQ ID NO: 72316 - DNA, 538 bp, Heterodera glycines
  Genomic contig location: Contig_ID=SeqID_44912; Location=657..1194; Strand=-
  SCN-specific regions: Sequence locations=1-410,436-538
atgcaaaacttgcaacgcgtgcgccgataccagcgcgagttggaggacgcggaaggacgcgctgaccaagcggagagcaggtgatgaacaatgaacacgtcacggggcattcactgattttggctgatcaattgatcagaatgtataattgggcttgattagaacatacattggaatttaatccatgatcactaatcggacggtcaatgattatttagcttgataaaaactttctttgaactgatctcaaagaactgatcagattttccattacctgattaaggcacaaatcgctattgtaattttgaccaggactatgatcgagatcttatcagagtccgatcattgaactgattacctttaatcaaagcaatcacagacaaatctaatcaatttcaagacttatctgatccccgggaaaaattattttatttgcttgcttttcagtctccacctgatccgtgccaagcaccgttcgtccgttgtgaccaacaagtccaactcgccgaaggtgtacgtgctggaggacgagcaatga

SEQ ID NO: 72317 - DNA, 893 bp, Heterodera glycines
  Genomic contig location: Contig_ID=SeqID_44913; Location=1..893; Strand=-
  SCN-specific regions: Sequence locations=1-101,123-174,202-371,393 -467,489-671,703-802,824-893
ttccaacttgccgtaattgttgggaacaatgcatgttttgcgcacaatattttcagcaaattgccgaagagcgtaaaggcaatggtaattaattgatgtgatgtaataaaaatccaaattcgaaacccaaaacaacccaaaataacagaatttatttctatgaaaaaagaattcaaaaaattttaattttttataaaattacgaataaacatccaattactacatatcaagagtggcttcaatgggccaacatttgcttcatcaagtgccgaaactgtagcaaaaatgccaaaatttttgatgctgcccgggtcaggcacatctgattcatcacagctgactgaaaaaagcaatatgggcattccaggtggaaaatatccaaattaaaatttagtttttttccttttccattaaggtcctaaaaaattcgaatttcaatttttcttaattaaaaaaacttaaaattctaaattttttgttgcgtatttcttgtaaaaaaataattaggcgaatggctaatgaggattgacgaggagcaaattttcttatgtggtgccggctttcgaggaattggttcgactttggaagaagttattttcgctttcttccaatttaagaatgtgttgattcgtgtttgccaacccaatggcacttggattggttgcaaattcaattaatttaaatataaattctttttttaaagttcacgccagtgccattgtgctgatgggtctgcatgtaacgtggtgaccggcgaatgcccaaatgggaaatgcaatcctggtaaaaatggataaaaaattaaattgtaacagtagaaaatttttatattccaatcatattttgggtcaatcattgactaatttgtatgaatcataagcgtaactttaaat

SEQ ID NO: 72318 - DNA, 742 bp, Heterodera glycines
  misc_feature (39)..(39): n is a, c, g, or t
  misc_feature (159)..(159): n is a, c, g, or t
  Genomic contig location: Contig_ID=SeqID_44916; Location=47..788; Strand=+
  SCN-specific regions: Sequence locations=1-286,354-360,395-506,552 -584,621-742
atgtccccccagttgttacatcctgccattctgtcccgnctggtgctgaccccggccattctgcacccgacagtgatgtcgcccactgtgctctccccgttcgtgctaacgccgcaaatttctctcccaaatttctgggcggtcttttcctctcccctnacgcactgtcccccgtttttaagtcgccccttttcgtttattcgatcgttttgtcgccgagttggctgagctgatcaaaaattgccttcataaatatttgttgttttccaaaaattttatacagaaatttaattttatttttcgtattattttattttttttcttcttaccatcttttttttgtacatatttttttcatacatatttattaaaaaatttaataaagaataaaattgcaagggaaatacccaaaaattttacaatgtaattttttgtattttacgagtgaatgttacaaaaataaccgtttctacaatattttacatgactcttaaatatcggctatgtttaattaataatttgcattttttctttttattatatttttattacttttcgttcgaattcgactcaaatgactgtggtttaaaaaaataatatttttgatttgtaatattttagtgaacagttcatttctcgttttccattttcggtataaaaatcatttcacgcatatccaccaaaatcggtaatttgtggatttacggaaaattttgcggtcgagatttccgagacttcgtta

SEQ ID NO: 72319 - DNA, 735 bp, Heterodera glycines
  Genomic contig location: Contig_ID=SeqID_44918; Location=332..1066; Strand=+
  SCN-specific regions: Sequence locations=1-120,147-380,402-474,521-735
atgtcaaaaagtttcataaatattattattcaatttttatttctgctatgcttattttataattttgctaaatcttttggcgaaaaatccgcaccaaaccctcagcaaagtcctaatgtatatttgaatataatttcaaatttaatgggtataatcacgtgattccgttgtcaaaaatgtttttaactaaaatttcattttgggatgccaataattagggactgttaattaggtgtatttccaaatattatatttttcagtccatcataaacagttcctcagggaattatgaaagtaaagcacggattaatgcagaacacgatttgaaaaatttgccaccgtaaataggaaaaatttgaacacatcaaaaataacataaattttaaattcatacaatttttctgaaattttcctcttaattgccaaaatgtgcactaaaaaaacgtaaaatggcaaattatggatttattctacataatatgaattttttataaattataaaatatttaatgaaaaaaaactgccgtttttgcattttagttccaacaaattccatccgatgtcttgtcagttttgtcaaaagatgttgcggcacaactggaagcaatacaaaacaatggcacattgactgtgcacgaaaaggcggaacaaattgaccaaattatgactgagcagcccagcgaagtgttggacaaaattccggacccgcccaattttggcactcttccaatgaat

SEQ ID NO: 72320 - DNA, 321 bp, Heterodera glycines
  Genomic contig location: Contig_ID=SeqID_44919; Location=870..1190; Strand=-
  SCN-specific regions: Sequence locations=1-321
attttcggtaggggtcaactccgtctggccttctccgtctcagcaatgttcaaaaagctataactttttctttgttggccaaacttcacaatcatggtatcattcgaaagccctagatgtttagaagatatttataagctatttctcagtgattgatcagctctcaaaaaagttgtcagttgaaaaccgcaaaaaaggcagaattttcgaagttttttatttctatctttttttatagttctaaattttctgtaatttttagtaggctaatagagcctgtgaagagctttcgaatgatatcaagattgtttgattcagtca

SEQ ID NO: 72321 - DNA, 205 bp, Heterodera glycines
  Genomic contig location: Contig_ID=SeqID_44920; Location=1000..1204; Strand=+
  SCN-specific regions: Sequence locations=1-90,121-136,159-205
atgcgttggaatatgaactgcttgattttatttaaaattgctcataatcacaacattttttggcaaaggtgcgcctcaaaaagcagttttgcaaataattttttatttaaatgaatagaggaattgcaaatttttggtttccagcccccttggtttctttgaaaaatcttttggatatttttctagtgattaagttaaaatttaa

SEQ ID NO: 72322 - DNA, 82 bp, Heterodera glycines
  Genomic contig location: Contig_ID=SeqID_44921; Location=528..609; Strand=+
  SCN-specific regions: Sequence locations=1-42,64-82
tattacttcaatcgggtaatagtaactagagttcgacctggacctggatccaggcctggatttttcctggatccaggtccag

SEQ ID NO: 72323 - DNA, 146 bp, Heterodera glycines
  Genomic contig location: Contig_ID=SeqID_44921; Location=191..336; Strand=-
  SCN-specific regions: Sequence locations=1-146
cgcagctccatggagccttacagtttgacgtttcaagtcggagcgccttccaacgaagaatacaaatttaaaattatcgcgattgatgcgcgcggggaggaactgtgcaccctcccccgcgtcaccggccgcctccttccgtagtt

SEQ ID NO: 72324 - DNA, 1016 bp, Heterodera glycines
  Genomic contig location: Contig_ID=SeqID_1310; Location=811..1826; Strand=+
  SCN-specific regions: Sequence locations=1-387,421-437,462-495,582 -606,628-753,775-868,890-1016
atgaaatattttatgaacatttttatttgttttatccatttttacgaatgtcaaacgattgaagaggatatttttgaagaactttggaaacacataaacaaggttgaccacaaatttgaaagtgaaagtgtgctaccaaaagtcaaagaagagccaatcgaaattgccaaaaacggagtgccaacaatcaaaactgaaccctatgaattgccaatgaattatggaaaaactgtcgtaaaaaatgaaccttgtgaaaatgaaatgccaaaaactaaaaatgatcaacaaattcaaagagaaaagactcatttgacaaattatggaagaatcgtaaaagtaaaaaaggaaaaattcaatgctgaagagcccctgtataaagaagaggacaatagggatttaaaatgtgaaaatgaatgctatgaaaacagttcaacaggtaaaattaaatttaaataattaatcagatgtatttataaattaggatcagatacgaccgatgataattatgaaattgaggaaagtgctaatgatgattatgataacagcgaagatgatgctgatatcaataatgttcctaatgagggtaagtcgatttttcacatttagaaattatgattatgaaatttttctttaacagattcctcgttgacagatagtgaacaagaaaaaagagtgcatttaacaaaaaagagattaagagggattttcactaaaaaagatggcccaaaaaatggtaagaatggagcttggatttgagtgagaggatggaagaaatacattaatttttaagtaaaatcagttgagtattatatgaaattgaggtaaatttcctttttttatgaaaaatttgctcaatatttagcgattattcttaaaataatctacttttggaaaatatccttattttcggggttctttcgtctaaaaaaaaccttttagccaaattgttccgagcaatgagctccacggaagagaaagtgcgtttggctcaggcaaaagcaaccaaaagtacataa

SEQ ID NO: 72325 - DNA, 328 bp, Heterodera glycines
  Genomic contig location: Contig_ID=SeqID_1312; Location=5..332; Strand=-
  SCN-specific regions: Sequence locations=1-281,303-328
atgggaaagagtttttatgaggagaaaaagaaagaattcattgaacgatttgatgaatttaaagatttatatgcccatggcaaacagaaagaatttgtgaaggaattgggcatttctgaagtgacattttggaaatggaaaaaagaattggcaccaaaatacgataaaagtaaaagtaagaattattttagtgaaattaaattgtactttttctttaagaacgtcgtaccgatgaggacgaattgatgaagatgaagcgatattttgaaataaaagaagcaaacccgaagatgagtgacgaattaattccgaagaaatgggaatggaa

SEQ ID NO: 72326 - DNA, 331 bp, Heterodera glycines
  Genomic contig location: Contig_ID=SeqID_1312; Location=860..1190; Strand=-
  SCN-specific regions: Sequence locations=1-85,109-127,149-309
atgtacctggatccagccctgtatttttcctggatccaggtacaggcacaggccatttttcggcaacctggattttcctgtacatttattttaaataaaatgcatattctttttttctttttacgattaaataccattaattttaaaacttagcggtcatttgccccgcctgcgggcggcaaaaacattgcattaaattacaaattacacgcattcactataaaagtgaaaatcaacggactggaaaaaaagccaatgttagcctattattcaccagtagaagcagtgtgtttcaaagtagagaagagctgattttattttaaaaaataaa

SEQ ID NO: 72327 - DNA, 1459 bp, Heterodera glycines
  Genomic contig location: Contig_ID=SeqID_1312; Location=1543..3001; Strand=-
  SCN-specific regions: Sequence locations=1-129,276-379,402-461,494 -702,724-877,899-966,988-1055,1090-1459
atgggaaatgacccaattgatcaaatgaacggtttgaatgatcaaaacattctcaaaagtgttcagagttataaaaagaatgaaactgatcagcaaaagagagaaactgttaaaaaatttgatgcaattaaagaaaagttcagagaaaaaggaaaatatcaaagaaaagaccaaagcaaaattgagacaaaaattgcaaaattattaggcacaaatagaaaattaatacaaaaatggaaaaatgaattaaatttaaataaaagtaaaattaaaaagcgcttctatgatgcgaaaaagcgcaaattcattgaacgaattgatgaatttatagaattaaatggtcaaggcaaacagaaagaatttatgaaggaattgggaatttgtgaatttacatttcagaaatggaaaaaagaattgttgccaaaatattataaaagtcaaagtaagaatatattttttatgaagttaaatgtaacttttatttaagaaaaccataacaatgaggacagattagaaaagctgaaaaaatattacgaaataaaagaaaaaaatccaaaaatgagcgatgtaataattgctaaagaattggaaatttcacgaaacacgcttataaattggaagaaacaattagctaccactaattgagcagtgatttttatttgattgaacatcatgacaatataaaaacatcattttattcaattattttaccatttcttttgtgtttgatctataatacttttttattttatgtctaaaattgtctctctcttctagtgggtggttgttctttgatcacaccttcttttttgcctttttggggagcatttatcaaaaatatgggaaaatagggtccggcggtgccgataggcgccactgggaaaatttttaaatttgggcgtgcttttttaagcgaatgctgaaaattttcaaaaatttaatgccaattttagtgcctatttcgcaatttttgggcatttttcaggatttccggaaaaatccttaacaaaaaagcattaaatcaacttatttactatcagaaatttgttaacaacaattttgtttttacccatttttctacctatttcagcatttacgtacctattacacagaaactttaaaaagaaaaaaaagaagagggaaaggatttagattaaagaaacaacaaatagatagggctggcaaaaatatgtacaaaaagtggtcaaaataagtacataaaatgtaaaaaaaaatcgggatccaaatggttaggtataaaaataagtacctaggtaataggtagaaaaactcccaaataggtaagaataggtattatgaaagtcatcgtattgaccccaatccaagtggaaaataatttttttcgtgcttatctgtgcctattcaatgcgcaaaaaaaattttttggaaaaacgtacagcaaaaaaaaccttttattatattttttaattggaataaa

SEQ ID NO: 72328 - DNA, 1436 bp, Heterodera glycines
  Genomic contig location: Contig_ID=SeqID_1312; Location=3044..4479; Strand=-
  SCN-specific regions: Sequence locations=1-140,165-589,619-895,917 -1030,1055-1091,1120-1168,1209-1436
atgcaacaacaaattgaaaatggtcaaccattacaacctccgttagaagcgcaacaacaaggacaacaacgttccttgcttccatctactgcggattatgaggaacatgatgatgatctgatgcgaaacaatgctgaacgttttttgtttcttttagcagcaccgctgtggcaaaaattgcagaatgaccgttaattgatggcaattacataatttgctgtgatgagaatgagagaaaataacaataaatgttgcaatcaaaatatttgtgttaattgataaatgaaaagtaagcttttgctttttagaaaaattgtcaaaattatcattgatatttcctaaaccaattaatggcacaattttttccgtgaaaaagcaaaattgacaaattttcaccggttagctacatataaaagtcataactaggctgggaatttataatggtcataaagtattgaccaaaaaacatgaaatatggaaagtaattgcaagaatatggacacaatttttcaaaattaagggtataatttctcaaaatttcttcagattcgctaaatataaagtaaacgcttcacaaaggctaaataggtatttaaaatcatttaataaaaaaataaaggcacaatttatttaacgaaaaaacaacctaattacaaaattttgtttatttttgaacagatttatcaatctttaagagaatttgaatttaaactatgtcaaagagaaaaatttactataaaatgaactttacaaaatatggacaaatatgaaagaaaatatgacataattcgcgaaataaagaaaatatggatatagaaactccatcctgaagcttcaaaccaagataaaaatatgtcttcgtccgtttcaagcctcaaacagtccaagatataatattttcagtagagttcaaaaaaccaaattttccaacttttttggctcgaactttttcgaaatgttttggaattttgcaggctaatagagcatctgaagggctttgcacaatttatttaacgaaaaaacaaacaccaaaaataattttgaaaattttacaggcaagtggattcaataaacaatttgaagcaatcaactttattttattaatttttattattttttgcgaaatttatttgttaaatctgagtaaaaaattgatttctctgttaggaattattcatgtattaattttaaaaatatttgttgaagtggaaataatattattgaaatgcgaatataacattaaatataatcatttacagcaataaatttgatttccacaaaaatgcttttatggcatttcatattttccataattttctttgtttataaaattgaatccgccaaaattcgaccaaactttgatgaaatatttggcgacggatgggacaaagatgggagtgatcaaacagtaaaatgaacaaaagaagcaaaataaa

SEQ ID NO: 72329 - DNA, 482 bp, Heterodera glycines
  Genomic contig location: Contig_ID=SeqID_1313; Location=2174..2655; Strand=+
  SCN-specific regions: Sequence locations=1-298,321-482
atgacgaggctgcggcactctggggaagaagccggctcgaagccgaaattggcaaagatggcggtgccgactgaagtggcgatggaagccgatggatgtgccaatggaagtggcgatggaattgccaatggatgtgccgatggaagtggcgatggatgtgccggtggtactggcgaaccgctgttgttcaccttaataatttttgttaaaaaatttccgactttttctaactccgttctttgaatgcttttttagctgctttaatgcattaaaattactttaaagggtttctgcactttatctgatgcttctaacatacagttttacattttatttgactttttcctactttttagatgttaatggttttgtttccactttttaagccaaatcaattgaggaaattccattcaattaaggaaattccagaaaataagtcaatcaaagagatcggtactgaaatcggagaccatatggactga

SEQ ID NO: 72330 - DNA, 1017 bp, Heterodera glycines
  Genomic contig location: Contig_ID=SeqID_1313; Location=2862..3878; Strand=-
  SCN-specific regions: Sequence locations=1-56,85-88,204-258,280 -288,310-311,334-513,552-554,576-616,638-1017
atgtttatgacacttaataagcactggtaagaatgggggtctggtgagaaaagagaaggaaattggtggagatggagaaatttttgagaaaaaaaaaattaaattatatatattttaattacagatagaatatttttcatattttctttaccatttttatgtaattgaaattctaattaataaaaatatatcaatttttttttgtacgttgcccttttgtacgagttgcctttttgtacgagtggcgggggtcagagtcgcgggggcggtggcgggggcacgataattccgcccccgcgggggcgggggtttgctttgaattagctccaaaaaactcataaaaaaattaatttttatgaatgatttctttggctccacattcctttattcgttgatcgcctcgatactatttattttgacataaattgcacagattttgactaaaaaaaggcaaaaatagttaataccaaaatactttctattttttttaccaatttattgctacaatttcggtaaatttttgtattttttaaatttcaatatttttttatctatagaaattgttgagagaatttgttcaaaagtgaaattaatgtggtttttttgagctaagatgttttttattaattaataaatagcaatatatgaaaaggcaaaaattagttaatacaataaaaatagggccaagcgcattggagaagctggacccaacgccatttgccattgggccgtgtccgggtgcgggatgtacgtcgcaaacatcgacgactccatcagcaacaacatcagcagttacgacgacgactgcacggccgaacgacgaccatcaatcgaaagccgcgccgaaatcgtcgatgctgttgaagttggggctggcactcgccgcggcccttttgtactcgatgctaagtcgcaggccatcacgcgactactggctgcagccgagtacaaaaatggtgcgttttaagtttaacaaaattggtattgctgaaaatttaaatttaaaagtcgattaaa

SEQ ID NO: 72331 - DNA, 748 bp, Heterodera glycines
  Genomic contig location: Contig_ID=SeqID_1313; Location=5005..5752; Strand=+
  SCN-specific regions: Sequence locations=1-46,97-467,644-748
atgcattttctctttttgagcgtcttttcactctttttggccaaggtttttttttattattatcaattaatttcttatgtttaatttttaaattaagcactgttcaaatgccattccgatcggtgctggtaaccaacgggatgtgcggcgatcaatggtcattgatcttcttaatgccaatcaagagtttgatcagttgcgaagtcaattggcgactgcatcggcaaatgatttgaacgctgaagacagggtttttggcgaccttttcaaaaaaattggaaacattgctggaaacattgggaactattttggtaagttttttattacattattagcgaaatgttcaaaaataaatcaaaaaagacaaatggaaaatcttttgcaacgtttcaaaaaatgaacttagatcgaaaaaaacctggaaatggtgaacctttacaacccccgcaagaaccaccacaaccaggacaaggacaatggcagccacaaccaggacagggacaaggacagggagaaggacaacaatatccaggacaaggactgcaacaaccaggacaaggacaatggcagccacaaccaggacaaggacaacaatatccaggacaaggactgcaacaaccaggacaaggacaatggcagcaacgttccttgctaccatctgctgcggattatgagtagcttttgcagaatgaccgttaattgatggcaattacataatttgctgtgatgagaatgagagaaaatgaca

SEQ ID NO: 72332 - DNA, 154 bp, Heterodera glycines
  Genomic contig location: Contig_ID=SeqID_9682; Location=1555..1708; Strand=-
  SCN-specific regions: Sequence locations=1-154
ccgatcaatccgcaccaacaatgaaaaatggacggacatgcgaaagaagggaaggaagagcacggacactcccatcgattgaattaccaaataaatttaaaatacaagcgaattgttgcattaagacaataaaagtgtaaagcgggagacaaaa

SEQ ID NO: 72333 - DNA, 665 bp, Heterodera glycines
  Genomic contig location: Contig_ID=SeqID_9683; Location=1..665; Strand=-
  SCN-specific regions: Sequence locations=1-214,238-591,614-644
  Gene Ontology: Cellular component=nucleus; Biological process =myogenesis
cacaaaatgcccggcttcgtaccgccagtccaatcaaagtgcccaaaatgtgggaaatcggtttatgcagcggaaaaaatggttgctggcggatgtcagttcaaattaccggaataataatgcataaataattcgatcgaatcgcatttcctttacagatgactggcacaaattctgcttcaagtgcggtgagtttttaatgcccatctgtgtttctgttttattattttttaatttgggcttccgtctctcttcacattgcttttgttaggctccctttgtccgttttcatgaattgacttccagaattgtgtaacaaacttttggaatccaccaacgtagcgccccacgaggcggaattgtactgcacaaaatgccatgcgcgaaaatatgggccaaaaggcgtcggattttggggtgggcgcaggcgctctgacgatggattgtggcgcaaaatttgggaaccaaagagtcgaaatgacgttggtattacagtacgccacctcttctttgtttacccaaacgaactttccccgtgatttaacatgggaaaaacggtcagtgactactgtagtcactgactactactgtaacaaaacaaaacacaaacagtcgagccaaaggccccgccgcaacgctcgaaaactgctgcaacaacaacaaca

SEQ ID NO: 72334 - DNA, 312 bp, Heterodera glycines
  Genomic contig location: Contig_ID=SeqID_9683; Location=3986..4297; Strand=-
  SCN-specific regions: Sequence locations=1-312
atgtctcagtcgggtaccacgccagttagtgctgctactcggaccacgcctggtcaaatgttggacctctactacacctcactttgccagcctgccttccccagcataaccgagaaccctgtgagttcaatattcaacacagcttaattagtttaattacctccccctttctgtcaggttaatcctcttggaatgtatccttcacactatttgttggagcagtacaaccagcatctttctcagcagcaacaacagcagggaaataacggaggcacatccaatgcatctgcaaatgggggtggacggttttag

SEQ ID NO: 72335 - DNA, 867 bp, Heterodera glycines
  Genomic contig location: Contig_ID=SeqID_9683; Location=2739..3605; Strand=-
  SCN-specific regions: Sequence locations=1-174,197-458,480-818,840-867
atggacttttcattggtcccgttagctcataagcctgaactcatcgatcagtgcatcgatctccttaatgaggttaattccctttgtgatggaattctcattttggctttttttcggtcacaattgtaggaatggcctcgaagtcaaaaagcgcgaatagttgggctcaagagattgttgtgtacttcgccaccaatggcttatgtttttattgagaatggttccggtgaattggtgggacatctccgactcagtccgttgggcatgggaagcgccagagagtgttggattgaatcggtggtgatccgcaagggaataagaggacaaggaattggacgcaaaatgatggagatggtggagacggaagccaggttaaatcagataatggaaagatttgttcggatttacgcatcaccaatttcaaaaaaaaatgggacgcgtaaaacccaccgtgccaaattaaatgtttcattcacttcaggaagcacggtttcgacaaggtttgacagcagaatgacagtaaaaaccccaactccgatatccaaacgacagatttgttgttcgacaacggataaaatcgacttctaccgacgttgcggatacaaacagtccgaccgacccatccaaaattgtggttcaagcgctccacttctcgaacgattcggactcacatccctcctgagaaacatcgaacaaaatgacgaattatctatcaaacaaactggtacaacaactccgactgagtgccaagcaaaaaagcaaagtgacccagcaaaaaatgtacccattccaccagcaccgccattgtttttttcaggaccccataaaattacaaaaaagacatttgtatttaagcaattggaataa

SEQ ID NO: 72336 - DNA, 267 bp, Heterodera glycines
  Genomic contig location: Contig_ID=SeqID_44926; Location=818..1084; Strand=-
  SCN-specific regions: Sequence locations=1-40,90-267
atgaaaattaagccacaatttgtaagccattcccaaacagaaatattaattatataattaaatttaaaaattatattattaaaaattaacagacgaaaaaagttgcatcagcacactgccgactgcttgcactgttcggtattcgagatccttgttcaacaagccgtaaaacagcttcaccaaagcgatgtggtcgactttctgaaaagggcgtatttaattaaagtggtcgtttttccgtgccaaatcttataaaaggcaaataaa

SEQ ID NO: 72337 - DNA, 281 bp, Heterodera glycines
  Genomic contig location: Contig_ID=SeqID_44926; Location=884..1164; Strand=+
  SCN-specific regions: Sequence locations=1-112,162-281
aaagtcgaccacatcgctttggtgaagctgttttacggcttgttgaacaaggatctcgaataccgaacagtgcaagcagtcggcagtgtgctgatgcaacttttttcgtctgttaatttttaataatataatttttaaatttaattatataattaatatttctgtttgggaatggcttacaaattgtggcttaattttcattcgttttcagccggaaatcattgctggtccgcgaggatttggtcttggattggcggcctgttaatgaagctctacactga

SEQ ID NO: 72338 - DNA, 502 bp, Heterodera glycines
  Genomic contig location: Contig_ID=SeqID_44927; Location=1..502; Strand=-
  SCN-specific regions: Sequence locations=1-192,216-358,380-502
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaatttttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttca

SEQ ID NO: 72339 - DNA, 756 bp, Heterodera glycines
  Genomic contig location: Contig_ID=SeqID_44928; Location=211..966; Strand=-
  SCN-specific regions: Sequence locations=1-169,191-582,604-756
agatatggcttgggtcacaataaaataaaaaatggctagtatgtaaaaatttggcggtcacaaataaaataaaaaatggctaatatgtaaattggcgtccagaaatttttagactaatccgaagcaaagcacgaatgaattaaagaggcgaaagaattcacagtatcgtttctaatagggaaatattgacaggatattcggctaaaaacgggtttgatcatttttagcgcatttttaggtatacatttgagacaattgggcaggacaagaaaagaatgaagttgatgcctcatgaaactcggaattggttatgttttgtcgaaaatatccttacataatactcataaaaaatacaaataattcaacccacctattctatgaccacattctgaaaaaaatcccagaaatacgaggaaagatatgcttggtcacaataaaataaaaaatggctagtatgtaaaaatttgcggtcacaaataaaataaaaaatggctaatatgtaaattggcgtccagaaatttttagcctaatccgaagcaaagcacgaatgaattaaagaggcgaaagaattcacagtatcgtttctaatagggaaatattgacaggatattcggctaaaaacgggtttgatcatttttagcgcatttttaggtatacatttgagacaattgggcaggacaagaaaagaatgaagttgatgcctcatgaaactcggaattgattatgttttgtcgaaaatatccttacataatactc

SEQ ID NO: 72340 - DNA, 578 bp, Heterodera glycines
  misc_feature (10)..(10): n is a, c, g, or t
  misc_feature (18)..(18): n is a, c, g, or t
  Genomic contig location: Contig_ID=SeqID_44929; Location=587..1164; Strand=-
  SCN-specific regions: Sequence locations=1-268,290-421,448-537,560-578
ttaaagtacnaggctatnagggaagctattcccgaaggattccttctccccataaatctgggcgcatcggttcggggggactgccccgaaaacaaaaaaatcaattttttcaagtgtccgtttggggtactcaaacaattatggggagcaaaaatccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagagcattttctggaaaaaatatttatgaattaattatgcaaaaaataaacaaataatgaa

SEQ ID NO: 72341 - DNA, 126 bp, Heterodera glycines
  Genomic contig location: Contig_ID=SeqID_44933; Location=291..416; Strand=-
  SCN-specific regions: Sequence locations=1-126
atggacaactgctgcattggcagagtcagagaggggtcacaaagagttcgcacagcatcgaatatttccttcattttaggcgtcattcttccccactgcacttctttcgtcggtttaattacccaa

SEQ ID NO: 72342 - DNA, 80 bp, Heterodera glycines; identical to SEQ ID NO: 51817
  Genomic contig location: Contig_ID=SeqID_44933; Location=809..888; Strand=-
  SCN-specific regions: Sequence locations=69-80

SEQ ID NO: 72343 - DNA, 128 bp, Heterodera glycines
  Genomic contig location: Contig_ID=SeqID_44934; Location=1081..1208; Strand=-
  SCN-specific regions: Sequence locations=1-128
ctgagggacaattgaaaatgatcttttgcaattggatcttttcattgttgagaagcaaacacaaaacgctgtttccatgttttgaatatctcacgccttctctattatttatgaaaataatgaatttc

SEQ ID NO: 72344 - DNA, 1099 bp, Heterodera glycines
  Genomic contig location: Contig_ID=SeqID_44938; Location=197..1295; Strand=+
  SCN-specific regions: Sequence locations=1-509,534-577,620-737,759 -858,888-1099
atgggcagtgactctccagcagcgcgcaactacgcctatacatatgtaagtgcattaattgtttataaaatcccacaaattaatttatttttaatagattatcaaccaacgacttaagctacccaaaattgaggtaatccctttaccaccagctgatcaaatccacccagccgacctcaacgcaatgaatgtcctccgccaaaatctttacatcgaggtgaaaactgaattggggaaatgcagaatgctgtggaaagggatgagggtatgaaaaaacttaattaaaattgattaatccatatttttagctcaaaaatagactcataattaaaaaaacaatgttgggaacagagttacggcgtaagtcctttgaaaaattaaactaaaaatgatttttttctaaaatcagaaaaaatcatttaatttttagtgtaattggaaatattcgccgccctaagggatgataatttaagaaaattttatgttctggaatggaagcttgttcaattgcaaaatttttaaattttttcattaatgttcaatttcgaaaatgtgctttctttttgtcagtcaaaagtttaaaataaaattgatagaaaaattaatatttgaaaaatttgtcaaccaatttggcagatattcttaggtgctcatggggaagggaatctaaaaaacaatgtcgggagccgaagtcaaagcgtatgtccattgaaaaaaaataagttaaaaattaatcattttttcaaaaatcaaagatgttgaaaaaaaattttgtttagggaaatggaaacattcgacgccataaaggaggataatttaagaaaattttaaatttaggaatggaagctggttaattgcaaaatttttaaataataaaatgtttattacttaaaggtgactattgtgcctgatggggtacgcttgggttgcatttctatgaaataaaattttaatgaagattatgagtaagcattcgcttacttcatttattgaaacaaatttctcaagaaaaacggagaacagctcggatgcactgttcattgggttccgaagaaattggccaacgaacagttacttacaatggtcagagtaaaattcg

SEQ ID NO: 72345 - DNA, 890 bp, Heterodera glycines
  Genomic contig location: Contig_ID=SeqID_44939; Location=50..939; Strand=+
  SCN-specific regions: Sequence locations=1-782,813-890
gtgctttgcgttggttaattggcgtgggtgagtgtggtggttgggccgtttttgcgatattgtggctggaaaaaagaagcgatttcgctgtggggagcgcggccgtctgggtttaagtgcttgcttgcgcttgtgctcggcattgaacggtgatggctgctgctggggtgccacctttgtcgtggcctcagtttctccagcgattggcagctgtcgaaatgaataaaacatgcagctcgtctgtgtgttaaagaaatttggcgagttaattgacttgtgtaaatgttgcctaaggcacaaatgctgtggggaactcagcactggggatgctgaacctaaagttggtggtggtgttggtatacgagtgagtggcgtattgccatggttgacaagccctatgagttcgtggatcggaactccttgcctggggaccagtgtgcttgcattcgaaaaaacacgagacataagcgaccgaaggcctttggcctgaggaagtgtcctaaccgggaaatccggagtgctcgtgtgagtgcctgtgcactgccctcggagctgtgtccagcggcgagatggttcttcccaagtccgggaagctcggatgcctggccagcgctgtgtcattaccacttgctcggtcgccttcgccgcccatgcgcacgcttgcgctgaaacggagttgtttctgctgaaactatccgtctttacaagacggctgtaatagcggcgcttggcaacgctcgctagcagctatctggttgatcctgcctgaactgatgtgttcatttcaaagattaagccatgcatgtgtaagtttaacctgccagacagggaaactgcgtacggctcattacaccagctataatttacttgaccttgacttcttacttgga

SEQ ID NO: 72346 - DNA, 449 bp, Heterodera glycines
  Genomic contig location: Contig_ID=SeqID_44940; Location=482..930; Strand=+
  SCN-specific regions: Sequence locations=1-2,97-320,352-449
atgagagagtgggagaaaagagtgagtttgagagggagagaaaagacatgaaatagagaaaaaagataaatagagaaaaagagaaggagaagagggcagataaatgagactgtgagggtgaataagtttcaaaaaatagaatttaaaattactaagttggcagaatcattttggcattcatttccatttccaggaatttctgagtgccactagctcagtcaatttcatcatttgtttcacatcgttttgcattgccacgaggccgcgaagcggccgagtgagtaccttgggcgcagaaaaattattaaggaggagggttcattatttatttatttttttacaaaattaattcataagtatttttacagaaactgctctgaaacgcaccaaaatttatttacaagttgaataaggcactctgactcttatattatcaaaaagggagatga

SEQ ID NO: 72347 - DNA, 696 bp, Heterodera glycines
  Genomic contig location: Contig_ID=SeqID_44941; Location=59..754; Strand=+
  SCN-specific regions: Sequence locations=1-1,23-85,131-156,178 -217,307-339,409-477,518-657,681-696
atggatccaatacaggcaagaccgtctaattatgacgacagtgagctgatttcgttgatccaattccatagcatcgacataattgtaaaaataattaaaataattaacttaaaaaaaaattaattaatttgtgaggttggcgccttctcttcaatgatttgtgtcataacactttttgtcttcattagttcaaagcaaatgttatgccataatgaggtaatatatttttttaattcattaaagcaacaaatttatttttttaaataatttatctttatttattctttaataaaaaataaaatttaagcatacaagatttcagcaaatttcttaaaaatgaatttaattcaattttttatttctttagtttattataattttgttttaattaaatttttgattaaatttcttctctgagcattttgattttgatttttttattattttaatacttcgaataattgcatatttttaccattttaaaattcttttttatatgttgaagaaataattcattcaaattttctttcagttgctaacattgctcgctgccgctgacctttgcaccagcctcggcatttttgtgctcggtctaatgcgcaaggcactttatgaacaggtcatggaaacaagtcggataccaattgaggtatggtgaacaaaaataaggaaaaagatgttactaatttgaaaata

SEQ ID NO: 72348 - DNA, 625 bp, Heterodera glycines
  Genomic contig location: Contig_ID=SeqID_9686; Location=218..842; Strand=+
  SCN-specific regions: Sequence locations=1-85,107-233,258-625
atggcaatgttgagcatcaacaacaacaacccgagtgatgagctgcagtccgcccgacaagtgagtggcgttaatggacttttccttcattgtcagaattatttttggcatttgtttttgtctttatccaaaatttttgccagccttttactcgcatgtgctcggcccgttcctcatttgcatccacaggttggaatcgctatttccagaaccgttccgcgcacggcactctgtcggccgagggcgccggtgcggcggaggcaattcaaagtttgaacgaacttggcaaagacgacgaggagcgggacgaattgggcaacaacaacggcaacagacagatgatggacggtggaggcggcggtggcttatcccaggaggaggacctcaacgaatttaagtcggtcgtttcgcatttaatttactttcaaaaccattcatttaatgtgctcttttcagtctttactattcaatggccgaggatggtgcccgtttggactacttccaattcgcctacgagggcgtgtccgagtcggacgagccggactcggtgacttgttcaaggcgtaattcccaagaaagcgaagaggaaaaaggttggaatggacgagttatggacacagtttaa

SEQ ID NO: 72349 - DNA, 831 bp, Heterodera glycines
  Genomic contig location: Contig_ID=SeqID_9686; Location=1278..2108; Strand=+
  SCN-specific regions: Sequence locations=1-275,297-646,668-831
atgcttaacgcattgcctttgccgtccaaccgagaacacgttgagaaagccgctgctgctgggcccggtcgttggagcccggtgccgaagagagcgcgcactgttgaggagaacatggcactgatcgaatctcgatggcaatatttggaggtatttaaaactgccgactaaaaaagggggcgggggtcaaccgaggataatgaattatgcgaggaaatctgaattttgaattcacaggaattacgattggaaagagaggaaacagccaaaaaggagggagaaaagggcgaagaagacggggacaatctcttccgattggacttaagcgaagtcgcggcaacagacgaaaatgggaacagcgaagaacaacaacgacagatggcggaagaacggatggacgacgaggagaacggcgtcagcggggacaatgacaaaaacgcaaataatactgacaacaataacaacaatgaggacggatttccgatggaatgcgtcgatggaatgggtaagggtcaggttataggcgtaaaatacaagaatttagaaaatatcgtaattttaaaacttatttgtgcgatacatattcttaaaccgaaggaggtgtatatcactcttttaatttgttattaagtgtctgtcttattccaattgaatattatttaatttttctctctctctctctttcttttcaggtgccggcgttctgctcgattctttgttcgaagcattgagtcgactcactgagcacacttttgccactaatttgcaactgatcggcgcgttcaacgaactgttcgcctactcccaaccgttgctgaccacctatttgtt

SEQ ID NO: 72350 - DNA, 57 bp, Heterodera glycines
  Genomic contig location: Contig_ID=SeqID_9687; Location=303..359; Strand=+
  SCN-specific regions: Sequence locations=1-57
tggcgtaagaagcgaatgcgtcggctaaagcgcaagcggagacaggcgaagaaatga

SEQ ID NO: 72351 - DNA, 731 bp, Heterodera glycines
  Genomic contig location: Contig_ID=SeqID_44942; Location=462..1192; Strand=-
  SCN-specific regions: Sequence locations=1-104,126-158,188-312,334-731
atggctggcaaatgctttatgccaaacgaaagtgccaaaactggtggcatttcgttgcggttcagcgccgactgcagcgtgagccgtaagagatttttttagaatttacttttttatatttattctcggttgaaatatagatcgaacaaattatttcgtttaattttttaaaatttaattaaaaattgcgtaagaagatttaatttagttaattcatggaaaaatacaaaattttcactgagtttctggggttttatcagctaatctcgccagacttaaacgccaggcccgtagccaggggatggaattgggaaaataaacaaaaaattgaaattttttttcttggaacttcttctgttaataaatttgctaaaaagtgacatttttcacttgagctcttaaatttaaaaaattataacgaaaaattaggcctatattcaatttacaggcctggcattggcgaaaaaagtcgtctcggcgataaaaatgccaatttttttgtccccgctttttagcatgtctaatgcgtgccgttttacgcggctcgaccaactccccagcagcggatgaagcctgtctggtggaaaaagatggtgccaaaaagtgtgctttcaatgttggccaatcgttcgatgccgtggccgtgtcctgcaacgggtgcccgagtcagaaggtgctcaaatgcgcggaatatatggcacgatagaaaaaaggacgaacgacgaaataaa

SEQ ID NO: 72352 - DNA, 80 bp, Heterodera glycines; identical to SEQ ID NO: 51817
  Genomic contig location: Contig_ID=SeqID_44943; Location=575..654; Strand=+
  SCN-specific regions: Sequence locations=69-80

SEQ ID NO: 72353 - DNA, 49 bp, Heterodera glycines; identical to SEQ ID NO: 51181
  Genomic contig location: Contig_ID=SeqID_44947; Location=93..141; Strand=+
  SCN-specific regions: Sequence locations=1-49

SEQ ID NO: 72354 - DNA, 574 bp, Heterodera glycines
  Genomic contig location: Contig_ID=SeqID_44948; Location=384..957; Strand=+
  SCN-specific regions: Sequence locations=1-29,67-114,136-143,175 -180,207-355,411-449,547-574
atggtaattatttgtacatatcctttttgaattaaaaatttaaaaaaatatattttagattataatctgtctagtaaagtttctgtgcaaatttggggaatatttttgttttgattggtttcatttcttttcatataaatttgattaaagtatttcttttctttttcctttaatcaaatgtttaaaataattattatttataatatcgactttttgagaattggtattttatgaaaaagggtttaattaatgacgaaatttaaaagtatttatcatttaagtcattttaatatggttgatttggtttgttttcattgcaaattaatttaataggtaaatacagttattttttcactttttaattaattttttatatataaattgattttactatttaaaaaattatttaagctcgctttttagcacttttagagaattggcattttgtcattaatatttgtttttttaaatttgttattgaattattttaagttttttattatgtataaattagcttaatttaattcattatttttatcattaattctaattgcattaattatttacttccata

SEQ ID NO: 72355 - DNA, 844 bp, Heterodera glycines
  Genomic contig location: Contig_ID=SeqID_44950; Location=162..1005; Strand=-
  SCN-specific regions: Sequence locations=1-129,168-230,253-444,474 -480,532-594,616-844
atgcaattggcatttaccataatctctactcggactgaattcaacgagaattcgaaattagaagtaacattggctaatgctgatagaattggcaaagctttgcttggcatttctgaaccaattgagcacaaatttttagaatatttaaaaatttcaaaaatatttttgttggccgattcattgggtgctgatgaaacggcattgatcgaagctgaatgcaaaaatttggaggtttggcattgatatgcaaatattaaaaatggcttagaaattttcagttttttttttgcaaagttaacaatttgtcttttacactgaaaataaaaaaaacacaaaatttcagaaactttctggaaggaggaggctcataaaaattcctttggtaaaaaagtgactaaaagaaaaatcaaacaaaattttcttgctttgggatcatttaaccataattgatcttttttaattttaaatgcaaaagagaacattaattaaaaaaaatgttttttatattaaaaattaatgaataaattttttgagaaataacattttttatgtttttgtttttgatgagggctgtttacattaaattaaatatgctttatttaaatttaagaaattcattaccaattttgtccctattcgtgcatcatcagctgaagaaaccaataaaattggcaaaaacaatttgaaattttatgtccattttttcaaagaaatgcagcagttgctggacagcattaagcacatcgtcaaaagtggattaaaagaattatggaagaaacttattgcgtttgtagaaaagtttgaggaaaaattggaaacatttgccaaatcaacgaaaaattga

SEQ ID NO: 72356 - DNA, 846 bp, Heterodera glycines
  Genomic contig location: Contig_ID=SeqID_44951; Location=760..1605; Strand=+
  SCN-specific regions: Sequence locations=1-288,310-846
atgcaaaaacctattccttcaaatcgccccaactcttctgtctccaaaacccttgcctgcgggcttgaaaaaatggtgaatgcgagtggaaatgagccactcacggtgccggtgctggcggatcggagtgatccgctggggctcaagtcggttcaacccgacccggtgccaatggaaagtgccgaggctggcacaaaagaaatggaagtgatggaagtggatgaaatgagcggagaaaaagggaaaaagggagaaatgggtaaagaaaaggtgaaaagtggtggaattgaagaggaggaagaaagtgagggcagtgagggtgaactgctaggagacggtggatttggcaatttgcaactaaaccccagcctgagggcgggaaataaagcagttgaaaaggaagataaggggaaaccctatctggtcgcccaagtgagaagcgacggtgtgatcgcggcacggatgaaacttttctgggatttcccggaattggtctttgtcccttttagcctcttcgacaacgcccagccgatcgaaatcggcgatttgttccgcttacataagtgtgagtggacgaatagcggaacaggatgggaagagcgcggagattggctgtatgaagcaaccggacggctgaactaccaagccacggcaacggacgtgagccaattgcgccagcgcatccccactcaggccgtcggcattttggtcgatgtgcaaagagcccgtgaccgacacgtcaaagtggctatggtgtcagcacctgagctgagctgcgtgatgcgcgcctaccgtcgccacttcccggccgatttcacggataacgacatccgctaccgctccgtt

SEQ ID NO: 72357 - DNA, 1097 bp, Heterodera glycines
  Genomic contig location: Contig_ID=SeqID_9689; Location=1223..2319; Strand=-
  SCN-specific regions: Sequence locations=1-658,682-746,775-895,917 -1097
atgatttattttcgtgctcttcttgagcctggggtgcgatccttaccgtaccggcctcttcgagaggataacggcgtcgcagttggtttgcgtgccgttagacggctcgtccgagtgcccggaacgtggacgcgatacgtcggggatttttccaatcttcaattatcgttccattaagccaaaatatttttccacgattgaagttcaaaagaagaactgaatcctttggcaaaaactcaaccgattttgctcagtggtgttgatcaaattgacgagccatttttcgcgcataatcagcttgtgatttacggcttttggctgggtcgatgattttggcttgttcttcctttgggtggacaagagacaactgtgtgcggagtcttcgaccgaagaacaattgatctggcgaaagtccgttgagtaccgaattcggagttttcctgtaggagagaagcatcttttatgcccaaaatttaccatctttggcgcatttcttcagggcccttttgaacgtatcgacgacccgctcaactttgctattcgtttggaggatggagttgatgtagcaatctgtgtacagatatttgttatcaaaatgtctatctcggggctaggttaattggcgattaagcgggacagtacatcggcttatccgaagatttttttaaattaatttttttaggctttttaggtttattatagcttcataactaaaagtgctcagtttccatttatatcatctctcctttttaaatattttaattttcaaaaattgtattcggtttcttttgtaaatcttttatagagtagcgcggccgtgcgcggtggacgtgctggcgttgggacttgggcaatttgggaggccaaatggggaataatggggagaaactcatataactcccgaaggaagggccccatggggtgatcaagcctagggatcccatcccactctgatggtcacacttaatgggaaagtggctttattctcgggactgagcaactgaattgataatagcgtaaatggtgaacattaaatacatgtgaaagcgaaatatgaccgatcaatgattggtcggggaaaggggtggtacaataaa

SEQ ID NO: 72358 - DNA, 74 bp, Heterodera glycines
  Genomic contig location: Contig_ID=SeqID_44953; Location=181..254; Strand=-
  SCN-specific regions: Sequence locations=1-74
tccaagtggggaattgaacccaggcgaaaaattatgaaaggtagaaagttaaccactacaccacatgtgcatgt

SEQ ID NO: 72359 - DNA, 62 bp, Heterodera glycines
  Genomic contig location: Contig_ID=SeqID_44955; Location=1..62; Strand=-
  SCN-specific regions: Sequence locations=1-62
aaaaaaacccggctttttacaattggccaaaaatgggttgtaaaatgtgtgttttcacctta

SEQ ID NO: 72360 - DNA, 48 bp, Heterodera glycines
  Genomic contig location: Contig_ID=SeqID_44956; Location=868..915; Strand=-
  SCN-specific regions: Sequence locations=1-48
atgcaaaaatttaattattttaacgaaaagcgattcaatgtcgtaaaa

SEQ ID NO: 72361 - DNA, 475 bp, Heterodera glycines
  Genomic contig location: Contig_ID=SeqID_44957; Location=238..712; Strand=+
  SCN-specific regions: Sequence locations=1-261,290-475
atgcgagttcaaaaacagcaccaacaaatgcaacggccgaatctggacggacctccacgaccaattcattcgcctagcaactccgcacacatgtccagcagatgcgtcacgtgttgatgctcaaatggtcacgaccgcaatcaaaaggcgtgcaattgccaccttcgaaccaccttctgtcatcagagcagaagcgcttcaaaatgtcccgtctccgtcagcaattttggtgtcaaaacaagcagcaaaagatgtgaaaacaaaatatttttcatttaataaaaacaattccaatttagttgatcaaaagagctcgccgagaagtgaatgcgccccccgtcgttcctgcaaatcttgagcagcttattatcagcccggcgtatcagacgtacacaccgacggacggcattgatgaagagttcctgttaggagacagcggcgtatattatgaacgaggaaatgagaacccacagag

SEQ ID NO: 72362 - DNA, 505 bp, Heterodera glycines
  Genomic contig location: Contig_ID=SeqID_44958; Location=164..668; Strand=-
  SCN-specific regions: Sequence locations=1-1,23-133,155-258,287 -295,317-390,419-505
caaaagttttttacaaccacttattgccaatctaatttcttgcagatttaaagctatccattgcctgccggttctcggcagagcaaagcactaatagggtgtttgactcacttcaaaaaataattccttacccaaaagttttttacaaccacttattgccaatctaatttcttgcagatttaaagccatccattgcctgccggttctcggcacagcaaagcactaatacggtgtttgacttacttcaaaaaataattcattacccaaaagttttttacaaccacttattgccaatctaatttcttgcagattgaaagccatccattgcctgccggttctcggcacagcaaagcactaatagggtgtttgactcacttcaaaaaataattcattacccaaaagttttttacaaccacttattgccaatctaatttcttgcagatttaaagccatccattgcctgccggttctcggcacagcaaagcactaatacggtgtttgactc

SEQ ID NO: 72363 - DNA, 213 bp, Heterodera glycines
  Genomic contig location: Contig_ID=SeqID_44961; Location=111..323; Strand=-
  SCN-specific regions: Sequence locations=1-91,121-213
gctaatagaggacactgggctatcaaatgataccaacaatgttcaattagttgagaaagaaaaacgttatagtccggggtccaaattcttgtaaaatataaattattaatgaaaaatatagaccaaaacttgaaatattcaggaagccaaacttgttcggaatgataaagttaggactttttaagcttggccgagatagagaggtcccccacg

SEQ ID NO: 72364 - DNA, 2662 bp, Heterodera glycines
  Genomic contig location: Contig_ID=SeqID_9690; Location=458..3119; Strand=+
  SCN-specific regions: Sequence locations=1-19,41-159,181-1237,1259 -2048,2070-2558,2580-2662
atgtaccccgacatccgaccaaaagctaaaccagccccagcagaaatcaacgccatggccattcctcagccaacgcacaaaatttcggatttggaatcgctcacaaaggccctccaaactgatttttctgaagtttttggccccggattaggccattgcaccaaagcaaaggcccatttgatactcaaatccgatgctcacccaacattctgcaaagcacgccccgtcccacacggcgccctcaatgccgtcaacgaagagttggaccggcttttgcagattggagccatcaaaccgattgagttcagccattgggcagcaccgattttggccgtaatgaaaaagaatggaaagacccgagtttgcatcgacttttccaccggcctcaacaattcgctcgagttgaatagacaccctttgcctcggcctgaagacatttacactgccatcagcggctccgtctatttctccaatctcgacctccgagacgcgtatttgcagatggaattggatgaggaatccaaacacctttgtggaataaacacccaccgtggcctcttccaatgccagcgcctcccatttggcgtcaaatctgcgccgtctattttccaacatttgatggaccaaatcgtctcaggcattccaggtgcgtttgcctacctcgacgacggcataatcgcctccaaaacgcttgaagagcacattttttccctttacaaacttcaaacgaatccaggaatttggccttaaaatccaattagaaaaatgcaaattcctccagcccgaattgctatttctcggccatgtcatctctgcgaaaggaattcgccccgaccccggacgatcagaagcaattcgccaaatgccgccaccacatgacttgagcacacttcgctcattcctaggcgcattgaattattatggaaggtttattaagtccatgcgcgaaatccgcgaaccactggaccaacttctccgaaaagacgtgaaatgggaatggaccgacgaacagcaaaacgccttccaaaaggccaaagaaatcatgctgtcggatctactgctcacccatttcgacccgtctcttccaatcgtcgtagctgctgacgcatcaaaagacggaattggcgccacaatcagtcatatttttacggacaaatcggaaaaagtcattgaacacgcgtcatgcacactcaacgacgcacagaagaactatagccaaatcaaaaaggaagcattggccctcgtttttgcggtccagaaattccaccgaatgttatttggtaggaaattcacgcttctcacggaccacaagccattgctggctatatttggctccaaaaagggaataccgatttatgcagcaagtcgtcttcaacgatgggcactgatcatgtccaattacgaattcaacataaagtacatcaacacgtcatcctttggacaagccgatgtactgtcccgcataatcgccaattatccccggcccgaagaagacattttgatagcaaatatctgcacagagacagattgctacatcaaaacaatcctccaaactgcaactgatcaattgccgatcacgaaagcagaaatttcagaatggacaccaaaagacgatgttctccgaaaaatttctgatcacaccaaaaacggctggccacaaaagtgcaccgaccccgatctgtcaccgtactttcctaagcgaaaggaaattttggagatcgacggatgcttgctctacggaaagcgagtgatcgttccgaccaaacttcgtgaacgcatcatcaaggctctacacatggcacaccccggaattgtgcgcatgaaagccctcgcccgtcagcacgtgtactggccaggattggacttggaaatcgagcgtatggtcaggcaatgcgaagattgccagagcgcccaaaagagtccacccaaagcaccgctcgctccatggacgtcttgctcacgaccattccaacgcattcacattgatttcgccggtccctgttcagatggccactcctatttgattttgatcgactcattttcaaaatggccggaagtatacagaatggaccgaatttcgacaccagcaacgctccaagtcctccgatcaattgtctaccgactcggatttccagaagaaatcgtgtcagacaatggcactcaattccatgccgcagaatttgaggaattttgcagcgagtttggcatcaagcataccttcaccccgccgtatcacccgcaatccaatggccaagcggagagattcgttgatacgttcaaaagggccatgaagaaatgcgccaaagatggaaaattttgggcagaaaagatgcttctcgcctacaggacaaccccgaattcggcactcaacggactttcgcccgatcaattgttcttcggtcgaaggcttcgaactcagctgtctctcctccatccgaaggaagaacaagccgaagtcatcgacccagccaaaatccgcaaatcacaagctgattatgcgcgaaaaatggcccgtcaatttgatcaacaccacggatcaaaatcggttgagtttttgacaaaagatcccgttttgcttttgaatttcaaccgtggaaagagattttggcttaatggaacgatcatcaaaagattggaaaagtccccgacgtatcgcgtccac

SEQ ID NO: 72365 - DNA, 649 bp, Heterodera glycines
  Genomic contig location: Contig_ID=SeqID_9690; Location=1076..1724; Strand=-
  SCN-specific regions: Sequence locations=1-9,31-649
gtggaatttctggaccgcaaaaacgagggccaatgcttcctttttgatttggctatagttcttctgtgcgtcgttgagtgtgcatgacgcgtgttcaatgactttttccgatttgtccgtaaaaatatgactgattgtggcgccaattccgtcttttgatgcgtcagcagctacgacgattggaagagacgggtcgaaatgggtgagcagtagatccgacagcatgatttctttggccttttggaaggcgttttgctgttcgtcggtccattcccatttcacgtcttttcggagaagttggtccagtggttcgcggatttcgcgcatggacttaataaaccttccataataattcaatgcgcctaggaatgagcgaagtgtgctcaagtcatgtggtggcggcatttggcgaattgcttctgatcgtccggggtcggggcgaattcctttcgcagagatgacatggccgagaaatagcaattcgggctggaggaatttgcatttttctaattggattttaaggccaaattcctggattcgtttgaagtttgtaaagggaaaaaatgtgctcttcaagcgttttggaggcgattatgccgtcgtcgaggtaggcaaacgcacctggaatgcctgagacgatttggtccat

SEQ ID NO: 72366 - DNA, 963 bp, Heterodera glycines
  Genomic contig location: Contig_ID=SeqID_44964; Location=216..1178; Strand=+
  SCN-specific regions: Sequence locations=1-430,457-963
atgacatgggacaatccgttgacaaccgctcaagcaaaaaagggcaattacggggagcgtacaaaaagcgccgactcaccggcacccaacaattggtcacccgactcgccaaagccatccaaacaaaagacggaagcgccgctcggtttgatcggatgacggacaagcagaaaggaatcggagaaaacgacggcacattcttcggctgacggcaccaacaaagagcagcgggaaaggcgtttgtcctggaggcgtttgataaatttgacaacaatgggcccaaaaacaaacaaatccagtggcactcagcgattcgggaatcgcaattcggaccaatgttttgagagaacgcggcgaatgggcactttgttgatgacgagtgtcctcttcataataccctggaaaaggaaggaaatcatttgattaacaaatgttaaaaaccaatgaaaatttgtttgtcttcttcggccctgtctttgccgatgagtacgccaacgaaaagcagcaaaatacccgaccgaaacattgctgcgtcaagaacaacaaaatgacgaagttcagcactgtctcgactctttcagttaattatgaattggtttataaatgccaatgcttccgctctcctcgccaaccttattgtgtttgctcaacgccaagtcggcaatgtcaacttcatgaagttgcatttttcgctcgaaaatggcataaaagcgcaaataacgggccaaaacggtgacgagatcggccggaccaaagttcccccgaacaaagagaatctttttgattctgaaagaaatgaggtaaagatggaatggcagaaaagacacgcactgctccttttcagatgccaaattgccgaagagaaaaagggacattcgtttgccaatgccaccgcccggcccaccaacatccaaaggacgcgtcgccattcttctgaatttgctcggcgatttaaactcacaa

SEQ ID NO: 72367 - DNA, 62 bp, Heterodera glycines
  Genomic contig location: Contig_ID=SeqID_44964; Location=1355..1416; Strand=-
  SCN-specific regions: Sequence locations=1-62
ggaagccgtacagggacgagagctgtttgctgaacatttaagtggcgcactccgtgcagttg

SEQ ID NO: 72368 - DNA, 302 bp, Heterodera glycines
  Genomic contig location: Contig_ID=SeqID_44969; Location=1..302; Strand=-
  SCN-specific regions: Sequence locations=1-302
aaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaaagagatagccatttttctgggatagagtataaatttaaaaaattccctcaaaaataaaagggctattgcgcacccgccctcccta

SEQ ID NO: 72369 - DNA, 101 bp, Heterodera glycines; identical to SEQ ID NO: 62755
  Genomic contig location: Contig_ID=SeqID_44969; Location=709..809; Strand=-
  SCN-specific regions: Sequence locations=1-101

SEQ ID NO: 72370 - DNA, 492 bp, Heterodera glycines
  Genomic contig location: Contig_ID=SeqID_9691; Location=594..1085; Strand=-
  SCN-specific regions: Sequence locations=1-124,146-235,257-300,322 -411,433-492
atgctttcgatgctgaccatcgtcgtctgtcctccctctctgtttctgctgctgcttcatctcttcccctcggtgcctctgctgttgcttcttctcttcccccattgtcctcctccaatttgtcgtcttcttctccgtcttctttggtttgcactgtgtgccgcaacaaacgctttcggtcgcgcaacgcctttgacaaccatttgcagtcgcgtcggcacaaagaggaagaacaactgcaacagcagcagaagacgacagcgacaattgaggctaatgagtgccaaacggaggggcgagaaaatggcggcatggaagcaaaattgccaaagattgtggcacaaaacattgatggtgaagaagaagcggttttgccaatcgaaagtgataatgatgacgatgaagaagcggagcagaaagaagacaacagttttgccaaaaaagaagtgggtaattgcatgcccatgggatgaaatcgaatgaataattaaa

SEQ ID NO: 72371 - DNA, 1017 bp, Heterodera glycines
  Genomic contig location: Contig_ID=SeqID_9692; Location=951..1967; Strand=-
  SCN-specific regions: Sequence locations=1-109,131-323,348-729,792 -1017
atggccatcgactcgaaggatctgagcgcggaggaacgcttccaattctcaatgcgaaagttggagtttctggaggagttgggcaacgacgcgggcaggtacaaatttcaatttttattttttttaatatgtcaaacattcgatttttcttgggacatggggagtcgaccaaaatgtttgcaaagggatcgatccccccccccccccaaattttcgtccctgaaaatttctgttttaatactttatggaattgtgcggcttatttataagtaaaaatttcgctatcgctgggaaaaatttggattttccaaagatttgtttggaaattaaaaaaaaaatttttttttcattttcagctcgatttgcaatggcttgctttttataattctttatctttttcctaaagggtcaacaatcacattgagaaacacctggcgtttgaaaagtgcttcgaaatttctccgtcgatgaccattttccatggcaaaaagatgccactgcacaaagagtgagttggtggaggggggggggggcggcactttttccaaattttgggccgtaaactaacaattttgagttacaataattgtttgttcgttggtcggtggtgctttcttgaaagaatccgacatttcgaacttaaaaataatcgtgtattaattatttaaattgaaatttccaatttaaatcatttcttttttccagtgtcacccctcaacagttggtcccacaacaacagcagcatcatcagcggctcaacaacaacaacattctcatcaacagcaacaacataaagatggaacatgatgatgttttgaatgggatgaattcgataaaagtggaaaatgattatgttgggattggggggaccacttcgatcaaagtgcggaagcgaaggcattcggcaagtcgatgaggagagccatggatggatggattaacaacttcaccagcagatgaacgcgttggaattcaaaaaatgaatcactctgttatttcctcgtgtttcacaataaa

SEQ ID NO: 72372 - DNA, 319 bp, Heterodera glycines
  Genomic contig location: Contig_ID=SeqID_9693; Location=675..993; Strand=+
  SCN-specific regions: Sequence locations=1-44,66-319
atggcaaaaaccaattcaaaggaaatgcccggaaagtaagtcggtggtcaagaaaaaatggaaaattttcaagcgttttttccacaacatttgttttatgctgaactagttttttttaaacccaaaaatcgatgaaatttttttccattttttgggccctggttcaattttcccagactgcgaatgcaaattattatatatttttttgggtttatgtttggtaagtgaattaatttttaagtatttacaggaaactgaaatttttccaattttgagttttgtagccctccccacaattctcgcaattaaaaaagacaaa

SEQ ID NO: 72373 - DNA, 700 bp, Heterodera glycines
  Genomic contig location: Contig_ID=SeqID_44972; Location=330..1029; Strand=-
  SCN-specific regions: Sequence locations=1-61,108-700
atgtccttccaacaaattttctccacctccgccgttcttttcggcttagtttttattacggtaattaaaaattaaaaaataaattaatttcattctttaaataatttcagtcgacgctttcggccccagcaccaaaaccgcaaaaccaacaacaacacccagcagaaaagcagccattcaatgcttatgtaagtgttgtaaaacaataaaaaaaggaaaactcaaattaattataatttaattgaaaaaactatttgtccccattttaagctaaatcccggctttgacaagcgatctttcgattccttcactggccccggcttcactgggctggacaagcgggccgctttcgacaccggcttcaccaattacgacaaacgcgcgttcgactcgttcactgggcctggcttcaccggacttgacaagcgatttgaaccgtttgatggtaaaaaggacaaccctttgattatatttgatttatgttttctttttttcaggctatggcttcaacggatttgagaagcgatcgttcgattctttcacggggcccggctttacgggaatggacagaaaatgaacataaaatggacggatggccaaattcaatcaaatcgttaaaatttgaaatttctatgtgaccccagctgttttctttgctgaattgcaccagttcgatattctcaatttatgcgccattaaa

SEQ ID NO: 72374 - DNA, 719 bp, Heterodera glycines
  Genomic contig location: Contig_ID=SeqID_44973; Location=258..976; Strand=+
  SCN-specific regions: Sequence locations=1-77,100-391,418-584,607 -659,711-719
atggtagttttatctgtttatactgtatctatctatatgtgtctcagcttactgtacgtcaatttatctaacagttcgtctctcttctgctgtttttgttttcttttcagccgtagtaatagctgtaatgacatgaaaaagacagaattaagcaaaataagtttaagtatgagctttgaattgaaaatgaaaggagccaacggaaatttatttattttgaaaagcgtacgaaagcgcaaaagggcggcataatgaaagtgatttgagagcagacaaattgagagactttttatagtagcgccaagccagacaaatgccataccttccaaacacaccaaaatgacacaacatcaaaaaaatagactcttcagctattttaccataaacaatgtattaattaattaattattaataattcaaaacaccgcagccaaactcaaattatgaccggaagtgacacacataacaaattcagaaaacctaattttgcacaattgctttcaaatttaattaattagggaagaatttagtgattcataaatcattcaaaccattaaatttaattagtgtattttaattggggaatatgtctaaaccaaattaccacatcaaaacatcaattcatttttatgacggaaatgacgcaacaaattcttaagtaattatatttttattaagatattttaaattttagaaaagaataataattacaaagaaaa

SEQ ID NO: 72375 - DNA, 100 bp, Heterodera glycines
  Genomic contig location: Contig_ID=SeqID_44973; Location=1424..1523; Strand=+
  SCN-specific regions: Sequence locations=1-100
atgttccatttgcgtttcgttgtgcttcttctgctggtaattgtcggccttttcattggccccaattttgtttctgctgattgtgataaaaaggtggccg

SEQ ID NO: 72376 - DNA, 273 bp, Heterodera glycines
  Genomic contig location: Contig_ID=SeqID_44974; Location=391..663; Strand=+
  SCN-specific regions: Sequence locations=1-273
atggacaagtgtttgaaccgaaaagatgtgttaatgtgtcgagaattggctgacgaagcgaagggggcatttgaaattgttaagcagtataggttggatgccggtactgcgtaccgtaacgcctatactcagtctgacctcgggatcggggaattggccgaaaaggtaaaggaaacaatgaaagaatatttgtcccgaccggggctatcctcaagaccaacatttaatgatgagtttatatctgcttaagggtataaaagagaacggaaaaaa

SEQ ID NO: 72377 - DNA, 247 bp, Heterodera glycines
  Genomic contig location: Contig_ID=SeqID_44976; Location=1..247; Strand=-
  SCN-specific regions: Sequence locations=1-247
aatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcgaagccaccaaaagcaaaacgatataaccaaatataaggaa

SEQ ID NO: 72378 - DNA, 127 bp, Heterodera glycines
  Genomic contig location: Contig_ID=SeqID_44978; Location=164..290; Strand=-
  SCN-specific regions: Sequence locations=1-127
atgttcctcgatgagcaacccatcgcacagtcaattcacaatgctttcacagattggcagcggttcgtttggcaaatgctttctgtgcaaaagggtggcggacggtgcccaaatggtgttgaagaaa

SEQ ID NO: 72379 - DNA, 470 bp, Heterodera glycines
  Genomic contig location: Contig_ID=SeqID_9694; Location=2769..3238; Strand=-
  SCN-specific regions: Sequence locations=1-25,59-121,144-230,252 -255,298-470
atgccccccttcggtgcgttttcccacctcctcttcttcttcctcctcttcctgctgttcgtcgtgcccaccaccgttccgtccattctccgcctctttttgcgcttttttattttcaaattcgtcgttcgttttctgtgtcgtcctcggcttcttctttttcaatttttcattgttttcgttgtaagtgagcaatgaatcggctaacaattggaaaccgtcgccaccattaccttgaaaaatttgtaaatgcataatggaaaaggaaggaagggcagaaaaacctttttgtctgtcacacagcgtcatctctgtccgattattactgccgaccaccaattataaaatttattctaaaatcccaaaaaatcatatttatagagagtctgttaattgtttcaattttcaaactaaaaatatactataatgttaacttggttttgcaatttctaatgttttgagatattaaa

SEQ ID NO: 72380 - DNA, 1230 bp, Heterodera glycines
  Genomic contig location: Contig_ID=SeqID_9694; Location=1405..2634; Strand=-
  SCN-specific regions: Sequence locations=1-290,312-444,474-731,756 -796,818-874,897-1230
atgctgactctgaatgagttcgcccgttggaccggcctcactcttttcgagatggatttgcattcggccgctctgttcctcacttcccttcttttcgtgagtttttcggatgcttttcccatcactttccttaaatgccttcgaaggtgctcagtcggcactttctcttttccctcacaattttgcatctgttcgccccccttttcgtcgcttctgccctcaatttttactttcttgtgattatttttgtgcgcactgtcattgaggacggatcaccgaagcgggcgatcgcagggtttgcattttttgacaaaaagcaacagatggataaagcacgcgcctgccattcagaaatgcgttacattttttccgggtcacaatggttgcattatttgaagtgagtttttaatcagtatgtaccaggacgagggtactttgcaaggcaaattaaaatcaaaaaattattttaataacagatgattttatgccataaattgcaagatgaattcgagcggggcaatcagcagaaatccatcgaaacgacttattttatgattatgatgcccttatgggctctcctcattgctttgtcagtccatgcatgtcgactattttagcaagaaaatgagtaccaaatatttattcgttttacaatttatttcttattctatatatatatgtatatgcttattattttttgtataaattagtggtctgtccagtgatccgttggtcatttttgattgctctcttccgttacaacaaactgaacacgaactcgcgctccctttcctcgtcccactgctcctcctcctccgccgtttcgtgcttacaattagcaggcaattcgttgtcatttttactggggttttttgacggagtgcagcacgaagagatcaacattttgtacttgagcagttcccatcgttctcgattcctggtcaaaattcgcgtttcctaattgttccgagttggtccgtcttcaacctgatctgtttgcttcgtctgatcacttcctcctcgtgttccgacctttccgcgccgctctcgtcactgctctccgactcattgccaattctgaacgcggctggcagcggattttcatcttcttctgctgccgaggggggagaattggaggacgagggacgacttttcggttgggtgggcgaagcaaacggaggagagaattgggcggaccaatcgttgctgaatgatgcaaagggcacataa

SEQ ID NO: 72381 - DNA, 55 bp, Heterodera glycines
  Genomic contig location: Contig_ID=SeqID_9694; Location=13..67; Strand=-
  SCN-specific regions: Sequence locations=1-55
gcagcagctcaacgaattacgccgcccgctgctcaccctgccgagcccgtcgctg

SEQ ID NO: 72382 - DNA, 811 bp, Heterodera glycines
  Genomic contig location: Contig_ID=SeqID_9694; Location=2930..3740; Strand=+
  SCN-specific regions: Sequence locations=1-12,55-58,80-166,189 -251,285-309,331-443,490-575,597-811
atgacgctgtgtgacagacaaaaaggtttttctgcccttccttccttttccattatgcatttacaaatttttcaaggtaatggtggcgacggtttccaattgttagccgattcattgctcacttacaacgaaaacaatgaaaaattgaaaaagaagaagccgaggacgacacagaaaacgaacgacgaatttgaaaataaaaaagcgcaaaaagaggcggagaatggacggaacggtggtgggcacgacgaacagcaggaagaggaggaagaagaagaggaggtgggaaaacgcaccgaaggggggcatttacaggggaggatggccaagtgtccgtggagttttggaaacaaattttgtagattgctagtgaatcttgggttcttaagaaaagtgctccagcaagaccaaatcagcagggggaaagcgccccaaaataacggaatattattttttattaaatgggcaaattttaaaaattaaatttaacagtcctcaaaattgcttattttttccagccgaacaaattgacatttttgttcttcagattcaacgtcttcgaagagtccaccgcattttcacttggggtcacaacattccccgtccaatcagtgacttcgcttccctcccattgcccgacaaatttcgtgcaaatttgcgtgatttcatccagccgacgcccgttcaaatgcagggaattccgatcggacttctccacagggaccatctgatcacagcacccaccggtctctgctcaaactttgcatttcaaatgctcaatttctattttataatggcttttaattcgatg

SEQ ID NO: 72383 - DNA, 690 bp, Heterodera glycines
  Genomic contig location: Contig_ID=SeqID_9694; Location=1197..1886; Strand=+
  SCN-specific regions: Sequence locations=1-58,80-542,565-621,643-690
tcacctattacctaaatgtcgcacgggaaaattcgaatttgcctgaaaagaaccttaaattcaacaacttttttaacaacgacagaacaaagccaaaacaaaatagcaaaaggagacagtgaagtgtttggagaaggaatggacaatgaacagcagaagaaaacgcatagagaaagaagcaaaagccagtaaagtgccgaatgtttggttatgtgccctttgcatcattcagcaacgattggtccgcccaattctctcctccgtttgcttcgcccacccaaccgaaaagtcgtccctcgtcctccaattctcccccctcggcagcagaagaagatgaaaatccgctgccagccgcgttcagaattggcaatgagtcggagagcagtgacgagagcggcgcggaaaggtcggaacacgaggaggaagtgatcagacgaagcaaacagatcaggttgaagacggaccaactcggaacaattaggaaacgcgaattttgaccaggaatcgagaacgatgggaactgctcaagtacaaaatgttgatctcttcgtgctgcactccgtcaaaaaaccccagtaaaaatgacaacgaattgcctgctaattgtaagcacgaaacggcggaggaggaggagcagtgggacgaggaaagggagcgcgagttcgtgttcagtttgttgtaacggaagag

SEQ ID NO: 72384 - DNA, 432 bp, Heterodera glycines
  Genomic contig location: Contig_ID=SeqID_9695; Location=1..432; Strand=-
  SCN-specific regions: Sequence locations=1-141,163-286,313-432
ctcagtcggcactttctcttttccctcacaattttgcatctgttcgccccccttttcgtcgcttctgccctcaatttttactttcttgtgattatttttgtgcgcactgtcattgaggacggatcaccgaagcgggcgatcgcagggtttgcattttttgacaaaaagcaacagatggataaagcacgcgcctgccattcagaaatgcgttacattttttccgggtcacaatggttgcattatttgaagtgagtttttaatcagtatgtaccaggacgagggtactttgcaaggcaaattaaaatcaaaaaattattttaacaacagatgattttatgacataaattgcaagatgaattcgagcggggcaatcagcagaaatccatcgaaacgacttattttatgattatgatgcccttatgggctctcctc

SEQ ID NO: 72385 - DNA, 2306 bp, Heterodera glycines; identical to SEQ ID NO: 9696
  Genomic contig location: Contig_ID=SeqID_9696; Location=1..2306; Strand=+
  SCN-specific regions: Sequence locations=1-98,127-132,167-1295,1330 -1407,1430-1514,1569-1677,1730-1893,1915-2031,2053-2306
  Gene Ontology: Mol. function=RNA helicase activity; Cellular component=cytoplasm; Biological process=35S primary transcript processing

SEQ ID NO: 72386 - DNA, 149 bp, Heterodera glycines
  Genomic contig location: Contig_ID=SeqID_44985; Location=29..177; Strand=-
  SCN-specific regions: Sequence locations=1-149
atgccgtggcccagttccgatttacagatttcctggtcatcggaatatatcaattccacttataatgcccccggcgtgcaaagcccggttatcgactcgctgatcaaccaaattattgccgcgcagggaaataaagaaaaattactgcc

SEQ ID NO: 72387 - DNA, 468 bp, Heterodera glycines
  Genomic contig location: Contig_ID=SeqID_44986; Location=355..822; Strand=-
  SCN-specific regions: Sequence locations=1-263,287-333,355-409,431-468
atgcgcagcacagtttcgtcttcaatggcacttctgtttcttcttcggctgccggcctcgtccaaaatgaggagaacgagtgaagcacaaagtgtgtgtatttttgtgttatgtttcattgggttcgcttaattgggcaattttgtctgtttgttgtgccccatttctaattttattttcgctttggaattataaagctttgttcggcttttcatttcgaaaatttttagattttagcaaagactaaaacagaaaaatttcggtaatctttcagcttttctttttactatcccttgtcattttcatttatttgctatgcttttgcttaatgttattatacatatgttttgtaaaaattataatcaattagaaaattgaatctgaatttatcatttatgttaatggaaaatcatttcagacatgctctcttcaacatccacgacaagtttggtgaaacgagataattaa

SEQ ID NO: 72388 - DNA, 524 bp, Heterodera glycines
  misc_feature (486)..(486): n is a, c, g, or t
  Genomic contig location: Contig_ID=SeqID_44987; Location=43..566; Strand=-
  SCN-specific regions: Sequence locations=1-253,275-344,366-524
atgcctgatttagtgcacagtggtgccgaagtaatatcaattcagtcaacttccgaagactgtgaaagacaatcaaatggttctgtatgtagagtcagtggaacaaccgaattaacaatattacccgctggacaaaaagtttcattagcattaaaagatgataaaggaaaaataataggttcattagaattaattttacaatttttacgattacactgtaaccaacaaactttaaaatggttacggtcatataaaataaatgttatttcaaaaagacgctgtccaacaatgggctcatgcacaaaaagtaaatgtaaaaacattaaaatggatgaaaaaattccagaaatggaagattatgaaaattttccatgaaacaatttctgtaaaaaaggagacgcaatttggggtcataaatgcgcactcccatcatcggaatgtttcttttatagaacttacgcagaaccaacatcaaacacaatttgnggattaattagatggaccggatgggaatatgaattaaa

SEQ ID NO: 72389 - DNA, 388 bp, Heterodera glycines
  Genomic contig location: Contig_ID=SeqID_44990; Location=284..671; Strand=+
  SCN-specific regions: Sequence locations=1-388
atgtctgacaaccgaaacgaagcggaggagaaaatggcgaaagcaatgtaaaattaaaacgccatttttaaaatttcaattttaaattttgttttccttttttttcagcttcatttccgccgattgttggctttgtgtgtacgatctgcttccggcttcacaacttggccttggaattgcgatgatcagccaccgttttgacttctacgtggatgaacacttcaagactcgtcgctggaatctgggatccatgaaaatcaaaatgaagttcgaagcggatggcaccaaggaaatggatgttgtcaatgccaatttggaatcgtttggaattgcgcaaaagccgttgccaaagagagtcgtcggattcaaagccatttcactgaagtga

SEQ ID NO: 72390 - DNA, 238 bp, Heterodera glycines
  Genomic contig location: Contig_ID=SeqID_44992; Location=348..585; Strand=-
  SCN-specific regions: Sequence locations=1-100,138-238
gcaaaatgcgcagaatgccaatgaaaggactttgctgctgggtattgtgagtgcgtatactttggtacgtttcggaaaagggacccttcccgtaaaaaccaaattggtgttttttaaaaaaggaagatttctaaattcttgttcgaaattccgcgagttccatacataatactcccaatcttttccagctaagtgtcgttttgttggcttcacaaattcgcacatggctgagccgcta

SEQ ID NO: 72391 - DNA, 514 bp, Heterodera glycines
  Genomic contig location: Contig_ID=SeqID_44995; Location=191..704; Strand=-
  SCN-specific regions: Sequence locations=1-478,500-514
atgctctacatgtcacaatattccttgcatgattttaacattgattttgttcttttcttacaaaattttaagtaccatgtggagtttatgaaagttgaagaggaacgtgaggaattacgcctttggatggacccaatgcgcaacattgagtatcttattcgagacttcaagaataatttgcaagaaaactccgatgcgaaaagccaggcttacatgttgattgtgcgcaaaacacaaaacgaccttaatttcaacacaaatctgatcatgagccatccgttcaaagcattgtccgatcagcaacttttgattgagttaattcgcgaacacaaaaacagcggaattcggacggaaaacaaaacaatcacacaacaacagggacaggtggaaaggcgacaatttgaaaaggcacagtcccaaagaccaatacgacccctaaagattgtgtttcgatttgttataaatgctatgtgattctatttaacaatttattgtatataatttgtaaaataaa

SEQ ID NO: 72392 - DNA, 627 bp, Heterodera glycines
  Genomic contig location: Contig_ID=SeqID_44996; Location=142..768; Strand=+
  SCN-specific regions: Sequence locations=1-37,66-75,97-130,152 -179,209-261,297-627
gatctcaccacttccgctgaaatgcaacctatcgccttggataacaacaacagcaacaataatatggtagcaagaatttttggtttgtttatttgtctaatattccattttgttttagaatccacaaatttcttcgtcagcatcttcatctcgtcgccgaaacaatgccaatgccggacgtggccgaggaagaggaggaggaaccagacgcagagcggtgagacgattgaatgaatgaagattaaaaaaaatcattttgtgaattattattattatttgtttcattttaaaataaagaatgctcgtcaacagacccaaagcgaacgaattcagtcgtcccaaccccaaacggtccaaatactttctccatcagtggttcaacatggccaaggtttaacacgtgaacaatgcgatagtatacttcccaatctggaagtgaacgaggcaatggtccgaaatgatgagcgatgtgttatttgccaaatcggatttgacttggggtcattgaatgctaccgaactcccatgtaaacatctttatcatttgtcatgcgctagagattggcttatgcaccaaaatcgttgtgccatttgtatgcgccgttttgtgcttgactctgatgcttaa

SEQ ID NO: 72393 - DNA, 477 bp, Heterodera glycines
  Genomic contig location: Contig_ID=SeqID_44997; Location=146..622; Strand=+
  SCN-specific regions: Sequence locations=1-453,475-477
atgtcaacaatcggagtagatgaaatattcaaactgtcgcaaaaagaccatcaggttttcttcctctgaatcaaaaaaatccttcaaaattttttagcctcccgaaaaaaggagcaaactcagcgatggatcaacacaaattgtgccgtcggttgcggcagcaaaaaatggaggcgacattttggaagcattagaaaagtcggaagacacttcagaactcaacgaaattgacgaagcgtcggtgaagcggatttgttttcaggttcagtgaaataatgacaaattgacagcgaaagtgattttagttggagagaaaacaggggaaaaatgcggaattgcgcataaaatacgcggaagagcctccgaaatttatggagtcggaaattgaattgaacaacgcaattcaggcaattacaagacaaaattgggctcttatatggtttgtcccccatgaattttttgaaaaaattataatta

SEQ ID NO: 72394 - DNA, 773 bp, Heterodera glycines
  Genomic contig location: Contig_ID=SeqID_9699; Location=804..1576; Strand=-
  SCN-specific regions: Sequence locations=1-97,121-452,484-540,584 -618,682-773
atgaacatcaccgagctgatcaacggactgtgcgtcaaaggggccggatgtgtcaactccatgaattttgtgttcttccttttcattttcatggcccaagtaattttcatttaattttttgatggaaaattgtatattataatttctataattttgaggtctgtattttttgggcaattttgctcaatgtgccagcgcgcttgcgctgcatcgagcgccttcgtccgcgtcgtccgcctgtttccaacaatgatgagggccacccgcgtacgcttcgctttcttgtccgtcgtgaggtgagtgggaacgctcccccccaccccatttttttcatttccttccttttggataatttttggcaattcagcgttcgtttgttcatcgattgccggccgggagtgccgggcgagaacgcccaattggaacggtgggggaggggtggggaggggatgactaacaaacaaataaataaaatcacaaattttcacaggcttcaacggaatttgtcggtggtagattgtccccaattgaggaggtggcaaattttaaaaatatcaatttgtaaattaaaatttttttatttctacaggcagacgaggccgttgagaattgagaactgaagagaagtgaagagaacaagagaagagaagaggagaagaaaatatgaaaagagaaaagaagcacaaaggaaaaatttttaaaagaaataatcagggtatcattataagtttgtccatttatttaaataatttggtgaaggttatttaaataaa

SEQ ID NO: 72395 - DNA, 1075 bp, Heterodera glycines
  Genomic contig location: Contig_ID=SeqID_9700; Location=290..1364; Strand=+
  SCN-specific regions: Sequence locations=1-582,605-668,695-697,734 -736,759-1075
atcagattaatgaaaatgtggtcaaggaagcggtggattctattgaagagtacgaggataacagtgcgtatatagaagtggcaaagaaatgtaatgaaattgttcattgggaggatttggtgagatcatcctaccggggacacacgcagccctcgagcaccatccaggtcaaattggtggggtgggtggcgacaggttgaatgatgctcatgacagaaaaaggtgatcagttggactaaagcaattggaaaaattagaaaatgcatagaaaaagagcacagaacaaatatgaaaaatgatggcaaatgcccgtggctatagccgaataagcccaacccaccccttcccatactcacattccgatcacttccattgtccacaataaccgtcgtacattttctttgtccctaaaagttttcagtccccctcccccttgtcccgacccttctccacaaagcaaatcgctagatcaaaatctttggatgctcctttcgtccacattttgcgattccgttggaaacgatatgcatattaatattcgggggtggagagatagtacacaacttggagaggaagtgcgaagaagggaagagagaaaggcagagacaacgagaacactctgtccctttcttctcttcccttggccacccatcggctcgagtgcaaagggaaaaggatgagaagaaaagcaatgaagaataaaaaatttattttaaataaaaataaaaatttacagtataccaaaaaatgcgcgaaaaacaaacagccaatacccttgggttttttgcgcgaaaaagtgtgaaaaccagggaccgtcgcctccctccccttccccgaaaatgcgcgaaaaaacagccaatacccttgggtttttgcggtaaaaaagggcaacaaaccggggaccgtttaaggtgtgaaatttcacaccttaaacggcaacgggtaccggccactaactacttacggctcccaataattcgagtccgcagcaattgcttttcgcattgcattttccatactctgcacgacttgtgataaatccaagcggtctgacatatccacgaggctaaagaaa

SEQ ID NO: 72396 - DNA, 611 bp, Heterodera glycines
  Genomic contig location: Contig_ID=SeqID_45002; Location=291..901; Strand=-
  SCN-specific regions: Sequence locations=1-191,223-472,495-611
gtgaaaatcaaatacacagacgaagccaaacgaaagtgttgctgggttatgttagccatttgcatcatttgtgtaagcctccgtttctatttcataaaatcagaaaaaaattttcccctcccccagccgttcgtcacgttgtttatgctcacgtttatgtccatgattctgcttttatccacaaatctgaaaatactctcctttctttcctttcttcctcctgaagtgcttctgattgttgtgatcctcgcagggctttcaagtcagacagctagtgtcgtatcactaatgctttgcttccacaaatcgtattttggtaaaatttttgggcattaaatatgttcaaaaatccatctctcccctcattttacatacagactgcaaacacatggcgcttgaagtgttgtacaactgtgattcatgtggccatgatgtgcacaaaacttacgaatgcttcagtacggcacggatgaatttttgttttggtgcagaaaatacgcgtccaatcaatgaccatgttcagtcttttagtccacaactttttttcttacttggtctatgcttgttttgaaacgaaagcttaagtactcatgaatttattgcataataaa

SEQ ID NO: 72397 - DNA, 730 bp, Heterodera glycines
  misc_feature (603)..(603): n is a, c, g, or t
  misc_feature (689)..(689): n is a, c, g, or t
  misc_feature (704)..(704): n is a, c, g, or t
  Genomic contig location: Contig_ID=SeqID_45003; Location=349..1078; Strand=+
  SCN-specific regions: Sequence locations=1-135,158-275,297-442,464-730
gttttgcatccgtggactactaaccaaccaacctcttttttaatgatttgtcttttgtccgactgtttgtcggagctggccgtgctgttcagctgctgcaactgttgctttagctcggcaccaacgacgcgtggtgttgttgggccgccgctgctgagcgcggcagacgcagtagaaaatgaacgtgtcaaccgctttttggccttgaaaattgccgagtctccgctgctcagcgcctcgttgtattcttggacaggacaacgcggcagttcagcctcagacgacgacgaagaagatggattcttgacaagggactttcagttattttgacaaatcaacggattgccaatcaccttgctgaacccacaggcacaggacaccggcacacacgaatcccaatagtcagaatcaaacggaatagtgacctaaaaagtaagggcgattggcattttaaataaaacaacacaaagaggtggggtttgttgacaattctgcgatgccaaacgaatgttttataaaaatgatggccaacatattggatttggaattttgtaatgctttttcgaatatctcgaccccaatttggacaaaagacaatatctngggaagtcgggattaaatgacaagcgctattccccatcccccattcgataccatctacaaacaataaatgtacctcattggacttngtcatgtccgctgtnggcacaaataaatgtgtatttgaccc

SEQ ID NO: 72398 - DNA, 242 bp, Heterodera glycines
  Genomic contig location: Contig_ID=SeqID_45005; Location=841..1082; Strand=+
  SCN-specific regions: Sequence locations=1-242
atgccatcgaatggtgcgaacgaaccgaaaatgtgggcccgcgaaggaatcgacgcactgaacgggactgtacagttgcaaagcccgcccggttacggtagcttcccctttttggacggacggcgttttcaacgagaaaacggaagcaaaatttggtatttcgtatatgcggtggagccaatgacggacaaagcaaaggacggattgccaaagcaaagcttgacaaagtgtttgtcggaagg

SEQ ID NO: 72399 - DNA, 48 bp, Heterodera glycines; identical to SEQ ID NO: 65457
  Genomic contig location: Contig_ID=SeqID_45008; Location=644..691; Strand=+
  SCN-specific regions: Sequence locations=1-48

SEQ ID NO: 72400 - DNA, 304 bp, Heterodera glycines; identical to SEQ ID NO: 69803
  Genomic contig location: Contig_ID=SeqID_45008; Location=117..420; Strand=+
  SCN-specific regions: Sequence locations=1-304

SEQ ID NO: 72401 - DNA, 1050 bp, Heterodera glycines
  Genomic contig location: Contig_ID=SeqID_45009; Location=78..1127; Strand=+
  SCN-specific regions: Sequence locations=1-101,123-135,157-351,373 -983,1005-1050
atgaaagagtgtttcgccgacggcaccttcagcatcacaccgaagcctttccaacaagtgtacgcaattttggcacggtaagaaatttaataatttaacaattttgaacttattatttaagtcggaatcgctgggtcatgccagtgtgctactgcatgctgtccaacaaaacgcacactacatacgagcgtatgtttcgtatgctcgttgctgtatggccagacttcaacccgtacagcgtgtcgatggatttcgagacagcggcaatcactgcgctgaatgtagtcttcccattcactgaagtgcgcggatgtctgttccacctcgtccaaaattttcacaaaaaatttctgaatttgggctgaaacagttgaattcatgacaaaaaaaaaaaatcgaattttcgaaaattttagcgctatcaaaatgacccgacattcgcagaaatggcacgatgtgtcacgtcgctcgcgtttctcccaattggagacttgacccctggaatcattgctctggacatggctcttcccgacgaacttactcccgtccttgactggtaaattgacaatctcaaattgtttagtatttattgttctttaattatttattaggttcatcatgaactacacgggtcgtcttaagcatgatgtaagcagaacacgcccgcgatttgacccaaacatttggagtgtttacactcgaacactgcaaggcgatgaccggacgaataaccattcagaagccgcgaacagacgcctgcaatgcgcatttgcctgttcacatccatcgatttggcatttcatttaccttttgcgaaaggatcaaaagttatccgatgatgacttcgcgaagtgttcaactggacaagaaccaccgcaaaaggcaaagaaatatcgcgaagcagaccgccgaattctcacgatggttcaaaattatttaccacttaacaacgtagacaccaacattttcccaattcatcagccttttaatcatcactttattattgcttttttgatcggaatttctcgaaattatgaaatgagaccgtga

SEQ ID NO: 72402 - DNA, 788 bp, Heterodera glycines
  Genomic contig location: Contig_ID=SeqID_45010; Location=365..1152; Strand=-
  SCN-specific regions: Sequence locations=1-224,248-252,275-301,326 -421,443-788
  Gene Ontology: Mol. function=ubiquitin conjugating enzyme activity; Cellular component=proteasome complex (sensu Eukarya); Biological process=DNA repair
atgatccccctgccggagtttgcggagcaccgacagaggttgccattgcctttgccatcccccgaagtgaggaagacccgtccaacttttaggaatcgatcatgcgctgggaagcagtcatttttggacctcaggacacaccatttgaagacggaactttcaaattgacactcgaatttactgaagaataccctaacaagccaccaaccgtcaaatttgtgtcgaaaatgttccatccaaatgtttacgccgatggaagtatttgtctggatattttacaggttaatcttgtctttaacggaattttttaaatttatttttttaagaaccaatggtcaccaacttatgatgtggctgcaattttgacctccatccaatcactgctggacgaacccaacccgaacagtcctgcaaactcattagcagcgcagctttatcaggagaatcgacgtgaatacgaaaaaagggttcaggcaattgtcgagcaggcaagtcttggcccaacttgggaatttagtcacgaagtttgaaaacatcctatatttagtcatggatgtctttttcggatggaaattcagaagaaaggaacgcggcgggtacatcaaatgtcgtggacacgggtagaggaacaaatccaacgaatgaaaatgcaccggtggagaacgaaagcagcagcgaaactcccaatgatggcagtaacatggacgagtgaaaatcacatattatatattgactgaaaggagcaaataccactgaccaatatgtccaaactatacaatttgattaaa

SEQ ID NO: 72403 - DNA, 1885 bp, Heterodera glycines
  Genomic contig location: Contig_ID=SeqID_9701; Location=619..2503; Strand=-
  SCN-specific regions: Sequence locations=1-142,219-290,312-412,625 -735,758-820,842-915,939-1030,1176-1176,1287-1287,1319-1345,1367 -1472,1509-1529,1580-1730,1762-1762,1793-1797,1835-1836
ccccccccccccttgtccatgtatgcctgggggctttatttttcaaccgcccgcctgaaaaggagggctttctttcaatgggacggcgggggggggggggctgtattatagaaatatatctattaaacattaaattatttcagttttctaccgcatctgtgattctttgtttttcgttgctcattggtggaatcatgggacttgtttttcgccaaaaagtgagaaaaaattttcgtaattctattttatgtaatatgttttattttaatgatttatactttgaaatcaaagcaacaaaattggaaaagaaatcggattcgaattaatttaaattggatatcgactgatcagatatcagtacacatcgattccaatgcaaaaattaaaaataaatggttgctttacaattaagttagtccaaacacctctgcacttgaagatgaacacatcgttgaaggagttgtacggcttgtccgacatgaccgcaattacattggcctgggacagtttgcagcgcgagttccgatgctgtggcgtcaacggcactgaagacttcaccatttggcgcacctccaaatggcacatgcaccaccgggagccaaagcccgcattcccccagtcatggtacatacacaccaccagcccaatgcttggccctcggatatttttttttttttggttggaggtctaaccaaaatttatgaaatgctaacgaaacagggagggagggtgcggaagaaatttatgaattgaatttattggaggggccttttttgggaaccacccactttggcgccagccatttcggcacgctataacatttttatttgtcatttaaattaaataagcttggtatattttaaagcgcttgatagtcccgattaatcaataaaattcaaaaaattagctctgaataaaaaagttctggccaaaaaactcaaaagattgatttttcggccatttgtttattgcttcttcccagacttttgagaagatttcatttgacccaaaaaattttatgtgctttaaagttgtgtgccggaacggttggctgagtgtgtggagcgcagcattaccatggacaaggagatgagcaatggcattcggccatcaatggagcaattagcagccgaagcagcgccaacctcggcagaagcggaagcatctgttgttggtggtggtgaacatgttgcgcaaaatcaacaacaattaccagccgattcatcatcatcatcgtcaacaattttcatgacaaatttcaccggatcagaggcggcggctttctatacaaacacttgttacatgccgttcagaacaggtgttgattttggaagtgatcatatataaaaatatttttgaacaatttgaactcttcattttggtcaatgctgagttgatgtcatatcatgacaattcgtacgaaataggacttttacaatcggcaaatcgtacaatattttctttataaaagctttaatttttgttaaaatatttcaaaaatttaatttcaactttttcttaaaaagccgtttttaattttatacgaaaaatacttttttaaaaatatatttaaaaaattgtacgaaattatcattgatccgctgggatagagcacactatttacaacttcgtttttcacataaaatgtgaaacatgcctgatttggaacaaattccatagccaaatagttaatttcaaaaatgccgaaataattgtttataattgatgttcagatttgctctcggtagttcatgttgcggcgtggctgtcaatttcttgcagtttctatctggtttgaaaattattaattcgtttattttaaatttttaattttcagttggtgccagccttctttgcaactttctttgctaaactggtcaaaaaa

SEQ ID NO: 72404 - DNA, 367 bp, Heterodera glycines
  Genomic contig location: Contig_ID=SeqID_9701; Location=1874..2240; Strand=+
  SCN-specific regions: Sequence locations=1-6,219-319,341-367
atgtaccatgactgggggaatgcgggctttggctcccggtggtgcatgtgccatttggaggtgcgccaaatggtgaagtcttcagtgccgttgacgccacagcatcggaactcgcgctgcaaactgtcccaggccaatgtaattgcggtcatgtcggacaagccgtacaactccttcaacgatgtgttcatcttcaagtgcagaggtgtttggactaacttaattgtaaagcaaccatttatttttaatttttgcattggaatcgatgtgtactgatatctgatcagtcgatatccaatttaaattaattcgaatccgatttcttttccaattttgttgctttgatttcaaagtataaatcattaaa

SEQ ID NO: 72405 - DNA, 139 bp, Heterodera glycines
  Genomic contig location: Contig_ID=SeqID_45013; Location=121..259; Strand=+
  SCN-specific regions: Sequence locations=1-10,32-38,67-139
atggacgtacagaaaaattttataaaactcatagaatattttatggtaataaatttttaaaaatacagtattttacattatttcaagaataaaaaaggtcatgagaatcatgagaatgatctgtagtgaaaaattgaaa

SEQ ID NO: 72406 - DNA, 243 bp, Heterodera glycines
  Genomic contig location: Contig_ID=SeqID_45013; Location=535..777; Strand=+
  SCN-specific regions: Sequence locations=1-124,146-243
atggtatttatgctatggattcttctgaactttgtgactgactttctgaacatggcggatattgttatgcagacgaggagaggtattaaatctcggcatttaaaaaacgcacttaaatataaatctttagaatattttgtggatggcattttgattagaaatgccaaattgacgcagaaacgttacatactcaggtaaaaaggcaaatatttgatttgcaagatttcaattttagattcatta

SEQ ID NO: 72407 - DNA, 228 bp, Heterodera glycines
  Genomic contig location: Contig_ID=SeqID_45014; Location=208..435; Strand=+
  SCN-specific regions: Sequence locations=1-228
aatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctgaaaaataaaaggtctattgcgcaccgccctccctatcatg

SEQ ID NO: 72408 - DNA, 230 bp, Heterodera glycines
  Genomic contig location: Contig_ID=SeqID_45014; Location=764..993; Strand=+
  SCN-specific regions: Sequence locations=1-230
aaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaaattctcaaaaaagagatagccatttt

SEQ ID NO: 72409 - DNA, 214 bp, Heterodera glycines
  Genomic contig location: Contig_ID=SeqID_45015; Location=341..554; Strand=+
  SCN-specific regions: Sequence locations=1-214
agcgctaaaattatcagagtgccgaaaatcgcatgtgatctaagcctagaaaaaaatggtcaagtaaaaatcgtaattacgctcaaaaagcttctcaaacaattttaacgcttccaattccttctacaatcgcctttatacatcccattatgagcgctaaaattatcagagtgccgaaaatcgcatgtgatctaagcctagaaaaaaatggtct

SEQ ID NO: 72410 - DNA, 648 bp, Heterodera glycines
  Genomic contig location: Contig_ID=SeqID_45017; Location=48..695; Strand=+
  SCN-specific regions: Sequence locations=1-418,440-571,598-648
atgctggtgtggtaagtgtgaagaactgtgttcctccaggcaaaaaattctaagaaaatttataagcatttgaagggttctcagcagtttccctgcaaaattgtccgtttggggtactcaaacaattatggggagcaaaaatccaacgcagaattaaagtacagactatagggaagctattcccgaaggattcggtctccccataaatctgggcgcatcggttcggggggaccgccccgaaaacaaaaaaatcgattatttcaagtgtccgtttggggtactcaaacaattatggggagcaaaaatccaaggtaaaaataaagtagaggtatatcgaagctattcccgaaggattcggactccttataaatctgggcgcatcggttcagggggactgccccgaaaacccaaaaaaaaattttttggataaaaattatttaaatgaactgactagataatatttaaaataggttatttctcttcatttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaa

SEQ ID NO: 72411 - DNA, 815 bp, Heterodera glycines
  Genomic contig location: Contig_ID=SeqID_45020; Location=325..1139; Strand=-
  SCN-specific regions: Sequence locations=1-1,28-141,165-196,253 -253,343-348,412-425,455-491,519-735,768-776
atgtaccgccccagtcaaactccccgcctgacactgtcatcggcgcgggtcgccgggccaccgggtggcccgacttaacaccaaaatggacaccctttcgggcgcactcccgccccaccgattaagtaaggaatcgatgaaagtagtggtatttcactggcgccttgcggctcccacttatgctacacctctcatgattcttcacaaagtcagactagagtcaagctcaacagggtcttctttccccgctaaatttgccaagcccgttcccttggctgtggtttcgctagatagtagatagggacagtgggaatctcgttgatccattcgtgcgcgtcggtagttagccgacgaggcatttggctaccttaagagagtcatagttactcccgccgtttacccgcgcttaatcaagtttccttggcttaacattcagagcactgggcagaaatcagacacggtcaacgtccacaaggaccatccgtctcctctgttttaattagacagtcggattccccgagttcgtgccagttctaaactggtcgttcagcgccaaccgaagtgcataccctgacgagcatacacgcagctgaagcgctccacaagcagctctcaccactagtccacgcaccatccccgaaagaacagcacgcagccacgggcaaaagccgcctgtttcacgcaacagcccggctgacccgacctttagagccaattcttttcccgaagttacgaatctaatttgccgacttcccttacctacattattctatcgactagaggctgttcaccttggagacctgctgcggatatcg

SEQ ID NO: 72412 - DNA, 2174 bp, Heterodera glycines
  Genomic contig location: Contig_ID=SeqID_1314; Location=82..2255; Strand=+
  SCN-specific regions: Sequence locations=1-65,87-839,861-1790,1812 -1907,1931-2108,2130-2174
atgctcgaagaagcaaataaaaacggcacgcaagtcacgctcaagcaaattgaagaggaattaaggaccattcagctggtgaaggacagcgcactcactttggcaaatcctcctgttgcaacccatgccattcacacccggccacaacagtggagggacccgaaaggcaaaacaccgcaacaacccaagagggccaacaatgcaaaggagcaacccgcgcgtccaccaaacaccaattatggcaaggcaagccgcggatcaccaacgcatccgtgcggctcatgtggagaatcggatcattggcgtacggattgccgattcaaggacgccacatgccataagtgccaaggacaagggcacattgcaaaggcatgccgacgcagctccaaccaagcgaaaaatcgcagagagcgatccgtccacactgtcgttgtcaaatcccactgcatgggaattggaaccgcagcaggccgctggtggcgactcacgttcatcatcaatggaattaagattttgatgaacatcgacactggtgctcaggccaccattctcacactcaaaacgtggaaaaagctgggttctccaaaattggacaaacccgacatcgaaacacggaactgcaatgaagtgccgttcaacatcgaaggaaaatttgtttgcgacgtttgccaacccaatcaagcacccaaaaagcttgtggcatacgtcagttccgaaatcaattacgatcttttcggactgccctggattgaggctttggaagtcatcccgcgtgaaatcatgcaccccgacatccacccaaaagctcaaccagccccagcagaaatcaacgccatggccattcctcagccaacccacaaaattttggatttggaatcgctcacaaaggcactccaggctgatttttcggatgtttttggccccggattaggccattgcactaaagccaaggcccatttgattctcaaacccgatgctcacccaatattctgcaaagcacgccccgtcccacacggcgccctcaatgccgtcaacgaagagttggaccggcttttgcagattggagccatcaaaccgattgagttcagccattgggcagcaccgattttggccgtaatgaaaaagaatggaaagacccgagtttgcatcgacttttccaccggcctcaacaattcgctcgagttgaatagacaccctttgccccggcctgaagacatttacacggccatcagcggctccgtctatttctccaatctcgacctccgagacgcgtatttgcagatggaattggatgaggaatccaaacacctttgtggaataaacacccaccgtggcctcttccaatgccagcgcctcccatttggcgtcaaatctgcgccgtctattttccaacatttgatggaccaaatcgtctcaggcatcccaggcgcgtttgcctacctcgacgacggcataatcgcctccaaaacgcttgaagagcacatttgtttcctttacaaactcttcaaacgaatccaggaatttggcctcaaaatccaattggaaaagtgcaaattcctccagcccgaattgctatttctcggccacgtcatctctgcgaaaggaattcgccccgaccccggacgatcagaagcaattcgccaaatgccgccaccacatgacttgagcacacttcgctcgttcctaggcgcattgaattattatggaaggtttataaagtccatgcgcgaaatccgcgaaccactggaccagcttctgcgaaaggacgtgaaatgggaatggaccgacgaacagcaaactgccttccaaaaggccaaagaaatcatgctgtcggaccttttgctcactcatttcgacccgtctcttccaatcgtcgtggctgcagacgcctcaaaagacggaattggcaccacaatcagccacatttttccggacaaatcagaaaaagtcattgagcacgcgtcctgcaccctcaacgacgcgcagaaaaactacagccaaatcgaaaaggaagcattggccctcgtttttgcggccccaaaaattccaccgaatgctatttggtcggaaatttactcttctcacggaccacaagccattgttggcgatttttggctccaaaaagggaataccgatttatgcggcgagtcgtcttcacgctgggcactgatcat

SEQ ID NO: 72413 - DNA, 2578 bp, Heterodera glycines
  Genomic contig location: Contig_ID=SeqID_1315; Location=21..2598; Strand=+
  SCN-specific regions: Sequence locations=1-136,158-658,680-1167,1190 -1668,1691-1707,1730-1849,1894-2139,2161-2226,2248-2320,2342 -2465,2487-2542,2564-2578
atgtccaatttcgaattcgacataaagtacatcaacacgtcatcctttggacaagccgatgtactgtcccgcttaatcgccaattatccccggccggaagaagacattttgataacaaatatctgcacagagacagattgctacatcaacaccatcctccaaactgcaactgatcaattgccgatcacgaaagcagaaatttcagaatggacgccaaaagacgaagtcctccgaaaaatttctgatcacaccaaaaacggctggcctcaaaagtgcaccgaccccgatatctcacattattttcctaagcgaaaggaaattttagagattgatggagttttgctctacggaaagcgagtgatcgttccgacccaacttcgtgaacgcatcatcaaggctctacacatggcacaccccggaattgtgcgcatgaaagccctcgcccgtcagcacgtgtactggccaggattggacttggaaatcgagcgtatggtcaggcaatgcgaagattgccagagcgcccaaaagagtccacccaaagcaccgctcgctccatggacgtcttgctcacgaccattccaacgcattcacattgatttcgccggtccctgttcagatggccactcctatttgattttgatcgactcattttcaaaatggccggaagtatacagaatggaccgaatttcgacaccagcaacgctccaagtcctccgatccattgtctaccgcctcggatttccagaagaaatcgtgtcagacaatgccactcaattccatgccgcagaatttaaggaattttgcagcgagtttggcatcaaacataccttcaccccgccgtatcacccgcaatccaatggccaagcggagagattcgttgatacgttcaaaagggccatgaagaaatgcgccaaagatggaaaattttgggcagaaaagatgcttctcgcctacaggacaaccccgaattcggcactcaacggactttcgcccgatcaattgttcttcggtcgaaggcttcgaactcagctgtctctcgtccatccgaaggaagaacaagccgaagtcatcaacccagccaaaatccgcaaatcacaagctgattatgcgcgaaaaatggcccgtcaatttgatcaacaccacggatcaaaatcggttgagtttttgccaaaagatcccgttttgcttttgaactttaatcgtggaaaacgattttggcttaatgggaccatcatcgaacgattggaaaaatccccgacgtatcgtgtccacgttccggcactcggaagaaacgtccaccggcacgcaaaccaactgcgacgccgttatcctcttgaggaggacggtaatgatacggtaaggatcccaccccaggctcaagaagagcaagactggacccatcgccgatccgcgagcctcctccgcaaccggcaccaattcgacggactcaggcaaagcgacgatctccgagtcctcctttggccccgcgtcgatcgcaacgccaacggaaagcgccgatccgcttctcgccaaacccctgagggttcagcttaaagaagggaggtgttggagtgttaaagaatttgaatttggcgcgcatcgattattgattaatgttgtgacgtgtcaatccctcccccttattcattttgtttatttaaacactccctccttccccacatggttccttctccattcatttgctattttacattttatattttgtactgcatttctcctccgacataaattgtgtttattattttattgtgtgtccaaagttgagacacaacaggttcattactatttttattctttagcctttagcaacgaaagaaaaatgaattgcaaattaattcaaataattaaatttttaagtttaatttttaataagccaacgaagtaatgacatgccatttcagaatttgttcttccatccatcataatttattaatcggttgatcaaaaattgttttggcacgtcctttgctcgtcctctcttttcttttccaagtccaatgtgccaatgtcgaatattttttgggctctgccgctatgaatgaattcgggtggcactttgatcacaaaaaggcgatggcacggctaaatgtgctttcagaatgcctttgtcgcctctcatttgtccctttcccccctctcactttaatatcgtccgcacagtcgtggattattcgcaattcgggctcaatttgactcaattcgcgtgtggtcccatccaaaacaaagcgtcctttgccatcggtatggcccaaaagtgaattttgcgattatttttattcgaaattcatttcatttgcgtggcacttgggccgcaggaattttcgcgcaacccccgcgccgtggcaatttttcggccattgcgctttttcctcagttgtcccccccccctttaaacaacctttgtccagtaaatcatccgaatctcccgggttccgatcaacgtcaaaaatggccaaattagtgtgtgctgcgaatgcgccgttacacaacaaaacgcccttaacgccaacgccttgaagccgaaaggaaatggcaaaagatggaaaattggacaaaa

SEQ ID NO: 72414 - DNA, 747 bp, Heterodera glycines
  Genomic contig location: Contig_ID=SeqID_1315; Location=1910..2656; Strand=-
  SCN-specific regions: Sequence locations=1-73,95-150,172-295,317 -389,411-476,498-747
ttttccctttcgatgtttcctctcttcacacaattgcctttcccttctctccttttatttttgtccaattttccatcttttgccatttcctttcggcttcaaggcgttggcgttaagggcgttttgttgtgtaacggcgcattcgcagcacacactaatttggccatttttgacgttgatcggaacccgggagattcggatgatttactggacaaaggttgtttaaaggggggggggacaactgaggaaaaagcgcaatggccgaaaaattgccacggcgcgggggttgcgcgaaaattcctgcggcccaagtgccacgcaaatgaaatgaatttcgaataaaaataatcgcaaaattcacttttgggccataccgatggcaaaggacgctttgttttggatgggaccacacgcgaattgagtcaaattgagcccgaattgcgaataatccacgactgtgcggacgatattaaagtgagaggggggaaagggacaaatgagaggcgacaaaggcattctgaaagcacatttagccgtgccatcgcctttttgtgatcaaagtgccacccgaattcattcatagcggcagagcccaaaaaatattcgacattggcacattggacttggaaaagaaaagagaggacgagcaaaggacgtgccaaaacaatttttgatcaaccgattaataaattatgatggatggaagaacaaattctgaaatggcatgtcattacttcgttggcttat

SEQ ID NO: 72415 - DNA, 377 bp, Heterodera glycines
  Genomic contig location: Contig_ID=SeqID_1315; Location=3551..3927; Strand=-
  SCN-specific regions: Sequence locations=1-196,218-377
atgcccaaattttgtcctcgctttttggaatggcttaacctcaacaaattggaccaaattctccgcctccgatgcaaaacgtttagctgctgcgattatgagccatttgaccaagtgaggattaaaagcgattgttctggcatttcaaaggataattgacaaagtcacggccttttcagttggacgtccaattcaatttgaaacatctccaaacggaaattatggacaaagcgaacgggacgatcttctcggatgaactgctccaccttttgttcaatggaaatccgcacataaaagcatttagcactcgctgggtgatcaattgtggcgacgacttcaccgatcggctgattgaggtcgaaattcaaattaattga

SEQ ID NO: 72416 - DNA, 829 bp, Heterodera glycines
  Genomic contig location: Contig_ID=SeqID_1315; Location=4878..5706; Strand=-
  SCN-specific regions: Sequence locations=1-829
  Gene Ontology: Mol. function=nucleic acid binding; Cellular component= mitochondrion; Biological process=positive regulation of growth rate
atggacactcagcaaggctatgagacggacgtgggagagaagggcggtcaaatgtctggtgagagagagcattcggaagacattccgaattttgccgtgacaggaggccaaaaacagcgaattgccattgctcgagctttggtgagagagccggcggtgcttttattggacgaagcgacctcagcgttggattcggaatcagaacatcttgtccaagaagcaatccaaaaaaatttgaaaggtgcgcagaaaaaggaaaagccattgggacgacattgtaaaaggagaaaaaagcccaagagaaattaaggatggaaggcataattaagcaaaattaaggacggactgtccttttgattgcgcaccgactgagtaccgtggaaaatgcggacaaaattgtggtggttagtgcaggaagagtggtgcagcagggagtacacagggaactgattgcgcaagagggactgtacaaacaactcgtccaaaggcaaatgctcggtaattttgggcatttttccgtttggcccgtttaatttgtcgattgatcactcaattagcttatgtttatatttcgagtgtctgatgtcggtaaatggttcagagcattggtcccttcgctttttccttcaaatgaaattaatttttaggcgccgaagtgaacgacgactttcccgtgcgtccggcgccgatgccgcagtcgcgccaaagtcaaaggcgaggttcgcgcgcacggtccaagtcgaaaaccatccgttcggactcgccgagtcagcaaagcgtcacggctcagagctttctcggctcaagtttggccagttcatacctttga

SEQ ID NO: 72417 - DNA, 1236 bp, Heterodera glycines
  Genomic contig location: Contig_ID=SeqID_1316; Location=19..1254; Strand=-
  SCN-specific regions: Sequence locations=1-212,234-238,279-484,539 -1236
  Gene Ontology: Mol. function=TAP2 binding; Cellular component =mitochondrion; Biological process=positive regulation of growth rate
atgtccaacactctatccttgtacatgaacgtgttttggtcagtttgtctctgttgtctgatcactccaatggatcacttcagtcgtaacattgtgatgctgttcggctctctgattttcatgttttctctctcttggcgtctctccgttatcactttcatcgccgtgccaattatttttctcatttccaaagtttttggcgtttattacgacgtaagtcatccaaaaaagaattcaaagcttaaaattgattaattaagcgaattgcggaagaaaatcagcactcagtggcaaattccaacgacgtggccgaggaagtgctcagttccattcggacggtgaaaagtttcgcctgcgaacggttcgagtcgcttcgcttcctcagctttttgaacattaccctcggcattggagcgcgaaaagctgtggcacacatcggctttcttctcaccacagaggcgagtcaaagtggcggaaggcagagactaattaattaattaattacttggcgaattgggcaatcaatttggcaattaatcctgctaattggggaaattcatttggcattgtttcagttcctccaaatgggaatcctcacgatggtactcttctacggaggacatttggtcatccaaggaaaggtttgtccatgccgttatgaattttatgagtttctctgagaccgatgccactcaaatttggcattgtgtcataagaaagagttgtcaatggcccctcatcaatcagcctttgtttctgatcagatcagctcgggattgctcgtctcctttatgctctaccaattccaattgggcgaaaacctcagagtttaactcagaacagaaaaaaggaagtgaagaattaattattaaggaattaggcgaagtttggaacggacttatgcaggcggtcggcgcgtctcgcaaagttttcgaattgatcgatcgccgtccgttggtgcaaaatgacgggcgaattgcgccggacggacgcaatgcaaaaattgaggggcgcatagaattcagaaaagtgcgctttcgttacccgacccgaccgaatgtgccggtgctaaacgtaagcggcggacagcttccaacacatttgatcacctctcttgaggacctttccttcactgtcgagcctggccaagcggtcgctttggttggccccagtggcagtgggaagagttcgtgcatcggactgatcgaacacttttacgagcccgactcgggcgaa

SEQ ID NO: 72418 - DNA, 366 bp, Heterodera glycines
  Genomic contig location: Contig_ID=SeqID_1317; Location=680..1045; Strand=+
  SCN-specific regions: Sequence locations=1-178,201-366
atgtccagacaggcaaaacagcaagccaagccaagggcttgcccaggtgagtaccaagaggatgactcgaccatggcaagtaaaaatgggaagaggacaagcggagaaaaacagcaaaaggaagaagctgcggatctgaggaaaagcgatcagacaaaagagtcggggcggaaagtatcaagcaaaagaaagaagaaaagtgatcggagtgatcgggcaaaaaagtcgaatgtttcggtgcgcccattccctccacacccaaaatattcccctccttcgacctctcaattttccgttgtccgtcagtccagtgaatgaatcttatcaaagaaagacaaaaattagggggggggggggtaattagca

SEQ ID NO: 72419 - DNA, 747 bp, Heterodera glycines
  Genomic contig location: Contig_ID=SeqID_1317; Location=1..747; Strand=-
  SCN-specific regions: Sequence locations=1-403,425-480,503-747
gagtcatcctcttggtactcacctgggcaagcccttggcttggcttgctgttttgcctgtctggacattctcgtcaatgtgataatgccaagactaatttcaattttccatcatcgttttacttccccgcaggtgctcggcttggcttgggatggtcgctttttcaccatcgataacatttaccactggttcgacttccgctattataacttcacactgaaccccgtggattttttggtctgtcccccgggggcttttctcgatgcgtcccaaaatgccttaggctgttgccattctccgcgtttgcgtccttctcggcggtgcccttggcgtatatttcaacccaaagggcggtgccgaggcgtgtgccaccttctccaatttgactttcgccttcgttttggtcattgtcgccttctcccccataaaattactcgctttctatgaacacgaggagatgcaattcgccgttggcgattggattttgatggtttggtgtatcgtcgccgccctttttgtccaggtccctggccgatcgtttttcggcacacccaattgcttcagggcatttgggtgaccgttttcgcaaaagtgcgcgaatcgatggtcacgcgcggcgacgtgcggcaccagcgaatgttcgagcaggtggacaacgaatacttcgcggagatgcaaaagcgcgagagcgaaatggacgcgcagaagcgcgagacgatggccatgctgtggcgactgttcggttac

SEQ ID NO: 72420 - DNA, 1374 bp, Heterodera glycines
  Genomic contig location: Contig_ID=SeqID_1317; Location=1838..3211; Strand=-
  SCN-specific regions: Sequence locations=1-51,73-288,310-335,358 -675,706-1064,1086-1374
  Gene Ontology: Biological process=regulation of protein activity, epigenetic
atgaattcttcgaaaaaattctttgttctcattttggtcctcgcccttattgccgagccttttgttgtctgcaagcgaagtggcacttatgggaggtgggcaataccgtactcacttgactagtgtaccatcgcttactgtactgcccaattacgtatttttttatttccatcgtatctgaattggattggatcggtccgtctctttacttttctttcgtcctttggcaggggcgggtcgccgtcgcgcggaacttcgatacggagcaggtgccaatcactcatccgtcaattatggctcttaatttatttctgatcggaccgcttaaatcccatcaaatggaaaaaattgttttttggcgcttaaacttttatttactaaacccaaaattcgaaaattaccccgaattttgaaggatttcttccgctcttggacgaaattccggctcaaattacccgataggaggctatggacgtgacagaggcggaggaataaccggaagattatttggacataaaaatcggcataattatggtggttatgaccgttatgggacaggcaaatacgggggaaaaggcgcgggacttttggggggcggtggccgaggtgcggtcggacgcggcgtcgccggtggggggcttctcgggggactgagccgttctcgccatcgcgggttgggtggaggaggaggaggctacaaaacatcgatgttccgcaacagcggaatgggctcccgctcacgatcgaacacgttcaaagtgaggcgccgcacgggggaagaatggcatccattggatgagagggcactcggatgggagggggaaggggactatggcaccacttaaaaagagtgattttgggaaggggtaaaaagaggaagggggaggaggtcaaattcattaattaaagcaggagaccattacgaattcccatttaacagaatatgattgtcggggcagctgccggtttcttggcttataaggccggcaaagcgatcattcggaatgtggcggcgccaatgatgtcagtttccggggagggcatcgccaacccttcgcaacaattggcaaaaattttgcattattctgtcattttttaggtggaacaaccggcaatactactggggtaataagcaattggcattaccacactaaataccaaacgcattgccaattagggcctcagtattacccgtcccaccaccaacgccacggcatggcctcgcgcacaatgtgccgaatggccatcgacccgagtgacccggtgcttggccaagtgtacatgccggacagcaccaggcccaaggagatcgtgtggagttgcgagatgcacgaggttacgtcgagacaaattcaactcatcttaaacaataaa

SEQ ID NO: 72421 - DNA, 293 bp, Heterodera glycines
  Genomic contig location: Contig_ID=SeqID_1319; Location=621..913; Strand=+
  SCN-specific regions: Sequence locations=1-293
atgaagcctctgaaaattgacgtggatttcccctcgaatagtcatcccacttcccaagaattaaaccaagattgtattcctttgtacgaaatgcttgaattcgaggaacttcaattcccaaactattacctttccgaacaattgggaaggggtgcccatgcgacagtgatgccgtgccatttccatgggaagccggcagcggccaaacttttcaatgccaacgtggacttcaaaacgatccaaaaggaggccaagctgttgcacgagtttcgccatgaaaacatcatcgaatt

SEQ ID NO: 72422 - DNA, 2899 bp, Heterodera glycines
  Genomic contig location: Contig_ID=SeqID_9703; Location=2073..4971; Strand=+
  SCN-specific regions: Sequence locations=1-4,26-193,215-367,389 -536,562-572,615-639,700-1118,1191-1194,1216-1410,1433-1541,1585 -1586,1608-1806,1853-1916,1994-2001,2024-2044,2066-2094,2116 -2119,2168-2670,2727-2899
atgttgtcaaaagtttgttttccaaaatgtttgttgctgttgttattcagctgtataattggcaataaattttcattatgcgaccaaattttatcgcctcaaacaactgaagaaaaagattattcggaatgcggaatttcggtctttgatccgttcaacgaacgaagcgaagagaacacggaaataagccatgtaattatgttattaattacattcataattaggggacttttaactgaagcaaaagcgaaagctgtttttttgaccagaaaccgaaaatcgaaccgaggggctttaaagcgaggaggggaccaagttgcgtctaacaatgagacatcattaaggaataattacttttttcatcattttattaaactcaacaaatttaataaatccccggataaaaaacgaccgtaaccaattcccctaattaataatattaatttgttaggtattcaaagggcaaactgttgatgatgatcgcgcattgccgtggatggccacattgttaaggcgcccatgttctttcttttttcaaatttttttaaaattaattaattacactttttggcttaattttaaaaaatatttggaattaaatttaatctaattttgtgaaaacaattaattaggtacatgtaaattattataagtaaattttattaaaaaggcataaaaataaaaaattttatttattaagttgaaattgtccaaaatgcaactgtttatgaaccattttgcactgcaacaatcgttggaccaagacacattttgacagcattgcattgcgttgccgacataaatctcttcgcaggtacggtgaataaatatactgtacatgaatattgtaagaattttttttttactttataatttgacaaaagtataaaatttacaatttttaatgaaaaagattcccctgctattggaaatattttttgaaacaaagttttatttttttaaacaataaaaattgcgcaaaaattttatggctgccggaaccgctcagttgggcgcgcacggttgggcgccaacatgtttttccactatagctttttatttgttatccaaatccaacaatcttggtatcattcgaaagctcttaacatgctcacaactttaataagatataaattattttgtttaaataaaaattaaaaggcgcaaaaaaatatatatttttattttatgttcaatgtactgtacatcaatattgtcatattttggcacgaaatacggtatttctctaggttgctcgaaagcatgaaaatttaagaaaatttgattgaattttcagaaatttttgcaaattttttgaacctttttcatcactttttgaaaaccggaattaaattgatatttttttttgtgctaatagtgcaatccgagagttaagtatgagacacaagattatttaatttagttatgcttaagaaaggttatgacgaattttctcaaaaaatctgaaaattggcactttttgcgaatgacccacaggcactaatctgcttgctgttggtccgtggtcacttatattaaccaaaaaataaataaactaaaaaaagaaaaaataaaaagaaaaaagtgaagattgttttttaaatattatgccataattttttgttttttcagataattataaaattttattcggtgccgttcaaagctcaaaacaaacgcacaaattgcgcattaaacgcgtccattatcatgaaaatgcaacatatttggttcttaatgacaagttgaatcctgctagtggtgtttatggtgaaattgtgcacccggattttgctttaattgaagtaataaaaaaattcaattatttattttttaattaaatgttttttaagagcgtggagccaatacaattttcatctcgtgttagaccaatttgcttgtttggcataggtaagtatttataatttttttgaatttaaatttacctttaaatgcaattatataatcttaaaaaaattttcaaaaatttaaagcagtgaaaaatcattttttattgttataaaggaattttagaatttatagtaaaaattgttttattcattacgcggttttttttattaaggctagcctctaaaatttcaaaaaatttaaagcagtgaaaaatatttttttttttttgtacataattataattcaatattaatttgtattcatgctaaccccccatatttcaatattaaggttcctcaaatttgaaatattcattttctgaaaaaatttctgcccaacacttcaataattcacggccatttgttgttgccggatggtgctacacagagccaatttgctctaaaggaactcacaggacaagtgaccagctgatgtacggtacaatgcgcatggtttctaaagacgcatgcccacttgcttacggtaatgtaaaaacggatatgctatagctaaactaaatcggtatactatagccaaacaaaagcgggtatattatttgtaattccccgaaggtcggagaccaatcctaaaattaaaaaaacaatcgaaaatttaacaatttttaagggcgacagtggcagtcctttgctaagcaaaattggtgacaagaattgggtccaagttggtgttttatatggtggtggaggatgttctgaaaagcatcccttttccacaagtcggcgtcactgtaagaaaatcaaaaataaatatttaaatatcaattttatttattatttttaaataattttatttttcaattagcattatacacaccgatcgattgcgattggatttcgcgcgtgacaaatgatgaagtgaaatgtaaaggatggtgaattgaaaacggaaaaaatgaatttaaataacatttacattgtgacaacattttgatgcaatttacaaacacttacagtatttatgtacagaa

SEQ ID NO: 72423 - DNA, 870 bp, Heterodera glycines
  Genomic contig location: Contig_ID=SeqID_9704; Location=507..1376; Strand=-
  SCN-specific regions: Sequence locations=1-237,259-393,434-524,549 -657,702-870
atgctttttattggaattgacagaatgcttggaattgtatttggtgaaatgtaaaggaatacattctaaaatattattgatttatttccaccgtttttaggcatagcaaatgcaaaatccgactgtatttggctacgataacaattatttgtagtgctttaaatttcagtttttgtataacaatttaccaaagtatagaactgaatggtgatcaaatgatcactggcacttatgccgattttttcatggtaaataaattcttgctcacaaatcaacgaaaaagaatattttagggttcttctctatacagtatactatggctctttctcatcataattaccatattcatttatttatttgtcgggctcattataagaattaaatcggcaggtgataatttattaaaaaaataaaattaattttataatttaatgattaggtttgccttccgctgatcagattaattatcgtacttttcgttcacttttttgtataatcgtcgttaatgttggtggttactgtactaatttaatttatttaattttaatcaaaccatcaattgcttctccgatcactgcttggtttggccttgtgatcagcggaatttcactaaacattggtgcggcatcgaatgcacccattttgtgcttcacaaggtattataataattacttaaattaattaaatttttattttttttagtacggaatatcgccaggcattccagacggcgtttccatttgtgttcaaacgtttttcaaatgctaatcaagtaattccactacaaaatgggcatccattaggcactacacaatattgaatgatgtcatccagaagatatttttctggataaatcagtccatcattaaa

SEQ ID NO: 72424 - DNA, 430 bp, Heterodera glycines
  Genomic contig location: Contig_ID=SeqID_9704; Location=1529..1958; Strand=+
  SCN-specific regions: Sequence locations=1-244,266-283,326-362,388-430
atggcgaatctgatggaggatttcaaaaaaggaacaaagtgccaagaggtaattaacagtgccacggaatgacctaattaaggtaattaaggttcacttataactcattaatactgcttactccaagaatttatctacactaattacgcactttgttaaaaaggttacaacaattacagaaaaattgaaaatgatgccaattaccgcaatgattccataaatcagtgcacaaccaattagtgaccagctgggatggacatctttgaagaccaaataaaactgcaaaaaaattttaaaaaagtaatttttaaatatttcaattaatgactaccgtattgtacgttgtgttgtcattcattttgtttaattttatttaattaattttttgagataaaacaacgaatggcaaaatgctgaattatttgcttaa

SEQ ID NO: 72425 - DNA, 1098 bp, Heterodera glycines
  Genomic contig location: Contig_ID=SeqID_45026; Location=187..1284; Strand=-
  SCN-specific regions: Sequence locations=1-153,175-212,236-310,334 -819,841-1051,1073-1098
atgatgaaagctaaggagttaaaagggagacttgagaaatatcaagttactctccaaagtttcgaattagaaattatttatcggcctggaaaaaagaataaagtggcagattttttgtctcgatataatataccgggaaatgaaaaggatcctgaaccaaaacaggaagaaaattcagatgagtttgaccttcagccaaaaattttaagtgcaaaaaatattaatgaaaatttaattgctgaaaatgatggaattttgaatgaaaatccaaaaataaccttaaaaacagtaattgaggcacaaacaaaggtaaaagaattggccaaaattttctatattttaaaaaccggaaagtgtccaaatgatgttctgaaatggaaaagagttgtttctgattatagcctaataaatggggccatttactttataaaaggcaaagaaaatatggaaagacctaaattaataatccctcattcattacgacaaaaacttttcattattttccattcagaaggccattttggattcgaaaaaacttggcacgaaattaaagaacgattttattggatcggaatgaaagacgacgttaaactgctaattgaggcgtgtgaaaagtgccaagtgaggaaaattcagccagggcaggccaaatcggctccgagtgtcccaatcgaaccatcaaatggcccatttcaaagaattcattgcgatttaatgggtcctttaaagaaaactgaaagaggaaacttgtatattttcttggcgattgatagtttttcaaaatgggttatggccaaagcaatcccggatcagaaagcgaatactgtatcagaaatttttgttgaaattgtggtccatcaacattcaactcctgagattgttgtgactgatcagggaagacagttcacttcgggaatttttaatgatttggcaaaaatatacggttttgagcatgtcactacaacaccatatcatcagcagtctaatggaatggctgaaggggctatgcgaatcatggctaatattatttctcaaatggtcaatgaaaaagggaataattgggatgaaattctgccgcacgctattttttatcattaa

SEQ ID NO: 72426 - DNA, 54 bp, Heterodera glycines; identical to SEQ ID NO: 53113
  Genomic contig location: Contig_ID=SeqID_45029; Location=846..899; Strand=+
  SCN-specific regions: Sequence locations=1-54

SEQ ID NO: 72427 - DNA, 1001 bp, Heterodera glycines
  Genomic contig location: Contig_ID=SeqID_45031; Location=220..1220; Strand=-
  SCN-specific regions: Sequence locations=1-140,170-1001
atccatccaatccgattgtgatcagtgacatcacttctgatgtgttcgaggccatgctgaatttcatttacacggacaatttatgcgcagtcaacggagaaaatgtggcggaaatgctttatgcgggtaaaatcaaattcaaataaaaaattattttactaatttattagcagggaagggattatatgtttttacatttttttttggcatatgctatcgcatgaaaagctcaaaaatagcatttttacttgttttccatacatcagacccagtttttagcatatataaaaacatattttggggtttcgttgtttttggcacatattttggcgattttttgggaaatttgatttttttttacaaaagttccttttttggcaatcaaattcttggcaaaatgtccccaaaaatgttcaatttcaatttttgtatttttggcgcttttcatgaccttttttcacttttaaggtaaaatttgatttttagctaggaaaattccgaaaaatgagtaaatttttgagagcgaaaaaaatttacgacaaaaaggattaaaatgcttttaattagcattgtgctagcgaaattgataaaaaacgagactttttgagaaattcacttattttttgagcagtttttttcaatttttggcacatattttgggagttttttggcacatatatatgtacatattcatatttggcgttttttagcacatataaatcccttccctgtttattagccaaaaaatacaatgtcaatgggctggtcaaaatgattcggaattttaatgtctcggagctgcgaaatgttttccgcgcttttgcaatgggtcggctggttgaggaagaggtggaaaattaggaaatttgtgaaaatttattaatggacaaatgaatttaatagagctgggcaaggcccaacccatgagggaagcagcaatgtttagaatccgaaatcaaaaaattatattacaattaaattaccgtagttcctgaaataaa

SEQ ID NO: 72428 - DNA, 399 bp, Heterodera glycines
  Genomic contig location: Contig_ID=SeqID_9705; Location=214..612; Strand=-
  SCN-specific regions: Sequence locations=1-240,267-399
atgtgccaacttctcgcagttcggtgttgttggcaccttttgacatgcattaaacaaatcactgctggtccgagactgattgaacatagtcgagggatcaaatggcgccttaaattgttcgcacgcaataaaatagggagaaacggacacattcagccaaaactgtggcatacggtcggcaaacacaatttgtgtacagtttgtgcccaaatggtcaatgtttgacgctttcggcacaggctaaagaaaataaaaaactttattaagagaaattttcagggcggccacctgcatatcgaaaaggctgacattagcatggacggagaaaagctaacttattacaggaaatcaagccaccatttggattacagtacccacccatcaactaattcgattgtc

SEQ ID NO: 72429 - DNA, 1591 bp, Heterodera glycines
  Genomic contig location: Contig_ID=SeqID_9705; Location=2877..4467; Strand=+
  SCN-specific regions: Sequence locations=1-36,66-183,205-278,300 -564,586-1407,1429-1452,1474-1591
atggcccgtcagacaagtgcaagggtatgttaatatattattttgaattttgaaaatcttttaaaattcaggacgtttgcacacggatttaaataacgttgtgcagaagttggtcgtgagttcattcgtgcgacatgaacgctgagcatgtggaatgtcagcgacttgtaactggactcaagcgacgtgctgctgagatgtgcgaagcacctgcgactatttcgtgctcaagtgctgcaaaaaacatgcacacctgtgctagcagctttccgagcaaagcgccacaaaaaagtgggtttatatccaaaaacaattttgttatttttttggttttttaggtgatcaaacgattgcgccgtgatgaaaatgcaccgcggaccgaacctctcaatttggagcagttggaaattccgaatacctatcgtatttacaagcgaactgaaattgacaagaaacactttctattggcggacaccggcgtttttcaaattcaaggacagaatggaccccaacggtgagacatcatttatacattaaatgctgatcattgaaccggtattaagaattctcatttttggaagagcttctacggcggattgggcccatcagatgaaagacatttacgcggacggcactttttcattgacgccaccgcttttcagttggcaatggtcggtgcggtccgcacagtgcttccggcatgcagtgtccgctactgttttttcaccttgtccgcaacatgaagaggcagatcagaatccttggcctcacacatgtcaattgaatttttcagatgataaatttttttcttagtagtttaggcttacaacactgatcatgctttcgccgagaagtctaagatgatcacttcattggcctttctgcctgtgcaccaccttcaaaatggccttaatgttcttcaaggacaaattccaccacaacttaacggcgttttaaattggttaagtccgaaggcgaattttatgatttttttgatttttctaggtttttggacaactacatgggccgaatgcgtttcaatgttccaatggcggcgcctctgttccacccgcacgaatggaatgttcatcagcgcaccttagatggtgctgatcgtaccaacaatttcgccgaggcattccatcgcaaacttcagcggcaatttagctgcactcatccaacaatttggcgcttcattgacacgatcagatgtgagcagaaggcaattgacgcagacatttcacgttgtgtcatgggagaatccgctccacaaaagaaaaagaagtatcgcgaagccgacgcacggattctccgactcgtgcaccgttataacgatatcaataaccagggattctttttttatgtaaatacatgtttttttcctggattctccatagcctaattagtaggaaaaacactttcttttttgtgtttgcgaacaaaaatcgggacttttatttacatatttttacatatttcggcatttttctacatattacatatgtacatatttttatacatattttggactttttcgcattttttcgaacatattttgaaatttttgaggatttttttaaggaaattttca

SEQ ID NO: 72430 - DNA, 140 bp, Heterodera glycines
  Genomic contig location: Contig_ID=SeqID_9705; Location=3011..3150; Strand=-
  SCN-specific regions: Sequence locations=1-70,92-140
ctcggaaagctgctagcacaggtgtgcatgttttttgcagcacttgagcacgaaatagtcgcaggtgcttcgcacatctcagcagcacgtcgcttgagtccagttacaagtcgctgacattccacatgctcagcgttcat

SEQ ID NO: 72431 - DNA, 155 bp, Heterodera glycines
  Genomic contig location: Contig_ID=SeqID_45039; Location=114..268; Strand=-
  SCN-specific regions: Sequence locations=1-155
acaaaaccaaaacatgaaattcgagacttatttctccttcggaccaagactaaaaaacccgagacttttcccgagacgctcgaacaatattgtaaatgataaatatttggtcaatatatcaaaagatatggtgcctcccgccaagggcgtaggca

SEQ ID NO: 72432 - DNA, 505 bp, Heterodera glycines
  Genomic contig location: Contig_ID=SeqID_45041; Location=369..873; Strand=+
  SCN-specific regions: Sequence locations=1-111,134-340,368-403,432-505
atgaatggtcagttgcagcagcgaattcggcacagcggtgttgccggcacaacaaacaatgccgcgctgaccacattgtcgatggcattgtgccgttcacaacagcagccagccgtgccgccgccgccgcccgagtttttcatcgaccaccgtaccaccacgttgttgaacggtggaaacggtagcagcacattgagcagcactacggtagcgattacgtcatccaacggtggttgccatgcgaatggcacagcagtcgtcagcgctgcgcaacaattggcaccatcaaacgtgacaacgccggcacttttgttgaaggcatacgaagcagcggtgtgtgattaatttatatattttaaattaatttccattacgaatcctcaaaattaatttttgaagatggtaattataatattcaaaatttaatttttctcggttttattttaattgcttttaaatttttttttacaataattgattgatagggctggaaaatatatgtata

SEQ ID NO: 72433 - DNA, 605 bp, Heterodera glycines
  Genomic contig location: Contig_ID=SeqID_9706; Location=74..678; Strand=-
  SCN-specific regions: Sequence locations=1-605
atgaaccgacggtaagcaattattcaattattattttgaaaaattacggattttcatttcaaattacaaattttcattttcccaatttttttaacaaatttcagttggatttgtggcgacgtttggatggacattctcccatcctttgaccatgctcaactcggcctcaaaatggcactgatttccgaccgttttgatgcgcttgtggacacgcattttgatgccaaaacgacggaatttagaatttggagagaaataaggattcgcaaggacaacggaacaaaagcgaaactctctgtacggatcgatggcaattttgtggattttccattgccggaccatccgctgcccaacataatccgtattaaggatcttcagatttagtaatttaaacgaaagtgtatattatattagagcattttgttatatgtatttttttcagctacattgaccactccgtcattgcatttctccgtgccaacaagcacgatttgggacagaatgggcaccgatttggagttgtctatttcaaatgcccgagccgatttgggatgtttttgtccgagaaatttggccaattcttacgacaaacgttcgccgtttga

SEQ ID NO: 72434 - DNA, 211 bp, Heterodera glycines
  Genomic contig location: Contig_ID=SeqID_9707; Location=65..275; Strand=-
  SCN-specific regions: Sequence locations=1-211
atgcaccccaccggtcccgtggtggtcgtctacgaagcgccgccgcaacagcaaacgtcgccggacaatgcgacacaaagggaaacgaaacagccgaaagagacggggaaaaacggaaacgaaattgtggacatgctccgctcatccatcgtcaaaatgtgcgtgaagcaaaaggacgaaaagcggcggaggacaccgacaattgacgaaa

SEQ ID NO: 72435 - DNA, 966 bp, Heterodera glycines
  Genomic contig location: Contig_ID=SeqID_9707; Location=413..1378; Strand=+
  SCN-specific regions: Sequence locations=1-185,209-944
atgttcaagaaagctttggccggtgaaggaagttggttggatggccgggtccggcttcaacggtttgaacaaattttcaacggtcgaacatcgccgggaaattgtcgaatcggtggacatttggtaagacagcgccggaattgcaacatttgaagaaacggtgggcaatttttggtgggacgaagctgaaaaaataaaacaaataaggcggcgatgtaaaaattcacaattcagattgtgcaacaaacaaatattttaactcaaatcgcattatgagttgtgtttcgtccgccaaccccgccctccttcaaaagacagaatcacctgatcaacacaatatcgccatttatccaggaagtcacatttggagaacacctgacggacaaactgcgcaaagcccacccgttgacacggcacaaacgatcgaagtcgttcgggcacgtcgcaattgtcggagcaataaaagtccaagaaaaaccaatgggccaattcaatgtgaaagcagacgcggatttgattttccttctaaaaagtgaaaaatattcagatgattaatcgagtatgactcaaaaatgcctcattattcggaatattatagaggaatcggaagagaatgtcctccatgaccatctccggcacggtcggtccgaaacatttgacctccttgagataattgctggaggacgactgttgctggtggacatttactgggaattgctgctgttgaaccgatgggaaaagcgggggcggtctgttgcttgggccaacggaaggcgaaccaagtgccgataggcaccaccgtggaaaattttgaaaatctaagagacattacgccataaaattacaaattttctgaagaatttttaaaaataagaacaattgcccgaaatcagaacatttgcgcttaggcggtgccatttgttagtattagtgcaggtgctaaattaaaaacaaaagagaaaaaca

SEQ ID NO: 72436 - DNA, 70 bp, Heterodera glycines
  Genomic contig location: Contig_ID=SeqID_9708; Location=194..263; Strand=-
  SCN-specific regions: Sequence locations=1-70
atgaataattttggcgttggtcaaaaggactcgcagcgtcagcaaatagggcgcgtatctgttcttattt

SEQ ID NO: 72437 - DNA, 463 bp, Heterodera glycines
  Genomic contig location: Contig_ID=SeqID_45042; Location=1..463; Strand=+
  SCN-specific regions: Sequence locations=1-81,122-189,226-422,462-463
taattgtgccgaagatgaacaatgttttggcattttcggctgattatttgccggaattggtggcgcaacggctgaaggagcgattgggcataaaaatgccaaagaataaaaaccagcagaaaacgaagaggattttggccgaaccgatcaaagggacggaggcgaaaggcgcgcggacggcgaaaagagtaaaaaattaaattaaattaaaaaaacaaaataaatgcgatttttaagaaattaaccaaagtgttagccgaagcaagcaaaggttagccaatttaacacttcttttttaatagctcaaataattttaaagggagtcactcaatcgcctcattattcggttcaaacaaaacggacaaaaagtgatcggtggcgattcgaaaactaaccaacgattgttactatcttttggcccctttttattttgtttttttaaatattattctatttttaaaca

SEQ ID NO: 72438 - DNA, 56 bp, Heterodera glycines; identical to SEQ ID NO: 58360
  Genomic contig location: Contig_ID=SeqID_45045; Location=398..453; Strand=-
  SCN-specific regions: Sequence locations=1-8

SEQ ID NO: 72439 - DNA, 99 bp, Heterodera glycines
  Genomic contig location: Contig_ID=SeqID_45047; Location=552..650; Strand=-
  SCN-specific regions: Sequence locations=1-35,57-99
taacaatacacggcgattcaattttgggctccaagtacaattaagttggttttttcgtcttagtggtctgtgagttagtcaccaaaaagggggtctcaa

SEQ ID NO: 72440 - DNA, 361 bp, Heterodera glycines
  Genomic contig location: Contig_ID=SeqID_45050; Location=277..637; Strand=+
  SCN-specific regions: Sequence locations=1-249,276-310,332-336,358-361
ttggaaccaccaccatcacaaagtgtatgactggacgttttgagagttgcggatcgatcacaaacggagcagcttacggctacagacctgctcatttcactgtttcacggaggatttgtgcaacggcgtaatcgccatgaagccagccgccgttggctgtgccgttttggtcccattgatcattagtaaggctggaaatctcctagattctaaataatctataatttgttattttacatatttgtgttcaagatttttaattttcttaaaatcaaaaacaatttttgaaaagtatactccaaaaacgcagaaaagtttctttttaaaattagctaaaggaaatggatattttttattcaaa

SEQ ID NO: 72441 - DNA, 258 bp, Heterodera glycines
  Genomic contig location: Contig_ID=SeqID_45051; Location=712..969; Strand=+
  SCN-specific regions: Sequence locations=1-258
aaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaat

SEQ ID NO: 72442 - DNA, 2872 bp, Heterodera glycines
  Genomic contig location: Contig_ID=SeqID_9709; Location=1955..4826; Strand=+
  SCN-specific regions: Sequence locations=1-735,758-1013,1035 -1197,1219-1456,1478-2170,2192-2259,2281-2403,2430-2503,2541 -2692,2722-2846,2868-2872
  Gene Ontology: Mol. function=polypeptide N -acetylgalactosaminyltransferase activity; Cellular component =integral to membrane; Biological process=O-linked glycosylation
gtgtggatgtgcggtgggtccatcgaagtcgtcccctgctcccacgtcgggcacattttccgtgccggccacccgtacaacatgacgggccctggcggcaacaaggacgtgcacggcaccaactccaagcgactggccgaagtttggatggacgactacaaacggttgttttatgtgcacagaatgggattgaaggtgccgcaaattatgaattgaataaacaaatttgacttctcttcttttaggatgttgaagtcggcgatttaagcgcccgcaaagcgttgagggagcgtttgggctgtaaaagtttcaaatggtatttggacaatgtcatcccggaaaagttcgtgcccgacgagaacgttaatgcgtatggattggtctgttcggaaattcaattgattgagatccgattcctacttgaaaggtgcaagatacagacgggaaactctgtttggacacacttcaaaggctggagaacaaagggacagtcattttgggcgtttgggagtgccaaacgggcggctcctcctcacaggtgacgaattttctatttatgctaattccaaacaattaaatgacaacaacaaacgaataaattagacgaaagattttttagaaatttctaatataaaaatcagagatcaaatgtaaaagtggtcaaaaatcaactaatttttgaatttgggcacattgcaaatcaaagcaggcgtcacctccgattacgtcgaggcattagagatgaagattttcagcacattttggatgacattcccacctgaaaattgaacacgtttttactaaaagtggaaaaaactcacagccggggcaattgatgtccatcttttgggacaccttcgtgaacccgtccatgcacccgattgaacatccgcacgggtagaaaaaagagttgaattcacggcattcgtttggatggcagaactggcagtcgatgtctcgttgtcggatggagatcagttcctcgcctaaaccgaacagtttctaattccccgccattttatttttacatttttccctgcaggcgtagcattcctccacattttcgtctctcagacactttctgtgaacatttaaatggcagcctaaaaaatgtgaaaattttgacataatttcgcttataaaatgcctacatgggtagaaaagtgtgtcgctgtttggctcaaggcacatcacacactcgcccttaaccagctccgtgttcagtccgatgttcacttccgccctttgctccccactgtcccattgcgcctctctttcttccgcagtccatccacttttgagaagacgcgctttaagctttcgttccaacagtccacagctgctcaaaatgcttagtgtgctactttcttcgtacgaccgcctcaacaccgcctttttgtccacttcgatgacgagagaaaagtctgatttatacggaggataacgcacactaaacatgaatttaaacaacaaaaaagattcgccctgacctgtaccacggagtcggactcacactcccaaatgagaagcgaaccttaaatagtctcaacaaacgattagtttcaaattgctgttttaaatttgatacccggactccgtttccgtcggccaagtccagagaaatggtgaaaatttgaccccgcttcggagcaaccaacagccaattgggtatttcgttcaacccgttgtccacaaaacgcaccaattggatgaaactgagttggtctggcgttgcgtttttttcactcagcagagcacggtcttcgtaaagctcttgcaaagacaggcaggagaagccaatgcggggaagacgcggaaagtcatcctgacaatgtgaaaaccaaaaatcgaaccacaatttgtacctcgaaaaaaatgtggacatcgacgccatccgaggacacatcagcgcacaattcgttaacacatttccgggaaattgcgaaatgcgcaaaacattgaaactgaatgtatggctcgagcgatgtttccgccgcctctttccgaagaattcgcacatttttgattaggttggtctgtgaggaagttgaggcaccgctgtcctggttgtcttggccgtcgtcactcaacgtgtccttttgtgactctgttggctctggggttttattcagaattggaagctttttctcggccggaagaggccttgcaaaaaatattggcatttcaattcacctagaacaaaaatgccgaatattgaacatttatttgtacacacaaaaagttcagagacataaaaaggagaacaaaattgatttaaaattattgattctttgattcttaacacagcgatcgaaaatgagcccaaaagatttgcatgtgtggctcagtggtttttgtaagatagccaataggaaacgggtgaatgttcgagtctgcttcactttattaatacttttatttatttacttccaaaataaaaaaaaatctatttaagctttggaagcaggcttttttcaaaatccgagctctagcattaacaaacaaaaaataatagattttaatttaaaattattttttaaggcgttcagttggagcaaagatggagaattaaggcgtgagagcacttgtgtagatgtgcaaaaatcttctgccgctgatgcacgttccaaacggaaagccattctcagagaatgcagcagacaccaaatttcgcagtttgaacaccaaaaagttttaatatttattatatttttttaatttgttccgttttaaggacggtccgttgaagcatttgtcctctgggctgtgtttggatgtgcaatcgctgaacgccggcgacgacatttacttcgcccagtgccataatgagaaacaaagtcaaccatggcaatttggcacatacttttgagct

SEQ ID NO: 72443 - DNA, 1461 bp, Heterodera glycines
  Genomic contig location: Contig_ID=SeqID_9709; Location=2677..4137; Strand=-
  SCN-specific regions: Sequence locations=1-706,728-965,987-1149,1171 -1426,1449-1461
atgccaatattttttgcaaggcctcttccggccgagaaaaagcttccaattctgaataaaaccccagagccaacagagtcacaaaaggacacgttgagtgacgacggccaagacaaccaggacagcggtgcctcaacttcctcacagaccaacctaatcaaaaatgtgcgaattcttcggaaagaggcggcggaaacatcgctcgagccatacattcagtttcaatgttttgcgcatttcgcaatttcccggaaatgtgttaacgaattgtgcgctgatgtgtcctcggatggcgtcgatgtccacatttttttcgaggtacaaattgtggttcgatttttggttttcacattgtcaggatgactttccgcgtcttccccgcattggcttctcctgcctgtctttgcaagagctttacgaagaccgtgctctgctgagtgaaaaaaacgcaacgccagaccaactcagtttcatccaattggtgcgttttgtggacaacgggttgaacgaaatacccaattggctgttggttgctccgaagcggggtcaaattttcaccatttctctggacttggccgacggaaacggagtccgggtatcaaatttaaaacagcaatttgaaactaatcgtttgttgagactatttaaggttcgcttctcatttgggagtgtgagtccgactccgtggtacaggtcagggcgaatcttttttgttgtttaaattcatgtttagtgtgcgttatcctccgtataaatcagacttttctctcgtcatcgaagtggacaaaaaggcggtgttgaggcggtcgtacgaagaaagtagcacactaagcattttgagcagctgtggactgttggaacgaaagcttaaagcgcgtcttctcaaaagtggatggactgcggaagaaagagaggcgcaatgggacagtggggagcaaagggcggaagtgaacatcggactgaacacggagctggttaagggcgagtgtgtgatgtgccttgagccaaacagcgacacacttttctacccatgtaggcattttataagcgaaattatgtcaaaattttcacattttttaggctgccatttaaatgttcacagaaagtgtctgagagacgaaaatgtggaggaatgctacgcctgcagggaaaaatgtaaaaataaaatggcggggaattagaaactgttcggtttaggcgaggaactgatctccatccgacaacgagacatcgactgccagttctgccatccaaacgaatgccgtgaattcaactcttttttctacccgtgcggatgttcaatcgggtgcatggacgggttcacgaaggtgtcccaaaagatggacatcaattgccccggctgtgagttttttccacttttagtaaaaacgtgttcaattttcaggtgggaatgtcatccaaaatgtgctgaaaatcttcatctctaatgcctcgacgtaa

SEQ ID NO: 72444 - DNA, 80 bp, Heterodera glycines; identical to SEQ ID NO: 51817
  Genomic contig location: Contig_ID=SeqID_45052; Location=270..349; Strand=-
  SCN-specific regions: Sequence locations=69-80

SEQ ID NO: 72445 - DNA, 80 bp, Heterodera glycines; identical to SEQ ID NO: 51817
  Genomic contig location: Contig_ID=SeqID_45052; Location=886..965; Strand=-
  SCN-specific regions: Sequence locations=69-80

SEQ ID NO: 72446 - DNA, 304 bp, Heterodera glycines; identical to SEQ ID NO: 53844
  Genomic contig location: Contig_ID=SeqID_45054; Location=176..479; Strand=+
  SCN-specific regions: Sequence locations=1-304

SEQ ID NO: 72447 - DNA, 304 bp, Heterodera glycines; identical to SEQ ID NO: 53844
  Genomic contig location: Contig_ID=SeqID_45054; Location=556..859; Strand=+
  SCN-specific regions: Sequence locations=1-304

SEQ ID NO: 72448 - DNA, 394 bp, Heterodera glycines
  Genomic contig location: Contig_ID=SeqID_45055; Location=213..606; Strand=+
  SCN-specific regions: Sequence locations=1-66,94-101,125-236,258 -296,326-394
atgggcgatgaatttacagttaatgctgcgaatttggacactaatgagggtctgaaaaaggctatgttattataatattttaattaaaaaatacatgagtgaatttaaataaaaaaccccttttaatttttttacagctggagttttgacattgacttcttatgacgagtctgcactgattcgacacaacgacaaagcaattacttatgaattaacagaaattgaatatccataatatattctcattctttaaaataattcatgttaaaatgatttatcacagcagagttttcatcaaaaaaataatttaattatttttaaaaaactctgttaaatttttttatttgtgttttttaacacttgattccattatggaattttttttttgtatgga

SEQ ID NO: 72449 - DNA, 93 bp, Heterodera glycines; identical to SEQ ID NO: 68445
  Genomic contig location: Contig_ID=SeqID_45061; Location=845..937; Strand=-
  SCN-specific regions: Sequence locations=1-93

SEQ ID NO: 72450 - DNA, 658 bp, Heterodera glycines
  Genomic contig location: Contig_ID=SeqID_45061; Location=163..820; Strand=+
  SCN-specific regions: Sequence locations=1-658
gttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgattttttt

SEQ ID NO: 72451 - DNA, 1388 bp, Heterodera glycines
  Genomic contig location: Contig_ID=SeqID_9711; Location=97..1484; Strand=+
  SCN-specific regions: Sequence locations=1-91,113-121,240-330,442 -709,731-800,823-841,863-884,934-1027,1049-1138,1160-1164,1210-1366
atggtgccgaaacacgaggaacgtttggtgccattgttccgctgtgtggacgagttgttcgacaatgggctcgagtttcgaaacagcagatgtgaagaggacgacgatgatgttggaaatgtaataaaaaaattaaaaataaatcaaaaattattgctataatttaatttattttgaaaaaaaaactaaattttttttttaatgaaatggcaacaaaaataatttataaatttaaaaatggaaaaaaaaattgatttttgaaagttctttttccttttcattttttagcatttttttttgcgatgagcaaaataaaggagccagagaaagatttaaaaacttttaattaaaatttttttgtctttataaatttatttaagattttaaaattcactattttttatttttaaattatttttttgagtttttaaaatttttaaaggcattgaaggactgactgactgtttgctgatgtgcccgattcggtcggtacttcaacaacataagccaaagcagcagccgcaccaataacaaggaggacgagaacatggccaaaatgagggcactgaacgaaaaatatgccggcgcagagcggacaaatgagcaaaatgcgtatgaaattgacactttttggcactaaattaatcgggaatgaacatattattatttaattcctttaacaaaattggcactataaaaaaagacatttttgtatttgagaaagtgtccagaaaaatgcaaaaacacaaaaattcacctttggcacataattaataatggggaatgtcccaatttattggttaatttttttttataaaatttgcaccataaaaagacatttttgtatttgagaaagtgtccagaaaaatgcgatacacaaaaacttttttttattttttataattctattttttttaatttttgaaaattttagaggctccattttcctccaatttcgaccgtctcttccgtcgtcccatcataaattcgcttgtcccgcaatttgtcatcataatttttttttaatttccattttcatttttcaccactctaccacaaatttctgtttttctgatgatgctgcacttttttttcaaaaatttttttttttttgcctttttaccaaatgcaaaattttgcctttcccaaaaataacattctttcatttttaaaaattattttctttattatttttatcatttattttatcatcattttatcatttgcaaacatgacacccattcttttgtagacaatttatgtgttgatggatttggaattttacatcaaaaaatgtgacttttttatctccctctaaaacagataagaatgttggaatccaaatccaatgaatgcaaaaaatgatttaaaaatgcaattaaaagaaa

SEQ ID NO: 72452 - DNA, 1150 bp, Heterodera glycines
  Genomic contig location: Contig_ID=SeqID_9712; Location=1336..2485; Strand=-
  SCN-specific regions: Sequence locations=1-514,541-672,694-960,989 -1121,1144-1150
atggctctgcttctaccgatgctgctgctaatcttggcacaattgcaccagcacatcagcgaggcgtacattcgtcgtctgtcagacattgtaccatcgtcgtacaacaccaatcgctggctggcatcaaataatggtgccgaaggagagcatggagatggcaccgccgattcgcgccagctgctactcttggtgccaaccgaggcacaaataatgcagcaacaacaggaaaatgaggagctgaaaccgcagcaacagtacatcaacagcccactgttgcccatgcggtaggctttatgtacaaaacgcccctgaagcgcttatttgtgttctttttttcggttttatcaaaatttgttgtttgaaaaaaatttaggtaaaaattttatcaaatttcaaagtcggcaacaaaaattgttttagaaagttgctgttttttcgataaagaatttttgaattcaaataaattattggtttaaaattcataattcatttttttgatgcccatgaatgatttgtaataaaatttatttaaatgcatgattttgttaaacgctttttcttagatttttgattttgatttttaccaatttatataaattttaagaagaaaaaagattttttttttgcagaatttataattgtttaggttagaatttatctgctttacctaaaaaatgtttattgaaaatcagagaaatctgctgatcagtcttatttataacaaccaatttaggcggccttgctatttctcgccaatccaatgtctgttgcgcacccagggacagcatgaaatgtttgtgcatcatccggcaatcaacgagttccgcgctgatctggatctgagccgtagtgatcaatccaaagaatctgttgacccagtggtgatcggcgggagcacttctcaacaccagcaagtatcgagccgatcattgttcggcacatcgacaatgctggcacaaaatttcatttttaaataattttaattgtcaagaattgagtgggatgagagagatttatggaaaaaccgggacacgcgattgaccggggccgtgaccctgattttcaaccaggacctggatcgagactcaagaaaccggggtaatccagatcaatctcggtcccgctgaactctacacaacaaaataaa

SEQ ID NO: 72453 - DNA, 417 bp, Heterodera glycines
  Genomic contig location: Contig_ID=SeqID_9712; Location=2995..3411; Strand=+
  SCN-specific regions: Sequence locations=1-142,173-317,339-417
atgtacaatgacgaaaaaaggaaaaaagtaaatttttaattgggttattaaacagaattatttaattataccgaagaaaaatggaattaaatggccgccttattggtaattgagtgatcatttagtgttaatatggccagagaaaataaatatatatttttagaaaataaatgtacggcatgtgactaaacaggaggattgttttatgtgccgccaaccaataaaatgccaaaaaggcactcattttggcacatcaaataaatttagagcgtaggaaaaatgcctaaaaagggataaattatgttagaaattggttcaattcaaaaagtttttatttttgcttaatataaaaatacgaattaatatatggacataattttttagacaaaaaaaaatggttaatttttttttgaaata

SEQ ID NO: 72454 - DNA, 477 bp, Heterodera glycines
  Genomic contig location: Contig_ID=SeqID_45062; Location=567..1043; Strand=-
  SCN-specific regions: Sequence locations=1-477
atgtcgcagtcctttcttaaacgccccttgatttctaattcccctaatcaaatcccgcaaaaacgtcaacagttcgtcgacgaagttacttcaatgaatttggacattagcacacttgacgacgaacagaccatttcaccagctgcccgtgccatcatttcacaactcaacaatctactgaaaattgccgtctccatcgtcaataactctgtctcagacattgactacgctgcggagatggaaagacgtcgctctgtagtcatcaccggacttcctgaaaaccagtcggagactccttctttccgtgccatttctgacaacaatgccgtcacaagttttcttgaccagctcggggttaagacccgttctgtagtttgttacagaataggatggtacaacacagaccgagcaaataatggtgcttggcgtcccgtaaaagtcgtgctccctgctctgctgatatgtcaacaaaactaa

SEQ ID NO: 72455 - DNA, 758 bp, Heterodera glycines
  Genomic contig location: Contig_ID=SeqID_45064; Location=25..782; Strand=-
  SCN-specific regions: Sequence locations=1-531,555-758
  Gene Ontology: Mol. function=inositol-145-triphosphate receptor activity; Cellular component=plasma membrane; Biological process =endocytosis
tccgcaattggcgatttccttggcgagaaggacgatttcaatttggaagtcctacaacattttgtgcgtctccaaccacttcggtcgctgccattggtgcaggcaatgcgtgggtttttgtcgcgtttccgcttgccaggcgaatcacagcaaattgaacgcatcatggagtatttttcggggcattaccatgtccaaaacccgggcatatttgagcatcaaggttggtaaaaaaagtttcaaaattgataaattgcaattaacttctattttaatgcaatgttagcataaaaacctatttttgaagattggcatcatactacgagcagaatataattttttgctttttcttcagacaattgctacaccctttgctacgccataataatgctaaacacttcgctgcacaatccgagcgtaaaggagcgcatgagtttggacaactttctaaacattaccaattcattgaatcttccgccggcactggttacggttggcaatattttttgttgctgggcatttaatatgaacaaataaaaatttaaaaaataaatggctgattctataaaaattatcgcaaatttgtttaaaaaacagaattaatgctccttttctgtatgttttaattctaaaatttaaggacatttataattccattcgctccgaagccttcaaatttccggacgacaatttgcaagagcagttctctgccgctttgtttcaacagtcggagaagcagggatggcttgagaaacaag

SEQ ID NO: 72456 - DNA, 49 bp, Heterodera glycines; identical to SEQ ID NO: 51181
  Genomic contig location: Contig_ID=SeqID_45071; Location=593..641; Strand=-
  SCN-specific regions: Sequence locations=1-49

SEQ ID NO: 72457 - DNA, 1139 bp, Heterodera glycines
  Genomic contig location: Contig_ID=SeqID_9713; Location=768..1906; Strand=-
  SCN-specific regions: Sequence locations=1-348,373-432,455-525,547 -835,862-1024,1050-1139
atgagcgaatttgttgattggattttgggatttaaacgatttgaaacggttgcttttgctcattatgctggaaggttcgactcgcattttgtgttaaaagagctgactgaaagaggggtcgaaactgagttgatgatggcagacctgaagatttatcaaatgaaagcgcgtggtgtgtattttcgggatttctggctgctcagccaaaacaagttggcagatcttccaaagactttgggtttgaaaaccttagcaaagttgtacttccctcataagtacaacaaaaatgtgaactttggaaaaaaattgacacacctaccaccccttgaagattattgtccggacaatatgaaggaggaggaatgtgctaaattggtaaaatggcacaatgaaaattatagaatggaatttgagctaggttagagaaaatctgttttccttttaaaattgaattttaggagagcagctcaaggtttattgcgaaaatgacgtcgaaattttgatggaggcaattttgaaattccggcaattgtttttggagattactgatgggatggatgtgttgaaggacagtgtaacaattgcgggggttgtgatgagaatttttcgaacaaaatttttgagagaaaatcatctcccaattattccggaaggcggttatgagagagccgagaatcagagcaaaattgccgtgaagtattttgaatggttggctcaaagcaaaagagtgagacttagacacgcatgcaatgggggtgaagtggaaatcgggggattaaaagtggattgtatcatcggagctgagaaaaaaatcattgaatttcaggtaggcagaatttccttccatattttattttttgctaaagggttgtgcgtttcatggatgcccaaaatgttttttgccttggaccataggacccaatgggcgttgtatggaagtaaatttccgacgaactgagacacgaatggagtttttgagggaaaaatgtaaaaacttctcggtggaggaagtttgggtgtgccaatttcaaattttattgattattgaacaaatttaggaatgcgatgtgaaagagaacttgaaaaaatagggagatgaagaggttctttgacgctgtgccggataagggtccaataaa

SEQ ID NO: 72458 - DNA, 663 bp, Heterodera glycines
  Genomic contig location: Contig_ID=SeqID_9713; Location=2553..3215; Strand=-
  SCN-specific regions: Sequence locations=1-113,137-172,202-343,365 -473,495-663
atgtcagaatttctcattttccttttgggtttctcctttgccatgcttctcatgttgtgtttgctggtttcgctggtgctctttgttctttgtgcagcatggtattattggacaaaagaagaagaaccagaagaatttgatgattttccagaatacccaccgccttattaatgaaataaattttttgttgaaatgtgtcatgaaaaaacttggtttaagccatgtacattttttctgctttaaaatttccatttcaaatatctaagcttttaactttaataatgttcaactcatctttttttgctgatgtcaaagaactagggcgtattccaacaccaaagggaaaatttagtgagaagaaaaatgaaactcaatttatgaaaatatttaggtatattttatgcacttgagttcgctaagctttatcaaacggttggacgtgaaatttctcgtgataaattccgacatatcatgaaaacagggaaaaaacaacatgaattagcattggttttgatggaaaaggctgggataaatacacaggagaaaacttttgggcttaaacacctcgaatttgtgcaaaacttttgggacaaagaattcccagatatatttcgtatcgttgcgtttgatatggtaaacgaacatttcctaaactgcctgtga

SEQ ID NO: 72459 - DNA, 1128 bp, Heterodera glycines
  Genomic contig location: Contig_ID=SeqID_9713; Location=3746..4873; Strand=-
  SCN-specific regions: Sequence locations=1-180,202-995,1019-1128
atgccatacaacgccctccgtgccccacaacaccccatccggtttccaattgtcaatgttccgccacttccgctgccccctcaggttggatactgttttttgaccctattttgtgccaacatttctcaaacttttgagttcttagggacaaccaatgctgcgtaatgttgttcctgttcaccaccaccatcatccaatcaacggcctaccacttccactgccccatcaggtcaaaactcatgaccttttttcgccttctcttgaccaacatttcccatctttgatttgttaggggccactgttgttgcgtcatgttgttcatgttccacatcaccatgtccaacctccaccgaatggtctaccgcttccattgcctcatcaggtcaaaaaatgacctttttttcgccttctcttgaccaacatttctcatctttgatttgttaggggccaccgttgttgcgtcatgttgtacctgttccgcatcaccatgttcatcatccaatgaacggcctaccacttccactgccccatcaggtcaaaactttgaattattttgacccaaatttctcatctttgatttgttaggggccaccgttgttgcgtcatgttgtacatgttccgcatcaccatcatccaatcaatggcctaccacatccactgccccatcaggtaaaaactcatgacctttttcgccttcttttgacccaaatttcaccgctttgagttcttaggggcaaccaatgttgcgtcatgttgtgcctgttcaacatcaccatcatccaatcaacggcctaccacttccgctgccccatcaggtcctaaacccgcagttttttctaagacaggagaaatttaggctcatcttgtgccgccccaaccatggcatttcccacctgtcatcgttcgcgtcccgcccgtcgcacaaaggaacgaagctcttcaagttcggaactttcaaaacacccaaaatcatcaacgtgaatttatttaggcgcctccaattgtcaatccgttggggcaaaatccacagcaaatgatccgttggccaagacaacaatggattgggagaccaattgacccccgctcacccccacattaatgagaaaacagaatgcatttgttaataaa

SEQ ID NO: 72460 - DNA, 184 bp, Heterodera glycines
  Genomic contig location: Contig_ID=SeqID_45073; Location=1149..1332; Strand=+
  SCN-specific regions: Sequence locations=1-184
aaacaaaaaaatcgattttttcaagtgtccatttggggtactcgaacatttatggggagcaaaaatccaacgcagaattaaagtacagcctatagggaagctactcccgaaggattcggtctccccataaatctgggcgcatcggttcggggggactgccccgaaaacaaaaaaatcgattttt

SEQ ID NO: 72461 - DNA, 960 bp, Heterodera glycines
  Genomic contig location: Contig_ID=SeqID_45077; Location=284..1243; Strand=+
  SCN-specific regions: Sequence locations=1-33,56-246,268-551,581 -780,814-960
atgcaaccgccacaactgtcgattgagcagcaacaacagtacaaatggatgcaagtgaaaagagcgacggcaacgccccggggaatgccaacttcgccgggaggtaaaaatttagggagggcggaaaagaatagccgaaaacttgggggagggagcaaagaataacatttgacacttcgcgtccccctaatgagtgtatgaacggtcgtaaatctttctgcttgcgaagggaggggaaggtcaaactcagcaccccccaaaaaatgccaaggcaaaataaaaatacgaaggattttcagtggcggaacagcgagaggaacagtcgcgccaccggggacgaattcgcgggactgaaagtgccgtggcgggcggaaaccgaacgaatttcacttatcaacagctaacggaactcgaaaaggtaacgaacggcacaaacagagagagaggcaaactcatgaaaatgcattaaggaattccatacgaacaaatatttgaacaaaacgcgacgggcggagatcgcaaacacattgcaactgcaggaggcacaaatcaaaatttggttccaaaacagacggatgaaagtaaatcgaatggcattttgggaggggggggggaaggcattttgataaattatgggtttaaagtcgagaaatgggcatggatgggactgagcacttttggcacttttttgggtcgtcggatggaaagtccgcaggaaatattgtgctgacaatttaccgatttttttagatgaaaaagcaaaagaaggagcacgactttctgctttcctcctcctcctccaccgccgccgcttcgctttggccaaattcggcggcttttgccaacccccacccgccctcaagcaatgccaacaacagttccgatggtctctctacggcacaactttcgtcgtccgcctcctccgccgaggggccgtcgccgtcgccaaaacggcactga

SEQ ID NO: 72462 - DNA, 1419 bp, Heterodera glycines
  Genomic contig location: Contig_ID=SeqID_9714; Location=820..2238; Strand=+
  SCN-specific regions: Sequence locations=1-22,52-65,87-115,159 -246,437-544,576-610,632-689,711-716,760-764,826-926,948-962,984 -1241,1263-1419
atgatttcaggagaaaccgaagtaattatattgtttaaaatttaaaaaaaactgaaaacagttaaaatttgattttcaacaccaatatccgctaaattctttaaaaatatccaaataattaataaacaaaatatttttgaaatatcaacaagttatatttaattttctttagttgggcgtgtacttatcattattgtagtgccaagaaacaattggggttatttttaatatgattcttctggagtctaaataaattagaaattattatatgaaatttattgtttgatatttcataaataaaatgctaaataattttatattgttattttatttcatttttctaagattcaaaattataaattatataagggaaatattaatttaaaataaatttatgtagaatcattttaccaatttattattaaaaatttattttctacgttaaatttacaatttgatcaggctttttttagattcatatccttaatttatttattaccaaaaattgttataagatattcttttattgaatatttgagctttgtaatattttatttttattatttattttttaagttttctgatattcttttttttggtccaataaacatttgtaacctaatttaaaaatcgttcatgtattttgtaaatcaatcagttaagacctgtgttgcccttgataaagcaatataaaaaattattttaggtttgtagtcttttcacatttttaagtaaattaatttttccttaactctttttcttagataattttattaaactttttgttttttaaaatcattaaaattttgtagatttaaattataacatcagctgtccgacctgctttcccaaaaacgtgccgccctcaaacgggcccaggacgagttagccgaggcggaaaggaccaaccgccgcccgactccggcccctgctggacgaccacttcctttggctgccatttgcccttcctcacccaaaaaatccgccttcgccaatcgcaatgccacggaagcagcaccggacgatttgcgagccatactccatcgacaattcgctcgcctcgccactgatcaagaggctgccgcccaatggacagagtgccgaaagcgcgaaattgccgaggaagcggaacgaatgcttaaaaggctgaaggaagtgatcgtcgactccatcgacattcagcgacaactcttaaatgagcaggcggtcgcctttcgatccatgcgccgaagtatggaggaggcccccgacaccgaagacgaagtcctctccgtgaagtccgtctcctcgagcgctggtttacctggtctttgcgcggggagtgtcgccaaagcgacaaaagaaaaaaaggacaaaatgaaaaaaattgtgttgattggcctttggccggtgattcaattcgtttgtttgagaatttga

SEQ ID NO: 72463 - DNA, 2926 bp, Heterodera glycines
  Genomic contig location: Contig_ID=SeqID_9716; Location=381..3306; Strand=+
  SCN-specific regions: Sequence locations=1-176,198-566,588-1210,1233 -1607,1651-1677,1699-2043,2065-2240,2262-2842,2864-2891,2913-2926
atgccatccgattggaagacggaaaatgaaccgtacattgagcggcatgttcggctcaatggaaaagtgcacaaaatggtagtcgactcaggctcaaaattgacaatcgtgagaaaggccatttgggtcaaattgggccaaccgtttctcacagaaacaaagctcaagggtcgttcattcacagggaacattttcacatttatggggaatttcaaggtccaagcagcattggacgatggaatgcccctcgatttggaatgttttgttatcgattcgaaggacacactcgatttgatgggactcccatggataaaagcatttgagcgtgcctacaaacaagtggtggctacaactttgtcaatcgaaaatgttgccgacagtcgttggtgcaaccgatcaaacagcacgtcgacgcaattggagatggatttacagaacacatttccaagaatttttgagaaaacattgggactttgcaccaaaatcagggcccatctcaaaattaaagaaaattcatctcccgttttttgtgcagcacgaccaatcccaatcggcgttaagcaagaagtggacaaggaattggaccgtctcatcgatatgggcgtcctgaaaaagaccgactacagcagttgggcggcaccaattgttgctgttcggaaagcaaacggaaaggtacgtttgtgcttcgatttcagcacaggactaaatgccgcattggaaccacaccaccatccactgccacgacctgaacaactttttgcgcagctctccggcgcgaaagtgttttcgcaaatcgatttcaaagacgcatacttgcagatcgctgttgatgagcagtcacgcaagttattaggcgtaaacactcaccggggtttatttgagtgcagtagtttagccttcggaattaaaagtgccccagggatttttcagtgggtcatggaccaattgagcaatggaattcccggagtgcttggctacatggacgacttcatcatcgcctcccgttcaatcaaagagcattaccgaacactttatcaatttttccaacgaattcaggaatttggtttccacattcaactggggaagtgcaaattcctcgtccagcagatcaaattccttagccaaattgtgacaccaaatggaatcaaaccggactcggagaggacaaaagcactgcaagacatgcctccaccacacgatgtctcaactctccggtcgtttttgggtgccatcaattattatgggaaatacatcaaaaatttgcacgaaattcgtgcaccattagactcattgctcaaaaaaggagctaaatgggaatggacacgggaacatcagaaatcatttgatgaagcaaagtctgtgttgctgtcagacttagctcttacacacttcaaccccgatctcacaatcattgtcaccgccgacgcgagcaacaaaggaatcggagcgacaattcgccaccggttcaacgacggaaaagagaaagttttccaacacgcagcgcgaacactcaccaaaacggaacaggcctattcccaaattgagaaagagggacttgggctaattttcgccatccaaaaatttcatcaatttatttttggacgaaaatttattctccgtactgatcaccgaccattgttgggaatttttggctctaagagtggcatccccatattttcagcttcacgattgcagcgttgggcactgattctgctcaactacgacttctcgattgagtttgtcagaacggactgcacaggacaagccgatgctttgagccgactgatcagcgaccaacgatcaagctcaaaagacgaagacgtcgtcattgcacaattgttggccgacacggaagcagatgtggcacatgttttcaacacgcaaacggaacaattgccactcaccgcaagggaaattgccgaggcacagcgcagtgacccgctgatcagagaagttttggactgtacaatgggacgatggctaaacaaaggcattaatcccgaaataaaaccatattttactgtccgaaacaatctgtccataatctcagactgtctcgttttcaacggacgtacgatcattccacaggcactgcgcgatcgaattttgaaggcacttcacctcgctcatcctggcatcgttcgaatgaagagcctagctagagaattggtctactggccgtcgatggacgccgacattgaatcacttgtcaaacgctgtgttccatgccaagaagccgccaaacaacccacaaaacatcctctccaaccatggccatcaacaacatccgttttcgaacgtgttcacattgatcttgccggaccatgcagtaatggtagaacttacctggttgtaattgacacttattcaaaatggccagaaattttccagttaaacaatacttcgtctcattcagttatttcacagctacaatggttgtttgatcgttatggtgttccaaaaacgcttgtgtctgacaatggaccccaattttcgtcatccgtttttaaggaattttgcaaaaataatggcattaaacacattttcagcccgccatatcatcctcagtcgaacggagcagctgaacgctacgttgactacttcaaacgccaactcaaaaaatgtagtggtgactgaaattggcttagcaaatcacttctctcatatcgctcaacaccaattgctgttttaggccaacgctcaacagctgaattgtttttaggccgaaaattgcgcacaaaattgtcactcatgaggcccgaaaccattccaaagcaacaacatcacgaacacacgtccaaaatgaaattgcaatttgacaaaaagcacaatgtaaagccggtacagtttaaaattggagagcaagtccaatttctcaattaccgaaatggcaaaacactttggctttttgggcgcattgtttcaa

SEQ ID NO: 72464 - DNA, 364 bp, Heterodera glycines
  Genomic contig location: Contig_ID=SeqID_45082; Location=543..906; Strand=+
  SCN-specific regions: Sequence locations=1-97,119-126,149-331,353-364
atgcggcggaagtgcgggcgctttgctctccgaagcgtttgtccggccgatttcccaggcgcaggaatttctcacctacggacacatcgccccttttatgggcgcttttctcccacatcagtccgtttttggggagttaatccaaaggcatcattcaccgattattgctcatttgtcagatgcgactttatggtgaagaaggaagtgctgaacgaattccgaattccgcccgaattggacgaagcactcaaccgaaaatacaatgggcaaaagggggagggaggaggagaaagggaggaaaaggcagtctcgagaagggcaccaatggtcgagaaaggccaacagcagcagggggagggagaag

SEQ ID NO: 72465 - DNA, 298 bp, Heterodera glycines
  Genomic contig location: Contig_ID=SeqID_45084; Location=357..654; Strand=-
  SCN-specific regions: Sequence locations=1-298
atgccgtaagtgccgcgcgaagtgatttccttttcaaattatgatataattgatcccatttctcctatcatattgaatgcaaaatttatttgcattaatcatgaaattaaatggttgcagccgacattggtcatctcgtagggctaatttgaatgaaatttgattggactttttggtcaatgaatattttggtgcaaccgctgaagatattgaattccttaaggaataatgccaacgcttgaaaaggtgtcctttgatttgatgtatctcaaaaataattaactgttttattaataaa

SEQ ID NO: 72466 - DNA, 819 bp, Heterodera glycines
  Genomic contig location: Contig_ID=SeqID_45086; Location=4..822; Strand=-
  SCN-specific regions: Sequence locations=1-485,513-659,686-819
aaacaaaaaaatcgatttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcagggggactgccccgaaaacccaaaaataaattttttggataaaagttatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaatgaattttgcaaaaaataaataaaaacgaaagact

SEQ ID NO: 72467 - DNA, 49 bp, Heterodera glycines; identical to SEQ ID NO: 51181
  Genomic contig location: Contig_ID=SeqID_45090; Location=739..787; Strand=-
  SCN-specific regions: Sequence locations=1-49

SEQ ID NO: 72468 - DNA, 57 bp, Heterodera glycines
  Genomic contig location: Contig_ID=SeqID_45091; Location=725..781; Strand=+
  SCN-specific regions: Sequence locations=1-57
ggtatagggaagctattcccgaaggattcggtctccccataaatctgggcgcatcgg

SEQ ID NO: 72469 - DNA, 317 bp, Heterodera glycines
  Genomic contig location: Contig_ID=SeqID_45092; Location=490..806; Strand=+
  SCN-specific regions: Sequence locations=1-317
atgcctattagcttaggtttatattttaaaagttttatcgaacttagcagataacgacaaacgacgtattacgacagctttggcgtttgtcgtttatcttttgtcgctcgtaattgtgattggcccctgctggggtccagtggtgccgaaacacgctgccgggggatttgaaaaatataacacgcaaatcgtctcacgtcaaaacgagattttgtttcggtacgagtttaagagtggaattagcacgaacttagttagaatttcatttgtttcggccttcaacttttattgagcttattgtctctacatacaaatga

SEQ ID NO: 72470 - DNA, 48 bp, Heterodera glycines
  Genomic contig location: Contig_ID=SeqID_45094; Location=143..190; Strand=+
  SCN-specific regions: Sequence locations=1-48
gactttcttggagactcgcactcgtccattttcgacgccggcgcgtga

SEQ ID NO: 72471 - DNA, 179 bp, Heterodera glycines
  Genomic contig location: Contig_ID=SeqID_45101; Location=55..233; Strand=+
  SCN-specific regions: Sequence locations=1-179
gtccgcgaatggactcagttggaccataaccatttcgaggcccgtctcgacatggaaacggcgagaaaatctttccttttttcctaatcagctgattaattggatttttagctaacccatggaatgcaagaacacacagtgattgtctacacaaaagtgatgtgagaagtgatcaaagc

SEQ ID NO: 72472 - DNA, 296 bp, Heterodera glycines
  Genomic contig location: Contig_ID=SeqID_9721; Location=462..757; Strand=-
  SCN-specific regions: Sequence locations=1-141,163-296
atggacctctttttaagtagcgcccaaattttgaagttgcattctttgattctcattgactcattcatttttgacatcatattcatggcagaggaacggcaacatgggcaacaaagtcgggaccaacgggacagatatagttctattttttctgaggcagttgatgcggaaacggactggaatggtagggatagatagctaacaaaaaaaacaaaattatttaagaaatctctgttaaggtctcatctcaaaaatggagcaaaaccaaggcaccattgacgacttcaagaaattga

SEQ ID NO: 72473 - DNA, 588 bp, Heterodera glycines
  Genomic contig location: Contig_ID=SeqID_45102; Location=265..852; Strand=+
  SCN-specific regions: Sequence locations=1-266,288-312,335-406,429-588
ttgatcatatgtccatcaaattgatcgaggccaatgagtccattgcgctcctgcggcgccagttggagtcacgcgacgaggaaattgaacagttgcgacgcgccgagtcggtggcgggcgaacgcgtcgcggacgcgcaacgggaggccattcggtggcgcacggaagcggaacgcggactgcgacgcgtcagcagcggacgaaatttggcggcatccgccgaaagcggagaatttgtcagtttttgaacgtatttttataaaaaagttggaaaattcacaaatttttacccatgctaaaattcttttggatttatttgtacaaattcgataggtgtcatattgttggctttttgtgggttgtcgtcgagtcaatttcctctaaaaaatggtcatatggatacatttggtcatgttacgaaatatttttcaaattttgaaggctggttttgacaaactgttgttgagcgactaccgtagtgcgctgtccaaataccgtacatggtcactgtttgcggacaaacagctgcagaccatgaaacagttgttggaggagtgcggcggatggaccgagccaaatcgttacaag

SEQ ID NO: 72474 - DNA, 908 bp, Heterodera glycines
  Genomic contig location: Contig_ID=SeqID_45103; Location=267..1174; Strand=-
  SCN-specific regions: Sequence locations=1-131,153-295,317-459,481 -595,617-748,774-908
ttttgatactaaagcatcagagtgctaaaattaacttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaatttattcatctccctttttgatagaaaaagcatcagagtgcctaaactagcatgtaaataaaatttggtgcgtttcagagcattttctgaaaaaaatatttatgaattaattatgcaaaaaacaaataaaaacgaaagact

SEQ ID NO: 72475 - DNA, 56 bp, Heterodera glycines; identical to SEQ ID NO: 52733
  Genomic contig location: Contig_ID=SeqID_45106; Location=792..847; Strand=+
  SCN-specific regions: Sequence locations=1-56

SEQ ID NO: 72476 - DNA, 55 bp, Heterodera glycines
  Genomic contig location: Contig_ID=SeqID_45107; Location=126..180; Strand=+
  SCN-specific regions: Sequence locations=1-55
aattggagattgggggattaatggagattgggggataattagagaaaatacggta

SEQ ID NO: 72477 - DNA, 615 bp, Heterodera glycines
  Genomic contig location: Contig_ID=SeqID_45111; Location=124..738; Strand=-
  SCN-specific regions: Sequence locations=1-615
atggaaagcctggtgccggaatacgacgttgccggcgtggtgcgcgagcgcaccggcggcgcgctgcccggcatcgtgccgtccaacacctacaccacgcgcgacgaccagaacatcgtcatcgccggcaatggcgacgcgatcttccaccgcctgatgctggccatcggccgcgacgacctggcctccgacccggatctggtgcgcaacgacggccgcgcccgccgcgtcgcggaaatcgacggcgccatccagcaatggtgcgacggccgcggcatcgaagaggcgctcaacaccctcaaggcggccgacgtgccggtcggcaagatctacagcgtggccgacatgttcaccgacccgcagttcctggcgcgccgcatgatcgagcagcaccagttcgccgacggcagtccggtcaagctgccggcggtggtgcccaagctctcggaaaccccgggcgggacccgctggatcggtccgtcattaggggaacataccgaggaagtcctgaaatcgctggggtatgattcagcggctatcgacaagctggcgcagaccggcgctatcggcatccccgcacccaaggagacaacacatgtcagtcactcgtcgtga

SEQ ID NO: 72478 - DNA, 3416 bp, Heterodera glycines
  misc_feature (2697)..(2697): n is a, c, g, or t
  Genomic contig location: Contig_ID=SeqID_9722; Location=339..3754; Strand=+
  SCN-specific regions: Sequence locations=1-124,146-203,225-598,622 -675,697-826,861-1061,1083-1172,1246-1328,1352-1355,1378-1622,1696 -1703,1740-1819,1851-1907,1929-2070,2094-2349,2414-2570,2643 -2650,2672-3244,3266-3416
  Gene Ontology: Mol. function=alpha,alpha-trehalase activity; Cellular component=extrinsic to plasma membrane, GPI-anchored; Biological process=trehalose catabolism
aaaataatttgttcccgagaattccttcacacatttccaaacagtgattaatgggacttaattattcaaaactgtgctcaattcgtgcctatttaagctgcagcaatttctaaaaaattattcattttctttggcttccccaaaaatggcaaattttgcccctttttcccccatttttattttccaattaatttttattttccaattgctcggcaccgttttctgtgctactgtttatttgaaaaaacagtacggtgaaaacgatttgtatgttgagtcatggggcaaaacgaactgttcactgaacggaattgacattgcggcgcttggaattggccgaccatgtgaagaatgaccagatttaggtaaaaaagtgaactaaaattcattaaaaataattacatttacataatttatcaggcagtgaattattggggcgagcgaacgcttttcatgcgcgactcaaagcatttcgttgaccgtcctctgctgaaagatgccaaaaaagtcgtcgaggaattcaaaaccatttttgaagtgacggaatggagtaaattcgcggtcagcgaaatgagcgaagcgcaagtggacaaattggccaaatttgtccaacaaaattttggaatggccgacgaagcactgattgagtaaaatttacaagatataaataatggaaataaatgtttattataattaaggcatgttccggaagattgggtcgaatctccgccaaattttaaggaaatcaaagacgaaaagttggcgaaatgggcaacggaattgaacaaaatgtggaaggaaatgagcaaaaaaatgccaaaagacgtaaaattaattataaaattatcttaattaaaaatgataacattaagatggacaacaatgccaaccaaatgcattcgctgattcatttgtccaaccctttctcgttttccggtggccgatttcgcgagtttcgctattgggattcctattggatggcacgaggactgatcgcatcaggtcaaagtgatcaaaaagtgatgaaaatattttaattatttaagggatgacaaaatcattaaaaaatatgtgcagaattttgcggaaatggtcaaccgatttggcttgtgcccgccgggaggacgcatttattacaacaaacggtcgcagccgccattcctcacattgtgaattaaattacaatattttttaattaaacgacaataaatattgtaaaataattaataataaattgttaattaagtttggtcaatgattacttcgctgccaccggtgacattgcgttccttaaggaaataatgccagcacttgttaagctcaatcagtataattatattaaatttaaaatgtcctttatttatttctttaattttcactaatacttgaatttcatttccattagccaaaagaaatggtctttttccggtggatttttcatcaaacggttgagaccattttgcattgcaaaaattgcattgacaagaaaaaccctaaagaataatatcaaaaaatgaagatttcaattaagacaatgattgttcatcgattgaatgtgcactgatctttttgggattttcccattcgttttaaggtccttgtttttgtggcgtaagaatttcaaaaaataaaattttacaaaaatgataaaaatgtaagttaatattaaaaaaaatacaaaatacaaaaaaaattcggccctgatatttttatttgaattattataattaaattatttacatttgcttcttttttttgtttttaaaaccgacccaaatatatttgtttgcaatgctcaaattgaatgttttctccgattcgatttcttcaataaatttggcattgttttgatgcaacgacgaaccatctgatgaattggaaaccgatttaaaatgataattggtatttaaaaatggaaaaatttacaaccatcggccaacaaatcgacaaattcggcagccgtttgtcccttcgcacccgcataagccatggccaacgcaatttaataattttttgctaattttgcattttaatcaaatgatacgtattatcatctcatgcacacgtccctggaaattatttttaattcaaaaacaattaaaaccaaaggtacgaatatattattaaaaaattccgatattacagaatttttacgcaaataattccgttcccattcccacaataagctttagaccaatttgacttaacaaatgggactaatttgtaaattatagtgctaatatcgctcacttatcatgcagttatttactgatttttccagaacattttacactgaccttatcattttcaatggcgggaagtttgaaggtatttattccagatctgatgaaattaaaaataaattggaaaatttaaatttgtgatttttaattaatctattaaatttaataaagaattctttacgcactctccgcttatggtcaccgtaatgccattgaatgcattttcatttgcgcactcccaaataaactgctgcaaattcggtgttggaataccacgggaagggtaaacggagaaacggaagaagtcgaaatttcaaaactaaaatataattaataaaattataaatcaaatacttatttaattatttatggttgatgggtaattaattattaattaatctgacaatattttctattcttttttatttgccaaagtttctttcacctgctctcnaacactgttttcatttgggcgtcacaatttccatagaaaaacgaacttttcggctgctcaaatcaattttcacttttgccttacaatttttgtctgctcctcacgcgacgcatcgtcccaaaagtgcgagagtgcgtaaagagaaattcaaatttaaatttaaattaatcattttcggaggcacagtaatttttaaattgcttttacgtttattttcgtggccacaacgattgagaaaaaattcatccaggtttcattgagttttatcgatcgaaattttatttttcggaattttctttgtattttcgcattttctttgctaaaattcaaattttgctcaaaaagtaaaaaaaaaatcacgaaaaaagtcgcaaaaactaaaaaaagtcataaaaatcccaaaaagtaaaaaaaaaagtcacaaaaaactgcgtgatagaggcttcagacaaagtttagaacactttttaaggcattttaaggccaccatttagagtcagcaaaaaaaaagtcaccaggcccatttgacccaaaatgaggctttttgcccaaccaggttttttgtattttgtattaggaattttcgagtatttaacgacccaaaacatatttttttttagaatttgaaaaatgggttcgttaagactttctcgactcatccctcaaataaagctccccgccccctccccgaaaaagttgaaaaaagagtttacagggta

SEQ ID NO: 72479 - DNA, 479 bp, Heterodera glycines
  misc_feature (454)..(454): n is a, c, g, or t
  Genomic contig location: Contig_ID=SeqID_45112; Location=109..587; Strand=-
  SCN-specific regions: Sequence locations=1-479
atgacgactcaacaacgaatatttgggaatcagctgctttttctttgcatttttcttattggagttgtttttttcctcttttctgctgctgttgcaaatggtgctcatttagttgactcaagtgagttgctctctttttaaagtgatttaatcgaaatttcaatttaaatccgtttgttggaatgggtcaagacaaattggcatatttttggccaaagaaaatgccaaaaaatagtcaataaaaggcgcccatttccgattaaaaaatcataattaggcgttgatcaaattggtcgtgtacagcacaatcataacggcgacataaacatacgcagagggattgaacgcttcaacgacaatcggatggcacaaaatggtaaagaaaaatggcgaaaatacgaattcaagagaagaaaatctggctaatgttcaaaattgggccaaattctttcgnggagagcaatgaagaattaaataaa

SEQ ID NO: 72480 - DNA, 727 bp, Heterodera glycines
  misc_feature (715)..(715): n is a, c, g, or t
  Genomic contig location: Contig_ID=SeqID_45113; Location=144..870; Strand=+
  SCN-specific regions: Sequence locations=1-63,85-90,112-138,160 -186,208-234,256-282,304-308,330-727
gaactgtggactcggacaaaggaaacgcggacaaaagccagggagcggacacggatggaaagaacccggaaaagccaaaggaaagccaagaagtggaagaggatggaccaaatccgaaggagtcaacgaaaagccaagaagtggaagaggatggaccaaatccgaaggagtcaacgaaaagccaagaagtggaagaggatggaccaaatccgaaggagccaacgaaaagccaagaagtggaagaggatggaccaaatccgaaggagccaacgaaaagccaagaagtggaagaggatggaccaaatccgaaggagccaacggaaagccaagaagtggaggaggatggaacaaattcggacgaggacgagctcactgaaagacaggaagcggaagttgatcggatgcgtgtccgtgccggtgccacctccatgcatgggcttgacaaacttgcgccaacgccaccgccgagtgccacttctacaaatgccatcgcaatacgagtggctaccactcgctggattagcgatacccattggagaaattgtgataccattcgtcaccaacaaattatgcgagcatcgtacccaatattgttcttgtgggaggggaaggtgcgtgccggtaactacgtacaaggcggacaaatgttgtgacagcaactttgaatggaagtgttgccccgatgtaagtattaagttaaaaagaaattattatncaaaattctgca

SEQ ID NO: 72481 - DNA, 108 bp, Heterodera glycines
  Genomic contig location: Contig_ID=SeqID_45115; Location=81..188; Strand=-
  SCN-specific regions: Sequence locations=1-108
atgacttccgaaaatgagcgacgatttcgtgaaaaactgtccattctgaatgagaattttctgcgatttctgcaaaaggcgtacagcaaaaaccctgacgcagatttt

SEQ ID NO: 72482 - DNA, 498 bp, Heterodera glycines
  Genomic contig location: Contig_ID=SeqID_45116; Location=220..717; Strand=+
  SCN-specific regions: Sequence locations=1-72,94-303,349-455,483-498
attttgttccgcaacgacccggcacaatacagggaggaagtgcgacggcgcgtggagagggcatcagcatcgacaccgcgagcgaggtcgtcatcaacaccaccgccggtagcgcaaccgccgggagaacagcagcaggggacgccgccacaaccgccggacggacaggggatgcaaccgccgggagaacagcagcaggggacgccgcaaccgccagcgacaccgccgcaagggcaagaagcgccgcagcagggcgaatggtacctttgatgtgacgtgatgccctctgcgtgatgatattattatatacttatgtatgtgtatatgtattgtattgtatgcatgtgtctgtcgtccgaccatttcattaattaatggtctctctctctctgtgttcgtttgccctgcttttgttcgctgttgtacatattatgtgtattgtcattatccaccaattattgtatatatatgtgtgtacatatgatggtgtatcgagca

SEQ ID NO: 72483 - DNA, 1016 bp, Heterodera glycines
  Genomic contig location: Contig_ID=SeqID_45117; Location=278..1293; Strand=+
  SCN-specific regions: Sequence locations=1-100,249-354,380-381,619 -661,683-758,788-806,847-895,918-995
atgacaatgaccgcaggttccatgacaatgaccgcaggttcgaagactttctgatgtttatctttctcataaatatattgttctgactatttaaggcaactttttttaattatttttatataaaaagtatgcctattttttgatattatagtaagaaaaaaataattatttaaattcattaatattttaaataattaaataattgaatgggccacatttttatatttaaataataattaaatttaaatgttttatcattgatactttttttggttcgaccgagcacctttaaattcattaatattttgtaagtgattaaaaaaataaataaattccataatggatcttttgatgtgtttttaaattattttgctttttggcaatatttttacaaataaattttatttaaataattgtgtcttttttgaaagttaatattttcttgtttaaaaaaataaatatcaaaaaccttggttaattaattaataaactaatgtttgataataatctgtatttttattctgaattattttttcatatttcaatgaaatataaatgtatttcatgaatatattaatgaaaatatttttattttcttataaattctaatattttaatcggtttcatgttagggttatttaatcatccttataaaacagtaacagattgcttttgcaaaaattccatatttcgtattcattcattatttttcacattacacatttatatacaagagaatttcaaagtaaaatttatccatttaataaatatatttaagttaaaaaaacgaacaaaggaaaaaaggcaaaatttttaattatataattaaataaaaaaattaaaaaaccttataatgcgattttgaaaagataaattcaatcaacaaatgagaacaataaattatatttgtaaaatttgattaattcaggttccgtaaaatatgatgaagaatgagtcaacattgaggcgtgaaaaaaatacatatggcaaaaaccatttatagtaaattataaata

SEQ ID NO: 72484 - DNA, 351 bp, Heterodera glycines
  Genomic contig location: Contig_ID=SeqID_45119; Location=212..562; Strand=-
  SCN-specific regions: Sequence locations=1-146,192-206,229-351
atgagtatttgcttcaactttgttttcgggtggttcaatttgagtgcatttacgctttaccacattgctcgtcccgctggttatatcttctatgtattggggcattgcagcagtgcgccggttcttttctttaccaggtccaaaacatttttttaattaaagatttacttaaatttttctattttttatttggcaaataaattaactaatttaattgcctacagttctgtgtaccgaaaagcgtatcaatccgtgttttggtcaaacaataaccaagtggcaccggtacagaatttgcaacgtcaaccaattataacgaacaatattcgtacctatatgaatacccgataa

SEQ ID NO: 72485 - DNA, 631 bp, Heterodera glycines
  Genomic contig location: Contig_ID=SeqID_45120; Location=7..637; Strand=-
  SCN-specific regions: Sequence locations=1-310,332-631
atgaccgatgccagcaaagttggaatttcggctattttatgtcaacacgacgatgagatgaaattgagaccaatttatttcgcttctcgacaatgcagtaaatatgagagccgttatgccgcaactgaattagaagcgttagcagtgagattcggagcaaagaaatttgctcagtttataacaatgctgccgacgagagtcctcacggatcacaaatctcttgtgcccatgttcaaaagcaaggcggagactggaaatgcgcgagtcgacaaatggctcatgtaattgaattcgagatttatgttgaaagtagaataccagccaggaaaaatgaatgtgattgcagaccttttatcgcgctcatttcaaccaaacaatgaaggaatcgccgaaccgccactggaggaggacaaagcattaattggaatgataaaagtattgacagcggaagaagttgaagcatcaattgtggagaaaagagaagcatggagccatgcctccgaagaaagtgaaatgaagcacatatatgcatttttgaagaagaaaattttcccgaacgatccaagacaggcgcaaaatttgaaggaaacgtccacaaagtacacgctgctcgacggactgctttatttat

SEQ ID NO: 72486 - DNA, 720 bp, Heterodera glycines
  Genomic contig location: Contig_ID=SeqID_45121; Location=109..828; Strand=+
  SCN-specific regions: Sequence locations=1-141,166-720
atgaaagagtactacgacaaacgaacaaatgtcagcaaaagagacaagcacaaagtcggggaccgatgtatggtcctttacccaggagcaaacgcgcgatccccgcacaaaaagttgctttggaacaactacggtccatacaaaatcgttgaaatgagtacttcttcggcaaaattggtacccgttgacaaaacagcgtcagaacctataaatgtacctttggaacgattggtcaaagttccaagtgaaatcccgaacgtttcaactctccctaagggcaagaacatgtataagaatactttgaaggctattttatgtccaaatgattggtctgaaaaaggtggccagaacgacggggaaattctagaaagagagcaaaattcaccaaaaacagtgtttcaattgaggacaattgaaaatttagacggcggaatggagacggacgacttttgcgaactgagttggctaatgagttgccaagggaaggaccatgaaaagtgcgacaaattgacgtgcagtgaacttgacccggtcgtggatgcctcgtcagagctcggaatgacttccgttcgttcgccattacaagcgcttttgactgcatttctgttgaaatcaaacgccgcagtctcagcttcatccggtcgcgatttggcagagctcattctcgactctgaacctggcatggagttggtgatctacgaaggagaaagacgggacaat

SEQ ID NO: 72487 - DNA, 1179 bp, Heterodera glycines
  Genomic contig location: Contig_ID=SeqID_1320; Location=68..1246; Strand=-
  SCN-specific regions: Sequence locations=1-77,101-134,156-403,440 -442,464-475,510-667,697-898,920-1179
atgaatttcttcaacgtccttcttttcctcgccaactttgtcctttcaatgtaagactaagagtgaaacaaaaaatcaaacattaaaataaattaaaattccaaacttttaccgtaagaaaaaaaaagattttcaattttttgtaaaatttttcagtggcgctttcagttgcggagagtttttggaaacaaattcgatgaagttcaaacagacgttggaccctgacaacatccgtcaccctagtgtgaatcttggaaattattgcggtgctccagacatgaccatgtgttatggcataggatgcagctcaccggatggtacggattagggatggcattccgaggcccaaaaatttttcggaactcagaattctgaatttcgaccccaaaaacgtcggaaatcgaaaatttttgaaaaaatataataaattttaaaatttcagtgcaatttattaacagaaattgtacacaaattgttaattattttaaaaaaatcaaaaaaaaaaatttccgacctttcataaaaaattttggaaaccggaattccgacctcaaaaatgtcggaaaacagaatccgaaatcccgtgtcatcccgacgaaaaaaaaaattcttaaaaatttggcacgtattttttctaggcttaaaaaatgcgctgatcacggatcttagctcagattttggaaatcattgattttttgtcaataatttttcatcaactacatgatttttttccaaaattttaaggtaaagaaaagttaatccaattggactgtatgcatgcaattgacaaggtgaacatttgtaatgatatagaagttaaactgaaaaatgcaacacaattgcccgctgtgtactgtgagtgccagtttggaaatgaaggcgaagaaaagtcaaatgcgaatttttatgaaaaatatttcaagaatcgaacgcaaggtgtgtgtgtgtgtggtctgatatccctacaattgatcaaatcccccttttatttgggtacattaattagtcagataatacatcaattagttttggtgggatacagatttgtcggcagatggggctacccgacatttagggatttgtgacttgggacccgacaattggacatcccgaaacttggagacttcgacatttgggacttgggcatttgggggcaaaacgacatttagggatttataa

SEQ ID NO: 72488 - DNA, 114 bp, Heterodera glycines
  Genomic contig location: Contig_ID=SeqID_1322; Location=215..328; Strand=-
  SCN-specific regions: Sequence locations=1-114
atgtctttcttctggagtacaaccaacgcaattgtttcctcacttttaccagtcttaccggcttttgtcatgtcatccagccatcgacgcgatcttgaggccttcagcagtaag

SEQ ID NO: 72489 - DNA, 679 bp, Heterodera glycines
  Genomic contig location: Contig_ID=SeqID_1323; Location=291..969; Strand=-
  SCN-specific regions: Sequence locations=1-12,34-155,177-426,456-679
atgccatctgtgaacaaaatgtaagttacaaaatttaatccaataaaaattctacggtaataaggcaatgatttttgattaagcttatttttaatcttattggtatcaaataactcaatgggggcgccaaccgcttacgacatctgcttggctgcctgtggaaactcggagttgtgcgtgtccgcttgttgggctggtctaaaggctgaggttggggcggggtctgccccaatttttcctgcatctcatgattataatcttgattttacagatgtttgttggagcttgccctccagtatttgggccgttctgcatactcggctgtccctcagcctgtctgccgttccttccatttcttccagcgtgggcgctttgcatgtccgcatgcattggcgcacagccgccgccggtcttttctgaattaagaattttttataaaaattatatttaaaaatggcggagaaattcattcagatattaaccagttttcattctgccaggtgtgggcatgcaaccagggcggccttcacgccccgtgggaccagcagaactgcgatgtcgaagaattgttgggagacggctcaaacgcttagccagacgggctgcctgaattgacttttccatcgcttctgtagtgattagaccatcaaagtaaattgttcggcaatatcccaataaa

SEQ ID NO: 72490 - DNA, 1019 bp, Heterodera glycines
  Genomic contig location: Contig_ID=SeqID_1323; Location=1501..2519; Strand=-
  SCN-specific regions: Sequence locations=1-115,184-196,242-254,281 -283,305-395,417-787,812-1019
atgtctcctggatttgttataggacccttcaaatggtcaaatggggtatgcactatctaattattttgctaattctgatcaaatgtaattatttcgtaatctttttaccattggaaaataaatatttaatcaattagtattttaatcaacaaattaattaattaaacaaatacaattaactaaatggtgtttaatgattattttactttttaaatttatttataattaaattctttaaaatgacaaaatgctgcatttaaatttttttaatttaaattatccaaaaataaaatgtaacaattttcaaaaccaaaatcagctaaaaaaggtccgatagcgtttattgagctccttcaagcacacgtcacgttgatcaacaatttccgcctccgcgtcattacggccccgcccgtgggccgatttgacgtgcattatggccgctgaactgctcaacgattcaaaggcacggccacagagacggcacgtgtaaacggccatatgcaaatgcctaaatcagagggggggggtaatttgtaggcctaattagttaaaaataactgtatttttttttgcaaaaatatcccactttgtgttcatgtggttagttagctgactggagtaaatggaggccacaaattcaccgcactgcaaacactgaacatgcgaactgcttccacccggttcacttccggactgaggccgttcgcggagtgaaatctgggaaaaaaatattttgctgttttgacatccctaatcagtgccatatttggcattctattttaaaaccaaaaaaaaaaaaattaattttttaggaaatcacgggtaaataaatgatcggacgaacgggcaagggccaataggtccgaatatcttcttacggattttcgtaatccattttatcacagtttattatcccggaagaggaagtaaaaaaatgttaaaaatctgtttaaatgtaatcagttattattttttaaattgtaatcaaaaaaaggaaaagaaaatagattttaaataaa

SEQ ID NO: 72491 - DNA, 778 bp, Heterodera glycines
  Genomic contig location: Contig_ID=SeqID_9724; Location=12..789; Strand=-
  SCN-specific regions: Sequence locations=1-257,279-478,510-720,742-778
atgatgggcccgcatttgtttcctgaacaaatttataaaatggataccaagaatggcaattttttgaacaaaaaaagcatgctgttgttccaaattatgacagcgatcgatctgtgcggtacaatgccacatttccaaatccttgagacaaatgatcatgtaaactgaatgtaataaggtggaccaagccgttttctttctttgtaagcaaaattcaacaatctttgtatcattcgatagccttaagtgttagcctgcaaaatttaagagttaaaaaactggttgttcgagcattttttgccatacctttttgaaccgtaacgaaatttttcgaaatttgcaggcaaatagaggacacttaggactaccaaatgataccaagattgttgcatttggtttgcaaaaaaattttagccaacaacttgtgctcgtacgaaaacgacccggaccccagactgtgccgataggcgccgccgggaaaaaaaaatttttattttgaaattttaataccttttgttaagaaaaatgattttccttgaaaaattcttatttttcatttcgggggtgggtagaattctgcccccttcctggctacgtgcctgaccaagcaccctgatccggatttggggaaacgacctaattatcctcaaaataaataacattttcaggcagttttactgagttatattacaattccattattttcactgtatggacgcttttattcatcaaaagtcaattcaccaatcgtccaaagcatcccgaacaatgcgtttag

SEQ ID NO: 72492 - DNA, 407 bp, Heterodera glycines
  Genomic contig location: Contig_ID=SeqID_9725; Location=1..407; Strand=+
  SCN-specific regions: Sequence locations=1-235,257-407
tttattgaagaatgatgagtgggagcaaattaagagctggttggggtattgaaatgtgctgaagaagcaacaaaaaggttcaccgcagagccaatttcatttgtcattcctcaagcaagagcattacatgatgagttgtacgaaatgaaaattgttaaccggactgtggagacaatcagaacaaccctttattttgcggtcgagcggcgcttttttgggctagcgaatttgaagtagaaaaatttaacttaattttcaataatgtttggtcttagggaatatgcgctagcgacttttttggatgtgcgattcaaggacaaagtgctgactgaaaattccgcaacttttcgcgctcgagtcactgtctggatcaaaaatgaattgaaggaatgggaaattgataatga

SEQ ID NO: 72493 - DNA, 338 bp, Heterodera glycines
  Genomic contig location: Contig_ID=SeqID_45122; Location=189..526; Strand=+
  SCN-specific regions: Sequence locations=1-172,195-202,241-243,333-338
atggtatgggggaacggcggggagggaaacaagctagctgctgctcccaagaatgggccatcgccggtcgtcggagaaagggggcagggaggagacggacgcccagccaattcattcattctttcatgccattgttcgcttctcttttttttgcgtggactcaagccgccggaaatgttttttatgggaatttgtgtaggggaacaaaacaaaacaaaacacaaataaaataagagaaaatttgaaaagaaatgataaggaaagagaagagaagacgagagataaaaatgtaaagaaaaatggccgtggagagaaagaacaaaaagagaaaatagtaa

SEQ ID NO: 72494 - DNA, 714 bp, Heterodera glycines
  Genomic contig location: Contig_ID=SeqID_45124; Location=107..820; Strand=-
  SCN-specific regions: Sequence locations=1-275,297-551,573-714
atgccaaaacaaaacgaaatcgttataaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaaacggtataccaaaccccagatttttgaatccgggttttcagaaaaaatgccttggtggtgaaaacaatatttcacatttcactccataa

SEQ ID NO: 72495 - DNA, 276 bp, Heterodera glycines
  Genomic contig location: Contig_ID=SeqID_45126; Location=214..489; Strand=-
  SCN-specific regions: Sequence locations=1-45,67-145,251-276
  Gene Ontology: Mol. function=protein binding; Cellular component =axoneme; Biological process=eye photoreceptor cell development
atgtttgtgaaggaagagaagcaacgaaaaagcgaagtgaatgaaaaggagcagaagaaaggagaacgacaaatgaacagtgacactttgcagctccaatcggagttggagaaaatgttggcccatttgggaggaacgataaaaaaggaagaggagaaagaggaggaggaagaagacgagaatggggaggagttggaagaggaggaggaggaagagagcgaggaggacgaagaggaggaggaggagcagggcaggggccgagcggaggcgcacgaa

SEQ ID NO: 72496 - DNA, 1196 bp, Heterodera glycines
  Genomic contig location: Contig_ID=SeqID_45127; Location=89..1284; Strand=+
  SCN-specific regions: Sequence locations=1-1057,1079-1196
atgagcgctaaaattatcagagtgccgaaaatcgcatgtgatctaagcctagcaaaaaatggtgtaggtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctaaaaaagcttctcaaacaattttagcgcttccaattccttctacaattgcctttatacatcccattatgagcgctaaaattatcagagtgccgaaaatcgcatgtgatctaagcctagaaaaaatggtctaagtaaaaatcgtaattacgctaaaaaagcttctcaaacaattttagcgcttccaattccttctacaattgcctttatacatcccattatgagcgctaaaattatcagagtgccgaaaatcgcatgtgatctaagcctagcaaaaaatggtgtaagtaaaaatcgtaattacgctcaaaaagcttctcaatctattgtatcgctttcaaccgccggccccccaaaaagtccaatttttttgcaaaaaattgtcccaaaattgcaaaaataggtatttttaggaaaaatctgttaacaaattgcaaattttcaaaaaaaaaattcctcgcggctcctaatggcatcgtcgcccatcccccttctggctgttgcctaaagtttttttgaaaatgagtgccgcaaaaaatggtggtgaaattcgatgttgagacgggtgcgcaaaaatttcggttaaaccccctcccccttgtcaagtattttaaaccagggcttccacaattaacaccaagcccgaaaaaataagattttaggctcaaaaataagaacattttacaacattttttcaaatcagttacttttacaatttattcgatcaaaaatgtatcaaattttatatttttagtctcacattatcaattttaacaattttggggaggaaaatgcaaacttgtaa

SEQ ID NO: 72497 - DNA, 336 bp, Heterodera glycines
  Genomic contig location: Contig_ID=SeqID_45128; Location=189..524; Strand=-
  SCN-specific regions: Sequence locations=1-3,26-54,88-176,199-233,297- 336
atgcctgcaaaatgtcagtgttaaaatttcaaattgccaactcaaatctcagagaaaattaaataattttaaaataagtaaattttacagtaacttattaccagggaacggatttatttttaatgcgctcaaattttgccatacaaatcgactgataggattaaaaaacacaaattatttaaataggagttttattttcaattaggcaaaaatgaaaagaggaatttttcaagaaaaaaattaaaattaaaaaaaattaaattattttttctagttaaaatttttatattattaaacaattcaaaggcaagagcaatatttaaatggtttaataaa

SEQ ID NO: 72498 - DNA, 714 bp, Heterodera glycines
  Genomic contig location: Contig_ID=SeqID_45129; Location=233..946; Strand=+
  SCN-specific regions: Sequence locations=1-6,28-225,248-345,438-714
tggtcattgtgtgcaatattttccatttggctggtgctcagcacattggccgatgaagaaacatttggccaaccgcaagtgtactactcaatgatttcacgctacaacagcgacattgtgataatacttaactacgtgctgttggcacttgttttactcaccatgatggccaacattgccatcatggtacagaaccggaagatgcagatgcgcagtcggaaacggtaaacaaaacaatacttgaaaaattgatcagaggcctgttcaagaacaatcttgacaaaaaaattgttatcaataggggcctagtcgtttcctaaaattgccagtttggataaaaactgcaaaaaaaatctaaaaaaaaaatatattttttatttcataaaatttttatgtcagtttttgaaaaaattataaatataatataaaaattttaactatatcgcaattatctattattgtactgcttaaaaaatactggtgagaaaaaattaattttgtaaatgtcggtatgataattaatactagttgttttctaaaagtctgaaacgtccatttggcactttttgaggaaacgtacatttagtagcttttaggaaacgcctattaggcactttttagtaaatgctctggcaaatttataatcatttctttgtcagatttgccaatgccacggtgtcgccatcgtttagtcatgcccaaatggcattcgga

SEQ ID NO: 72499 - DNA, 499 bp, Heterodera glycines; identical to SEQ ID NO: 63619
  Genomic contig location: Contig_ID=SeqID_45131; Location=417..915; Strand=+
  SCN-specific regions: Sequence locations=1-107,134-263,292-499

SEQ ID NO: 72500 - DNA, 1345 bp, Heterodera glycines
  Genomic contig location: Contig_ID=SeqID_45136; Location=1..1345; Strand=-
  SCN-specific regions: Sequence locations=1-781,812-878,923-1052,1083 -1095,1117-1166,1202-1205,1231-1266,1288-1298,1340-1345
gtgctttgcgttggttggttggcgtgggtgactgtggtggttgggccgtttttgcgatattatggctggaaaaaagatgcgatttcgctatggggagcgcggccgtctgggttcaagtgcttgcttgcgcttgtgctcggcattgaacggtgatggctgctgctggggtgccacctttgtcgtggcctcagtttctccagcgattggcagctgtcgaaatgaataaacatgcagctcgtctgtgtgttaaagaaatttggcgagttaattgacttgtgtaaatgtggcctaaggcacaaatgctgtggggaactcagcactggggatgctgaacctaaagttggtgggtggtgttggtatacgagtgagtggcgtattgccatggttgacaagccctatgagttcgtggatcggaactccttgcctggggaccagtgtgcttgcattcgaaaaaacacgagacataagcgcccgaaggcctttggcctgaggaagtgtcctaaccgggaaatccggagtgctcgtgtgagtgcctgtgcactgccctcggagctgtgtccagcggcgagatggttcttcccaagtccgggaagctcggatgcctggccagcgctgtgtcattaccacttgctctgtctccttcgctgcccatgcgcacgcttgcgctgaacggagttgtttctgctgaaactatccgtctttacaagacggctgtaatagcggcgcttggcaacgctcgctagcagctatctggttgatcctgcctgaactgatgtgttcatttcaaagattaagccatgcatgtgtaagtttaacctgccagacagggaaactgcgtacggctcattacaccagctataatttacttgaccttgacttcttacttggataactgtggtaattctagagctaatacatgcaccaaagctccaatctccccagagcggagcgcatttgttcgccacaaaaccaagcgccctccgggcgtccagtgttgactcagaacaactaagctgatcgcacggtcttgtaccggcgacgtgtctttcaagtgtctgccttatcaactttcgatggtagtgtatctgactaccatggtgatgacgggtaacggaggataagggttcgactccggagaaggggcctgagaaatggccactacgtctaaggatggcagcaggcgcgcaaattacccactctcaacgcgaggaggtagtgacgagaaataacgagaccgatctcttatgaggccggtcatcggaatgggtacaatttaaaccctttaacgagtatctatgagagggcaagtctggtgccagcagccgcggtaattcagctctcaaat

SEQ ID NO: 72501 - DNA, 807 bp, Heterodera glycines
  Genomic contig location: Contig_ID=SeqID_45139; Location=344..1150; Strand=-
  SCN-specific regions: Sequence locations=1-178,207-785
atgtatcaactgttccgggcattggggtacatttttttcttcatttttatttttaatttattgcccatcatcccccttcaattttttagttacattcacagcattggcatttgtcatcgggacataaaaccgcagaatttgttgctcaatccgcaaacatcagtattgaaagtggggcatttaaaaaaaaattatttttaatttttcactactttttagctttgtgatttcgggtccgcaaaaacgttggtccagggtgagccgaacgtcgcctacatttgttcacggtcagttaacattttggcgttataattgcaaaaaatgaattttccgaaaatttctcatatttttcaaaaatggatgggattcagctttatttgagatagagccacagggaaaagatttgggtttttgcgtaacaaaaaaatcaaaatagttagctattttttctgctaaatttcaggtattatcgcgcgccagaactgatttttggcgccaccgattatacgaccaaaattggtacaagcaaaccaaatattattgtagttttagcatatattttttaccaacacataaaaagggtgcaattttttcagatgtttggtccgcgggcacaggtaaaaactaaaaattaaaaaaagtttttgtttctacggttttattaaattttcagtgcttgctgaacttttgcttggtcagcccttcttccccggcgactcgggtgtgtttgtactactactttttgaattgtttattagttttgtaaaagcattttcgggttttatgggaaaaccccatattttttaa

SEQ ID NO: 72502 - DNA, 284 bp, Heterodera glycines; identical to SEQ ID NO: 61132
  Genomic contig location: Contig_ID=SeqID_45141; Location=193..476; Strand=-
  SCN-specific regions: Sequence locations=1-131,161-161,186-284

SEQ ID NO: 72503 - DNA, 881 bp, Heterodera glycines
  Genomic contig location: Contig_ID=SeqID_9729; Location=77..957; Strand=+
  SCN-specific regions: Sequence locations=1-852,875-881
atggactttacaactaccgacaatacaacaaacacggatttgacaacgatggacaaggcaacggacgtggatttggcttatgaggacgccgcgacacaaaccgagcagttgaacaaacagctgaaggagcaggaacaaacgatcagctttctacgactgcagctccgcaacagagacgcaatgatcgccgatctgcgccgtcaattggaagagcaagcgcagacgaacccgccaacacgtaaaattctgcagaatttttagagccgtttatcatccaaattgtttttagcttccacacggtgcaaaaagaatgcgactacattggagcggacctcacggcgaaatttggtcgagaaaatcgttgatgtgatcgatcgagaccgctcccgatcagtgagccgatgttcgctgcaaactctacatcgtgaagtccgccacaaattcggacactacacaccaatgaagaaggaacaactcctacaacaacaaacaatccatggagaggatgggctgcttttgctgtcacaactcgggacccaaaaggcttatgtaaaaatgttttgcgatcaatcgaatttgaccggataatcctggcgccttttcacgtcttccagggcattggaaatgcactgatcaaagagctcgaaggatcaactgaaagcgcggaaattgcgaacggatttttcagaagcatcgcggccaggagagaagcgttcagaaaaaagacatgacggggaatttaatcagaaaagttctgattcatgctgaccaattggagaggctttactcagctgaatggcctcaaattatttgcaaaaccatgggacacttggcaaagatacaaacttttacaaaagtgctttttattttctttcttgaaa

SEQ ID NO: 72504 - DNA, 81 bp, Heterodera glycines
  Genomic contig location: Contig_ID=SeqID_9729; Location=1649..1729; Strand=-
  SCN-specific regions: Sequence locations=1-29,51-81
aacactgcgattcaattttgggctccaagtacaattaagttggttttttcgtcttagtggtctgtgagttagtcaccaaaa

SEQ ID NO: 72505 - DNA, 2031 bp, Heterodera glycines
  Genomic contig location: Contig_ID=SeqID_9729; Location=2822..4852; Strand=-
  SCN-specific regions: Sequence locations=1-139,161-292,321-368,390 -552,574-856,878-1329,1352-1389,1411-1706,1736-1887,1909-1956,1978 -2031
atggcacggaagggcaaaatgccaaagtggtgggacgaccgaaaaggcatccgagtgaatgcaaagtgtgcggaaggaaaagcatgtactgttattacagaatccgatgttgcgaaagtgagtgacgaaaaaagaatatttataatttaatatacttaaatgtgagtgtgaatcagggagtcggcgaaagtacagcactttctgcagaaaagaaaactgaaaggatttttttcaacggggacggaaactgccaatcttaatttgaatgaaaatctctgttcagcagattctcttttaaatacattaaatatttttatttacaaatttcggaccggatctgtttagtctggccgttttagtctggcaagctgtttttgtcctaaattgattcaattctgcttttttcgaaaaatctttaatttaacgccacatatatcatcaatttgaccaaaagtccgcacagacaaaacgccaaaaaaccacgctaattcaaaaattgtcgagaatttcccttgtaaaaacggaagagccgatctcgagttaaaaacaagttctattaaataaacttggaatcgctagagggggtcaaaatatggccctatgcaaaattacaagaacatttgaacatagggaaaattttttcaactgggtgaaaattttaataaattaccgtcattttaaaggttaaaaatgatattggtacgtaaaaacgatagttaaacatattcttaagaatttccccttcaaaatgagaccaaaattgctctatttggtttactaatgaccaagttaaaagcattagaaatttcataaaaatcactgttttatcacttttttctcttggcgcactgtgcgcatttattttcattaatttttatgtagtgtctgactctcacatgtctgctgtttcttcgcagttcttgttttttttattttcgcttcgacacattattttttttataatgctgcgcacttttggtcaaattgatgatatatgacaccataacatacttatcaatatgttttcaacgaaaaaaataacaaaacattgaaaaatgaatacaggcgtatttcataatttggagaaatctcaactaaaaaatgatgatattatcgggattaagttggcatggtaatcttgatcattttggtgagcaggattaatattgttgatgttattgtaactctgcaatagtcgagaattctcgcatcgacggcacgatatttgcatgttttttgaggcacgacttcaccagcgacgcatcatgcgatgtctgcatcaaatgacttttctcatatcgaattgtgttgatgaagcggaagacagttggatatgaaaaagcaaaagtccgttgaagccttctatggaaaaaaacgtgaaaaattaacgttttactttgcctgaagaatataaatttgactgaacaaaggcggctataattaacaaaaaaatatttgtaagagttatggacaaaaacagcttgtcagactaaaccgaccctctgactaaattgaccctctgactaaactggccagactaaaacggccagactaaaccgacccccaccgacaaattgttataaattaaggctgcaagcaattctttcgtcatattattctcaagaaaacattgttcaattgttatgggacgaaaaactgccaaattgaaaaaggttgttaaaaaacgattaatctaaaagaaatagtaataaaattaaatttaattataatttttcagatggaactcgatgccgcggctgtcgcttggacaaatgccttttggccagtatggacccgacagtgatctatttgaaacaaaaagaagggatggcccaatatttggaaaggttggaactacgaaaaatgagtgcattgttgagaaagaattgcagagaagggaagaatttgttattgtgatccgattaagctatcagaatttgtctttactgatttttgaatttaaatattttatatatgatattcacgagaaactttcctaaataaaaacatttttagacaattcgaatatag

SEQ ID NO: 72506 - DNA, 66 bp, Heterodera glycines
  Genomic contig location: Contig_ID=SeqID_45144; Location=1..66; Strand=-
  SCN-specific regions: Sequence locations=1-66
catttgttaaacacccaatcgtcgctgtctcgggagggaccggcgccacatatttgttgtacactt

SEQ ID NO: 72507 - DNA, 636 bp, Heterodera glycines
  Genomic contig location: Contig_ID=SeqID_45144; Location=263..898; Strand=-
  SCN-specific regions: Sequence locations=1-636
  Gene Ontology: Cellular component=COPII-coated vesicle; Biological process=intracellular protein transport
tttgatggtttttaccataggtcatttttcgcaaaatcaaaaaattatatcacagtcgaccaccactgacgagaaaaaggcttcgcgcaagtcgacatcgagatcggtgggaaaatggtttgccagtaaatttgaacgaattttggttggaaatagcaatttttgtttcttcgggttcataatatttttaatattatctgttggggctacaatgtaaagggcccaaaaaatctcattttgtttttttactttgatttttcgagtcacttaataatccctttcaaaaaaaaaacttgaggtggcagccaaagacaaattgaacgaacttcaattgcgtgtgcggcaattgttggaccaagtggaacaaatcaccaaagagcagaattaccagcgctatcgcgaagagcgtttccgacagaccagcgaaagtaccaacgtaagaacggggacaagaaagtgaacggattgccaaaatatttaccattcgctttttcctgccttcacgctttaaattgcctttttcggtttcagagtcgcgtgctttggtggtccgtcggacaaacgattgtcctccttttgaccggtgcttggcaaatgcgccacttgaagggctttttcgaggccaaaaagcttgtc

SEQ ID NO: 72508 - DNA, 845 bp, Heterodera glycines
  Genomic contig location: Contig_ID=SeqID_45145; Location=407..1251; Strand=+
  SCN-specific regions: Sequence locations=1-317,339-518,540-845
atggttaattttatgaataaattacgtggtgaaaacgaccaaacgatcaaacaacttcgttccgttattgccgaattaaaagatcaagtggccaaccagtacgttcgcattgacgaattaaaagatcaagttgccgaccagaacgtgcgtattcacgaccaaaaaaaggttttcctcacaaaatcgctaagagtttattggattcttgaaatttaggagattcgaaaactaagggaagacaaccaaaaaaatgcaacatttttccgttctacaaaaggcttgttgtgtgaaatcaaagggcaaaaccgtcggatcaactcagcaatggcaatgttcagagaacaacactttggttctgagacttgccaggaacatccatttccattggtcggaaaatttatttttgcttttataataatagcatcttatgtgccctgataatttgtgtcggtgtcggataatgtcacttccaaatttaagggggggggggcttcaatatcccactatgaaaaaagcaatacagccaaaacttcaaaaatagaagaatttgcacccaacaggactggtcgttcaattcggtccgcggcgtggtgaccgacttgaccaacaaacagcgttgctctctaattgaagcattccgtgctcgcatcatttccaaggaagattggatggtttgggacgatgtcggcggacgggaaattgagtttatggaggcagaaaaaatgcgcattgtgagcattgaggaggacttttacaagacggacccgaacagtggtgaacgcgtcacgctggcgaacgcggcaatgtttcaaaacatttggccaatccgttgcggaatgaaaaaa

SEQ ID NO: 72509 - DNA, 81 bp, Heterodera glycines
  Genomic contig location: Contig_ID=SeqID_45145; Location=46..126; Strand=-
  SCN-specific regions: Sequence locations=1-81
cactatgggtcaagcccagtgttagacaaaattctcataacgccaaatagcgtaattggcgtaaatttttgcgcgctaatt

SEQ ID NO: 72510 - DNA, 187 bp, Heterodera glycines
  Genomic contig location: Contig_ID=SeqID_45148; Location=684..870; Strand=+
  SCN-specific regions: Sequence locations=1-187
atgaggcgaaatgtggacaatgacagtggtgcaaacaatggcgcgaacatcagcagcaacccgaaaattgcccgggatgcggaaattgctcatgttgtggacactggaaatggcgcaaatgacgcgcttggcgacggaatggacattgggcactgcccaaactgctcgtggcattgcaatgtgtgca

SEQ ID NO: 72511 - DNA, 879 bp, Heterodera glycines
  Genomic contig location: Contig_ID=SeqID_45149; Location=189..1067; Strand=+
  SCN-specific regions: Sequence locations=1-86,108-613,636-879
atgggcgtcctgaaaaagaccgactacagcagttgggcggcaccaattgttgctgttcggaaagcaaacggaaaggtacgtttgtgcttcaatttcagcacaggactaaatgccgcattggaaccacaccaccatccactgccacgacctgaacaactttttgcgcagctctccggcgcgaaagtgttttcgcaaatcgacttcaaagacgcatacttgcagatcgctgttgatgagcagtcacgcaagtttttaggcgtaaacactcaccggggtttatttgagtgcagtcgtttagccttcggaattaaaagtgccccaggcatttttcagtgggtcatggaccaattgagtaacggaattcccggagtgcttggctacatggacgacttcatcatcgcctcccgttcaatcaaagagcattatcgaacgctttatcaatttttccaacgaattcaggaatttggtttccacattcaactggggaagtgcaaattcctcgtccagcagatcaaattccttggccaaattgtgacaccaaatggaatcaaaccggactcggagaggacaaaagcactgcaagacatgcctccaccacacgatgtctcaactctccggtcgtttttgggtgccatcaattattatgggaaatacatcaaaaatttgcacgaaattagtgcaccattagactcattgctcaaaaaaggagctaaatgggaatggacacgggaacatcagaaatcatttgatgaagcaaagtctgtgttgctgtcagacttagctcttacacactttctcacaatcatcgtcaccgccgacgcgagcaacaaaggaatcggagcgacaatttcccaccggttcaacgacggaaaagagaaa

SEQ ID NO: 72512 - DNA, 201 bp, Heterodera glycines
  Genomic contig location: Contig_ID=SeqID_9730; Location=705..905; Strand=-
  SCN-specific regions: Sequence locations=1-70,93-201
atgggccagactttggtatggcccagccaaatgaacacatatgctgatcataattatggccaactgttcaaaaaatttttaattttcagaaataccgcatttagaatgggcccagacattggtatggcccagttaaatgcacaattatgatcgatcactttaatttcaggaataccgcatttagaatgggcccagactcaa

SEQ ID NO: 72513 - DNA, 231 bp, Heterodera glycines
  Genomic contig location: Contig_ID=SeqID_9731; Location=3125..3355; Strand=-
  SCN-specific regions: Sequence locations=1-117,180-194
atgtctgtttggccaactttttcacatcgtctcccttcagcttattgtgcggcttgcccatggattgtcccattgcaatggttcacaaggtatggtttcgaaatttttggaaaaatctaaaaaaatttttttaatattttattcacaaaataattgagaaataaaaaagaaattatttaggcatgtcatttaagtaattaaatttattcattaaaattttttcttaataaa

SEQ ID NO: 72514 - DNA, 327 bp, Heterodera glycines
  Genomic contig location: Contig_ID=SeqID_9731; Location=3283..3609; Strand=+
  SCN-specific regions: Sequence locations=1-81,121-203,255-261,288-327
  Gene Ontology: Mol. function=calcium sensitive guanylate cyclase activator activity; Cellular component=membrane; Biological process =synaptic vesicle fusion
atgggacaatccatgggcaagccgcacaataagctgaagggagacgatgtgaaaaagttggccaaacagacatactgtatgtttattttttgtaataaaatatataattattatttttttcaatttagtcactgaaaaagaaatccgacaatggcacaaaggctttgtcagggactgtcccaacggcatgctaactgaaattgtaaattaaaatttattttaaaaaattaattaattatttttcattattttaagggcttccaaaagatttacaagcagttcttcccccaagagggtccatctgattttgcagcatatgtgttcaag

SEQ ID NO: 72515 - DNA, 195 bp, Heterodera glycines
  misc_feature (186)..(186): n is a, c, g, or t
  Genomic contig location: Contig_ID=SeqID_45153; Location=1..195; Strand=-
  SCN-specific regions: Sequence locations=1-195
aatgagaaaaaagagatagccattttttggtcaagaattttttttgtttgcgtttcaaatatcgtaagattgtttgatagggccagacaagagaaggcaactgttggtaccaagtttgcggtaaaaaaatgagaaaaaagagataaccatttttggtcaagaattttttttgtttgcgtttcaaantatcgtaag

SEQ ID NO: 72516 - DNA, 642 bp, Heterodera glycines
  misc_feature (51)..(51): n is a, c, g, or t
  Genomic contig location: Contig_ID=SeqID_45155; Location=419..1060; Strand=-
  SCN-specific regions: Sequence locations=1-642
tttcagtgtccgttttgggtactcaaacaattatggggagcaaaaattcancgcagaattaaagtacaggctatagggaagctattccggaaggattcggtctccccataaatctgggcgcatcggctcggggggactgccccgaaaacaaaaaaatcgattttttcagtgtccgtttgggggtactcaaacaattatggggagcaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaac

SEQ ID NO: 72517 - DNA, 87 bp, Heterodera glycines
  Genomic contig location: Contig_ID=SeqID_45157; Location=511..597; Strand=+
  SCN-specific regions: Sequence locations=1-87
atgcgaataatgcgaaaggcgaaatgcgaaaagcgaaacctcggcccatccctgttttgtacgtatttaatgcttttggttccgtcg

SEQ ID NO: 72518 - DNA, 1009 bp, Heterodera glycines
  Genomic contig location: Contig_ID=SeqID_45159; Location=132..1140; Strand=-
  SCN-specific regions: Sequence locations=1-822,844-981,1006-1009
atgaccgaccctggtaagtgatcggccgatgctcgcgatagcgacccgacagtttggacctgtaaatcggtaattaactaattggtaatttaacttcccacctgtcgattttgaaatttaacatgtaaaaacaattttgaacttttcttagataccacccgaatagatgtttacaattttttgaaacaaaaaaacttttgtagcaacgacttacctgtagtctggaatgcctaaaggggaaatataaaaatactgtatcatgacggaagagaggaaaacggcgaaatgccattagtaattagtgaaaattagtgagtggagagagagagaatgtggaaaagagagcacaagagaatcagagtgcaaatcgcttgattgtgttaattgttgtgccattcccacccgattcagtggaaatgccggcgcctgtcatcaccacaagcttgtcaatgcgcgaaaagtgttcctggaacttgtcaaacgctttcccatcaatgcaattagtcgtaggaacaaaacgatcagcgccaaaggatgaggcgaagaagcgacgggaaatcatctccaaacaaatcgaacaaagagaattaaaaacaaattcagtttttaattttcaataaaactcacaaaagccaaccaattaactaaggttgtggaaaatttgcaaaaaaaggaatataacatttataacacttatattttacacaacaatgaacaacagacaacaaaaagaaaataaatacaaaaatggtgagccaaaaatgccttcattcgttctatgtaagagaatgataataatttaatttaacttttgtcggcattgcatttaacaagtgataaataggagcccagcagatttcttacaactaaagccggttataaacagctaaaaataaaacgaaatctcacggctgttagcatctattttaatccatatccgttccaggtggtacacaagcaaatatgaaaatgaattttgataaaatttaaaaacaacagcaaaaataaa

SEQ ID NO: 72519 - DNA, 92 bp, Heterodera glycines
  Genomic contig location: Contig_ID=SeqID_9732; Location=3498..3589; Strand=+
  SCN-specific regions: Sequence locations=1-92
atgggacagaaggaatcccgtcatgcgtttgtcaattgtgccttgataaggcgagaagaatttgaagacaaaattcaggaactcaacaaaaa

SEQ ID NO: 72520 - DNA, 56 bp, Heterodera glycines; identical to SEQ ID NO: 52733
  Genomic contig location: Contig_ID=SeqID_45162; Location=786..841; Strand=+
  SCN-specific regions: Sequence locations=1-56

SEQ ID NO: 72521 - DNA, 49 bp, Heterodera glycines; identical to SEQ ID NO: 60106
  Genomic contig location: Contig_ID=SeqID_45165; Location=134..182; Strand=+
  SCN-specific regions: Sequence locations=1-49

SEQ ID NO: 72522 - DNA, 310 bp, Heterodera glycines
  Genomic contig location: Contig_ID=SeqID_45168; Location=992..1301; Strand=-
  SCN-specific regions: Sequence locations=1-310
atgactgattgtgagcatcactccgtgcccccgtccgtccctcccgtcgacttttgtccgtcttcgccccctccgagttatgtttcctctcccacggcaccgcgcaacaatgccaacgacggacagcagcaaaacactgcaaaaggctgctttttaccctcgtgtaaaaatgccaaaagagcgacaaaagagaatgacgcgggcggcactgaaccatcccagccgacttcggccgctgtggtcgttccaatggccaaagacaaagtgaccattctatgccttggccataacagccaatgtgagtgccgcg

SEQ ID NO: 72523 - DNA, 231 bp, Heterodera glycines
  Genomic contig location: Contig_ID=SeqID_45171; Location=32..262; Strand=+
  SCN-specific regions: Sequence locations=1-24,87-108,131-146,169-231
atgtggagggaatggaatatcggtggagagggagagggaaaaagagggggagagagtgaaggtgaggtaagaaagagggaaagggaaaacgagtaaagggtagaaagagaagtgagaggaaaagaaagaggggaaatggagggtgaggccttgaaggagccatttctgttgtaaataatgacgaatttcagttctagcctctatgcagtctgaaggatcccgatggctaaa

SEQ ID NO: 72524 - DNA, 58 bp, Heterodera glycines
  Genomic contig location: Contig_ID=SeqID_9733; Location=425..482; Strand=-
  SCN-specific regions: Sequence locations=1-58
aatagtaaaaacttctcgccgttcggtgctgttcgctgcttatttgccttagattaat

SEQ ID NO: 72525 - DNA, 1156 bp, Heterodera glycines
  Genomic contig location: Contig_ID=SeqID_9734; Location=2504..3659; Strand=+
  SCN-specific regions: Sequence locations=1-783,825-992,1024-1156
atgattagccaccgatttgacttttacgtggacgaacacttcaaaactcgcaaatggacgctgaaaatcatggaaattgggcaggaaattggagagaatggcaccaaggaaatggaaattgtcaatttggatggaaatctattgccaattccgcaaatccaagtgccacgcaaagtcatcggattcgaagccatttcaataaggtgatgagaatgattttttggtgttttcttttttttaaacgattcatttatttttttacagatacatcgaccacaatgtcatcgcttttgtccaccattttcgccaacttttcgccgcctctccaattaatttgtccatcgaaattacgaatgaccgtcgcatttcggagtcgattttgcacaacatttggccactgctcgaaaaaaacattcaaagcataagattgtccgacgaaaatttccgccgtttgcgcaaattggtcccctcatttctcagcgattgtccatctcttcgctttgtcttttcccattttgtggatatcttcatcgaatttccggccgatgacaatgccatggcatcggatggacaagcattggccaaatggcttttcattgcccgtccggacgatgtgccaaaagtgttcaattgttctcttgccaaaacattgaattgggcgtcaaaaattgaagcattgaaagcggtaataaccaaattaattaatttaattgtattccaaatttcccacttttcaggcttttgcctcggcttcatctcctgtcaatttcatcgctgttatttcgttttttcatttgtctgctcaacactctgttgtgccatttgtgctgaccaacgaattgactcgggaacaatttgcgttgaaaagaattgacaattgctatcgttttttgttagtgcgttgtccaattgcgcgagacgaaagcaaatggacaaaatgggagacggaagcgatcgggaaacggtaaagaattgttggcaatcctgaagaattggggtttctatttaaaaatgttttaatttgctctcaaaatcaggttccggggattttcgagggcgatggtcatgaattaggacttcgtaatcgagcaagtccgagttagtttcgtgataaagcaacccccgaaaacccatggaaaatgattttgagaccaaa

SEQ ID NO: 72526 - DNA, 361 bp, Heterodera glycines
  Genomic contig location: Contig_ID=SeqID_45175; Location=232..592; Strand=-
  SCN-specific regions: Sequence locations=1-169,193-250,272-361
ctgccgtcgatgcgtgtcaacagcctctgaatgttggcgttggcccttccaatttggtccgatggtttttcttcgcaccgtcggcacagtgccaaagtttcacgtacaaagggcttcagggcaacgaaaacaattttctatctcggtttgattgcgaacagatttgccaaggtaatcaaatgactgttaatcggctcaattgtttatcgcctagcaaatccatgtgctgtgggcacgcctttgcgagaccaacaaggacagattggcttctgctcagccactcagcagaacatttgccccattggcttttattgccatgtcggaggcgacgtcaagacgagtttatgctgtccaatgatgg

SEQ ID NO: 72527 - DNA, 55 bp, Heterodera glycines
  Genomic contig location: Contig_ID=SeqID_45176; Location=35..89; Strand=-
  SCN-specific regions: Sequence locations=1-55
ggaagctattcccgaaggattcggtctccccataaatctgggcgcatcggttcgg

SEQ ID NO: 72528 - DNA, 594 bp, Heterodera glycines
  Genomic contig location: Contig_ID=SeqID_45177; Location=73..666; Strand=-
  SCN-specific regions: Sequence locations=1-26,48-347,369-594
  Gene Ontology: Mol. function=oxysterol binding; Cellular component =cytoplasm; Biological process=signal transduction
atgcgcaattgcattggcaaagaattgactcgaattccaattccggtatttttgtggctttgtctctttgaaagatcgttgctttacaggtcaatttcaacgaaccactctcaatgcttcagcgtattacggaagacttggaatattcctatttgcttgatcgggctgctgaaaaacaggacatttgcgaacggctcgcctatgtcgccgcatttgctgtcagctgttattcagccaccgctgtacgtaccacgaaaccgttcaacccgttgctgggcgaaactttcgagttcgatcggagggctgatctcgggtggcggtcgctggtcgagcaagtctcacaccacccgcccgccgctgcccatcacgttgaaggagtgaattggcatttgaaccaggtggacacacttttttggttctatgccttctctctccatattatttattatcaacccgaaggaatttatggtcagttcacgctttcgtggcaaatatatgagcgtgattcccactggccatacccacgtgtcctttcgggacggaaaggcgcactttacgtttcaaaaggtggtcacgactgtgcacaacatcatt

SEQ ID NO: 72529 - DNA, 878 bp, Heterodera glycines
  Genomic contig location: Contig_ID=SeqID_45181; Location=124..1001; Strand=-
  SCN-specific regions: Sequence locations=1-878
atgcgcaaacacatttcgccgaccttcctcttcgactgcccaaaccttgtcgaaatcgtcagcccagttttgcctgaacgtccgaccgttgacaattctgctgctcctgaaacatcgagccgtgacttgtacatgtggctgcacacgacgcgcgtcgaccgtcttccgttggtgtacaaattgctcaaatggaacaaccgatgggaccaattcgtcaacgaattgatgatggtgggtgtgtgggatgatcgatcgattgatcgacggacggacggatttcgtttttttctctgtgcccttttaatcattgttctgatgatcacattcatttccgcttttcagtccttcaatacggcgtcagtcccggtcaactacatggtgttcacttcgttcgaattcatctacaccagaagggaacaaatggtgaacatgctgacggaggagaggctgacgatgttgaccaatgtgcacccgaaacgaggtggtggcgtggtgtccttcgtgaagattgtgcgctgtccagcggagttcagtgaagctgacgtggtgtcctggttgcgtatgacgcgcttgaacaacgaacctcatccgaatttggtgaccattggcttcgcagatgacgaaattgggtatggacgagttgtcaaccaatttttatattcgggggtactcttacaatttctgtccctttgttttcagaccgttgccttcaaattgtgctgcgtccatgtcgagaaacagaccgggctgagaacagaagcaatgcgcaaacagtggatcaacagcagatgagccctaaacacaatcaatggccactcggatggaattatctgatcattatcttttcacaaaatgtaaacttcccatcaaatgactga

SEQ ID NO: 72530 - DNA, 1738 bp, Heterodera glycines
  Genomic contig location: Contig_ID=SeqID_9736; Location=1040..2777; Strand=-
  SCN-specific regions: Sequence locations=1-1083,1106-1738
atgggatcagtcatatcatatgaatttgtttgccgccactacctgcatggacacattgacaaacgtcgcgctacaaaagttactggaataggcggcagttctaagacgcaaggacggtgtgtttttgattaatttcatcgcctaaaacatgaatttaaattcagattgacaattgttgtacgtattggcgatgcgaaggtgcgtgttacatttgatgtgatcaaaggattaccgttggatatgctgtgagtgttttgttgtcctactgtctttacatcaacccttttttcagtatcggtcaaaatgtgatggatgctctctgtgccaatcattgccgccaaaccgatcaattgacgtatttatacaaaggacaacgtctcgctgtgccgttgttggaaaattctgatacgactaaaacgaaagagaaaacgtggatggaccatcttcaatgcttaatgaacatcacctcctattccctcaatgattggatggcactcgagcagaggtgggacggtcggggtaaaacgacatgtgctaatttgggttaaatccatttttgtcaatttttggacggaatttattaattattagtcagattttcccattttttaaattttttactgcttcaaggaaaattgcaaacggaggagagaatatgccgttgtccgacttggaatgtggcggtagcacggaactcaatggcatggcgatcggcaccagcgacaaaatgccaaatggaggcgacaaaaagagtcaatgaaagaatcgagaaatgaaagattaatggcttcgcaacgaatggctgccttcacatggtcttggaaaataccgcaccgagttcatggagtgcctggtgaggtcgctttgtgtgggatttagaagcccaattctaccccgactatgtaaaaattaaggaacccaaatcctcccggggcgacaacttgttttgatcgaattttttcttttttacgattaatttttccgtttcaaggttgattcgcgaatgttggagcatttgagcaaaggagatctcggcgaaatgaaaatgatcgacagttttcaccggtgggaaaagaatttgaatgaaaaagtcaaaaaatattatcctcggcttttcattattttgattggcttattttgatggttctttcaaggacaagcttacactacggcattgtgtgcctgaagaaattgaattatgattggaagaaattggaagaacggcgaaacgcatcggaaaacgacaacagaggtgaaaaagagggaatttgtcgaaacgcgattaaataattgacgatctccaattatgtagatctaatggtctggtcaaatgagcgggtgatcaaatggctgaaaaagataggtcttggagactttgttacgaatgccgtcgactcgggcgttcatggcgcattaatggtagaaaaaaggaagattatccaaatctcaatattttaaggccttcgacacaacctttgatgtgcccgcattggcaaacattttacaaattccggacagtgacagcgcacgacggacattggaggcggagttccagaagctggtggccaattaccggggcagaggcgaggcgggagatgaaaacggcaaaggaggaagcggagagaagcagccgcaacagaagaagacgtgatctcacaaatgatctccatgctgtaattaaacttacctaattgatgactcaaatattaattgattttgttcattttcagataataaa

SEQ ID NO: 72531 - DNA, 185 bp, Heterodera glycines
  Genomic contig location: Contig_ID=SeqID_9736; Location=3284..3468; Strand=-
  SCN-specific regions: Sequence locations=1-85,127-185
ggagttgacccatagcgctggcattgcgctgtgtcaatgtgtatataagcaagcgctgtaagcaaaagaaatcatttggcttcactttcttttttcctcttttttttctttttttaactcttctttgtctaaactcgcgttttataacgtcctgttttagcgtattcagaagtgccgcaaagaag

SEQ ID NO: 72532 - DNA, 49 bp, Heterodera glycines
  Genomic contig location: Contig_ID=SeqID_45189; Location=576..624; Strand=-
  SCN-specific regions: Sequence locations=1-49
ggaagctattcccgaaggagacggtctccccataaatctgggcgcatcg

SEQ ID NO: 72533 - DNA, 378 bp, Heterodera glycines
  Genomic contig location: Contig_ID=SeqID_45190; Location=495..872; Strand=+
  SCN-specific regions: Sequence locations=1-378
atgactcagataaaattgctgaacgaggaggaaataaatatttctgaaataaaagtggagaaaaaagttgaaaattcgctgagcaaaatgcaaaaaacaaatgcattttttgaccaatcgtcggaaattgccaaccttaggacggaatttgagcaaaaaatggagaaattatgtgaaagaaccaaagaaaatgccaaggaagaaaaggcgaaaatggaaaaaacaaaagcaaatgcagcggatgaagggcatagactcggaacggaacttcactttctgtccaaatttggcactttcatttcgtcgccatttttccgttgatttccttaaattgagtattttttttacactgatcattagcgctataaattatatgca

SEQ ID NO: 72534 - DNA, 547 bp, Heterodera glycines
  Genomic contig location: Contig_ID=SeqID_9738; Location=2756..3302; Strand=-
  SCN-specific regions: Sequence locations=1-39,61-119,141-215,237 -319,360-509,532-547
atggatttgaatcatggtaagtaaggccttatgacatgttcacagtttaaaattattattatcctggtaatggcttcgtctttctctctcagtctcagatcacttaaaacatcatcatgaaccatgcatgttttattgtttcggtctgatcacatcatatcagctgctctgatcaaagatcttgaccaaaattctgttaataatagtaatgaattaaaataaatatgtacttttttaggcctaccgtacttatttttgtcttattatattgtgaaaacaaaactgcaatgaaggggtagatttctacagttttttccccaaattttttcaatttaacaattttttataattattaattagactaatagtttttttgtttgttaagaattttcgaatgaaatccttttcgcattcgatcaacaacttaaaaatacttctttgactaagtctttttttgtgggctagttttgttgcccatcattcaaacagtaagaacactgctgatgtgcacatatatttttatatatttttgcaattgttgaataaa

SEQ ID NO: 72535 - DNA, 78 bp, Heterodera glycines
  Genomic contig location: Contig_ID=SeqID_45192; Location=749..826; Strand=+
  SCN-specific regions: Sequence locations=1-78
cgcatccaattccttctacaatcgcctttatacatcccattatgaacgctaaaagtatcagagtgccgaaaatcgcat

SEQ ID NO: 72536 - DNA, 438 bp, Heterodera glycines
  Genomic contig location: Contig_ID=SeqID_45192; Location=81..518; Strand=+
  SCN-specific regions: Sequence locations=1-438
aaaatggtctaagtaaaaatcgtaattacgctcaaaaagcttctcaaacaattttagcgcatccaattccttctacaatcgcctttatacatcccattatgaacgctaaaattatcagagtgccgaaaatcgcatgtgatctaagcctagcaaaaaatggtgtaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaatggtgtaagtaaaaatcgtaattacgctcaaaaagctcctcaaacaattttagcgcttccaattccttctacaatcgcctttatacatcccattatgaacgctaaaattatcagagtgccgaaaatcgc

SEQ ID NO: 72537 - DNA, 575 bp, Heterodera glycines
  misc_feature (487)..(487): n is a, c, g, or t
  Genomic contig location: Contig_ID=SeqID_45194; Location=510..1084; Strand=+
  SCN-specific regions: Sequence locations=1-118,147-159,182-341,372-575
atgttcgaaggcttaacatctaaagcgagtgcaattaatgggatgatcactgatcagttaaacatgcttattccctgggtgaagcaactaagcccaattctgtgagcttgcacatatttttggcatttattctaaatctcttttttgaacagccaactctattaaaatttatatttaaaaaggcaaaaatattatgtaaattacgattaattcgattttctctgaaaattcataaattttaacttttttattttttctctaaaatgatttttaattccaatttagaactatgtacgtgattcttcacttaagtttaacataagaaattttgagaaattgcaccctatatttgaaaaaatatgtgtatattttcaacccaataactttttttaagacgagtcgtagaccatcgtccaaaggtaattcggcaaagaatttattgaattttttgtccatcttttttttctcaaaagcactcaaattccanataaaactttttttttctcagcctaattattcagggctgccaaaaatatggcacgaaaagtggccaaaatatgcgcataaatatgcaa

SEQ ID NO: 72538 - DNA, 844 bp, Heterodera glycines
  misc_feature (756)..(756): n is a, c, g, or t
  misc_feature (778)..(778): n is a, c, g, or t
  misc_feature (800)..(800): n is a, c, g, or t
  Genomic contig location: Contig_ID=SeqID_45195; Location=256..1099; Strand=+
  SCN-specific regions: Sequence locations=1-348,378-844
acgagtttggttgaacatgtcattgataccggagatgcgacgccaataaggagcagaatgcggccagttccgtatgcttatcgagaaaaagtttctgaaatgttgagggactatttgggtcgaggactcattcggccatctaattcaccgtgggcaagtccaattgtgcttgtgccaaaacgagatggaactttacgattttgtatcgattacagagcaattaactcagtaactaaaaaggacgcctttccacttccaaacatcgattacattttaatggcgttaggcggaaaacgctatttttcaactcttgattttatgtccggttattggcaaatcagaatgcacgaaaattcagttcaaaaaactgggttcatcacagaatttggactccatgagttcactgttcttccatttggtctgtgtaatgcagttgccacttatcagcgttttatgacgaatctttttgacggaatgataaatgatttcgtttcatttacgtcgatgacattttggttgcatccgagacttgggaagaacatttggtacatttaaaggaagtatttgaacgcgtcggaagagcagagttgaagctaaaaatcggaaagtgtcattttgctgcagaagaattaccgtttttagggcacattttgaccagaaatggtataaaaatggatgccgataaaactcgcacaattatcggtcttccgatccctgcaaccaaaaaacaattgcagtcattccttggtttcatgncttatttcaaagaatttatttncggttttggttcgttggcagcnccacttatgattgataaaagaaaatacaccatttgtcatgggtg

SEQ ID NO: 72539 - DNA, 787 bp, Heterodera glycines
  Genomic contig location: Contig_ID=SeqID_45197; Location=113..899; Strand=+
  SCN-specific regions: Sequence locations=1-71,95-116,141-176,198 -474,497-505,553-787
atgagacaactcagagaaatcaggggatgctacacaaggataagcagatatttggaggaccagagaatgttcaagaagctgctgaaggaggcggacttttatgagcagagaggtaaatttattatttagaagcaattcaaagcgattaagggactaattgccataaaacaatgccaaaaatgtgtaattattaaagccctgaattttaggttttacctattttttacggataaatacttgatgagagaagcacgaaaatcatattttctccgaacaatttttgtattagattgactttttagcatccaaaaacacttaaaacggggatcagcacttttttagcattttcggtctttatcacctattttggcctttttccagaaatttcataccaaaaatgcaataaaaacgtaaaatgcacccctaagaatcggtcccaaaaatttcagaaaaatacgccccgaagaaccgaccaagaaattttcaattacaaccctaagtatcgaaaaaaaattttttttaaatatctccaaaatttattatttattttttcttgacaagttgcaattgttcggacgaaatttttgcaccttttttgcacctattttagtacctatttcagtatttttggcacataaaaatcccagctctagtcattatctaaattcgcaaaacttagaaatttttggccgtttttatttctcaacatttgtcttctgtgtgggtgcattagattaagatagcttttaacattttgattactctgatagggttttgctatataata

SEQ ID NO: 72540 - DNA, 886 bp, Heterodera glycines
  misc_feature (5)..(5): n is a, c, g, or t
  misc_feature (24)..(24): n is a, c, g, or t
  misc_feature (69)..(69): n is a, c, g, or t
  misc_feature (98)..(98): n is a, c, g, or t
  Genomic contig location: Contig_ID=SeqID_45199; Location=137..1022; Strand=-
  SCN-specific regions: Sequence locations=1-247,269-338,362-886
aacgnccgatggcatcgcgaaatntgatggcggtcaaacagaagcagcggcccatgaaaccaacgcaanaaagggaaccaagttcagaaccaaactcnaaagggtttgctggcgttgtggcaagtttcaccatgctccaagcgaatgtccaagcatcaaaactgtttgccgaaagtgcaacaaagctggacatttggaggcacaatgcgagaagcaccatgagtggctcaaccggaacaaaaacggcaaatttcaagggaaaagagcttgcactcttcggatcggaggtgtaatggtgaacattgtgaaccatccaacgaggctcattgaaattaccgtggaaatgaatggaagaaaagtgatttttgtgcttgattccggcgccgaggtcacagtgatcaacgaagagactcactgtctgattggaaaacctcaattgcgccgatgccaagaacaagcagcatatcacgacggctccaagtgcactcttctcggaagaggggaagcgaaattcaaatttggagatgccacaaaaaacggaacgtattatgtgtccaaaagtggatcattgaatttattggggattgaaatgctggatgctttcggacttttggacgacattcgacaaaaagtgaactcaacactgcatttgaatgcaatcggaagaggaaatggtgacgaagcaacgattatggaggaactcaaaaagaagtttcctgaaattgttgccgacggacttgggcattgcaaaaaggtgaaagcacatctgtcgcttaagcccaatgcaacaccaatttactgccgaccgcgtcccgtcccattcaacaccaaatctgttgttgaggcagaattggagcgacttcaatcgatgaatgtcatccgtccg

SEQ ID NO: 72541 - DNA, 944 bp, Heterodera glycines
  Genomic contig location: Contig_ID=SeqID_45200; Location=133..1076; Strand=+
  SCN-specific regions: Sequence locations=1-347,373-377,399-645,681 -783,805-944
atgccaacgcttgttgtttttaaaatttttcgaaattctgactttttcattaattatttattttttgcaaaattaattcataagtattttttcagaaagtgctctgaaacacacaaaactttatttacaggttagtttaggcactctgatgctttttctatcaaaaagggagatgaataaaatttttaattcctttttaaacaggccaaaaagtttaggcttatattttaaaaagtttcatcgaacctagcgcactaacatcgatataatctctccaaattttgcaggccttctccattgtaaaggactaacttaacctgaaaaaatgccaacgcttgttgtttttaaaatttttcgaaattctgactttttcattaattatttattattttgcaaaattaattcataagtattttttcagaacgtgctctgaaacacacaaaactttatttacaggttagtttaggcactctgatgctttttctatcaaaaagggagatgaataaaatttttaattcctttttaaacaggccaaaaagtttaggcttaacttttttttcagaaactgatcagaagcgcaccaaactttgcagggatactgaaaggaagagtaataacctattttaaatattatctagtcagttcatttaaataatttttatccaaaaaaatttttttttgggttttcggggcagtccccctgaaccgatgcgcccagatttatggggagaccgaatccttcgggaatagcttccctatagcctgtactttattctgcgttggattttgctcccataaatgtttgagtaccctaaacggacacttgaaaaaatcgatttttttgtttcatatatattttttcagaagtgctctaaagcgcaccaaattttatttacaacttaattttagcactctgatgctttttctatcagaaagggagatga

SEQ ID NO: 72542 - DNA, 482 bp, Heterodera glycines
  Genomic contig location: Contig_ID=SeqID_45200; Location=498..979; Strand=-
  SCN-specific regions: Sequence locations=1-43,65-167,203-449,471-482
aaacaaaaaaatcgattttttcaagtgtccgtttagggtactcaaacatttatgggagcaaaatccaacgcagaataaagtacaggctatagggaagctattcccgaaggattcggtctccccataaatctgggcgcatcggttcagggggactgccccgaaaacccaaaaaaaaatttttttggataaaaattatttaaatgaactgactagataatatttaaaataggttattactcttcctttcagtatccctgcaaagtttggtgcgcttctgatcagtttctgaaaaaaaagttaagcctaaactttttggcctgtttaaaaaggaattaaaaattttattcatctccctttttgatagaaaaagcatcagagtgcctaaactaacctgtaaataaagttttgtgtgtttcagagcacgttctgaaaaaatacttatgaattaattttgcaaaataataaataattaatgaaaaagt

SEQ ID NO: 72543 - DNA, 120 bp, Heterodera glycines
  Genomic contig location: Contig_ID=SeqID_45200; Location=1467..1586; Strand=+
  SCN-specific regions: Sequence locations=1-120
tgtggtaagtgtgaagaactgtgttcctccaggcaaaaaattctaagaaaatttataagcatttgaagggttctcagcagattccctgcaaaatttggtgagcttctgatcagtctagaa

SEQ ID NO: 72544 - DNA, 554 bp, Heterodera glycines
  misc_feature (521)..(521): n is a, c, g, or t
  misc_feature (540)..(540): n is a, c, g, or t
  Genomic contig location: Contig_ID=SeqID_45201; Location=172..725; Strand=+
  SCN-specific regions: Sequence locations=1-554
  Gene Ontology: Biological process=growth
atgacagaaagagcgtaagacagatgactgactgaccgtgtatcatccgacagacaacaataaattaattctttagaattcttggacgtctgacaagcaaagacccggacgcagtggctgggcaaagtccattacctccgcccggaccctttgtaactccaatggcacaaagtcgcttctcgggcatacagccgaaattcgccgcacttttgaagccgaaacaccaatcaaagaaagaaaatctgccagagaaagacggaaacgacaaacaaaatcaggaggaaacgcgaccgagcaaagaggaaaaacggactgacgctgatgttgagaagacaagtgataggagtacaaaggaagcggaaggaagttgcaaggaggaggcagaaccagtgcaagacgacaccgtgaaagaaggttgactttcgtacattccataaatgcgtatacgtattttcactttcccgttagttatgactagggactccattttaggcacgaaaagtcgcaaaatagacgcctanaaaggtaaaaaaaatctanggctcaataggcaa

SEQ ID NO: 72545 - DNA, 1722 bp, Heterodera glycines
  Genomic contig location: Contig_ID=SeqID_9740; Location=2320..4041; Strand=+
  SCN-specific regions: Sequence locations=1-95,297-334,356-768,791 -1092,1152-1241,1276-1423,1451-1506,1550-1671,1693-1722
  Gene Ontology: Mol. function=general RNA polymerase II transcription factor activity; Cellular component=transcription factor TFIID complex; Biological process=regulation of protein activity, epigenetic
atggctgctcagcggatgaaggtgtgctatcgcctcggctcctccgcggttgccgggtcttccactggtgccaatggttccgccgcgtacggtcgcgcttctgccgtcggtagcgccgctgttgcctccggaccgtcggccgatgcggtcgcaggcggagccgcgccaccgccgctgatggctgcgccattgatcgcggcggcggcggcgaatgccgcggcagtggccgccgctgcgcagccgtccgcacagcaacgcgccgttgccgccgccgcgccccaacagccgcagcaaccgcagacggccgctgttcaactcgcactgtctgcggccgacttctcccacctcttccagcactaccaaagtgcaatcggacaactgcagccgtcgatgggcagtgctgcggccgccgtcgccgctaaccaagcggcggcagctcaaatcgccgcagctgctgccgcggcaccgtacgtttgccaaccgttggcggccaccgcagcgacagtgctcccatacggtatgagagtcaacaaaatgaattgcttttgtattctgcttttgtcaaataattgcttccacattcgacaggttccgcccggcatcaaccaccgccccaattttccgcagtgactgccccccaggcgcagtcgctgtcccaattcgtgccgaccgcgatgcatcccttcgtcgacccgttgatcgcggcggcgaccggagctgccaacgccgctgttgcggcggcggcccatcagcacagccacgcggggacgatggtgacgggatcatctgctggaggaaatgcatcaacagcgtctcacgtggggccgcaacagaatggcgcggtgccccaggggtggccgacccaacagcagcagcagggctcggcaaatgccacggcacaaaaccaggcggcgacgttggcacaaaacgcaaacacaactgcggcactgttcccgtgggccatcgcggcagcggcacaacaagtaagctaattgggtttgatttcttgactggtctctctgatttttcaggccgccctgctccccggcgctggcaacaaccccgcgggcgccgctgccgaccttttccttccggcgaatgccgcagccgcggcggcggtgcagcggcaaatggctgctgcggcggcggcgcttcagttcccccatttgttttctgcgcccgtccaagcggcggcacaacaaacggccaaaaactactcacaacagctgcaactgttggcacagatgcaacaacagcagcaacaggtggaggagggcattttgttggagatgagggaacattggaatggacataattcttttttaaataaatgctccgtttctgttacactcaattagcggagttgcacattgaatttgggtgggaagggggggtggagggattggaaatgtttttacattcttggcatttttgtaatttttggcattttgtcccccaggaggaatgggctgcccaagtgctgaacggtgtccggccgatgaatgcgcagcagcagcaaatgctgcaacaacagcagcagcagcaacaggcgatgatcgcccgactcaaaaatgacgcggccattctcatgcaaaattcgttggccgaacattaccttttggagaggttgggcaaaaaataaaatgcgaaaaatattgaaatttggtcgagttttttaatcattttttgtgaattgcttaaacacttaacatttgcctgtaa

SEQ ID NO: 72546 - DNA, 921 bp, Heterodera glycines
  Genomic contig location: Contig_ID=SeqID_9740; Location=594..1514; Strand=-
  SCN-specific regions: Sequence locations=1-446,500-508,530-825,847-921
  Gene Ontology: Mol. function=Pol II transcription elongation factor activity; Cellular component=chromatin; Biological process=anti -apoptosis
atgcaacgcttcttggacattgtgtacgacattatgagtcttcgaggtaaatccccaattatattttatgaaactttttgatagaattgaaaatcacgcttttgtttgtatatttcgggactcattgtcagcataattggattttgcctttccaggctccaattttctttacattacaataagcatttaagttttccttttgcacaggatacatctgtgagcaattggatggaaccgttagtcaaccggatcgtcagaaagccattcaaaactttcaacggcctgattcggacgtgttcgcttttcttctgacaaccaaagcgggtggtcttggtctgaatttaaccgccgcagacactgctatttttctcgattcggacttcaatccgcagaacgacaaacaagcggctgcacggtgccaccgcatcgggcaggacaagtgggtcttatatttattatttttatacaaaaaaaaaacatgaatttttcaataaaaaatgtttgacttttttctcaaaactctttggaacaaagaacaaaatctttagattccctcataaagaacaaaaagtcttcggattccttctccatttttcgatttagacctgttaaaagcattcgtctcgtggcaaaacatacggtggaggagctgataaagcagagatcagtaaagaagctgaagctatccgagaatgtcttgggaaccgacgaaaaggaaggttttcgagtattttgttcctaggtttttttgaaatcttctcaggcccttcactaatgtttgacctgtccaaacttttgctagaggggctcaccgacctggagaaagagcagaagaagcacacacagtttcacattctgaccgacaaacagcttgaagagcgattgggacaaaccgatcaaaacggacattggcaaataaaa

SEQ ID NO: 72547 - DNA, 394 bp, Heterodera glycines
  misc_feature (377)..(377): n is a, c, g, or t
  Genomic contig location: Contig_ID=SeqID_45203; Location=468..861; Strand=+
  SCN-specific regions: Sequence locations=1-18,40-125,180-303,337-394
atgttccgcattctgtcaaattttgttttttattgttcttacgaatatgattggatcaaaagctcagcatattggcgatgttggtaaacatgggaaaatttgcaaaggtaagctgaattgatcacttttaaataatgaaaattattaatatttaaaggtaattttgtttttaaaattttcggcattcgaaaaaatttggcacatggattccaattcagtccttaaaatgaaagcgtccacatccccctttacagtatgtaacgacagataatttaactgtatttacatgattatccgcttttcaaaaaaaaaaatttttgatttaaaaaaaaaattcggcattaaaattatgttcaccaaaatgggctacatcctgngtttacaaatttactca

SEQ ID NO: 72548 - DNA, 954 bp, Heterodera glycines
  Genomic contig location: Contig_ID=SeqID_45204; Location=40..993; Strand=-
  SCN-specific regions: Sequence locations=1-214,236-656,725-807,830-954
  Gene Ontology: Mol. function=heat shock protein activity; Cellular component=endoplasmic reticulum; Biological process=response to stress
atgcggacttcatcgacaaatttgcatccattggtgtacgaatcttatgaggtgctcaaaaaacatgcaaacgttgacaatcgattgacttattcacttcgacggctcgacaattttacgcggctcaactttttgatggaagtcgaacggaaaggaaaaacgaaaatacaggaagggaaagaagaggatgcatatatcctgtacagccgagccatgaccatttatcttatgataagtgagtcaattgacgacgaattcagacaaggccgcggaggtcaacttttctatgaaacttcacagcgtttgggtgtggattttgacaaagttgctgtgagtttacaacagcggttcatggatgggaaaggcgagttgcctaaattttgtgatccgttgggactgcgttgggccgaaattgttgaagaaccgatttccgaaaatttggaatgtggtaaggactccaattcgttggatgcccagaacaaaattcagtccattttgccgaaaaatgaaacagcacttcctacaaccgaagaattttccatcaaaattaaggggaataataaaaagcaaatttcacacatgacggacccggcaattgtgggcacgttggaaaagtcagaaaaagtagagaaattgatcgaagagagtggggaagcgaaaaaggagacaaaagagaaggaagaagcaggtgaaaagcaaaaggaagagaaaaacgatgaagaggcgaggccaaatttgaaattggtggaacagacattagaatggcagaaagtgaactcaatgaagcccatttggacacgaaggcatgcagaactggagaaaaatgagcacacgaaattctacaactccatcaccaaggactttgatatgccgttcggtcatttgcgcttttctgaaaatgcgatgccgaagtacattctgtatgtgccgaaaacgctggtcgctcacccatag

SEQ ID NO: 72549 - DNA, 262 bp, Heterodera glycines
  Genomic contig location: Contig_ID=SeqID_45207; Location=399..660; Strand=+
  SCN-specific regions: Sequence locations=1-137,180-262
atgggacgggatcacgcgctgtgcggacacacggcactacgtcaaacaggtggaaggggggggagggctcccacccgagccgcgaagcggcagagtgagtaccttcggtgcaggaaaattattaaggaagagagttcattatttatttatttttgcaaaattaattcataaatttttttcagaaactgctctgaaacgcaccaaatgttaattaaaagttaaataaggctctctgatgctttttctatcaaaagggagatga

SEQ ID NO: 72550 - DNA, 205 bp, Heterodera glycines
  Genomic contig location: Contig_ID=SeqID_45207; Location=860..1064; Strand=-
  SCN-specific regions: Sequence locations=1-44,71-177,199-205
tgaaaaaaaagttaagcctaaactttttggcctgtttacataggaattaaaaatttttaaaaattttattcatctccctttttgatagaaaaagcatcagagtgcctaaactaacctgtaaataaagttttgtgtgtttcagagcactttctgaaaaaatacttatgaattaattttgcaaaaaataaataattaatgaaaaagt

SEQ ID NO: 72551 - DNA, 658 bp, Heterodera glycines
  Genomic contig location: Contig_ID=SeqID_45209; Location=50..707; Strand=-
  SCN-specific regions: Sequence locations=1-268,290-658
gttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataaatgtttgagtaccccaaacggacacttgaaaaaatcgatttttttgttttcgggggggtccccccgaaccgatgcgcccagatttatggggagaccgaatccttccggagtagcttccctatagcctgtgctttaattctgcgttggatttttgctccccataaatgtgtgagtaccccccacggacacttgagaaaatcgatttttttgttttcgggggagtccccccgcaccgatgcgcccagatatatggggagagagaatccttcgggaatatcttttctatatactgtactttaattctgtgtgggatttttgctccccatatatgtgtgagtaccccccacggacacttgagaaaatctatttttttgt

SEQ ID NO: 72552 - DNA, 1827 bp, Heterodera glycines
  Genomic contig location: Contig_ID=SeqID_9742; Location=289..2115; Strand=-
  SCN-specific regions: Sequence locations=1-148,190-430,463-615,639 -696,719-1723,1745-1806
atgaaccagcagcaagtaattaaaacaaaacgaaataatgataaattggtgcatgatggtgcactttatgtgttccacaaattcagtaacgatggacttaagaaattttggcggtgtgagtttcatggcccggcagaccaatgcaagggtatgctaatatattattttgaattttgaaaatcttttaaaatccaggacgcttgcacacggatttaaataacgttgtgcagaagttggtcggagttcattcgtgcgacatgaacgctgcgcatgtggaatgtcagcgtcttgtaactggactcaagcgacgtgctgctgagacgtgcaagcacctgcgaccattcgtgctcaagtgcttcaaaacacatgcacacctgtgctagcctcttttccgagcaaagatgccacaaaaaaggtgggttactatcaaaaacaattttgtaaaaaattttgttttctttttattcaggtcatcaaacgtttgcgccgtgatgaaaatgcaccgcgagtcgaacctctcaatttggagcagttagagattccgaatacctatcgtgtttataagcgcactgagattgacgatgagcaattcctgttggcggacactggcgtttttcaaattcacggacagaatggaccccaacggtaagacatttatcgtttaaaccattaaatgatggtcatttacactattaaggattctcatttttggaagagcgtctacggcagattggactcaccagatgaaagacatttacgcggacggcacttttgcattgacaccgccgcttttcagccaaatttatgtgttgttggcaaagtaaagttaattgtgttatcacaatgttcaatctttttaggagagatggttgggtatttccaatttgctactgtcttttaacatcgaagtgtgccgcaatttatacgcgcatgttacagcttcttttggaacgatggccgaatttcgcgccgcagacaatttcgatggacttcgagttggcaatggttggtgcggtccgcacagtgcttccggcgtgcagtgtccgctactgtttttttcaccttgtccgcaacatgaagaggcagatcagaatccttggcctcactcgtgtaattttagaattttttattattccgttcccattcaaactcattaaggtttacaacactgatcctgccttcgctgagaagtctaagatgatcacatcattggccttcctgcctgtgcaccaccttcaaaatggccttaatgctcttcaagcacaaattccgccacaacttaatggcgttttcaattggttaagtccgaagacgagttttatgaatttttttttctaggtttctggacaactacacgggcagaatgcgcttcaatgttccaatgacggcgcctctgtttgacccacacgaatggagtgttcatcagcgcaccttggatggtgctgatcggacgaacaacttcgccgaggcattccatcggaaacttcagcggcaatttagctgcactcatccaacaatttggcgattcattgacacgatcagatgtgagcagaaggcgcttgatgctgatatggcacgttgcatgatgggagaagccgcaccccaaaagaaaaggaagtatcgcgatgccgattcacggattcttcgtctcgtccaacgttataacgatgtcaatattgtcccccaaaatgatcacaattatgccaatcccaatgtgaatcccgaaaacattaacaattttttcgccggtatttcccgaaactatgagatgcgaccctagtttgtcccattttgttattgttaaatttatgcattttttacattaaa

SEQ ID NO: 72553 - DNA, 330 bp, Heterodera glycines
  Genomic contig location: Contig_ID=SeqID_45214; Location=133..462; Strand=+
  SCN-specific regions: Sequence locations=1-85,136-330
atgtgctgctgtgttcgaatcgttgggcttaatttcggctgaaaaggaggaaatttatttgcaatttgaccaatttttgaaggagaaaatttatgtaaaaaaaaatatttaaaaaaatattttattttttattttcagccaatttccaaagcgatcgaagcttttctcggcactatgcgcgaatgtgcgcagatggcacgcgactcggcacgcgcgtgtgccatcttttcgcaatggagccgcgaatttggggaccaattgcaattgcagccgaattgggaggtgaaaagagaaaatttaaattaaaaaagaaatgcaaattatttgaaa

SEQ ID NO: 72554 - DNA, 79 bp, Heterodera glycines; identical to SEQ ID NO: 52291
  Genomic contig location: Contig_ID=SeqID_45215; Location=263..341; Strand=+
  SCN-specific regions: Sequence locations=1-79

SEQ ID NO: 72555 - DNA, 226 bp, Heterodera glycines
  Genomic contig location: Contig_ID=SeqID_45215; Location=725..950; Strand=+
  SCN-specific regions: Sequence locations=1-226
gcttaaaaacattgtacagcataattaaaacctaaaataattttcgtatatttttcacaatttatttcaaaagacaaaaaaaaatgattcaattttgaaacgaaatagtgcacaaaagggagggatggttagacgaaaagaggaatttttagaaaagagcgcaccccatctgatattcccatttttccgttccacaactggccaaaggcgactgtgctcattgaca

SEQ ID NO: 72556 - DNA, 81 bp, Heterodera glycines; identical to SEQ ID NO: 58971
  Genomic contig location: Contig_ID=SeqID_45219; Location=302..382; Strand=+
  SCN-specific regions: Sequence locations=1-13,47-81

SEQ ID NO: 72557 - DNA, 1099 bp, Heterodera glycines
  Genomic contig location: Contig_ID=SeqID_45219; Location=23..1121; Strand=-
  SCN-specific regions: Sequence locations=1-77,153-160,188-190,313 -364,394-394,478-483,516-774,808-821,868-878,900-935,961-964,1000 -1049,1071-1099
tttcgtgcggctgaacaccgaaaatccctctaagcagttgtgcccacagaagcaatgagccaactatttagtaggctagagtctcgctcgttatcggaataaaccagacaaatcgctccacgaactaagaacggccatgcaccaccatccaccgaatcatgaaaaagctatcaatctgtcaatccttacggtgtccgggccgggtgagtttccccgtgttgagtcaaattaagccgcaggctccactcctggtggtgcccttccgtcaattcctttaagtttcagctttgcaaccatacttcccccggaaccggaagactttcgtttccgggaagctccccaccagggcgaataaatccgccggcggatcgctagttggcatcgtttacggtcagaactagggcggtatctgatcgccttcgaacctctgactttcgttcttgattaatgaagacattcttgccaaatgctttcgctgtagtccgtcttgctacggtccaagaatttcacctctcacgtagcaatacgaatggccccgtttgtctctgttaaccattatctcggtcagcaaaaccaataaaatcggaccgaaatcctcttctattattccatgcacgaacattcaagcgaaacgcctgtttgaagcactctgatttgttcaaagtaaactcgccagcccaccgacgccgaccggtaaaggccaacgccggggaaagaccggcagaaaagccaaccaaaccagtaacacacaaagtgtgcaccggacggctagcacagatccaactacgagctttttaaccgcagcaataattctatgcattttgagagctggaattaccgcggctgctggcaccagacttgccctctcatagatactcgttaaagggtttaaattgtacccattccgatgaccggcctcataagagatcggtctcgttatttctcgtcactacctcctcgcgttgagagtgggtaatttgcgcgcctgctgccatccttagacgtagtggccatttctcaggccccttctccggagtcgaacccttatcctccgttacccgtcatcaccatggtagtcagatacactaccatcgaaagt

SEQ ID NO: 72558 - DNA, 382 bp, Heterodera glycines
  Genomic contig location: Contig_ID=SeqID_1325; Location=16..397; Strand=-
  SCN-specific regions: Sequence locations=1-382
atgttgtgcaaatgcggcgaatgcttcgaatgcgaagatgaaaagcgccgcctcaagcgcaatcgggagctcaatacccgcaaagagcaaattaagaactgcacaggcaatcatctagcaccggctatgatggaactcaaacgccggaatatggaactgtttaaaaaggcttataggccggtgaagggcgtcatcaataaaataaccgggggtgagtttaaaaaagaaattgaaaaaaaacaaaaaaaattttttaggcccttggaatgtagaatgtgaggtctgccatgagaccttcacatacttcatggtggagtgggaaaactcccggaccgacttctcgtggggtcccgggaggaacatggtcgaagcggataacata

SEQ ID NO: 72559 - DNA, 1463 bp, Heterodera glycines
  Genomic contig location: Contig_ID=SeqID_1325; Location=1232..2694; Strand=-
  SCN-specific regions: Sequence locations=1-166,193-466,488-817,882 -952,974-991,1013-1129,1151-1463
atggactcggcggcagattccattcgacagctacaacgtgcagtgcgcgaacagcagcagatgatctttttgctgagaagtcagatcgttgatcagagagcagtgttgcttcagaatatgatgcggattgaatcaacggaggggtacttggccaatgtaagttcaattttcaaacaagtatttaaaactaattaatttcgcttatttttataaataatcatttgattatttcagtctcgcgggaaccagagattcagcccgagatactctcccatggcgggagtggagctttcgctgctcggccgtcgacttgaggaacgagaacgccgacaacagtctcgtttgggtaggctgtaattttttttattgaaataacaaataattcaagtgcaagtggagaataataataatgctgcgggtccaagtgatggaaatgttcggcccataccaaatgaaaaccgtaaactaggaaatttttgtttaataaatttcgattttttttgaagagcagctgactccgctaagttcacgttcgggaaacaatggggctctgcaaaatcgtactaatggtgtgctaattttgaaaaaaaaactgaaattatttttgtttgttttttttttagagagcaatgtggctggaccaagtacggcgagtaatggtggtgacgatgaacgtgaaaacggtgagatgaacccttaataatttgaatcaaataaatgaatttttgacaggccccgttctaagcgctgtgattgaaggccacatgaaccgttcgcggatgcgtctaattcgggacgagatggttcatcgtgctgtgcagcagcaacttgagcaccagcaccatctgttgcttcagcaagcgcagcagcagcagcaacgggaagaacgcgaaagacaacagcactttgatcaacaaatggaagaagcagagcttcttcacgaacaactgcaggcagcagagcaggaaaacgacgagaacatcgaaccacagccccctcagcagcagccgcaacctcaaccgctgattcgtcatcagcagctgcagttcgaacgtaatgttcgactgcagctgcgcgagtcgcagcgatttgaaaggggagttgcctcgtcagtgctcgttccgccagcccagctctattgggagaccgaatgcatcatctgcaccagcaaccgcgcacacttctacagccgtaattgcggacacatctacctgtgctcgacatgtgcggtgaacgcggtgatccacaaggtcgcgacttgtatgctgtgccgtgtccgaattgatggaatttatccatttgtacgatgattgattgatgtatttgataactctcgaacaccctttatcattttgtccatcctatcattatcctattatcacaatttttaaacgatcattgattgccacttggcatttgcaattctcactcattatttaaactcatccaaccaatccaataaa

SEQ ID NO: 72560 - DNA, 502 bp, Heterodera glycines
  Genomic contig location: Contig_ID=SeqID_1325; Location=3775..4276; Strand=-
  SCN-specific regions: Sequence locations=1-5,28-235,260-260,302 -472,494-502
atgtccacatcctctaataaaaattatttaccaaaaaaccaatgcccaaattgtgatggtaattgcaattttttcaatactgtacaaattttttttttcaaattttagatgatgaagttgacactgacccttcacccgaagaagttgagaaatggacgccggaacaagtgattgagtgggaccagcgttgctacgggaaaatgccagctgaagaagagctttggcaagaattcctcgacaaaggagaggcaaatgtcagtaaataaaatttttgatccattttttaaattatttctttaggttctgcgtgagttctttggcggaaaaggggcgcttgaagttgagaagagccttcgagaatacgcgaagaaaaaggaacgccgagacgcaattttgattgagaaaagaaatgaatacaaaaaatgatggaaaaaaaggataaaaattgagtgttcgaatttcaccatccgctatatcaatggcttttattttattcaataaa

SEQ ID NO: 72561 - DNA, 798 bp, Heterodera glycines
  Genomic contig location: Contig_ID=SeqID_1325; Location=4517..5314; Strand=+
  SCN-specific regions: Sequence locations=1-798
atggtgcttcttacggaaaaaatcgccaaaattttaaactgccgtgtcagcgagctccgtgatcggcttaatcatccttccgattgtgaaacggtggtgaaagcgctgacaggacaccgtgttaaaacaacatacaaagacagaaatggatacaccaaaagctttgcttttgggggaattacagcacaaggagctgcaataactatggcttatggacgtctgggtcgtcctttcaatgttaatgtggccgcacatttctacgtccgtcaccgcattaaactccgacatcctttcctccactgtgctgttgagagctttccggaaggacaagaggatcgcttctatcctcttgaattatgcgaaatggaggatggaccaaacgaaccagattggcttggtcgtattttcacagaaattcgtaacgacaactacacagacagcatgagccctgcaaaccgagaagttttaacgccggaagacacgtcaatgtctcgtgaagggcgtgatgagtgcagtcaaaatatttcttacaccttatggtaattaattttttttcaaaattgtctcttctctttcttaattttgtacttttccagccaaaaagtactctttcctatccttaattttttcgaaaatgtgttttagatgatacttacactttctggtattgattaatattttcaaaattgtctcttctcttccttaattttgcacttttccagccaaaaagtacactttccaactcttaattttttcgcaattgtctctttgttttaattcaatttaatgttttttgta

SEQ ID NO: 72562 - DNA, 1237 bp, Heterodera glycines
  Genomic contig location: Contig_ID=SeqID_1325; Location=5371..6607; Strand=-
  SCN-specific regions: Sequence locations=1-50,86-1237
atgaccgacaaagaggctggattagtacatgcacctcgttggaagtaaagttttattttttaatattttattcaaattatttttagttaaatgcggcactagaggagggatatcgagtgacagagctgcttcgcgttctcgaataccacaaaagtgacaacaaactcttcaggccatacatgagcgagttcgttgttgaaaaactccatgcttctgggtttgatgagcaaatcaaaggcaattttgaggccgaagagcaatttattgcggaatgctgggaccaatttggaataaaaattgatcgaacaaaaatggtcccgaacaagggaaagagatcattggcaaaattggctgtgaataatttatgtatgttttttcgttatcctatgaaaatattataaacaaaaaatttagggggccgattttcacttcgaaattatggtctttcgcagacgctcatcacagatgacccatctgagcttggaaattacctggacaacaaaaagattgaaatcagcggccttgacatgctgacgccggaaagaattctgaccagttatcaattgaaaaaagattggatcaaagagcatccttgttcaaatgttgtgatttcactgttcacaacatcagcagcccgactacatttactgaaatcaatgcagaaagtggtcagaagtcccggctgcactcttttatacacgggtaaacatacaataattttctttattattctaaattttagacaccgattcattgtttcttgtacacccggaagactcaaacccacttcagacgggggtgcacttgggacaactcactgacgagttcccaaaggtaaaagaccaatataaatcgcgctgcatttttttaaatttagcacgatattttggaattcgtaagcggcggcgcaaagcagtacgggttgaagctacgaaagaaaggaacagcagacgaatttgaatacgtgctcaaacttcgagggattaggctcaattatgacgtgacagaaaatcaagggcttcgttataacacattcaaacagagtgtcctggaatttgcccgctccggaaagacagacccaattaaagtgttgtacccaaattttctccgcccggcagtaatccaaggcaatgtcacctccgctcccctccaaaaaatttataaaccttatgttggtaagggaattgtttgttcaaatgattttcgtgttctcgattttggtcacatttcaccataa

SEQ ID NO: 72563 - DNA, 832 bp, Heterodera glycines
  Genomic contig location: Contig_ID=SeqID_1326; Location=243..1074; Strand=-
  SCN-specific regions: Sequence locations=1-48,84-832
atgaccgacagaggctggattagtacatgcacctcgttggaagtaaagttttattttttaatattttattcaaattatttttagttaaatgcggcactagaggagggatatcgagtgacagagctgcttcgcgttctcgaataccacaaaagtgacaacaaactcttcaggccatacatgagcgagttcgttgttgaaaaactccatgcttctgggtttgatgagcaaatcaaaggcaattttgaggccgaagagcaatttattgcggaatgctgggaccaatttggaattaaaattgatcgaacaaaaatggtcccgaacaagggaaagagatcattggcaaaattggctgtgaataatttatgtatgttttttcgttgtcctatgaaaatattataaacaaaaaatttagggggccgattttcacttcgaaattatggtctttcgcagacgctcatcacagatgacccatctgagcttggaaattacctggacaacaaaaagattgaaatcagcggccttgacatgctgacgccggaaagaattctgatcagttatcaattgaaaaaagactggatcaaagagcatccttgttcaaatgttgtgatttcactgttcacaacatcagcagcccgactacatttactgaaatcaatgcagaaagtggtcagaagtcccggctgcactcttttatacacgggtaaacatacaataattttctttattattctaaattttagacaccgattcattgtttcttgtacacccggaagacacaaacccccttcagacgggggtgcacttgggacaactcattgacgagttcccaaag

SEQ ID NO: 72564 - DNA, 3095 bp, Heterodera glycines
  Genomic contig location: Contig_ID=SeqID_1326; Location=1350..4444; Strand=-
  SCN-specific regions: Sequence locations=1-350,372-460,482-572,616 -1092,1129-1331,1361-1453,1475-1625,1650-1909,1931-2240,2276 -2522,2544-2644,2666-3095
atgtcaaaatctcctccttcgaaacgagctcgccgttttttcatcgaagaattgcttcgggaaccctacaacgagctttccccaccacaaaagtcggcaaaggattacgtcagaaagctcgactcagagatcgaacacgttccgaaattccaatgggtgaaaaataagtctcgcttcgtcattgaagatgtaccggctgaccccgagggacttttaattggaatttttcaacactgtatggacgaagcaattggtgacagccgcttgaaaggagttcaaccaacacatctcggctgtatcatttccagccagttactgacatccgatatttggattccaattcgtcaaatgacacccgacaccataaacaccatacttaatcgctttaacgacgtggcgcagagcaaaaaacaggatggggtgacgctttggggagatgcatttaccgttattgtgacaacggttaaccgaaatggactaccagagaaaatgaagctaaaagggggagccgcgcggaagttggctccggtccaccaccgaattcatgaacaatgtcttataaaggttttcactttttttcttaatttaaaaaatcattttttagattaaaaatttcaatggagacaattactgcttattctacgcaatgcaagcgacgatggttcgggcagttggtgccatgacgcggcaacaattttacggatatctcaatggaattgatggaatgcgagggaagctgagaaccgaaacaacagaattgatggaagccgttcaagcacctcttggacagcccaattacgacgcagaaatttatgtgccccggattgttgattggtggaacaacgaaaagtttgcaggccagtggaagtttaaagctttcatctttggagcaatggggcattacaagccgcttttcaaatacgggccagaggaatacatcgttccaataattctctactttgacgatggacacttcaatggggtgcagaaaagcggaaatctttttggcaagccctattgtctgagctgtgaaaagacttacgaccgaccgaaacgccacattgctagttgcaaatcgcgctgcattaaatggttaatttcttgtaattttttattaccttttattttagctcacaaatgggaccacaattcccatgcaaaccaattgctggagttcggcaaaagtgcaaggattgcaataaaatgttcttcaataatgcttgctaccagtatcatctttcttccaacttttgtcaaatgagcaaagagtgcaaatactgtggcgtcgtatgggacatgcgtaaaaattgcgataatgggagagaggtttcttttaaaaatttaataatagtttaatattggaatagggtcacaaatgcaatgaacgctggtgtgaaaattgtcaaatcttccacgaatttgagcggggatgttttattcgcccattggagccgaacaagaagaaagaaacaaacgggtggcgccttgtcacattcgacgttgaaacaatgcagcatgagcctgcggacccgcatttccctgaacgaaagaagcatcaagtgaattttgttactgcaaaagtggcatgcccgaattgcatttcgaccggaaaatggaaagagagccttcttggaaaattctgcaaaatttgcggctatcatcggacaataacattcagtcaaatgccgttccgtgagacaacggtcgacagacaaacaattgaccgccaccctcttgttgccttcgttaaatggcttctctacaagcttccaaagcaatacgaaacaattgcctattcccatttcggcggacgtttcgacatggtcttggtctttcgggaacttttcatggagggactgaacccctcaatgatcagaaagggaaaccgtctgttcgagatgagggtataattttccatgtatttatttaatcattttcccatctcaggtgaaaagcagaaagaacttaaacccgaatgtgacatttcgtgattcttggaatttgattcctggcccgctcgcctcaatggtgcccatgttcggcttggacgtgcaggacaagcccttctttccacacatggccaacaaacctgacaattatggatgccaaatttttccgtcgaaagcagattacctggccgacggaatgaacccagagaaacggaaacaatttgatcaatggtaccagcaaaacaaaaatattccgtttctgctggatgagtcattggcaaggtgaatatgaataaatcaattttgataaaataataaaaaaataagctattgcaaaaacgatgtcgacattttaatggctggactcatcgcctttcgaggagaatttttggagatgacaaaacgaccggcaggcatcgatggaaaagccgacagagcagcgtacaaaacaccgcacaacggcattgaccctgtccgacattgcgtcacaattgcgtcagcctgcatgcgccattttcggactaatcacctaaaacccggacatttggcacttgtgccggagaagggttacgacagctgtggagacaatcagagtgaactggctctcaattttatgcagtggtatgccgaaaagcacggcgttcggattcaaaatgcattttcggctgacggagaaaaaaggtaactttgagtacaaattaaatctataaaatatttcaaagggtgggaaatttccgcttggacggctggatcgagtctcaacaaaagggactcgagattcacggatgtgtatggcacgcatgtgcaaagtgctacccggatgacaacgaagttttaccatgtggaaaatctgcgggccgcatccgagagctcaaccaaaagcggatggattttatactcggaaaaattcccaatgttgaagtgttttggcaatgcgaaatcgaggcaatgctggcccgtgacagacaaatgcggcagaaattcagcgaattcaatggagatggaggaccaatcgatattcgcagttgcttcatgggcgggagaactggtcctttaagctttatcacaaagcggcaaagggcgagaaaattagctactatgactttaccagcctctatccttttatcaagtgaatatttgtcgtaa

SEQ ID NO: 72565 - DNA, 1242 bp, Heterodera glycines
  misc_feature (1234)..(1234): n is a, c, g, or t
  Genomic contig location: Contig_ID=SeqID_45224; Location=172..1413; Strand=+
  SCN-specific regions: Sequence locations=1-41,63-225,247-298,321 -347,369-645,682-1242
  Gene Ontology: Mol. function=t-SNARE activity; Cellular component =plasma membrane; Biological process=synaptic vesicle fusion
atggtcaaagaccgcctcatggaatttcaggtaatagaaatgactgccttttccattttgttacgatatttatacatgcttttggtattttcagcagttgtccggtatgaatcggaacattgccgctaaatgcaatccgtcatggaacagaccaatgaaggaccgactggggaccctaaaaccggtcggttttttgttttattttcccaattaatgataattgcgttattaaaaacatttcaaggccgaggatgaccatttggtggcgagccaaagtcagttcatggaagactttttcgagcaggttgaagagattcgggccagcatcgacctgatcgccacgagcgtggaggaagtgaaaaagaagcactcggccattctgtccaacccgatcaacgacccaagtgagttttttgaggaaaagtgaagatgtaagactaaaatagagttaagataaaacagactgtagaattggcaggcgtgtggttacatagctccatgatgacctaacctacctatatttttctttaaacgaaaatttttggatttaccaagaaaaagcgggttcaatttttcctcattgaattttattcatatttcgggatggggcgggggttttccgtcgtttataaatagtcactttcgaattttttaaaagacaatttaaactttttaaagaaatcaaagagcagctggacgaactgatggtcgagatcaaaaaaactgcgaacaaagtacgcgggaaattgaaatgtcagttcatttgttactttttatttgttttgggttttatttcatttataatttattcggattggactttttcattcaaaagtttgcacgattttcaactgaaattcgaaaaggaattgttagtgccaagacaaggctccaccatcggaatttaaatacttttttctatttccagccatcgaaaataacctcgaccacgacgaaaacggaggacaagcgaacgtcgacctgcgaattcggaaaaaaccgagtgtcaactttcgaattcggataaaaaaagcgagtgccgaccaacgaattcggaaaactcagcacgcaaccctggcccgaaagttcgtcgaagtgatgaccgactacaacaaaacgcagacggactacagagagcggtgcaaagggcgcattcaacgccaattggacattggtcagtgggagggcacacgactaacgacggactcacttttggggcccttgtatctagtgnggaattag

SEQ ID NO: 72566 - DNA, 403 bp, Heterodera glycines
  Genomic contig location: Contig_ID=SeqID_45225; Location=433..835; Strand=-
  SCN-specific regions: Sequence locations=1-68,91-138,160-160,191 -369,391-403
taaaaacatttacgtccatgccaggctgaaggcgtgcctcgaaggttacttccattggcaactcatctggaaccaagcccgcctcaggtgcgtacacaattcgaccatcttccacaaaaattgtgccatttgttgacgaccttttttggcaaaatttggcaattttttttatgaaaaatttttaaaatttggaaaaatttcacttattgccaattttgaggctccacgactcgtccggaatgcgcagtgtttggatgggccaatttgatgagcggcatcggtccgtgacgcggaagcagaagcattccgagcagccgtacaggtcggacttgcgcagatcaaatgtgccgggacggcactgatcacaccgggggccaactacatttttctgatggaaaataaa

SEQ ID NO: 72567 - DNA, 564 bp, Heterodera glycines
  Genomic contig location: Contig_ID=SeqID_45226; Location=152..715; Strand=+
  SCN-specific regions: Sequence locations=1-496,518-564
atgtccaatggccaaaccatcgaattggtgtcggccaatgggtttcacttctcggacggagtccaaaatgtggaagaagtctcttctgaagggacttcttcctcttgcggaggctctcgactcactcacaattatccaccaacgactttgctttcgacggcagaagtattttcgccccaacaagttgagcctgtgtacgtgaatgagaagcagtacgcgcggattttgaaacggagggcagcgcgagcaaaattagaaatggaaggccgaattccgaaacaaagacgggtggggagaaggaaggggaggataagtgtgcaaatgccatttaacagaaatatttgcacgaatcgcggcatcggcatgctcagaatagggccagacgtgctggaggaaagtttgactcgggacagcctcgggcgaactcctccgcttcagttcaaggctcagagggaggagaccaagagagttcgaagaaagacggaagcgaaccgatggacagacaaatgccaaaagacagcccagacaaatgaccacaaaacattttataccctcaaggaatga

SEQ ID NO: 72568 - DNA, 481 bp, Heterodera glycines
  Genomic contig location: Contig_ID=SeqID_45230; Location=625..1105; Strand=+
  SCN-specific regions: Sequence locations=1-384,407-481
atgtcatttgtcaaaaattcttcacacaattatgagaaaatcttgaccggtcaaagaaataacagtcgtaaattaagagaaaagggtgacagttgtcaacatgtcgtcgcacaattacgaataattctatggtcaatcaacaaattgacgccaaacatgagaaaaaaagacgccacttgtcaagaaatttggcgccaaaatgtgaatatgagtcaacttcttacaaaatagctttaatatctgatgctagacggaactgatcaacgttgggcttaaatgtgtaagcacgcagggacttctaatcggtgtgggcgtgtcacgctgatcagctccccgaatatcggccggttcgtacaccctgtaatttacacaaatcattttaaaaattttgctaattttgttgttgcttttttggtctcactatattctgttgctttcctctcctcgtggctttttcaggaacaatttttaaattcatgaa

SEQ ID NO: 72569 - DNA, 1079 bp, Heterodera glycines
  misc_feature (62)..(62): n is a, c, g, or t
  Genomic contig location: Contig_ID=SeqID_9746; Location=78..1156; Strand=+
  SCN-specific regions: Sequence locations=1-228,262-288,311-360,392 -824,862-1079
atgttttttatagatacatatatgggagggattggctgcccaaagggcgacaaacaaaaagncgatgggagaaggtgagagagtgtgtgttgaacggagggcggtgagaaacaatggagacgaaagagcaggcagaaaagaacaggggaaagaaaacagaggaacaggtttccgctgccgtggggaatttccaatcgatcattctcattactaaggcccaacttccaatttgggaattcaataactttaattcaaagctttgattatcttttaatcataaaagtaacacatttccataataatgttttaatttaattgattcccatatgaccaaccaactaattaatgttttgcaccttttctctctctctctctctctctctctctctcttttctgtgctattgcggcgccgcgacgagacgtcggcgcccagtcaaaacaaaagaatacttgcggcgcctaaacttgcggcgctatcatttcttctttggggtgttgaaattttgtcatagcagagaatttttagtctattgattgtccgtgatctcatggattttacattcagatttctgtgagtgatcagaaattgttgatttaaaaatggtccaaaagggttcaggaggcaatcaaaattaaccaattattagagaccgacttttgaggcaaatgcctttttttcttatcaaacataaataacgcattttccacttggtttgaggcttctacgttgacttttattatgcctttttcgggattttcgtgccttaaatgccttttttggcatttttcccttttggtgctttttggcttttttccgaaaaattccattaaaaatgcaataaaatcgggaaaatacacccctaagaaatgaaaaatttttagaaaatacacctcctaagaattgaaaattttccttaaaaattgatcgccaaaatttcattttttttcttgataaaaaattttaggtttaaaaattttcttattcgaaaaacattataaaacatttaataatcattttaatgtccaaaattaagttattttgttaagtttcacgtgttttgctccctaaaaatccata

SEQ ID NO: 72570 - DNA, 87 bp, Heterodera glycines
  Genomic contig location: Contig_ID=SeqID_9746; Location=1650..1736; Strand=+
  SCN-specific regions: Sequence locations=1-87
taattatcatcctttccgtcacattcttatttaaagcaatgccgaaaatggattttgacctcttcgatatgttcgcacccattgtgg

SEQ ID NO: 72571 - DNA, 896 bp, Heterodera glycines
  Genomic contig location: Contig_ID=SeqID_45232; Location=67..962; Strand=-
  SCN-specific regions: Sequence locations=1-208,240-386,426-479,591-896
acactgaagatgtccaaaagttagctgatgaaattttcgcgctaacttcttcaacttgggacatcatttcaaagctccgccatgtcagtaagcatgccatcactttcgttcgagtcgcctcccaaattggcagtttgattgcggccggggctgacttagccttcaaagtaagaaaaaagaacgatataacaccgggattattaatcggaatataaaaattaattaatttcattattttagccagaatccgaggaattcaaggcgattcaaaaactgcatcattttgtagaagcaaaattcgcagcattgtcaagacacgttgagcatcaaacgaacgagcttaaattttttttaacagaaaccgattattatgctgtgggttgttgttttaattttatttattttatatttaatctaaaaaatatgacgaatagcattttttctaaaatccactgtgaacacggctcacctataagtacaaaatttttcaaaaaatttaaaaaaggaattttagatttttaattaattataatcaaaattaataattttggcttattttggattttattttcaatttttaaaatttatatgcatatttttacttttattgagcgtgtttagcaattttttgtgcatatgttggagcgactaataataaaaataacagttagaactatacaaatatactgtatgatttcataaagaacccaaaataaatttttttaaaaccgaattttcagagtgtcacgcgcccattgaatggcattcagagttcatattcaggaataactgacccattctcgaaccgaactcaatataagtctgattttatctctcggtgtacggaccgctcttcgccatatgatgtgctattggtaataattgtaattaattaa

SEQ ID NO: 72572 - DNA, 49 bp, Heterodera glycines; identical to SEQ ID NO: 64413
  Genomic contig location: Contig_ID=SeqID_45234; Location=452..500; Strand=+
  SCN-specific regions: Sequence locations=1-49

SEQ ID NO: 72573 - DNA, 474 bp, Heterodera glycines
  Genomic contig location: Contig_ID=SeqID_45238; Location=677..1150; Strand=-
  SCN-specific regions: Sequence locations=1-389,412-474
atggtgattagaagaggtacaatggtgattagaagaggtacaatggtgattagaagaggtacaatggtgattagaagaggtacaatggtgattagaagaggtacaatggtgattagaagaggtacaacggtgattagaagaggtacaatggtgattagaagaggtacaatggtgattagaagaggtacaatggtgattagaagaggtacaatggtgattagaagaggtacaatggtgattagaagaggtacaatggtgattagaagaggtacaacagtgattagaagaggtacaatggtgattagaagaggtacaatggtgattagaagaggtacaatggtgattagaagagatacaatggtgattagaagaggtacaacggtgatttgaagaggtactttttctgaaaaatcgaaaatttccagaatttctggaataactttttttgtttttgtggtataaatttcaaataaa

SEQ ID NO: 72574 - DNA, 281 bp, Heterodera glycines
  misc_feature (245)..(246): n is a, c, g, or t
  Genomic contig location: Contig_ID=SeqID_45238; Location=1..281; Strand=-
  SCN-specific regions: Sequence locations=1-281
ccaggactcaaatgtcccgctgaggccaaaaattttttctatttccgggaaaaaatcgaaatttttccgaaaaaaataccagtcgatagagctcgaaaaactatgttttggaagtggtctccgtttttctgggaaaattcgttaaaaaatcctaaaattcaaaaacccgaaaaccgttttttaggcctagctcgaaaaattttgaaaaatttcgaaattttaaaatctgggaaaattgggctttnntaagctctacaataagtctgctggccaccctgcgc

SEQ ID NO: 72575 - DNA, 159 bp, Heterodera glycines
  Genomic contig location: Contig_ID=SeqID_45239; Location=313..471; Strand=+
  SCN-specific regions: Sequence locations=1-159
atgccatttttattcccttccattgttaatacgaataatacggcgtttaatcggattaacgacaaatcagcaaatgttcgccaaaaattggatatgatggaaacagcgcttgtgcacctaacgactaacaaatgtcagcttaatttcagtgccgaaaag

SEQ ID NO: 72576 - DNA, 76 bp, Heterodera glycines; identical to SEQ ID NO: 51235
  Genomic contig location: Contig_ID=SeqID_45241; Location=329..404; Strand=+
  SCN-specific regions: Sequence locations=1-76

SEQ ID NO: 72577 - DNA, 843 bp, Heterodera glycines
  Genomic contig location: Contig_ID=SeqID_9750; Location=1745..2587; Strand=+
  SCN-specific regions: Sequence locations=1-54,77-843
atgtttctgatcgcgaaaattgtgcgggggcgacgattgcttcaccaattggagcaggaagaagagaaggaaaaggcgcagaaggaacgcgagaaaatcatggcgaccaaagcgggcggcggaggtgaaaagggacaggggacaaagggactgagacggaaagtgccgaaagagaaacgagcaatggcattcctcgggactgagacagaaagtgccgaaaagggataatagagaaaggagcaatggcattcctcgggactgagacagaaagtgccgaaaagggataatagagaaaggagcaatggcattcatcgggactgagacagaaagtgccgaaagagaaacgagcaatggcattcctcgggactgagacggaaagtgccgaaaagggataatagagaaacgagcaatggcattcatcgggactgagacagaaagtgccgaaagagaaaggacaatgtcattcccaggaactgagacggaaaatgccgaaaaaggatagtagagaaaggaccaatggcattcatcgggacggcgaccatgggactgagacggaaaatgccgaaaaaggcagtagagaaagaagcaatggcattcctcgggactgagacaaaaagtgccgaaagagaaaggagcaatggcattccccgggacggggaccacgggactgagacagaaaatgccgaaaaaggacagtagagaaaggatcgatggcattccccgcgacggatggacaatggtactgagacagaaaatgccgaaagagtaaggagcaatggcattcccgggaatcgaacgatagattagtatcaatgtttcgcaaaaagaaaaaatagcacgaga

SEQ ID NO: 72578 - DNA, 528 bp, Heterodera glycines
  Genomic contig location: Contig_ID=SeqID_9751; Location=1107..1634; Strand=+
  SCN-specific regions: Sequence locations=1-528
atgccgttaataatggacaaagtctgtctgtccccgcgtcatttgtcccctgccaaagtgccggcccatttggtggccaccacctcagttttattggccgggttgggagcgtcggccagcggcagatggaggcgttcgttcaacgatttggcccggttggactttggaggggtacaacagcagcaggacaaagaggaggacgacgagcacagccggtgttcacagcggggccaaaaatggcattttgccaaactcaaaaattacattattctcatccaatcttgaacattgccaaccaaacaccgaactcgaaaacgccccaatttttacgttttaattttctgcagaagggccgttcgacagcgcaccgattcgtcgctgccatccgtggacgaggagctgaccgcgtacagcaatcacaacgccaaaatgcggcgcacttcgtcaatgccttccgtggtcgaatcggacacacatgggaaagaagcttttgccattgtaaaaaagggtaatcgtttagcagattaa

SEQ ID NO: 72579 - DNA, 765 bp, Heterodera glycines
  Genomic contig location: Contig_ID=SeqID_45246; Location=2..766; Strand=-
  SCN-specific regions: Sequence locations=1-765
  Gene Ontology: Mol. function=acyl-CoA dehydrogenase activity; Biological process=lipid metabolism
atgagcatggacttggccatcgaacacacaaaagttggtgacaccgacttggaaatggacagagcaattgtcgggaaaatattttccaattttcaggtccgtcaagcgtttggcaagtccatctcccaattccaatggacacagttcaaattggccgaaatggccacaaaggtcggtcggcactttccattaaattgggtcattcattcaaatccattaaacttcaaacgctttttctagagggttcagtgtttttttaattcaaattttgtctcgattcaaaatgccattttcagctggtcacctcgcgacttttgctgcgcgaggcgtgccaccatttgcaggaggacactccgaacgcatcggcgatgagcgccatggccaaaatgtacataactgacgaggcattcacggtgggttcattctattgtgtgatatgacgtgaaaagaacgcattttccaactatttttccggaattttgtgccacatttgggaaatggcatttttaaatgatttgaatcccccaatttgccaacctaaattttctgcttataaggtgattaaccaagcgctgcaaatgttcggcggctacggcattctcaaggactacgccctgcagcaatacctgcgcgactgccgagtccaccaaatcatcgaaggcaccaacgaggcgagtttttgttttatattgtgcgtgccaactccgacggcacatatttcgcatttatttttgaattattttcattgttcagataagactctag

SEQ ID NO: 72580 - DNA, 713 bp, Heterodera glycines
  Genomic contig location: Contig_ID=SeqID_45248; Location=442..1154; Strand=-
  SCN-specific regions: Sequence locations=1-400,422-553,579-713
gaaggattcggtctccccataaatctgggcgcctctttcggggggactgccccgaaaacaaaaaaattgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggggcgcttctgataagtttctgaaaaaaaagataagcctaaactttttggcctgtttaaaaaggaattaaaaatttttaaaaatttattcatctccctttttgatagaaaaagcatcagagtgcctaaactagcatgtaaataaaatttggtgcgtttcagagcattttgtgaaaaaaatatttatgaattaattatgcaaaaaacaaataaaaacgaaagact

SEQ ID NO: 72581 - DNA, 49 bp, Heterodera glycines; identical to SEQ ID NO: 51181
  Genomic contig location: Contig_ID=SeqID_45250; Location=355..403; Strand=-
  SCN-specific regions: Sequence locations=1-49

SEQ ID NO: 72582 - DNA, 490 bp, Heterodera glycines
  Genomic contig location: Contig_ID=SeqID_9753; Location=1090..1579; Strand=+
  SCN-specific regions: Sequence locations=1-138,160-358,380-490
gaccggttggccctttgggaccgattgatggtgttggcttcgaaggtgcaaaaagtcatcaatctgtcgtccaaaatttcatctgtccagaacacggaccacatgatgcaacagccaacggaggaacagcgccagcgaatttatcaaagtccaatttttatttgaaatgaatataaattattacacattaacacaataaatacaccatactaaaaatgacgttttagctgataaagcaaagtctgcactgcttcatcttctgctcactgattgtctagcgaaaaatggtgggacaaaccaacgaaatggttgtgagggaaaattgttcaatttcatttactttcagatgaaacaaccgtttttgaccgttttaaaatgttaaaagaggaaaacaattgtaaaattgctccagagatgttcagcaatttaccattggcacgattattagtcaaatttgggaagggaatgacaatgagacgaggactcgcgt

SEQ ID NO: 72583 - DNA, 227 bp, Heterodera glycines
  Genomic contig location: Contig_ID=SeqID_9754; Location=257..483; Strand=+
  SCN-specific regions: Sequence locations=1-227
atagcttcgagcagcaaaaaatgtacgaagaggcgaagctaagcggtttgagcacattgtaagttcggtttgagggaggggggggaagtgatggtcgaactcgagtgcttttcaagacaatggttggaacgtcagagatcattgaacaagaggggtaaaaagcggaagcaggaagtggacacgaaggcatcgaaaggacgcaaaatccgttacgtggagatcccaaa

SEQ ID NO: 72584 - DNA, 772 bp, Heterodera glycines
  Genomic contig location: Contig_ID=SeqID_45254; Location=3..774; Strand=+
  SCN-specific regions: Sequence locations=1-280,318-475,498-504,535-772
atgaaattgtttctgatttccctgattgtgcttggcattctgctgaccaatttggaggcatttcgccaacaaactgttggcatcagaggccgtctgatgtgtggcaatcagccgttgaaggacgcgaacgtgaaattgtggaacaaaaacacgctcggtacaataaacagagattaatagtaattatttgggacggaaattcatgtaagaaaaattgcaaaatatttccaaaaaaaaaaaatgccgaattatgtatggaaaatgggtacaaaaaatcatcaaatattaattaaaatatgtaaatataattttattatggtgttttggattaaattcttagaaaagcatgaaatagggcacaaaatgccgcaaaaaaaagaaactaaggcttagaagaataatattttttgctttttaaacattcgttttggtgtaaatttttatgaaaaaagaggtggttttttaaatatttttcaaaaaatgcttttaaccttttctaattagtattatgtacattaaaatttttgaaattttgtgtccggtaccagcaggactattccccctccccatgtcacagaataggcatttaagttttttaaatttttcaataaatttttcaggttccgatgaccaactggcggctaacaggacagacaatcatggcaattatgagttgcaaggaggcgttggacagctcaccaagatgaatgtgcatttcaaggtgtaccatgactgtgacgacggaatcaaggtggaagaaattaaaatttaa

SEQ ID NO: 72585 - DNA, 125 bp, Heterodera glycines
  Genomic contig location: Contig_ID=SeqID_45256; Location=365..489; Strand=-
  SCN-specific regions: Sequence locations=1-125
atggcacttcaatttcgcgcaccagcagctcagccaacaacaatgaggaggtgctgttgtgcaaagtgtgctcggacaaagccagcggctttcactacggcattttctcttgcgagggatgcaaa

SEQ ID NO: 72586 - DNA, 491 bp, Heterodera glycines
  Genomic contig location: Contig_ID=SeqID_45257; Location=116..606; Strand=-
  SCN-specific regions: Sequence locations=1-273,296-364,434-441,464-491
atgtcgtccgcactttgtacaatattctcattatatttgttgtaagttttaaaatcaaatcccatatatttttgttttttctaaattttagaaactttctgttccaagtttcgcacaaattttttctgtgcatacgaaaacaggcatgttcgttggtttgaaatggctgagccgatatggcagattgcttttgtgccgaagctcaactaaatgcgtattattcgtttaaataatgttgcaattctccatggtattgcagcaattattcttagataaatgttttataaatttaattctatttgatcatataattttatacaaggcaagtagaatcgataaagaataaataaatttcaatcgtttgtaaataaatataatcataattatataaattccaataaataaattttaattggttttaatttttaaatttcagcagaattatttaaattctattttttcaataatagcaaagcatttacataaataaa

SEQ ID NO: 72587 - DNA, 80 bp, Heterodera glycines
  Genomic contig location: Contig_ID=SeqID_45258; Location=299..378; Strand=-
  SCN-specific regions: Sequence locations=23-23,69-80
gtcctgcccataatatctgtggaatggaataaattttggaactgcgctgcctaacggcggtgcttaaagtgcgctaaaaa

SEQ ID NO: 72588 - DNA, 836 bp, Heterodera glycines
  Genomic contig location: Contig_ID=SeqID_45260; Location=40..875; Strand=+
  SCN-specific regions: Sequence locations=1-127,150-438,460-610,636 -807,829-836
atgcttaaaagggcgagggaattcgaaaaagcgaacaattggcaaaatggaaacaaaaaatactacagcataatttggaattcgcctttctatgacggagtttcaaaagtgagtgtttgatcaaaaccaaagctcaagatttgaaaagcccaaagaaatccccgagaccgagtcgagactctcgaccagcaacagctcaaggacagtcaattcttacttttctgcgtttttagatataggccattgtttttcctagggtagtgttccatggctcttatcttgtcaactccaacccagaaatttccgttcctaatgtcgtagaaccgatttttcactccagaatactgtagtgtcagtattcactgtccaaatgataggagaagcttctccagtgggaaaaacttattaaaaattcactaaagccgaaaaacagacagataaatgaaaaagaaaattcggcatcgttgtttctgtgtcgtgccaaattaggaaaccataaaaaacataattttaggtagaggacagagcatttgtcgcatttgtgaaagggcggtcaacttttgacactttttgcacggaatttgcggatgaattggcgaaaatttgctatgaaatgacagaagagcagcagcaacccacgtttgaccagcagaaagaatatttggcacaaaaatatgcggcacacattggcgttgtgtatttaatgcgagagaattggcactgtgccaaaataattgggagcgaattgggaagtgatgggcagcagaaagagtgccaaaaattacacaaatattttgacattttttacaaatatttgttttgtgtttatgctgaag

SEQ ID NO: 72589 - DNA, 678 bp, Heterodera glycines
  Genomic contig location: Contig_ID=SeqID_9757; Location=266..943; Strand=+
  SCN-specific regions: Sequence locations=1-187,209-449,471-678
  Gene Ontology: Mol. function=N4-(beta-N-acetylglucosaminyl)-L -asparaginase activity; Cellular component=lysosome; Biological process=protein deglycosylation
agtctcaacttgggattcatttgatttccaagcggctgcccaaaagggttcgtcgtacacgccaatttttttttttaaagaaatgagttttcagcgttcgatattttccgccaagggcctgtcggttggaatacttcctcgtcataccgacgtctgaatgcaattgttgagggttcgcttattagacagagcagagacggtcgcaggatttaagcttggatgggataccgcccctgaaaactgaaatggtgttttggaggggggggggggggggggtaccaaaaaaaattcctattttaccatgaatttcggcaatggtcaagaattggtgtcccgacgaaaaaaaattaaaaatttcgtaggtgttttttctaggcttaaaaaatgcgctgatcattatttaaactcgcctgaatttctagtcgagccttattcccgtcttccgaaggagagtggcaggggtggtggagtcgtaccccccgcaccgcacccctccccctgggaccgcacctgagacagagcaataaagaaatattaccaatttgaaaaaaaatcattaaggactttctgagtgtgaaaaaagacgatgcgatcgcactgttggatttggtgggtctccggatgaaagaggcgagacgactttggatgcactggtgatggatggcccagggcataaaa

SEQ ID NO: 72590 - DNA, 122 bp, Heterodera glycines
  Genomic contig location: Contig_ID=SeqID_9757; Location=1083..1204; Strand=+
  SCN-specific regions: Sequence locations=1-122
atagagtgcgccgtcatgttctaacttaactttgtttcgttttgttttaattttttgctgctggtccatattatataatttaaatagccttaatttagtttataaactcattaaattataaa

SEQ ID NO: 72591 - DNA, 144 bp, Heterodera glycines
  Genomic contig location: Contig_ID=SeqID_9757; Location=1236..1379; Strand=-
  SCN-specific regions: Sequence locations=1-144
tttatacgggccaggacgttttggcagtggccgttttcgcgtgagggccgttttcgcgtgaaaattctcgggccaggacgtttttgcgtggccgttttcgcgtggttgcatataaaagagaattcataactcacattatatttt

SEQ ID NO: 72592 - DNA, 631 bp, Heterodera glycines
  misc_feature (8)..(8): n is a, c, g, or t
  Genomic contig location: Contig_ID=SeqID_45262; Location=147..777; Strand=-
  SCN-specific regions: Sequence locations=1-63,85-92,115-272,294-631
atgtcaanttttaaaacattacaggcagcacttctgctggtcgacgtcattcaacaagtaattaaattatttgagggctataatttatttgcattaattaaatttttaaaaattgcaggcagcgcgtctggtgtacgtcgttcagcaagtaattagtcatttgtgggacataattttttacatgaattgaattttaaacactgcaggcaccacttctggtccacgtcattcaacgagttaaaattatttgtgagggacgacgtggaattgattcttgtgatttattgttatttaaactgacgcttgtaaattatcaaaatgatgattaaaaaatagctaaaaattataataaaattccagaacaaacaaaggcagcgtctcatagtttcgggaaataccaatgaagaaattgataatgctttgcaaccaattggacacgcagtgaagttctgttggaagttgggcctgaaagcgggccagttgcgtctgagccaagtttagaccaccataacttttttctttgttgaccaaatccaacaatattggtatcattcgaaagctcttaacaagctctatcggctatccaaaaatcacaaatacataccgacatataaaaaagttataaattaaa

SEQ ID NO: 72593 - DNA, 327 bp, Heterodera glycines
  Genomic contig location: Contig_ID=SeqID_45263; Location=60..386; Strand=+
  SCN-specific regions: Sequence locations=1-69,140-155,194-197,232-327
atggtcaatgtaagttgggggcggtaaaatttgaggccataaaaatggcacttatacaggataggccccaaaaaaaaaaaaaatttatttgtaaaatttttaaatttaattaattgtttaattattaaatgaatttttacaaatgtcgcaggctcaattaaaatttttgtatttttttttattaaaattaattcagaaatttaatttaattattttattaaatttaatttatctcatttttaaacaatttacagctcgacgagtcgtcgaatcaggaggacgaggtgtttgttgaagctcatccgatgcaaccggtcactgctgacg

SEQ ID NO: 72594 - DNA, 85 bp, Heterodera glycines; identical to SEQ ID NO: 65905
  Genomic contig location: Contig_ID=SeqID_45264; Location=266..350; Strand=+
  SCN-specific regions: Sequence locations=1-85

SEQ ID NO: 72595 - DNA, 216 bp, Heterodera glycines
  Genomic contig location: Contig_ID=SeqID_45265; Location=517..732; Strand=+
  SCN-specific regions: Sequence locations=1-1,24-62,84-216
atggaaaatctcaaaatccaaattgtgacagtagttttcaaaaacgatgctgatccgttcacagttaaaggatttgatcaaaacaatgctgaattgtattcggctacaacacagtcaggcacatttaacaatgaaacatggcaatttgtgaagatgaatgttaatcattgggagggattggacgccggcatgattactttcaaagatgggaatgag

SEQ ID NO: 72596 - DNA, 479 bp, Heterodera glycines
  Genomic contig location: Contig_ID=SeqID_45266; Location=361..839; Strand=-
  SCN-specific regions: Sequence locations=1-147,169-209,231-479
atgcttaatttggatgcttctagaaaaagttatggcgttgataaattgatcatttttatggtgatcattattcaaccaagtataactttctatatacaaatcgcagatccaccattccaaaagcaattctgtaacaaatttgtgatctttccagtggcttcattttctctagaaaaaatttaccagccccttagggatttcgaaaatttcccctatttttagtgtattttgggtgtcccggtcactaggaaggagtgatctgatcaagttggtgtaagagacttttttgatcagcaccaaaagttatgcaagcatgaattatttcaagtttttaaatgaactatacgatagtttttcaggtttgagtcaagacttttttggggcactgtatttctctcataaaaatgtaattgtatgggaaaataaaataataaatcgaaattataaatatggtcaacaaatctaattaatagattaaa

SEQ ID NO: 72597 - DNA, 668 bp, Heterodera glycines
  Genomic contig location: Contig_ID=SeqID_45267; Location=1..668; Strand=-
  SCN-specific regions: Sequence locations=1-192,216-358,380-668
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaatttttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttctagtgtccggttggggtactcaaaacaattatggggagctgaaatcctacgcagaattaaagtacaggctatagggaagctattccggaaggattccggctccccagtaatctcgggcgcatcgattcggagggactgccccgaaaaccaaaaagtcgattttttca

SEQ ID NO: 72598 - DNA, 112 bp, Heterodera glycines
  Genomic contig location: Contig_ID=SeqID_45269; Location=127..238; Strand=-
  SCN-specific regions: Sequence locations=1-112
ataaaagtcaacgtagaagcctcaaaccaagtggaaacagcgttttttatgcttaatatatcgaaactagtgcgcagaaaaaaaaggcatatgcttcaaaatgcggtctcta

SEQ ID NO: 72599 - DNA, 89 bp, Heterodera glycines
  Genomic contig location: Contig_ID=SeqID_45270; Location=273..361; Strand=+
  SCN-specific regions: Sequence locations=1-37,59-89
accgaccaggtggtggtgccctcctgagccttgccactttcaatttcttcaacaacagtaggggtatggtagaagctgttcagatatga

SEQ ID NO: 72600 - DNA, 538 bp, Heterodera glycines
  Genomic contig location: Contig_ID=SeqID_45271; Location=85..622; Strand=+
  SCN-specific regions: Sequence locations=1-424,448-471,494-538
atgccggccgacaatgaagcacgactgtatttcggcacatttacttccgggtgtgccaacgcgatggcatccaatgtacgggcggacagtttaattgtttttggcggtgggttcagcgtgttcagcattgtctggtggtcagctgcgtaatcattttttcgttgctgattcgtgacaaaattttgggcaggcatttttgtggcttggagtactgttgttttctgtaggacaaaaaattatcaaccttttttaaatgccaaaaaatatcatacatgttaccatggtactgaaatttttcgactcaagagtcacgggcaaataaacgataagatttaaagtagaaaaatgttaagccccgggtgggaaccgaacccccatcaattttttcaaccccagtaaccgtctccggtcactttacagtaatattatttaattttctgtatttatagcgtattattggtataattatagtcattctcagtactcaatttagttgatcagcacagaaaattgttgctgacagtgatcagagttacta

SEQ ID NO: 72601 - DNA, 262 bp, Heterodera glycines
  Genomic contig location: Contig_ID=SeqID_45271; Location=43..304; Strand=-
  SCN-specific regions: Sequence locations=1-262
aaacaacagtactccaagccacaaaaatgcctgcccaaaattttgtcacgaatcagcaacgaaaaaatgattacgcagctgaccaccagacaatgctgaacacgctgaacccaccgccaaaaacaattaaactgtccgcccgtacattggatgccatcgcgttggcacacccggaagtaaatgtgccgaaatacagtcgtgcttcattgtcggccggcattgttcacttcggagtcggcaatttccaccgggcgcatcaggc

SEQ ID NO: 72602 - DNA, 520 bp, Heterodera glycines
  Genomic contig location: Contig_ID=SeqID_45272; Location=114..633; Strand=+
  SCN-specific regions: Sequence locations=1-334,357-520
catttcaatcactgggactcactcaatccaccaacattccaatcacattccaatctctgggactcaatccaccaacagtccaatcaacgggactcaatccaccagcatttcaatcactgggactcaattctactgcatttcaatcactgggactcaacccaccaacattccaatcaacgggactcaacccaccaacatttcactgggactcaatccacaaacattccaatcactgggactcaatccaccaacattccaatcaacgggactcaacccaccaacattccaatcattgggactcaatccaccaacattccattcaacgggactcaacccaccagcattccaatcactgggactcaatccaccaacattccaatcactggcactcaattctcctacatttcaatctctgggactcatcccaccaacattccaatcactgggactcaaccctccagcattccaatcactgggactcaatccaccaacattccaatcaacaggactcaatccacca

SEQ ID NO: 72603 - DNA, 323 bp, Heterodera glycines
  Genomic contig location: Contig_ID=SeqID_45273; Location=493..815; Strand=-
  SCN-specific regions: Sequence locations=1-246,282-323
atgggctacgaaactgctgatggtcaccaaaggaaaaggaatatcgcaatgccgacgctgggattcttcatctcatccacccgttataacgctatcaataacaatcttgtgcccaaaatgttcgcaattatataaatgcctatgtcatatttcagggatggcattccgaggcccaaagattttcggaaattggaaatcggaattcctagcctcaaaaatttcggaagatcggaatttctgaaactgtataaaatcaattaaaaatttttaaatgttttaatggctaaatttaaaaaattctaaatcaagttaataggaataaa

SEQ ID NO: 72604 - DNA, 284 bp, Heterodera glycines
  Genomic contig location: Contig_ID=SeqID_45280; Location=255..538; Strand=+
  SCN-specific regions: Sequence locations=1-29,52-284
atgttaagctttcgaatgatagcaagcttattggatttggatgctgccaaagagaaaagttatagccaaaaacataaactttatgtaaaatctgagtagggataattaacaagtaccaattatttttcctcgcattttcagttggatttgcaacgacgtttggatggacattctcccatcttttgaccatgctcaactcggactcaaaatggcacttctttcgccacgttttgatgcgttggtggacaaacatttcgatggccaatcagaatttccaattttga

SEQ ID NO: 72605 - DNA, 141 bp, Heterodera glycines
  Genomic contig location: Contig_ID=SeqID_45281; Location=51..191; Strand=+
  SCN-specific regions: Sequence locations=1-141
atgaagttcaaggccatgtacgggacttgccgcgagatgttgccaagttattgtgccgagcacatgtggcggcagttcaacggaaagaaaactttagcggcatttaacaatatgatttatcacattgccttttattacccc

SEQ ID NO: 72606 - DNA, 75 bp, Heterodera glycines
  Genomic contig location: Contig_ID=SeqID_9760; Location=849..923; Strand=-
  SCN-specific regions: Sequence locations=1-75
atgaagctgtccatggagcaaatcagtcaaattccagaactgcgcacgaatcagtttaaggagcgaatttgtcag

SEQ ID NO: 72607 - DNA, 535 bp, Heterodera glycines
  Genomic contig location: Contig_ID=SeqID_9761; Location=1027..1561; Strand=+
  SCN-specific regions: Sequence locations=1-3,35-92,124-377,399-535
atgaattttttatttattaatttcatattttttaccgcactgttcaactccgtcaatagccaatgcttctcccctgaagagtaattttacacttttaatttttaatttgtaattttaaataatgttcaggtcgaatgacactcagttggacaagtgctgtggtgaaaaggtaaattcaataatacagtatcattaagttcggtacggtcatattcatcaatcgattaattaaataacgtatcactaacttttggtacgtcattaatctatcgtttaaattaaataacgtatcattaagttcggtacgggcattcattcatttatcaattgattcatttgccaatatattttgtcaaaatgttcaactttaagctggtctacactttgaacattaacgaatcgtgttcaattcgtggaaaaaaattcaactgttcattggcatggctgttggaacgatacaaactttcggacaaatacacaatcgaagcgaacactgaagtaaaataaatgattatttaataattcaagaaaaata

SEQ ID NO: 72608 - DNA, 747 bp, Heterodera glycines
  Genomic contig location: Contig_ID=SeqID_9763; Location=5..751; Strand=+
  SCN-specific regions: Sequence locations=1-496,519-747
atggcattgctctgtgccgctgagcctgactgtatagtgccaattggacagacgaaagaatgtctatacacacgaattgcaccaaatctgacttgccatcgccaacatcaaagtttgctagatactctgctctacaacatggaatatcggaaacaaattgcgggttggttggacagatttatgattttgtttaattaaatttatcttttctttttaatgacagatccctcatttttgccacatacaagcgctaagcatccgcgatggtcagccaaattcattggttcttttcgcatcaaacattcccgatcattcgtggggaatgccgaagaatggctgagcaacgtcaaatgttgctgaacagtgatgacccgcaattgtcgggaccaaaacaattaattgacattgactaatttcaccaaaaaaatatgataactttgattggcatattttcactggagataccgtattggagttttgctatatcctcaacgaaacacatatatttatgaaaaattggatttaacaggattaatcatgaaaaagggccaaattctacatttcgatgcctgctgttggattcggaaatgttattatatatatttttttggttatttatcaaaatgctgattcatccttatccgttttccagtccctctcatcctttttcacggatgttcgacagaatgcataaaaaaattccaaaacaattttgataccacacggaaaaacactttcaaatgtaaa

SEQ ID NO: 72609 - DNA, 360 bp, Heterodera glycines
  Genomic contig location: Contig_ID=SeqID_9763; Location=895..1254; Strand=-
  SCN-specific regions: Sequence locations=1-215,237-360
atgagttttcttttacttttgaatttccgcttttgtccaattggttggctcgttgaagcagggccgggtaacagatgagaatgctatcaattcagattaacaatttataaaaaaaaatttctaattttcatccaatttatagtttttttttcacccatcctcgcaatttccgacatcctgaaccatcagacgaaattcaattctgtaatattcattgttggcatggcattgtgccaatagactaaattgcacttgtttgaatccgccgccaccatcagtcaaatgaacactttaatttgaaaatttaaaaaaatttacgcttcatcagttgttgacaattgacaaatgatgcacattaaa

SEQ ID NO: 72610 - DNA, 364 bp, Heterodera glycines
  Genomic contig location: Contig_ID=SeqID_45283; Location=686..1049; Strand=+
  SCN-specific regions: Sequence locations=1-139,171-212,254-258,280 -300,352-364
atgccggcatcggttgacagtagcagtccgcccaaatccaaatcggaaggcaacctggaacatcagcaaaaggatgaagcgaagaagaatggaggagggtaataagcacaatgaaatataaaattgaatacctaaactgaataatatttttatttttgtaattaaaaattctcagaactttaatcaacatagaaagggtaattttcgatttcaaaattattaaaaataaatatatttaaatgaaattttatatgtatcattttttccaactaattttcagttctaaagatgattatgaacagaaagagcagcagctgaagaagacagaagagaagcaagtggaagaggaaagcgacgggtaaaa

SEQ ID NO: 72611 - DNA, 508 bp, Heterodera glycines
  Genomic contig location: Contig_ID=SeqID_45285; Location=298..805; Strand=-
  SCN-specific regions: Sequence locations=1-31,53-126,155-294,316 -393,422-508
caaaagttttttacaaccacatattgccaatctaatttcttgcagattgaaagccatccattgcctgccggttctcggcacagcaaagcactaatacggtgtttgactcactttaaaaaataattcattacccaaaagttttttacaaccacttattgccaatataatttcttgcagatttaaagctatccattgcctgccggtctcggcacagcaaagcactaatagggtgtttgactcacttcaaaaaataattccatacccaaaagttttttacaaccacatattgccaatctaatttcttgcagattgaaagccatccattgcctgccggttctcggcacagcaaagcactcactaatagggtgtttgactcacttcaaaaaataattcattacccaaaagttttttacaaccacttattgccaatctaatttcttgcagatttaaagctatccattgcctgccggttctcggcacagcaaagcactaatagggtgtttgactc

SEQ ID NO: 72612 - DNA, 85 bp, Heterodera glycines; identical to SEQ ID NO: 65905
  Genomic contig location: Contig_ID=SeqID_45287; Location=290..374; Strand=+
  SCN-specific regions: Sequence locations=1-85

SEQ ID NO: 72613 - DNA, 256 bp, Heterodera glycines
  Genomic contig location: Contig_ID=SeqID_45287; Location=756..1011; Strand=+
  SCN-specific regions: Sequence locations=1-256
gtaaaaaaatgagaaaaaagagatagctattttttggtcaagaattttttttgtttgcgtttcaaatatcgtaagattgtttgatagggccagacaatagaaggcaactgttggtaccaagtttgcggtaaaaaaatgagaaaaaagagatagccattttttggtcaagaattttttttgtttgcgtttcaaatatcgtaagattgtttgatagggccagacaagagaaggcaactgttggtaccaagtttgcggt

SEQ ID NO: 72614 - DNA, 532 bp, Heterodera glycines
  Genomic contig location: Contig_ID=SeqID_45288; Location=98..629; Strand=+
  SCN-specific regions: Sequence locations=1-60,82-532
gcttaaaagcattgtacagcgtaattaaaagctaaaataattttcgtatatttttcacaatttatttcaaaaagccaaaaagtccggaaccaattttaaaaactaaaatagtgcacaaaaggggagccgccgcacggcggggcttaaaagcattgtacagcataattaaaaccgaaaataattttcgtatatttttcacaatttatttcaaaagacaaaaaaaaatgattcaattttgaaacgaaatagtgcacaaaagggagggatggttagacgaaaagaggaatttttagaaaagagcgcaccccatctgatatttccattttccgttccacaactggccaaaggcgactgtgctaattgacacgtagttgtccaataaggtacttggactttccacagtaaaatgtggtacaaaattttggaactgtcccgcctcacggcggggcttaaaagcattgtacagcataattaaaaccgaaaataattttcgtatatttttcacaatttatttcaaaagacaaaaaaaaaa

SEQ ID NO: 72615 - DNA, 547 bp, Heterodera glycines
  Genomic contig location: Contig_ID=SeqID_45290; Location=183..729; Strand=-
  SCN-specific regions: Sequence locations=1-209,247-547
atgaattttcttttatatcgtcgtcaacaattacttgctcaaattttggatgcaacacaccgaatcaatgtgtttgatgctaacttggcgactgggaacatgggcacagaggaacgtgagcaagccatcgccgaccgtgaacaactgtttgaattcgtccgcgaacttttgcgacaactcgacgttgttcgggaagatgaaaggcggatgcgacagagacagagagacgacgacaatgacaacaattctgaggtttattcacactggttttgggttcctctagtctgactgacttaacgaattttttccacccttttttggacaaaaattagttgtatgaaaattcggggttgtccaatttgcttgaccaaagactgttgcgatgagtgagtcaataggctctattcaatttacgcgtccaatcagtgactatcctcatggacaaaagcaacatacaaaaagtttttcctgaactaacccaaattcaaacaataagtcgaaaattcaaatttttgaacttcttaatattgccataaaagtgattaaa

SEQ ID NO: 72616 - DNA, 393 bp, Heterodera glycines
  Genomic contig location: Contig_ID=SeqID_9764; Location=27..419; Strand=+
  SCN-specific regions: Sequence locations=1-158,197-243,267-332,375-393
atgtccgtattttcgtctgtcgccgaaatgtccgtattttcgtctgtcgccgaaatgtccgtattttcgtctgtcgccgaaatgtccgtattttcgtctgtcgccgaaatgtccgtattttcgtctgtcggagtcggagcctccggagttggaataggtgttgttgtagtcgttgttgttgtggtggtggtggttgacttaaaagaatcgaggcttaagaaaaattgacaccgaaattaaaaaacaaattctttataaaaattttgtaagaaaagtggggccaaatttaaaaaaacaattattttattgagacatttttttgtatattctggtataaaatttagaaaatatttaattgtaataattaatattatgctgattatattttatgta

SEQ ID NO: 72617 - DNA, 890 bp, Heterodera glycines
  Genomic contig location: Contig_ID=SeqID_9765; Location=865..1754; Strand=-
  SCN-specific regions: Sequence locations=1-119,144-236,259-309,342 -697,748-758,793-890
atgaagcaaaatgagattggtaagctaaatcaaaagtataaaaaatcaaaaaaaaaaaatccggagcttagcatatttggttcaaaacggcatcatgaacaatacaaatgccatacaactttattttaaagtatttttatcactgacgcattttccactgtcgtcgtcggccgaaacgtcgtcggaacggaagactttttgaaccataactttgtaaggaaatgaattgagttttcataaactgttttactgaaaaaataatttttttcgtcaattttttttactttgcttttaaaccgctttttttggataaattttgcgatttgtgttttaccatctttaactgctttttcatcggaaacttgcagcctttaagtcaatttttgaaaattttaagagatttttaggggctcggcaaccggtgcaccccaaaacgtcgtcggaagactttttgaaccataactttgttcattgtcaattaaattaagcattgttgatgttgttcgatagctctgtgtgtgtattattaaaacactttatattagaaaaataattgtctaaacagaaaaatcattcattggtattaaatctttgcatttgtaagtaaatcatttaaattcattaagcaaaaactgttgatgagaagccatgtgaaacaatgaattgcttgtttggcataagaattggatgtaatggcattttattaaaattaaaaaacaatttaattttaataaatttacaattttagagtgaaaagaatgctaaaaagtgaaaaaaggaagaagaaaatgattgaggacaaaaaaaaagaaatttattatgtttgctaattttctttttatgcattttttgttttcaaaattattttcaaccataaaaattttaataaa

SEQ ID NO: 72618 - DNA, 929 bp, Heterodera glycines
  Genomic contig location: Contig_ID=SeqID_9765; Location=1778..2706; Strand=+
  SCN-specific regions: Sequence locations=1-280,303-549,572-638,662 -665,694-741,773-789,811-833,857-929
atggccgagaaaatgtaagtccttttttaaattgaatttgttctttgaatagagcccccccctgctttatttttttaacgcacttcggggggggggggtggctttaatggagggggcggggctattgtcgaaaaatgtgatgaattaaaatacaaccgcctcctctcatcttggtgtccttgttctgctgctggtcataatgcgaatttttacacagtatcacaatattaggcctaattaataccgtaatcgcactgtacactgtgtgttcttacagtagtgcctcttcttcttcctcttttgtcatcatcctcactctgttgctgctttttctccatccggcgcttggtggcccggcggcctacggcatatgccaggccggctgctctgcgctggtggtcgcctgttatgcggcggcgggcgctgtgttcggcacggtcacgaccggcattggcactccgccagcaatcattgcatgcaacgcggcatacggaacgtgccaagccgcatgctgggccgcacttcacgcgccgacgctttgatttgatgatggttcccaaaatttgggcaacggaatgattggctctgacgaaagtgccatttaaatgtgaccgattttgaattgccaaattggcaaattttctttctcttttgtcaaatcatttttaaatgaatttctatttttgtaaaatgttttttttgaacttttcagtccacctttgttttggccatataatgttgaaatattatttatttctttttttaattaaatgctccaattttgattgctttaacaaagacttcattttcgatttaattgataaatttgaattttttaccgatgaatgaatgaatgcatttgatcaaaaaaattattggatgtaaaagttgtgcggatgattcatttggcaaatttatttatccgacaa

SEQ ID NO: 72619 - DNA, 897 bp, Heterodera glycines
  Genomic contig location: Contig_ID=SeqID_45292; Location=8..904; Strand=-
  SCN-specific regions: Sequence locations=1-13,36-142,164-288,310 -472,505-897
atggccaagatcaggtccctaattatgggccttcaaactgattttggcactctttttgcggagatttcgatgaaaaaaattgaaaaatgcaaatggacaagcaaaatgtttccttgtattgttgcaaaaataaaccaaattgtggcatttgcagaacaaagtggctcatattgtgacctgtcgccatttgagcgagccacggaaatgcttaatgacctaattagtcggaaggaattagccaacccaagtaaagaacaagctcaaaggattgtggatgagttggttgttgagatgaaaatgggcatttggttgaacgaaatgaaaaccaaaatgatcaattttgaaaagccttttgtcgacattaaagggtttttcaaattttcgtcggatttaagtgccgaattagctgaaattaatgctgcaatttgtaaatggccaaattccatgaacaaaaaggtacatttaattgatgaaaattatcatttaaaaattaattaattaattcaggaggaattaaagggcaaaatcggcaaattaatttccattgcaatggaaaagtcgcattttttgaagcaattaattgtacaaaaattggacggattgcttaaaaaagcgaccaacgcttttgaagagttaaaaagtgaattggaagaaacaaaagaagcggaagaaaattttatgaaattcaacaggaaaatcatcgacatttacagcgacaaagccatgcacatgccggacgacgtggacttcgcggtgttcggcattttggaaaggactaaaaggggcgaactgttgttgccgacggcatttgaagagctgcaaaaagtgattgagcatgagaaaagaagcgccattgaagcatttgaaaacaaggaaggccaatcagagaaatgctaa

SEQ ID NO: 72620 - DNA, 796 bp, Heterodera glycines
  misc_feature (70)..(70): n is a, c, g, or t
  Genomic contig location: Contig_ID=SeqID_45294; Location=13..808; Strand=+
  SCN-specific regions: Sequence locations=1-796
ctgttgtgggagttccaaaggcgcaaattggcagaattggaaacggcacaaatgactctttttctgaacncaagcaatttgtgtgggaagaaaaaggcagaggagggacaattctttggagagtcaaaatggcacgaaacggcagagaaagtgagggaacagatcagccaggcatgtgaagaaggcgaagagagtgccgccgttgaaggcggagaaagtgaggggacgacgaagaagacaagcgaagacattcaggtcagacgagcagagaataccgagagaaaggccccattgaattcagtcggaagtcacaaattacatggaaactgcccgtctcgagttgggccaaccgtccaccagcggcaactgcgtcgacccgtcctctccaccactcgtcacacattttaactcaatggccgaactgctcttttggtggcggattaatgccgaacgcttcccacgccttgtgcagctcgcccgtcagttctgcgcagttccaatggccaacagcagtgaccagaggaaggcactaagcaacgacaatgcggaggaagagaaagtgacgcggagatacgcagccgaacagatggcagaagatggcgacatggcacaattggagagcggacggacagaacagttacagctgctcacacagctgatgaccgtgagaatggcactcagagagggggcgacagaaacgaacgaaaatggcaaaaaacgaaacgaatgcatggcaccaaatgaagaaattacaactattgaaccaattagagaaacatcagaaattaaaatatga

SEQ ID NO: 72621 - DNA, 54 bp, Heterodera glycines; identical to SEQ ID NO: 53113
  Genomic contig location: Contig_ID=SeqID_45295; Location=273..326; Strand=-
  SCN-specific regions: Sequence locations=1-54

SEQ ID NO: 72622 - DNA, 198 bp, Heterodera glycines
  Genomic contig location: Contig_ID=SeqID_45297; Location=36..233; Strand=+
  SCN-specific regions: Sequence locations=1-17,40-149,171-198
atgacggagtatgccagtgttgcagtgagaaagcatttacacgcagctttatcttaaatttgtattatactaaatcaaatttttttaggtattattgaacgctttttatgatttatcattttttttgggggttttatcgtataaaaagacaaaaaaggaatttcattttctccgaaaaactctcggattaatttgaca

SEQ ID NO: 72623 - DNA, 425 bp, Heterodera glycines
  Genomic contig location: Contig_ID=SeqID_45297; Location=365..789; Strand=-
  SCN-specific regions: Sequence locations=1-25,48-145,240-267,290-378
atgggaagtttttgggcaaatttatataaaaatggtgccaaacttgtgaaaagtgccggtgccgtagcaacaaaaagtttattatgccagttgggtcaactcgatcaagtcattgtcaatacatttgccaactcattaactcaggttttttaattttaattaaattaaatttaaattcttttaaaatactcagatttctaattttaatttattttaaatttatatatacttattttttagcgttttttattttttggcaaatctccaattgattatgttgaacaaaatgatccggcaatgggacaccttttgcaaaatttgtacaccatttaccaaaaacttaagctgttgaagtttttacgtaatgcaattaaatggaatttttaacaattttatataaaagttttttcttaaaaattaataaa

SEQ ID NO: 72624 - DNA, 1193 bp, Heterodera glycines
  Genomic contig location: Contig_ID=SeqID_45299; Location=6..1198; Strand=+
  SCN-specific regions: Sequence locations=1-80,102-287,396-757,779 -786,808-861,883-1193
atgctctttgaagatttatctgctgggcaaaaatcagcagtgttttttcaaaaacgattgataatgacgacaatgccaaatttgaaatttgaaaaatctttcttctcccgcgatttgtcggaaacaatatacttatttgttagtacaatacataatatacatcattgggaattttgaattattcttgaacccgagcgtttgtcttagttttcaatgactaattagcctttaaaatttagtggaaattttaaatagtaaaaaattttttgcagttcgatattttatggttttaaatttaaaaaatattttaatcggataatattataactctaaagaaatttttaattatttttgtttttaaatagcaatttttatttattaaaatttcattttttggaaataaattatcctcggccttatatccatctccacaccagggatgggccaaattgaaaaataaaaagcgaaatgcgaaaagcgaaatttgcgaaactgaaaaatgcgaaatgaaaaaaaagcgaaatgcgaaaagccaaaatatgcgaataatgcgaaaggcgaaatgcgaaaagcgaaacctcggcccatccctgctccacacccataaatttttcgcttcgtatagcaccttagttttttaaagggaaatgaatggtcgggttactgtatatcttggtttttgaactccattaccgtaattttaagttcaacgacaaatactatatttttgtaggaagactactgtaattgatttaatcaaaatttaatgcattttaatttattgcataacaaataaaataaaaattacgacacagatggtgagagcacaacagcaccaactccattagcatcagcaacagaagctgaagaggaggaacagccgattttgctcaattatttggacactttggcccagtcaatttgtgtgatggcgatggaacaaagtgccaacaaattgttcgagcgccaaatccaattgttctaccaattcgccgatggtttggcaaatgatgtcatccattcggtgcttcgattggccgacgaagagccatcggattttgacgacgatgaagtggaacaggaggaacaggcttttgaagacgtacattctgctgaagaagaagcggaaatgatgccgaaggacgacaaaaacgcatttttggcagaaaagtaaaagtttagagtcaaaaata

SEQ ID NO: 72625 - DNA, 445 bp, Heterodera glycines; identical to SEQ ID NO: 70325
  Genomic contig location: Contig_ID=SeqID_45300; Location=1105..1549; Strand=-
  SCN-specific regions: Sequence locations=60-131,199-334,370-445

SEQ ID NO: 72626 - DNA, 365 bp, Heterodera glycines; identical to SEQ ID NO: 61014
  Genomic contig location: Contig_ID=SeqID_45300; Location=907..1271; Strand=+
  SCN-specific regions: Sequence locations=1-274,310-365

SEQ ID NO: 72627 - DNA, 2667 bp, Heterodera glycines
  Genomic contig location: Contig_ID=SeqID_9766; Location=850..3516; Strand=+
  SCN-specific regions: Sequence locations=1-13,35-99,134-163,185 -637,659-675,698-700,744-886,908-963,994-1017,1058-1406,1444 -1462,1492-1697,1720-1777,1799-1996,2021-2076,2098-2186,2257 -2286,2337-2667
atggccattctgctgaagtgtgtgctgctcctctcaatcatggcgattttctgcgactgtatggaccccggcaaaaaaggaaagagcaaaggtaaacccaaaaataaaaataatttttataattttattttaagccattcgaaaaaaggctgagcccgatgactattttaaaatgataaattttaatgcaaactaaaacgatgatttcttttcctaaattgatcgtgaagccccatcccgttcatttgataattctattgtctattaattataatgaatttatcaattaataatgtttatttacttaatgctcagatccgatcccaatcccgaaacaggaaggtgagcaattaagcaatgaaaacgaacttaaatagaaataaggatataaaagttatgtttaggttaggatttatagggctagaaaaatgcacaccccaaggattgactttttggccaaaaatgaaaaaaaatttgaggctcatcgaaagttttatggcaaaaattaaaaatctcatttttttttatcattttcgcccgcacaatcgcaaatcaaataatagaagaagtgatttatgaaataaataataaagaaagacaaggcaatttctgcactaaaatccgatgaattttaaggaaagccgagcagcagtgcagcgaatagcccgacagtaacaaaaggcactccgaaacgtggcggtaaattttaaaaatcaaaaattgaaaaagtaaaaaatatatatcagactaaaaacataaaaaaatgaggtccacggaaagttttatggcaaaatttaaaaaagccataatattaatttttaagtaaatatcgaatttttatacaatttaacatttattatgaaaaccaccgtagacagttttaggcaatattttggcaaaatttcatgtatcatttgaattcaagttcaaaggttgcgcgattgcttagtggctatttacatcttttatttttttttaatatatttttattttcattaaagattctgctgaattgaatattttagttacattaaatttattttaatgaaaaaattggtcagaatttttttttctgcaattaggatttaagcaagctttaaatcagagctcgcaagtgtagtgctgaatttttagggttttttaaactaaaaattttttcatttttgaccaggccaaaatctgctaaaatcacctaataaataaagttgccgacagaaattaataaatttttcccaattacataatagatttgcacgaaaaatattgtggatttttaagttgttttttaaattataatcaccatcaaactatttgaaacttcgaataaagttcggaatttagaattccaatcccccaatatctgaattcggtgttcttttatattaaaaaaaaatacctaaaacaattccaaatgtttttggtattttggctttgattttggttatattcctgcttccttccatttaaaatatgaataaaaaatgctttcattaacaaaaaatgcaaaattgctaatagaagaagtgatttatgaaagaaataataaagtaagacaagataatttcagcactaaaatatcaaaatctccgtaattacgaagttagagatttccataatctaaatccaatttatgcaagcccggatttaaaaccaaaatgaaccaatagcaaattaaatttttttatgtgcactgatgtaaaataataaaaagaagaaggtattagttaataaaaaattttaatgcatgcaaaaatggtaatagaatcaattaattgaataaaataatgataaaataagaaactgaggcaaaagcttttttaatcttaatctttttatttggacaattctaatttcaatttttcttttaattttaactcttcctgtttttctctttaagaacttgatacccccgaattttacaaaacgagcccaaagaacaaaattaatagcccgagaaagcccaacaacggctctccgagaaagggtaacagtaaacataaaataattaattaattaataagtcgaataaaactttgcaaatttcgtccggtggccctatgggtgtatccctgaattgtttaaatatgtttctgtaaactttgactattccgttgttttgagtgtgctttactttcgaatttactgacttgtaaaaccaagtgatatgatgaatttaaaaaatcgtgaaatataattaaaaaaatatattcaatgaattaattcctaaaaaaaataagtagaattatatttaaatttcatttcgctaactcttctttataaaaatccaatttttcaatatttaaaaaaatatgtcaaaaatttgaaaataaaaaaatccaaagtctgtatatactatataaaccttgtgcatatttcagaatattttatataaattctgatgccacattaaagttgcaacaaagttaaaatgtgcttacatttttcttaatttattcttagtaaaatgtaaaaccttattgtactatttatgaacattgataaaataagtccctttttattattttagataaaaaagctctacaaaaggaacgtcaagaagaaagaaagcaaaaagaaagagaaagagaaaaccgtttcctgcgaacgaaatcaacagcaggtgctaaaaatggctacccaacatttgaggataaccccgccatttga

SEQ ID NO: 72628 - DNA, 628 bp, Heterodera glycines
  Genomic contig location: Contig_ID=SeqID_45303; Location=204..831; Strand=+
  SCN-specific regions: Sequence locations=1-397,420-628
ggcattgaaggccaaaactgctgcattgtgtttcatttttgagaagacaaccaaaaatgattgttcatgcaaagatttggagaaggaactgctccaacttgggctgccctcgggtttttttttaccattttttgaaattcgaaaaatcttggacaaatttttcttggcacagaccatgtcagtgtactggttgaactctacgattccaacagggccgcattgtgtgacagtttggcagggcctgcaatcaaaggttttttcatgagaggcggtaattttacaaaaaactgctcctccctctttgacaaaaaaaaaaaagagtaaaaatcagttttgaatatacaaaatccgaattttatttgtttctgtgggtttgcgattgattcgagttaatccaatttatgtccaaattttcaaaaatttccgaggcctaattttagaaaaaattgaaattttagccccttcactaacagtggtgtgcaaagagcaggttccaacggctgccgacccgtcagtgaaaagtgactattttcgcttggacacaacaagttcggacgggtcaacagcaaccctgctcatccaccgagatgagttggtacagttgagaacctgtaagattgctgtcgca

SEQ ID NO: 72629 - DNA, 1053 bp, Heterodera glycines
  Genomic contig location: Contig_ID=SeqID_45304; Location=232..1284; Strand=+
  SCN-specific regions: Sequence locations=1-595,617-678,700-1030
catcgaaaagttgccggaccgatgtcttcagttgattttctcctatttgtcccccactcaaatgctttccgtgggtcgagtgtgtcgcagatggaagggcattgcgtacaggtggctgttggaaaggaaattaagtgtgatttggcggtgccttaggcgcaattagtcccagcagttcccgaatttgccattttttcgagactgactcggcttgaattgtccatcttttgtctttttgctgctaatgtgccttttcgccctttagccccgtcctttggagttcggtgtccttccgtgtcaaccatggcggcattcaggtgacctcgaaacactcgcgtttcacttccgtaacgttgcgccgcaggtgaccaaccccgagcttttcgcccaaatgatcggagttcgctttaccgaactgcgcctttgtgagctgtccactgatttgatcactccaattgtatttgccaatgattttgtgccaaattcactcgaagtgccttttgccctctttaggtgctccatgaattggcgagtcgttgtccaaaactccaattcctcactttgggtactaatttattgtatcaagtataattggtccattctttttcagatttttccaccgctatgcaggttaacccatctgtcaattggcatttaaattataatgcccactggattaaaattggcacatttgcccctctcatccaaaaagtggcatctttttcatcccatttaatgacacttttttggcacattacatttaccccccccccccccccccagttgcacgacttcaacgacctccaatcgtttccgagtcgtctccgttctttaacgttgtgtctcagtgaaaacatttttctcgaaggctttcttcgtaaagtgtacactttcatctccaggtcactcttcttctcatcacaatatttttgcttattttcctctatttttagtgttgaaattctgcacattatcggttttcctcctcttccaataaattccattcgcttctcttaaggaacgtatgaaaaaggtggaggacgaggaggagga

SEQ ID NO: 72630 - DNA, 48 bp, Heterodera glycines
  Genomic contig location: Contig_ID=SeqID_45309; Location=286..333; Strand=+
  SCN-specific regions: Sequence locations=1-48
agttggacatttcgtgggtcagcgattagaccatggggaaatccatga

SEQ ID NO: 72631 - DNA, 501 bp, Heterodera glycines
  Genomic contig location: Contig_ID=SeqID_45310; Location=426..926; Strand=+
  SCN-specific regions: Sequence locations=1-107,134-263,292-408,435-501
atggagaaggcctgcaaaatttggagagattatatcgattttagtgcgctaggttcgatgaaactttttaaaatataagcctaaactttttggcctgtttaaaaaggaattaaaaatttttaaaaattttattcatctcccttttgatagaaaaagcatcagagagccttatttaacttttaattaacatttggtgcgtttcagagcagtttctgaaaaaatatttatgaattgattttgctaaaaaaataaaatagtgaagctttaaaaattaataaaaaattttaaattcagaattactggagttagcatcatagcagtgcttttccttgtctttttgatgctctcgcaaaatctggttcgcttctgaccagtttataaaaaaaaagttaagcctaaaatttttcgcatatttaaaaagcaattaaaaatttttagatttttttattcatctcccctttttgatagtgaaagcatctgagtgccctaaataacatgtaa

SEQ ID NO: 72632 - DNA, 135 bp, Heterodera glycines
  Genomic contig location: Contig_ID=SeqID_9768; Location=120..254; Strand=-
  SCN-specific regions: Sequence locations=1-135
gaaagggagcagcgttttcgcgagtttgagcaaaactatttgggcacacgcgacgacattgaggcgcagataaagcaggagacggaagcgaatctgaaagccatggacagtaatgttgcaaaaaacaaacagcag

SEQ ID NO: 72633 - DNA, 124 bp, Heterodera glycines
  Genomic contig location: Contig_ID=SeqID_9769; Location=2806..2929; Strand=+
  SCN-specific regions: Sequence locations=1-124
aggtaacttatggcgcaaaatactgcacaaattgaagagttcgttcgtttggtgctcagttcatggccttcatatcaatttgcgattaaaaatcagttggcgggatcattaacaagtgccaagg

SEQ ID NO: 72634 - DNA, 61 bp, Heterodera glycines
  Genomic contig location: Contig_ID=SeqID_45312; Location=1..61; Strand=+
  SCN-specific regions: Sequence locations=1-61
atcacctctgctggatatttttgtggattctttgatcccttaataaaccaaagtttaacaa

SEQ ID NO: 72635 - DNA, 96 bp, Heterodera glycines
  Genomic contig location: Contig_ID=SeqID_45320; Location=1174..1269; Strand=-
  SCN-specific regions: Sequence locations=1-96
ccaaaatagtgatttctagtgacgaaaagtgacgtccaaatgaaaaaattttaacgcagaaatgcgttttttgagctcctttcttcaaaacaattg

SEQ ID NO: 72636 - DNA, 188 bp, Heterodera glycines
  Genomic contig location: Contig_ID=SeqID_45321; Location=22..209; Strand=-
  SCN-specific regions: Sequence locations=1-188
atggagaaggcctgcaaaatttggagagattatatcgattttagtgcgctaggttcgatgaaactttttaaaatataagcctaaaatctttcgcaaatttaaaaagcaattaaaaatttttagattttttattcatctccctttttgatagtgaaagcatcagagaaacggatttaacttttaattaa

SEQ ID NO: 72637 - DNA, 364 bp, Heterodera glycines
  Genomic contig location: Contig_ID=SeqID_45321; Location=838..1201; Strand=-
  SCN-specific regions: Sequence locations=1-364
ggaagctattcccgaaggattcggtctccccataaatctgggggcatcggttcggtggggactgccccgaaaacaaaaaaatcgattttttcaagagtccgcttggggaactcaaacgattatggggagcaaaaatccaaagcaaaattagagtacaggctatagggaagctattgccgaaggattcggcctccccataaatctgaggcgcatcggttcggggggactgccccgaaaacaaaaaaatcgattttttcaggtgaccgattggggtactcaaacgattatggggagtaaaaatccaacgcagaattatagaacaggctatagggaagctattcccgaaggatcaggctccccataa

SEQ ID NO: 72638 - DNA, 1302 bp, Heterodera glycines
  Genomic contig location: Contig_ID=SeqID_1327; Location=46..1347; Strand=+
  SCN-specific regions: Sequence locations=1-54,77-161,183-322,344 -344,366-797,819-1177,1199-1277,1299-1302
atgggaagagaatcaaaggtagaacccgaaatttcgcatggaaaattttgagggaaaagtgcaaaaaatttttcaatcggagaagtttgggtagaataaaacatttagaaatatttttattttttggtttataggagtgtgacgtgaaagaggaattgaagaaaaataaggagatgaaaaagttctttgaaagtgtgccggacaagggaccgatcaatccgagggatgcttatgccgggggaagaacgatgccattttgtttgtacgcaaagactactgaagaaattgagatatcaatgttcgacatcattagtttgtacccctttgttaattatggtaaaatctgcttaatttttgttagtttcctttcgcttaagacaccccataccccgttggagtcccgaaaattgtagtgagcaggaattttaatgtgaattggacagcacccgacgacgtaccctatgatggacttttgaaagtaaaagtgatcccaccgaaaaatcttttgtaccccctcctccccgtgcacatcgatgaaatgctcctcttccctaattgttggtcttgtgcgagaagggccaagaatgaatttgtgatgacaaaagatgtaaagaaatgtaaccatcgtccagcgcagagagcatttttggggacattcacctcaattgagttgcggaaggctttagagctaggatatagaattgtgggattctatcgagcgtatcattttgaacagtttgacagtcaactgttcaaaggatatgtgcggatgtttttgaagataaaggtggaagcgtcggggtggccggcggaggtgaaaagtgaagatggaaaaagagcattcatcgaaatgtacaaggcaaagtatgacatcggtttggattatgataagattgggtttaatcccggactaagaatgattgcaaaattggtgagaaattataaaaaatctctaaaaattgttcgaatttaagggattaaacagtttatggggcaaattttcgatgcgcaataccctttcaaatacggaaattgtgggcagcatggaacgttggatggaattggggagagacaatacaattgagtttgggcgcccagtaaaaataagcgaagagatatcaagagtcgtgtaccggaaaaaggaggagttcatcagggagcataaagtgtcgaatattgttttgtcattgtggaccacgagtgctgcgaggctaaagctgtacgagtacatggagcaggtctacaagaaggaggggtgtaaactgctctattgtgacacaggtgaaaaggaataaaaagaaa

SEQ ID NO: 72639 - DNA, 1668 bp, Heterodera glycines
  Genomic contig location: Contig_ID=SeqID_1327; Location=2142..3809; Strand=+
  SCN-specific regions: Sequence locations=1-30,52-286,320-356,379 -930,957-973,996-1029,1062-1185,1207-1260,1282-1372,1394-1542,1577 -1615,1637-1668
atgagccgagaagctgagccgggctggaaaattgagaaaatttcagtggacctttattgcagtgccctgtcagaccccgtgatcatccctgcccgccccttccaacaatcgaacccagacattgttttcaacgagttcatgcacagacagcaatcatttggagaagtgaatttgttagaccagagaatttcaataattattgccacttattctttccctgttaaataaatttttttcatttttccctttcattattttttgtttattacaataattatttattcgacctttttctttattaatttttcagttaaaatgtactcgtttcaaaactattttgaggaggctctcgaaaaagaagattttttctggcagaaaaacagagcagaagtggaggcattgttaattgaggcttcaaattataaaattataatacacagggactacgaaagccgctattctgattatattgccacctatcaccgcaccccactcttctgtttctgcatgattgagagaaatttaagatttttttacgacacaggaaccgggacgcctataggaagggttacaactgtgctacatgttaccgttgaggcgagctatacaggagagggattcatttcgcctatgttttccttttggttttattgggagggcaggagtcaaacaacaaacgaatctttcacgagccgtctttatttgtacactgtttcgatgctaagagcaatgggcaaagcctggggcagagaactacttttgaaccctgttgaagttttaattgatatgttctaccaacgtatagataggttggaacatagaaaaaacaatttaaaaaaatattttagagatttggtcggatcgtggtcattgttctatagactcccaccctcactttttgacacttcccgccgggtggttgcggagaataaactggaagaatttttaaaattaccatcattttttcgcatgcttttttataataaatattaaatgttcatgttgtttttaaagtgaaggttttgacccaaatatttaatcaattttaatttattatttttggtagaattccagaaaatgcaaacaatcgctgaaattaaaaatttcgagattgttgatggtggaagaatttttgttgtgagagcgagaattgagaatgtgatggaggcggagtacagggtttgtaataaaaatgaaagaaaatttcagtttgtttaggcatgcactttatgccgtaaaggggcttgttcttgcggggctgagaaaaagatgacatcttatttgaaggtgtctgtggcagatgatacagggcttttggaaaatgtgggatttttcggtgtgcgtgggaaacagaatgggatggtaacgcaacgcttttttaaaaatccatatacatttaaatttaggatgaggtcaaaagtttggcgggcgccgtgtgcaccatgaaaatcggcgctagggtgaaagaattcggagggaagaaggggatctattactctttggttgatattgtcaacctttaaatctataaataaacttgttaattttttcaaataaaaatgttttacttaaaattatttctagtttggttcttgttggtcggaacggaaagttgttgcctttcaaaagaagaaaaagagcaatttaccagtgcccgaagaactgtag

SEQ ID NO: 72640 - DNA, 579 bp, Heterodera glycines
  Genomic contig location: Contig_ID=SeqID_1327; Location=4862..5440; Strand=+
  SCN-specific regions: Sequence locations=1-460,494-535,557-579
atgaattttcataaatcggaaaaagctaatgccattttattggaggcagctaaaagagagacggagagagcatggaaggatgttgttgcactagaggaagaggttagcgattttgccaaatcttctcgggaaactcttaatcgtgcgataaaatcccgagagaaagccccatacgctaatggtgttcgggagttttacataaaaatatccgactcaatctgggaaattttcacaatcttggacaaaattaatgtagagtcagaaaaggcagaagctgtatggagggaattggaaaaatgcaaagacttcgaactggcaactaaatttgaggaaaaatcaataaacgcattaaccgaagcccataggttgcatttcgaatcccgaagagtgcataataaaataagagcgtatgaaaatagacttcaaaatattgtctgggaatttattggacaagtgtaagatataaaaagaaattttttttattaaaattaatggaagagtttgttgaagttgaatcattttgtcagaccaatacaaaatttggccttaaaaaatacatagccaaattttattttaaaa

SEQ ID NO: 72641 - DNA, 439 bp, Heterodera glycines
  Genomic contig location: Contig_ID=SeqID_1327; Location=6525..6963; Strand=+
  SCN-specific regions: Sequence locations=1-351,373-417
atgtcaatgcaacaaaatcaagggtccgatgatgttttgccaatgtgggcggtaccggattttgatgaaatgggccaaatgccgcagcggcaaaaacaaaaaaaaatcccaacgttgaaggagtttcggaaccaatggaaggaacgaagacttctgtgggagagggaagaagcagaaaaaaaagaccccaaaacatggaagaagaggaccgatgagatgaagaaaatctgtgaggagagattggagcaatcgaaaggtgcaggcggcagcaacaaacgacaggaaccggacaaatacacttggaactggggcgaactgcagcgccaagaaagagaatatttggacgggggtctatggggaaaatgatgagatacccccccccccccccccttcacctccctcccgttcgtttgatcgattattttattttctatttgaa

SEQ ID NO: 72642 - DNA, 1236 bp, Heterodera glycines
  Genomic contig location: Contig_ID=SeqID_1327; Location=7187..8422; Strand=-
  SCN-specific regions: Sequence locations=1-227,310-322,389-841,863 -1236
atggcattcgcgcaaaatgaacaatttggtctacaaacggctgagacattgcgacaaacggacgcccaactcttgacaacaaaacacgcattcagccccacagaaacttctgcagattcgctttttaaatctgtcgttgctgctgtaactgcgcaagcaacatcacatcaaccgtcaacctcgtcatcgcaactaccaacacaacaaaatttggcatctgcatcaataccacaaccaccgcaacaacaacagtcaatatcgataatacatccccaacaacaacttcaatcacaactactaacacaacaaagtttggtatctacatcaccgccatcaccaccaccacaacagccatcagcatcatcaatgtcgcaacagcaaccatcacaaatacgccaacatcaaccgcggcaatttatcgatagtgaaggaaggctaacagcccatgtattcatagatgaggacgaagagacggaaacacagcaacaccaaaaccaacaatattcgcctatatctgacagtccattagagggggtgccaccacccgacaacgataaccaaatcacaggcctaatgacttctattttaaatgtgttttttaaaaatcaataaaaaactaattttaacaaaaattggtaaaaaacaggcttagcagatttaaattttcaaaaactttatttacaagtaaaaagcctcattttaggtcaaaagtctcatttttacaaaatttattcgaaacccaaattaaaggcctcaaacatcctcaaaattctcaaacccacaaaaatactcaaatcctcatttttaaaaaacatcaaagactcaaaaaaccaccaaatttggattaacacacagttctggggccccgataaaaaccaaactaatttagcgcatcccttcatcttctggatcatcggcgtcaacaacaaatacttcaaagtccgggcatgaattaagaaagcacatacgcgccctgtacgctgaactgggcgaaaaacacgcagaacagagagacagagccaaaaatgcgattgactcgaaaatcgggacttcttcaacatgttcaacagaaggaggacagaagcgatcaactaccaacacagacaaaattaaaaaaaaagttatccaacatcttaaatttaaacattctcatacatgtttattatgtgatttaatccacgcaggttatcaaaaataaaaactaaaaataccaatatttaaaaaatcgcaaataaa

SEQ ID NO: 72643 - DNA, 2743 bp, Heterodera glycines
  Genomic contig location: Contig_ID=SeqID_9771; Location=16..2758; Strand=-
  SCN-specific regions: Sequence locations=1-73,95-2743
atggatttgcacatcgacgattacttgaacccattttatgactcggtgagttgtgcaattaattttccacgaatttttacattttttgcagcaccgaaatgagccctttctgtgcgacattgagctcagtttgtcctcatttgcggtgtggacaaatctgtacaatcgcttcgacgtcggaattcagccgagggaatatttaagcgacatttttgccaatgcgaaactgcacatgcaatccatgaagaaagtgatggctatgcccgagacggattctgtaagtaggcattttaatccaaattaaaattgaaaatttaacctaaaaacaaattcattttccctcaaattctttaggaatgcctccgcgtttcgttcgcctggcagccgttgctgaacgcagacgaatgtgccaatgagaaatgccgacgcgaatttttgtcacgcattgagcgccgcgtgcattgccaatggtgcggccaaatttattgccaccggtgcatcagaaaaagagcaaatagcaacaacgaaatggacaaccacgcccccgtctgcgttctttgcatgcaaattgcttgttaattcccattttttgtcctatttccacctccacttttttttctcctgtgattttgtaatatattgtcaatttaacaatgaaaaagtgatactgtatgtttgtttgggtactataattgtgttttcatttgtcattgcttcgcctaaaaaatattcatcgctttacgattgttagttaaaactgttttaaatgtcttttccaaggaatggacgaaagggaacggtcgcgagctaaggaattttgggccggaaggcgtacaatgacaaaggtgggcattttcaagctcaaaagcatcttatttctcaaaatgacccctcctccctttttattggcccggaacgccacagttttgccattttccagcccagctttgactgatttcggcacacatttccctctgttaaggcagagtttgtggcggagtttttgacccatccggacattgggcgccaccgttgcgcgcagatttgtgacttcgttttccaaggcagcgatacattgacgggggatcaatttttgttggctttcgatgcgctcaaaactgttggatggccatgcggcgtcaagtgggacaaatttgccattttttccgtgccaaaatacagcgaatgcaacggaacactgaacgaaatcattgccggtgtcacgcactgtatgttttcctttctctttattttagagctttatatacatgtcaaacttcacgaggggggagggcggggacaataattccagtttttaagcgtttccaggcctgttaaaaatatgaaagttcatgtggacaaatacctccaaactctaacttctgttggaatactcctggtattagatcactgaaattctatgttcaaatgcatttaagtacttaaaagtgcatttttttcaaatcacataatttgcaaaaagaaagggtcaacacttttttggcacgtttagttgaggttgatcaaattgcgtggctcgaacgccgtttttgggaacgatgcgaccgccgctcgttgagcatcgcggacagtacatttgtgtccactgttctgtcagtcatcaaacggtcggaggtggccaacagagtgtttcggctgttcaccgagcactgtaacagcgccatcgggttcaaggagtacgtgtgcggtctatccagtctgtgccaggggccggaggcggaacgaatgaaatgtgagcgaattcggctgttaatttctttaggaaaaccaaaaattttaagttgttgttggcatttgggactccgacatggacggcattctatcgtgcaatgatttgaatgaaatcgctgatttttttggattttcaatggtggcgaactccacaacttttttactaatcgtatttttaggaccttttagtgcctcacgttgaggaagagcaaacgcgggacgctgttcctcttcacatttttgactttgtctgtttggccagcaaaagtgcgacagtcagagaggcacttttgcaattttcggacaaagtaacaaaattcgaaaaaatctgtttgaattactttgctaaataagtttcaaaaaaaaaagaagtaaaatttggcattttctaatctcttgttatttaatttcgctttttcctctttgtttaaattctttcttacaattaaaccgtttgtatttgatcttcaaaaatgcgttcattaattggcatccttttagctttgggttgcactgacaacgagtccaagcagttcgccaacagtttcgtcaccatcgacaacgtgtaacgatgctgccatttctgttgacgacgataaatcggaggaagacaaagaggacgaacaagaaggaaaagaacgccaaaaggatggaggagatgacgaacaacgacgacgacaacacggacaggaacagaagcaacgcccggggggacggcgacggatgggcggcgtacgaaacattggcaacacttgctatttgggggcggccatccaaacgctggccaatgtttcgctgcttagcggctttttactcagcaagtggtttattgggctcatttttgaatttattttcccattttttgcaccaccaaacagtgagcagcaatttcggcatttgccattagtgaggcattacgtgcaaatgctccgctcccttttggtggcgaaagagacggcgtcgccggtggagtttaaggtattccccgagg

SEQ ID NO: 72644 - DNA, 160 bp, Heterodera glycines
  Genomic contig location: Contig_ID=SeqID_45323; Location=155..314; Strand=+
  SCN-specific regions: Sequence locations=1-160
atgatggatgccggtgccattctgattgccatctcaacactgccaaatatggcgatgagttatgccggcgatgactccgcttacggtgtcaccaacaacccgcacgacacacgtcgcatcacgggcaaacattttaatccaattagtgttaatgagggct

SEQ ID NO: 72645 - DNA, 894 bp, Heterodera glycines
  Genomic contig location: Contig_ID=SeqID_45325; Location=74..967; Strand=+
  SCN-specific regions: Sequence locations=1-81,103-142,171-588,612-894
atggcatcacatccggcactggtcgattcggccaaaatgtgcattccgaccgtggcgatcgtcgactcgaacagcggtgagtggcaataggaaatgaaagaatttgtccaataatccgtgcatcagagcccaactacgtgtgctacccaatccctggcaacgacgactcggttgaatccgtcaactttttcatggaaatgtttgcaaaagcaatccaaaagggccgagcggagagcgacacttttctggagggcgcgaaagagaagaagcatcagcagaaaaggacgatgggccagcggaggcactgaacgaacaaacggagggcgacgaatgatcggagggggggggggggcgaagacggactgattcctctgcttattctttgtttctgtccactttctatgtttaggttttctgaatacacttttacccttttaaattattttgagtgttttcccataaaagtccgctgctatttctccttatttcttttttttttttgattcaatttgttttctgttcgatgtcttctccgcttggtgtgaatgtgtttatcaccggcgccaaccgaggcattgggctcggattggtgaaggaaatgttggcggttggtggaatgaaaaatgtgttcgccggttgtagggacgtcgattcggctgcggtcagtggacgaacccttaggggaaattgaaatttttaacctcagaccaaaaagggaaaaagagctttaaggaattgcaacaactgcacgacaaaaatggaccattgcgactgatcagaattgacgtcagcgacgaccgaagcattcggacggcatttggccaagtccaaaagcaattggtggacaaaggcggactgaacttgctgatcaacaacgcgggcattcttctcaaa

SEQ ID NO: 72646 - DNA, 306 bp, Heterodera glycines
  misc_feature (287)..(287): n is a, c, g, or t
  Genomic contig location: Contig_ID=SeqID_45331; Location=1379..1684; Strand=+
  SCN-specific regions: Sequence locations=1-44,67-106,135-142,166-306
atgtttgccacactgaagacaacaagttcaagcagacatttgctgccaattctgttcatcttctgctgttgctaccgcgccttttcaaatgtatgtcaattttggcttttttaaattaatttcaatttttttttgccattttagtttggtgatgcggccattgtgccattgtcagccctgggccgctacaaggtgtcacttggcgagctgaacgaattgctgacagaacaacaacgctcggctgacgcagtgccaagcactggcgacaaattgccaaattatgccanagttggacaaaaaaaataa

SEQ ID NO: 72647 - DNA, 323 bp, Heterodera glycines
  Genomic contig location: Contig_ID=SeqID_9773; Location=429..751; Strand=+
  SCN-specific regions: Sequence locations=1-194,217-254,276-323
atgtgtcaaccgttttctcttccgctcttaggcggtggcattgtgccgttgcccactgctcgtccgtctcaaattggtgtgggcctccaattccaagccgaacttcccgaaaatgatgacgaacaactgcaaaaggagagaccaaaagcacctgatgaggaggacccttatttcaggtagaccccgaacattattctcattttcctctttttatttcgaaaatttgatcacttaaataatatttttagcattttaaattgaattttcttcccccactgctaattggttacttttctgttttagacccccccagaaattttcaa

SEQ ID NO: 72648 - DNA, 1131 bp, Heterodera glycines
  Genomic contig location: Contig_ID=SeqID_9773; Location=1132..2262; Strand=+
  SCN-specific regions: Sequence locations=1-365,387-537,559-1131
atgcgaaattcgaaaattttaaatttgcgactttcaaggggtgggtctcaaaacagaaaagtaccgctaattgttgtcaaaattggcacatatttttccatatgatttagccaagccgaccccgacgaatgcctttggaatggctcaaaattcgcctcgccaacgttcatctcttccaaaacgccgccatggttctccaaccagcagctgctgctgaacttgaaggagttggagtcgttctgctccgttgcacggcgacactccaacttggacattgaaagggtgggagaaattttcatttttaaagcattgtttacagtagtacgtttggggattgtgccctggtggcagggatactgtggtccttgtgatgttttgtaaaaaatatttgaattcactgttttcccattgtttttaccaatatctcttatatagtgtgctgctcgagactgaaaatttcccgagactcaagaccgaaaaaaacccgagacttttctcgagccgagacaaatttcttacgcacaaaatttgtttgaggcacaacttgttgcaaatcattaggggtgtacgaaaacccgagaatttctcgagtgtcaagaccgagactctcgagcagcactactgttgtaacttgtagtaaaatgccattgtgaattccaattgcaggccctccacctcttcaacacgtccaacttctgtctccaaaacgcactgcgcgatttggaacaattcgctgccaattgcaccaatgcaactgtgaacacaaaatggacacccgacatggatgaacagttcattgaactgttgaacaaacaccagaaaaattttgggaaaattgcaaaaaatgtaaatcattttgaccgtaattttcgcaaatttctacggtgtctttttctaagctaccgtatgggttgacggtggcccaattggtgcaacggtattacacgctgaaaatggagcgctgtttcacctcaaacgaggctcaatttgtgcgctgttccaaccttaaaatgtgagaaagagagagaaaagaatttgaagaaattttttaagcatttggccccgtaggggtcaactcagtctgcgcaaagttcaaaaagttataacttttttctttgttgaccaaactta

SEQ ID NO: 72649 - DNA, 1059 bp, Heterodera glycines
  Genomic contig location: Contig_ID=SeqID_9774; Location=1230..2288; Strand=+
  SCN-specific regions: Sequence locations=1-143,166-204,227-228,250 -323,348-798,823-883,905-1059
atgtgccaaccgtgcgaactgtacgcgaggtgtgttttgttacggcacaccattgcattggattttggcatgtgccagaatacgaatttgatcacgttaagaaaactttatgaaattttggtccgtcggggagcagatctttaccccccccccccccccccccccgtatcaattccctccgtgaatttttttttcaaaaacttcaaataaaaaattattaaattttcataaactttgaaaaccttttcagcaattaagatgaattataatgtttttttcaaaaaagctgctgaaaaattcccatttattttgtaatttatgaaaatattttaagtttcaagttttaaaagcacacttttcaggaagcaaaaaaagcaccgtcctgtccaactgttgctggaaaatgacccgaactatgccgacgacctcagcaagcagcgtaatgagcatgacaatgctggcacaactgccgttgttggcgccgacacaacgggcgcaaaggcagcggaggttgcgccgcgacggcactatccgtgccatgacgatcgcaattgcatgttggcatgtgaggcagcaacacgcgtgcgagtgcagcaacagcagcgagcatcatggcacttcaacatcaaagaggaagtgccgatgacgccggaggacaaagcgggcgcggtggcgattgaacaaagtgacgatgaagcagcggacggatcaaatgttgctgagggtgaagcaagaaatgagaatggaggcgttggcattggtgggggtggcgagcagtacaacaacggcgacaaatgtctacagcaggaggaggagcgggagatgaagcagcgctgggcccagggtaaggacgactcatcaaactcattctcaaaacgctcacaaattttggggaaaatgaactcaaaagcattcaaaaaactgtaagaattgattctaaaggcctaaaattgggaaaaatcagaattagttttttctttctcataaaagtggcaagagagtgccactaatttggttttttagttcgggacctatgttaaatatttgtcaatttgttta

SEQ ID NO: 72650 - DNA, 99 bp, Heterodera glycines
  Genomic contig location: Contig_ID=SeqID_9774; Location=595..693; Strand=-
  SCN-specific regions: Sequence locations=1-99
ggattatttttcaaaacacctcgtagactgggggataattggagactacgggattaatagagactgggctataattagagcatatacggtattcagttt

SEQ ID NO: 72651 - DNA, 374 bp, Heterodera glycines
  Genomic contig location: Contig_ID=SeqID_45338; Location=791..1164; Strand=-
  SCN-specific regions: Sequence locations=1-97,120-213,255-374
atgtttcgaataaatataattgtgtgtgaacgtataaaaaattttccgttggcaagtgtactcaccagatttagaaacatcggttagaaatatttccaatatgcaaattcatataatttttagctttcgaacctccaacaaaaggaatcgactgcatcaatatttttatactttcatgacggtcattatgaactaataagaaaaccacaaaagataaattaattatttttttattttttttcttattataattagaatttccctttgaaagttgcaaagaaatattgtggcacttattgtggcacttcattttttgactcatgctttatagcaccagtaatatggttttgcaactttaaaaaaggtttaataaa

SEQ ID NO: 72652 - DNA, 238 bp, Heterodera glycines
  Genomic contig location: Contig_ID=SeqID_45339; Location=441..678; Strand=+
  SCN-specific regions: Sequence locations=1-15,39-92,114-129,155-238
atgagcggtgcagtgccatttttaaaaaataaaatcattaatacaagagttcaattaaaattattcagcctaatgtaatcagaaaagtacacttaattcaaattaaattcattcaccttaaggacttacttaaattttttaattaaaatttaaacgaatattactaaattttagtaatttagcccttttattgatcaacgattaaaaatcacaaaaattagatttaatcctgatcaaa

SEQ ID NO: 72653 - DNA, 468 bp, Heterodera glycines
  Genomic contig location: Contig_ID=SeqID_45340; Location=457..924; Strand=+
  SCN-specific regions: Sequence locations=1-125,182-389,465-468
atgagaggagaagaaaaacacattggaaaaaatataaaagaaattgaacaaaatatcgtaaattatcaagagaagataatgaattttggcgaagaagtaaatctcaatctcaactttaaagaaggtaattatttagataatttttttaatgaaaaaattcttttttttttaaagtttttttcagaaatcctaaaatttattttgccttctttgattgctgaatgtattacatccaacttattatacggaaaaaagatcgaatggaaaatgttggaaatggcacttgagaaaattgggaaaaaagaattatgggaagaaattgaaaagatttacaatgaatggaagacaaaatttgaaaagaagtctaagaatgacgacaatgtaatggaaaagatggaaaaaatgaaagaaaaattggaggaattgaaagatgaaattgaagaagaaaaggaagagaagaaaaagtaa

SEQ ID NO: 72654 - DNA, 2092 bp, Heterodera glycines
  Genomic contig location: Contig_ID=SeqID_9776; Location=4..2095; Strand=-
  SCN-specific regions: Sequence locations=1-105,164-166,189-218,241 -375,397-570,591-689,712-1152,1181-2092
  Gene Ontology: Mol. function=zinc ion binding; Cellular component =nucleus; Biological process=chromatin-mediated maintenance of transcription
atgccgacaaaagttgagatgtcaaaaggaataagtgtactgttaaggagaggtggcgaagatgaagatggagaggttgtggatactccacctcgaccacccgctccaccaccaccaccacctccaccgccaggtaaatgccctccacgtggaccaaatcctcccgctcctccaccacctccaccgcctgggagacgtcctccacgtccacccagccctccttctccaccaggaagtccaccgcctcgtccacaacgtccccctagaccatgtagagctgctgcaccttctcggagaggtggtctcatagagcaatggcggaaaagacgatatgatatacaactacggcggcccgtggtgcgggatcttttggcggaagcagctgcggctccattgcccgaaagtgacgatgaatatgactatatgctggagagtggattcgcgctgccagcaccatcacagtactatggagatttgcctgtactacccgacaacgcagacgaaattgaggagatggacactgttcagcgcaggattgccaccagacgaagattaaaaaaggacttggcagatgatgatgatgatgatgaagttgatttacagcgaaaaagaaataggatttatcacccttcacctccacggctcccatctccgccacggaaatctgagccaagacctcctccaacagccaagagagaacaccaaaaacaaacaaaggcagaattgaaatcgtcgacatcaaagaaaaccggtcaccccacccctacgcctcgtccaaaaagagaaccggagtttgggctggacccgcgaccatccacatcaaggcaagctgggtacaacccgcctccctcaacacctaaaataaaacacgatccaacaaagagacccaagccgtaccgtattccgaaaagagagcctaaaattgagcgaacaccacaacaacaacaacaacgccaacctcctccagctgctattgtcgaagaaatgcctcttattcctcctcctaggagagggaccaaacgccgccaccccgtaaatgatgatgatggtgacggggaggtgcgcataagaaaaagagtgaggcaaccgagaagggtaagagtacagtactctcccgagccaggtccatcaacatctgcacaaagtgatgagcaacaacaacaacaacaacaacaacaacgtgagctgtttgccattccgtcaaatcaactgaccatgacacagagaattgagagattatacatcaaaatcaacaattatgctgaacgtatgggcgttagggggaatacaattcacaccgcaaacggcaagccgttggcgcatagcaatttgcgaatggtcatcaggtatataatagacagaagagcgggccgccccaccattaagccacctggagcggctatattggaagagaggcttaggcaggacccaattttgtattcatggacggctccaccaaagagaccatcacagagcaaaaccacccggacggcacgggcaatcaagaaggaatttcgcccgaaaaaatggagctgatcaacaccactcttgacaaattgtacaataatccatcttccccagcggcgtttgcaggtgttacagcgctgtggaaagaggcgcgaaaaaagattaaacatttacggaaaaaggacgtgcagcattatttggatggtcaccgcacctacactctgatgcgcccccgcagggtacgttttccaagggccaaaactattgcagcgggattcatgaccgatgttcaagtggatttggcagattttcaagctctttcgcgccacaatcggggtcatcggtatctgctcgttgcggttgatgtcctatccaaacgtctgtttgttgtaccgctgagaaacaagagagccgaggaaatgctggaggcattcaagcaactcatcgatcaaatgcccatggcgccccaccgagttttctccgacaagggcaccgagttcaagaacagattgctcaaggaattctttgaggagcgggagattgagaagcacgaacccgtccattcgacagtaaaagcatcaattgcggagagagccatccggaatgtgaagcagcgattgtatag

SEQ ID NO: 72655 - DNA, 536 bp, Heterodera glycines
  Genomic contig location: Contig_ID=SeqID_45345; Location=412..947; Strand=+
  SCN-specific regions: Sequence locations=1-43,65-136,181-380,402 -486,508-536
atggaaaattcacaaggcgaattagaacaattttattcaacagccgtaaaagttttggatagactaagttttttcttactaaaacttgactgcaaaggtagaactatgaaagatagcagaattaatatggtagaattttcaactgttgcttagaaatttttaatttttaagaaaagaaaattgaactatcagtcaaatgaaggacaatcacagattaaaaaaaattaaaagtcaggaaacaacattaccattgtcaaattcactaactgaatttgaagaaaatcgacaatgttctattttatttgaagaaactagtgaaattattttttctttactcacattttttgattttagcttctgaaactgatgcatcagcggttttagaaataatttcaaataaaggtttgaaattatttagtcatttaaatcattattaatttaaatccgtgaaagaaaattattttttaatcctatgattgtcacgggatatattataacatataatattcacggacacaatggaagatgtcagttaa

SEQ ID NO: 72656 - DNA, 673 bp, Heterodera glycines
  Genomic contig location: Contig_ID=SeqID_45346; Location=330..1002; Strand=-
  SCN-specific regions: Sequence locations=1-338,373-516,538-673
atgagcaacagaccaacggaaatttcggggggcgatgaggacgcggatgaggaggaaatcgatggatggagtggggacgaggaggacgaattggagcccatcaacccgaatgtatgtgctaaaaatggtggcatttctcaaaaaaatgccattttgacacatttaaacttttttttttgaggggaggatgactgaaatttcgctacatcccccaccaatttttgaaagttaatcccaaattttaatacggatttccgaaagagccgtttattttaatctataacattgaagggcatttccaaatatcccatttcaactttcatatgaaattggccatgaaaaatttcaaaaaaaaattttttttttttttttgatttacgcatttgaaacccttttttgattcgctttgaaatttcaaactcctccaaattaattaaactcactcatttttttcagtgtgttgaccgttgtttggcggttggccaagcgccggacgaaacggcattttccgacaagtggaagagagagttctccaagcggccaacatggttcaacgcggacatggcactccaccagattttgcgggtactttcttgtggcaaaattaatttttggtgttataaattacggatttcagggccatagcctcagatttcactatattcttccataa

SEQ ID NO: 72657 - DNA, 75 bp, Heterodera glycines; identical to SEQ ID NO: 54636
  Genomic contig location: Contig_ID=SeqID_45349; Location=753..827; Strand=-
  SCN-specific regions: Sequence locations=1-75

SEQ ID NO: 72658 - DNA, 513 bp, Heterodera glycines
  Genomic contig location: Contig_ID=SeqID_45350; Location=315..827; Strand=-
  SCN-specific regions: Sequence locations=1-513
  Gene Ontology: Mol. function=glutaryl-CoA dehydrogenase activity; Cellular component=mitochondrion; Biological process=regulation of transcription, DNA-dependent
tttgggaggcaatggaattgtggacgattatcaggcaaaagggggaaaatggacaaaaaaagggggaagggataaactaagagagagacgatgcaggtgatgcgccacatggtcaacttggagtccgtaaacacttacgaaggtgaggaaggaaatggcatggaattgccaaattgtgacaaactttggcgaaatgtgcccatttcttaggcacccatgacatccacgcactgatcctcggcaaggcaatcaccggacaccaggcattccaatgagaagacgggcgggggacggacgaccaaagcgattgtcggaattggggaagtgttgtcgggttgagacggaggaagcgaagtgaatgaatcttcttttgccctctcaaaaatatcatttggcacttaaactcttacttttttttacggatttttcaatgccaacatttgccttatgattggaatgtttttacaaattattaggccaaataaatgatatttattcgaaattcaataattt

SEQ ID NO: 72659 - DNA, 77 bp, Heterodera glycines
  Genomic contig location: Contig_ID=SeqID_45351; Location=1..77; Strand=+
  SCN-specific regions: Sequence locations=1-77
gtccgtccattttcacgcgctcgccaaccgactttcgcctgctcaacgaccgtctcctcgcccgtcgccgtgtggac

SEQ ID NO: 72660 - DNA, 143 bp, Heterodera glycines
  Genomic contig location: Contig_ID=SeqID_45351; Location=850..992; Strand=+
  SCN-specific regions: Sequence locations=1-143
cagatgcagtgaaattgagcacttttcggcgtgtcaaatccggcacaaattcgtcagactttgtggaaatgcctttcacgggttcggatttcgacgtcagaccgcttctccatcacatcactcatgccagtttgccagacatt

SEQ ID NO: 72661 - DNA, 1048 bp, Heterodera glycines
  Genomic contig location: Contig_ID=SeqID_9778; Location=22..1069; Strand=+
  SCN-specific regions: Sequence locations=1-253,275-432,458-544,567 -733,765-767,795-887,946-948,971-1048
atgggcttaaaatatgaacttattaaccaaaggcaggggtttgttgagaagtgtgacggctgctattttaatgtttttcattctaatgtgcaggtttggatttttcaaacagttttatttattttggtttttatgttattaattttaaaatccagattggtgaaaatttaaatacacaaaaatccattatttttgtcttctaaggaattttatttatattttctatgttcagtttccaccgattgtgtggccaccacctgaaggtgcttctgaagatgttgtaagccaacatttgaaaccttttcatgacgtgctgcgcttcatttctgctaattgccttacaattgttcaacatcctgaattgtatgatcaagcgaaaaagactcttgatgcggttaacctgctcaatggtgtgttggatcagcatcgacgacagcaacaggggcaggggcaacagcagcagtacaccggaatgactgtgttggaaaacagtgacaataaccgccgacaaactaataatggtgatgaagaaatctacatttctgatgctgatgacgatgatgatggcattccatttcttgtgcgtcgcttcttgaacgctaacattgctgatgaacaaactgtaacagcagcagagcaacctgattatgctaatggtgaaacatcaatgttttgtgatgacgttgcggaaatggagtgtcagcagaactagtcttgtactggtaaacctgcttatatatatatatatatatatatatatatatgcaatttattttttagaggcagggtttcacagcgtcagcgtcgtaataattcttttggttgaagctgttttttcgcgtctttttttaccgaaacattgacaatcaactaaaaaaggcaaacagaattttttattatagatttcaattattgttattagtttaatatataattcttttttatcatacaggcaggggctttttgttttattggatgtattggatctactgtgcgtgatttagtgctaagaaatggtggacgaaggaaaattttcattttatggaca

SEQ ID NO: 72662 - DNA, 939 bp, Heterodera glycines
  Genomic contig location: Contig_ID=SeqID_9778; Location=1239..2177; Strand=+
  SCN-specific regions: Sequence locations=1-664,703-852,882-882,904-939
atgtccgacccgaaaaaatacaatattgaacaagcgcttcaaaatactgaacgtgcaatcgaaccctcactggactggcaggggccaacccaacagcaattggaagagaaatgttagagaattatattaaaaattacgtaataaaatgtgatgttttttggtatagatataaaaaattatgattctctaactcctctttttaaagcaatgcaagaagaaaacagccctactgcaccgtcaccgttccagcatcagctagcgcagcagaagcagcagcccagtcgtctggtaagcaatgttgtatttaatgattcttacatgaaataaccgttgttcattattctcagggacaacataattcttctcagggacaacaccctcaaatgcttccaactccactacatccacctcttgagctgtttgaggaaggtttgcgttacaccgccacctggacttttgctgctatgttcaataagcctttggaagctgaaagaattgccactacgttgagcgatgcttcaatgttgttaaacatgtgtgtgcaaattctgaatcgccgaccacagcgtttgcagcacggattgcaacatccaacgtccagttcgcagcagcactagtaacggcagcagtagccgccgctaagtaattttccatttttatgaacaataatttaatttgaaaatattatttatcatattatttcttatcatttctattccacttgtcacagttcattagtcggcattagttcagcacttcagcatcatgcaacaacaccatatggtcgtcgttaatccgctcgcgggtgtggcaggggcagaaagatacatacacataagagctactgcctgcaaaatttcttaaattttttatttttttatgggaatcggcagtttttaagaaaatttcgaatcatagacgtgtaattttcgcgtttca

SEQ ID NO: 72663 - DNA, 925 bp, Heterodera glycines
  Genomic contig location: Contig_ID=SeqID_45354; Location=89..1013; Strand=+
  SCN-specific regions: Sequence locations=1-201,225-699,743-925
atgttcaaaaaaatggtaaaaatgttcagcaaaaacaaagataaaatgaaagtccaagaagaaaatcaactggaagagaagtaccgaaatttgaacagtttaaaagagacagacccggcaatggcacaaattatggagaaattgcaaatgcacattaaggaggtcaagtcaggtaatgcaacaatgatttatcttctgtaattattgtaatttctctattgtagggaaaatttcggagccgttgaagcaatatttcatttttgtcattcaatttttggcaaaacgacatcacatttcggtcgccgaaattgtgccgattcaaaatatgaaaacaaaaaaagtattaacagagttagtaaagctggttttagaggaaaagcgaaaaaataagcagaaaaatgggaaaaataaggacacaaatggacaaaattgccaatctgagaataaatttaaatcgaacaaagctaaggaagagcgaatgttacgccttttactcacggcattagacaacgtaaacggcacgattaatttatcaatggacggtaagccagaagctgggcattatttgacactaattgtaactatttgcgcagatttaagcgggaccggcgtagcttttctagattttcaggtcccggaaaagcaaaataatgatgtgctaaaataggaaaacagatataaaatcccaggttttgcgggaaaaaaagtattttttgaataaataatattttatttattaattcaggtttatttcattatttttttgtaaactgataattttaagagccctttttcgatttttagagttgtactttttggaaaatcttgaaattttaattcttagagggatgtattttatgttgcattttttattatgacaaaaagatgaaagaaaatattggtttctatcttttatgtattaaaa

SEQ ID NO: 72664 - DNA, 70 bp, Heterodera glycines
  Genomic contig location: Contig_ID=SeqID_45355; Location=1091..1160; Strand=+
  SCN-specific regions: Sequence locations=1-13,47-70
atgcatagaattattgctgcggttaaaaagctcgtagttggatctgtgctagccgtccggtgcacacttt

SEQ ID NO: 72665 - DNA, 105 bp, Heterodera glycines
  Genomic contig location: Contig_ID=SeqID_45357; Location=402..506; Strand=+
  SCN-specific regions: Sequence locations=1-105
ggggcgtttgggggactcacacaattatggggagcaaaaatcccacgcagaattaaagtacaggctatagggaagctattcccgaaagattcgggctccccataa

SEQ ID NO: 72666 - DNA, 56 bp, Heterodera glycines; identical to SEQ ID NO: 52733
  Genomic contig location: Contig_ID=SeqID_45360; Location=791..846; Strand=+
  SCN-specific regions: Sequence locations=1-56

SEQ ID NO: 72667 - DNA, 750 bp, Heterodera glycines
  Genomic contig location: Contig_ID=SeqID_9780; Location=928..1677; Strand=-
  SCN-specific regions: Sequence locations=1-750
atgatggtgcaatggaactcactgctctcgcaggtggtcacagaggttgaccacccacagccaatcctggagcacatcaaagaaacggcggaattctccgtcaaacaggtgatcgaaatgcgacggaggggaggggaccaaacgcagtgagtggtcttgggactcgatctggttaaacattcattactcattctttgctattttcagtttcgtgacgcatgcttgggtatgatcagcgaattgacacgcacttcggtcgattggcaactgaacttcccaaacgaaatggcagaacaggtcatctccgtgtcatcaatcctcggaacccgacttatgcaaaataatgtttaggaaatttccgaatatgagaactcaatccgaagacaagaacaattgttgggtaaaatcagacagaaattggacgacgaaattttgtcgggagaaaattcgaattttgtaccttaatgtttggattatcacttggatgaatcgcttatcatttatcattttactatattatttggttctttaatcacgccaatcactgttaagagttccgactgtttgaattcaaccgatttttagttgtttttgagaccaacaaaatgtggcatgaggcgcgaagacaggagaaaatggtcagagccaaaatggtggacaatgcgaagagaaacgagcggaggaaacaattctatgaaagtgtggtcagtttaagggtatcagaagaatatccaccaaagttataataaa

SEQ ID NO: 72668 - DNA, 139 bp, Heterodera glycines
  Genomic contig location: Contig_ID=SeqID_9780; Location=2332..2470; Strand=-
  SCN-specific regions: Sequence locations=1-26,54-139
gtcacacttcgacaaattcgcaaacgagcagcagaaatgaggaggaggatgacccgcacaaccgacagtcatgttcaagtggataccaaagatagaggaaccattattcgtcccttagatgcgtcattctcacaacccg

SEQ ID NO: 72669 - DNA, 966 bp, Heterodera glycines
  Genomic contig location: Contig_ID=SeqID_9781; Location=31..996; Strand=-
  SCN-specific regions: Sequence locations=1-712,734-966
  Gene Ontology: Cellular component=cytoplasm; Biological process =synaptic transmission
caagttggacgtatgtgtgctcaacatgcactgaacatgcttctgcaaggcgattacttcacgcccgattctctcgcttcaattgctcaagaattggaccaaagagaacgtgcgatgctaagggacgaatctgagtttcaaagtcaaaattacgacgattcgggatacttctcaattcaggtgcttgtcacaaacttattcaggtttagttatctttttaggtgataactgaagctttgcgtcgtcaagcgaatttgagtctggagcctatcataagcccaaatgctatgaaggttttgcaaaatcccaggtattaaattctttcttgatttgattgagctgaaaatgtatagcgttttctattagctaaaaacgatatttcattttaattactgcttattgtaaactacggtagaccaataaccctccctcttcctaagtttggcacatgcttacatttgtcacctggaggaccattggttcacaattcgcaaaattgggacgacttggtttatcctcaattcgctgttcaaagcaccgcgcattgtatctgaaacgtttctcgaattgtacgtccatcagcttaataccgaaggtaaacattcaaaattatggaacaatccttctgattgtctaatcttttcatgttgaactgtttaattttgttttaggttggtccctttatgttgtcgaaggcgaattgcccgcttgtgcagcggaaactgtgccaagagaattttggaatgagacgcgacggacaaaaaagtttgaaaatgacatggaaagggcaatcgcattgagcctaaatgaagcacggccgtttcttgttacaaaggcaattctcggaataaaaaatcgacgtgctttttatttttattttttagactgccgatgaagaattgtttggagcggcgacgccggtgatcagccaagccgaggagttggacatccaggaaagacttacga

SEQ ID NO: 72670 - DNA, 105 bp, Heterodera glycines
  Genomic contig location: Contig_ID=SeqID_45366; Location=37..141; Strand=+
  SCN-specific regions: Sequence locations=1-105
cattcgcggagcatcattttcaatccgttgaacccgaccatacgtattctcggcagccgttgtagtttggcatcaattcacccgccccctcaacaacaacaatga

SEQ ID NO: 72671 - DNA, 682 bp, Heterodera glycines
  Genomic contig location: Contig_ID=SeqID_45367; Location=189..870; Strand=+
  SCN-specific regions: Sequence locations=1-207,229-682
atgccatcttttggcaaaatgccactttgttccatttccgcggcaccgttgtctttcagccttaccccgtctacggcaccggcccgggcgttggcgcttaccctccgccagtcggaccggacagcacatattcgccacagcagaaccgacgatttggagacgaacatttgcacagatattacgacaatgaaggcggacggcaccaccgatattgacgaagaaatgccatcagagcacagactgacaaaagtaatagcaaaacaaatttcttaattaccgaaaagctccgatcgttcatttccccaaaatttactgtgagcccttacagtagtcccaacatttccaatttggcacacattttcgatttttatgccaatttaacaaacgcaaatgaatataaatgtttagaagctgttcacatttgcctattaaatcagcaaatttgggcaattaaagaatgccaatgttttctttttgtccattctctgatgaaaaatgactgtcggggagtgccataatcaatttgtgtgccggccaagtggtgggcggggccagtcgataatgaattgcgctgggtaggggggggcaatgcgggaatctgtcaattttagcagcaaaagtgctcaaaggcggaagcacatggaaatctgaaagcagacaaacgcagccttttaaagcagta

SEQ ID NO: 72672 - DNA, 285 bp, Heterodera glycines
  Genomic contig location: Contig_ID=SeqID_45369; Location=11..295; Strand=-
  SCN-specific regions: Sequence locations=1-64,86-124,147-285
atgcgtccccagcgtcgtcgtctgcggccaatccaactctttcaattggtccttttgtctctgtttggcattttgctttttgcaaaagtcatttataaaacggtaaatttgtggatgaattgcgaaaagaaaatcaaattgtaataattacagctgttctctcaggaaatggattcagaaaagggcggcatcgtctttttcgctatttttatgttcatcataatcattctttgcattcgcgaagtttacaaaggcatagataataacttattcatttttaattaa

SEQ ID NO: 72673 - DNA, 988 bp, Heterodera glycines; identical to SEQ ID NO: 45371
  Genomic contig location: Contig_ID=SeqID_45371; Location=1..988; Strand=+
  SCN-specific regions: Sequence locations=1-226,249-892,914-988

SEQ ID NO: 72674 - DNA, 950 bp, Heterodera glycines; identical to SEQ ID NO: 9783
  Genomic contig location: Contig_ID=SeqID_9783; Location=1..950; Strand=+
  SCN-specific regions: Sequence locations=1-141,163-266,288-950
  Gene Ontology: Mol. function=tRNA binding; Cellular component =cytoplasm; Biological process=reproduction

SEQ ID NO: 72675 - DNA, 901 bp, Heterodera glycines
  Genomic contig location: Contig_ID=SeqID_9784; Location=38..938; Strand=+
  SCN-specific regions: Sequence locations=1-500,522-669,691-765,787 -853,875-901
atggcccttaaaactggcgatgaagagcccatcagattattgggcaaaagggtcaacgaatttgaacaggtagggttcggtaaccaaggcttggtttttgattgtttgtgccaggaattgaactcacaattgttgccatattggaggagggacaatttgcgtgagcaagtgaagcaattacggatggcaatgaaaaaactcaaaaaggcattcaaaaaatcgacgaaggacgaagagaatggcactgaaacagctgaagagaaacggagcaagggaaagagcggtgcgaaaaagaaagctgaagcggtggagaattgagatgacaggcgaagtgttgagctgttttcataccttttttgaggttgagggggggggggggggtcggcccccatctttcgtcataaatgctccggaggagggaggcctttgtaatcgggaagaggtcaaagggggaagggtcgacgaaggggggggggagagaaagagtaatacgatattccgggtgcaccccaaaatgtttttccgacggcgcctaaaatccttatttccctaaaaaatgacaaaatcgcaaacattggcctttttggacaaaatctgtaacaaatcccattaaaattacaaaaaaaaaaaaaatcccagcggcacctaccggcactgtcggaccccatatttcccaaaagttttttgaaaaacatgccgcaaaaaaggtggtaagaaaaaaaggccgtttacatggctgacccccttcgcaaagttagccgtcaatcccctcccctttgacccccctccctttttttaacgtatgactgtttttgccagcgattggtgtgacactgtcagtgttattgttggtataatattttgtttatatataatttgacactcaatattataaacctta

SEQ ID NO: 72676 - DNA, 726 bp, Heterodera glycines
  misc_feature (636)..(636): n is a, c, g, or t
  misc_feature (684)..(684): n is a, c, g, or t
  Genomic contig location: Contig_ID=SeqID_45375; Location=1..726; Strand=-
  SCN-specific regions: Sequence locations=1-518,540-726
  Gene Ontology: Mol. function=proprotein convertase activity; Cellular component=integral to membrane; Biological process=embryonic development
gtgtgttgagcattgtgaggagggcttttacgcggacggcgacaaatgcaaacgatgcgccaccgactgcgagacgtgttcacaagcggaactatgtgacaagtgccacgatgcaaaactgctgatagacgtcaaacattacggccatttggaccatggccgttgtgtcgcgacttgtcccgaaggattggtcgcggattgtaagagaggagtccctcgtcgggtaggacgtcggctgaactttgtctttaagacagactgacaatccaagccaagtgcgtgctcagaaggaattcgtgctccgccggttacttcgaaagtgcgcaaagcgtttgtttggagtgcgacaagtcgtgcgcaacttgccatgggcctggtaagccgaagggagcttcgttggacatgaaaaagacgcaacccaaaaaggtccgctccaatgcgacgaatgtgcacagggctttgccaaccatacgatgggttactgtcgccagtgctgttctcccgaccaattgactcagaaggacttgcactgtgaagattgctccaagagttaccccgaattccccacgaaaagccatctgtcaatgctttctcttttggccaactttttcacaatcattggcctcgtccttttgngcactgttcttttttatttgtgtcgccaattgatttgctgttgtttcnggattggtcgcaatggaaatcgttctgatctcgagtaaattt

SEQ ID NO: 72677 - DNA, 657 bp, Heterodera glycines
  Genomic contig location: Contig_ID=SeqID_45379; Location=335..991; Strand=-
  SCN-specific regions: Sequence locations=1-657
gttttcggggcagtccccccgaaccgatgcgcccagatttatggggagaccgaatccttccggaatagcttccctatagcctgtactttaattctgcgttggatttttgctcccgataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgattttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgattttttt

SEQ ID NO: 72678 - DNA, 441 bp, Heterodera glycines
  Genomic contig location: Contig_ID=SeqID_45380; Location=603..1043; Strand=+
  SCN-specific regions: Sequence locations=1-24,52-54,178-229,259 -259,343-348,381-441
atgcaccaccatccaccgaatcatgaaaaagctatcaatctgtcaatccttacggtgtccgggccgggtgagtttccccgtgttgagtcaaattaagccgcaggctccactcctggtggtgcccttccgtcaattcctttaagtttcagctttgcaaccatacttccccccggaaccggaagactttcgtttccgggaagctccccaccagggcgaataaatccgccggcggatcgctagttggcatcgtttacggtcagaactagggcggtatctgatcgccttcgaacctctgactttcgttcttgattaatgaagacattcttgccaaatgctttcgctgtagtccgtcttgctacggtccaagaatttcacctctcacgtagcaatacgaatggccccgtttgtctctgttaaccattatctcggtcagcaaaacca

SEQ ID NO: 72679 - DNA, 1367 bp, Heterodera glycines
  Genomic contig location: Contig_ID=SeqID_45380; Location=158..1524; Strand=-
  SCN-specific regions: Sequence locations=1-58,94-97,123-158,180 -190,237-250,284-542,575-580,664-664,694-745,869-871,899-906,982 -1053,1121-1256,1292-1367
taacggaggataagggttcgactccggagaaggggcctcataaatggccactacgtctaaggatggcagcaggcgcgcaaattacccactctcaacgcgaggaggtagtgacgagaaataacgagaccgatctcttatgaggccggtcatcggaatgggtacaatttaaaccctttaacgagtatctatgagagggcaagtctggtgccagcagccgcggtaattccagctctcaaaatgcatagaattattgctgcggttaaaaagctcgtagttggatctgtgctagccgtccggtgcacactttgtgtgttactggtttggttggcttttctgccggtctttccccggcgttggcctttaccggtcggcgtcggtgggctggcgagtttactttgaacaaatcagagtgcttcaaacaggcgtttcgcttgaatgttcgtgcatggaataatagaagaggatttcggtccgattttattggttttgctgaccgagataatggttaacagagacaaacggggccattcgtattgctacgtgagaggtgaaattcttggaccgtagcaagacggactacagcgaaagcatttggcaagaatgtcttcattaatcaagaacgaaagtcagaggttcgaaggcgatcagataccgccctagttctgaccgtaaacgatgccaactagcgatccgccggcggatttattcgccctggtggggagcttcccggaaacgaaagtcttccggttccggggggaagtatggttgcaaagctgaaacttaaaggaattgacggaagggcaccaccaggagtggagcctgcggcttaatttgactcaacacggggaaactcacccggcccggacaccgtaaggattgacagattgatagctttttcatgattcggtggatggtggtgcatggccgttcttagttcgtggagcgatttgtctggtttattccgataacgagcgagactctagcctactaaatagttggctcattgcttctgtgggcacaacttcttagagggattttcggtgttcagccgcacgaaattgagcaataacaggtctgtgatgcccttagatgtccggggctgcacgcgcgctacactggcaaaatcagcgtgcttgtccttccccgaaaggggttggtaaaccggtgaaaatttgccgtgattgggatcggacattgcaattattgtccgtgaacgaggaattccttgtaggggcgagtcatcaactcgctctgaatacgtccctgccctttgtacacaccgcccgtcgctgcccgggactgagccatttcgagaaattcggggacggttagtgttccggcttcggtcggtatgcagactggaaccg

SEQ ID NO: 72680 - DNA, 494 bp, Heterodera glycines
  Genomic contig location: Contig_ID=SeqID_45381; Location=200..693; Strand=+
  SCN-specific regions: Sequence locations=1-217,239-494
atgtccaaggattgctttggcgtagagcgcttattcgaaaaagaaatccgtcgccgcaacagattggtgagtgtacttgcacattttttaccaaaattacattcccaatttaaggagcgttttgcccgttcagctgcgaattcaagttcctccttcggaggacgcattggaagcgacgaaaatttgcagaacccaaacaaagaagggcagcacaaattggcacaacagcagcagctgacaatgaaaatttcgcatccgaaaatgttgacgaaaaatgaaaacgccgaggacagagaatggacgccaagggaagaggctaagaaacggcgtagcgaaggcggataccgcttctttggcgtaaggtgagtggaacaaatggaaatgccgaaaataattacgaatgcaattgacatgtctaatcatcatgaaaatttcgttgtttcagaaaaccaatggcacagaaggcgcgtgacgaaatgatcaaactgcgagag

SEQ ID NO: 72681 - DNA, 1027 bp, Heterodera glycines
  Genomic contig location: Contig_ID=SeqID_9787; Location=743..1769; Strand=-
  SCN-specific regions: Sequence locations=1-482,505-1027
atgaacttgtacacatcaacgcacaaaaagaagtaatcatgtctggcattggggacaaaaaaacaaattattttgcatgacccaagaccgagaattgaccccgagagtgtcgagaccgagaaactcagaaactaaaaaattcatgaatcaaattttatcaaagtatttttgcttgccaaatattttatataagcgatcaaagcaaattaattttgaagaaagtagtaaatggtgcatttaaacatcttaccttttcaaatcggtatctatttgttaggtagcaataagttttcttaatttgccgaaaaaatttgttaaaagcttcaccaagtttcaaataattacaccaattttctgcactttgtttgtcataatcttattctaaattggagaaaaaaaaattatttttttgaaattttgcagaataataaagagaaaaatatttcgaataataaataccacaaagaatacatatatatttgttgtttttgagcaaagttatcaaattatttgttaaaaaccccgaactaccgtattttacgaaaccaccagcacttttattccactcattaaggcatacccatgtggaattgtttggagataaggaggcatgcgcaaacatttctcttggagagtttggcattttggatggatttgctggccctgtgccaacgaacaagacggccttgtttaggaaccggtccttttgggggtacctgttgtgcatggaggagccaatcactgcactgtcctatgacatgttggccggccttccgcaacagggcggcaaattgggagtgattggccacaaggacaatgacaagtgtccgtttgcaattcgactggtaatgatgccgtaaaatttaattaattgagttgtctaattacatttttttcaaacaacaatatttgcatacatatagggcggtgagaatggactggcgaaatgtgtgggaaaaatgtgcgcgaaaagcccataggcaatgtggcgacatgtctttgtaatgtgtacgaacttacgaataaa

SEQ ID NO: 72682 - DNA, 427 bp, Heterodera glycines
  Genomic contig location: Contig_ID=SeqID_9788; Location=206..632; Strand=-
  SCN-specific regions: Sequence locations=1-182,230-427
atggcttccccttcgctgatgaatcgactcattttcccatttcttttgggagttcttctccaaaacagcaacaacattgttgatggtagtggcattgttgattggaccaccgggaagcagttgaacagtgtagagtcgagaaaagcacccgtagtgatcacggagagtggagaaatgtgtgcaaataaatttaaattattacgatcttaaatttttaaaaattaaaataccgtatttattgaaatagatcccccggtgcctctatttttcaaccccccccccccccccctcaaaaggggggctttatttcagaggggggctctaattcaaggggggggggggctttagttatcaacacccttgaaaggggggctttatttcagaggggggctctaatattcacgggggggggctataactcaataaa

SEQ ID NO: 72683 - DNA, 666 bp, Heterodera glycines
  Genomic contig location: Contig_ID=SeqID_9789; Location=1240..1905; Strand=-
  SCN-specific regions: Sequence locations=1-425,447-464,486-666
atgggtgggaatgcgaaggaaaaaatgctccggttcaatgacactgtgaaaattggtgaagcaacagcggattatgatcgtaaaacattgccgaatgatgaagttgtgccattgctgaccgaacagtacaaggccgacgcgcacaacgtgatggagatgtacatggaggacaagaagatgacctgcatgctgctacgctttaaccaaaaaaatttagataaactgtgataattagtgatttatgaaagcatatcgtttatattgactaaaatttagactaaaaattttcgaaaagaaatatcaatcaaaaatccaaaaaatggccaattaagaagatgacctaattatattatttctgcttttgtgttttttttatgttcttataattcttttattggaattgggaattgtaaatcactaattcatacaaattattaaatatgaaattttacattgccgaatgtcgaatttgtgccatttttggccgaacattacaaggtcgacgcgtacaatggagtaaaagaagatgacacgcctgctgctacgctttaaccaaaaatgcccgctatagcaaattttgggacaaaagaactataaattttggcattatgatatttttatggcaaaatataatttgatttaaattaaattgacttatccaataaa

SEQ ID NO: 72684 - DNA, 438 bp, Heterodera glycines
  Genomic contig location: Contig_ID=SeqID_45382; Location=220..657; Strand=-
  SCN-specific regions: Sequence locations=1-438
aaaatggtgtaagtaaaaatcgtaattacgctcaaaaagctcctcaaacaattttagcgcttccaattccttctacaatcgcctttatacatcccattatgaacgctaaaattatcagagtgccgaaaatcgcgtgtgatctacgcctagaaaaaaatggtgtaagtaaaaatcgtaactacgctcaaaaagcttctcaaccaattttagcgcatccaattccttctacaatcgcctttatacatcccattatgaacgctaaaattatcagagtgccgaaaatcgcatgtgatctaagcctagaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgc

SEQ ID NO: 72685 - DNA, 1242 bp, Heterodera glycines
  Genomic contig location: Contig_ID=SeqID_45383; Location=49..1290; Strand=-
  SCN-specific regions: Sequence locations=1-437,459-1242
atgcatcgcgaaatccgcgaaacaatgcatatgcaactgcacagatgcagtgacagttggtgtggtcctagcgacccaatttacgggcggtgcaagaaggggttcccagccccttactcaaaatgtacgattttgcgcccggacaggcccgcgatgtatttccggccttcaccaactgatggtggtgcccaattagaggtaaacggcctaatatacgacaactcacatgtcgtgccgtataatccttatattctgctacgttaccgagtacaccataatgtactgtttgcatatggtaacaaagcaaatattaaatacgcactcaagtaccctttcaaagggccagggcattgttatgtcgagtgcaaacaagagtccggcaataaaatcggaattgatgagccggctcaatatgccaagatgaacttccgtggtgcaacggaagcatatgccattgtccattcactgccatttgccaaactttcacatcaggttgtcaaacttagcatccatatgcctaatcaacaaccgattgtgtacagggcttttcagctggtgagcaaagctcaacaaatccagcaaggcgaactgccagagacgcaatgttctgcctattggaaacaatggcaaaatgaatggaagcatgatccgaagctcaaggacatgctttttgaaaaagtccctgagcattttatatgggcaaaggacaaatggaacaaaaggaaatataacctaacaaagagaccaccaatcggtcgaattgttcctgtacccccatcggacccggaaaggttcgcgctctattcacttatgcgtcactttcctggagacccagaccatcttaagatggttaatgggttgctttgtacctcattcactgaggctgcaataatgcatggtcttcttgaagacgacaaaatttgggacaaaactctggcggaggcagctctgtcgcgctggccagatcagatgagatggctctttgtgagcatcctggtctatggccagccgagtaatgccatagaattgtggaacaagtacaacgaccaaatgtacaatccgcaaggcattattactctggcacagcataaagtagcagagcttgaagccctagccgacattgattggcggctgcacagctgctttaacttaagctgtgtgcattttagcctgccagacccgccaacttcaattgccaaaaatactgacgcggcaattgaagagttttttctttggcgatga

SEQ ID NO: 72686 - DNA, 404 bp, Heterodera glycines
  Genomic contig location: Contig_ID=SeqID_45387; Location=245..648; Strand=-
  SCN-specific regions: Sequence locations=1-11,33-56,86-180,252-357
atgaccaattctggcattcttcatccacaaaagtgagttgagttggataggaccggaatttttcttttttaatatatttaaaattggcatttttaatcgcttgtattattttcatcagcagcccactcatacatagtcttaattaaatcagtgatcagtgacaaatgtaaaaaaaattgcatttatataattagtgttaaaaaaaaatcattttttaaatcttaatatataaattttagtttaattttaaacattgaattaatgttaaatttgatatggatgaggttggattaacccgtgctgggtcgttttataaatccgccaacatggggctttcataaatccgtcactacaaagaattttttatctattaaaaaaataataataattgtatataaaataaa

SEQ ID NO: 72687 - DNA, 64 bp, Heterodera glycines; identical to SEQ ID NO: 51065
  Genomic contig location: Contig_ID=SeqID_45388; Location=457..520; Strand=-
  SCN-specific regions: Sequence locations=55-64

SEQ ID NO: 72688 - DNA, 59 bp, Heterodera glycines; identical to SEQ ID NO: 72149
  Genomic contig location: Contig_ID=SeqID_45388; Location=1116..1174; Strand=+
  SCN-specific regions: Sequence locations=22-59

SEQ ID NO: 72689 - DNA, 773 bp, Heterodera glycines
  Genomic contig location: Contig_ID=SeqID_45390; Location=189..961; Strand=+
  SCN-specific regions: Sequence locations=1-128,151-249,271-319,343 -359,413-680,702-721,743-773
  Gene Ontology: Mol. function=microtubule binding; Cellular component =spectrosome; Biological process=body morphogenesis (sensu Nematoda)
ttactatcaatcactaaacacttttggtatctcttataaattatgtctttttttatttaagtataccgaaaagtcgccgcgagaagtgtctatgaaaaagggcgacgtgctgacgctgctgaacgcgtccaacaaggactggtggaaggtggaggtcagcgaccgccagggcttcgtcccggccgcctatgtgaagcggattgagcccggctcacagcaccaccatcaggtgggaaagccgacatagctaaaataaaaaatcctaatcttaacggacaaccccgtttttggaattttatgagcaatttaatgagagaaattcccaaaattttcaaaaaataaccccttgcaaatgaatcaattataaaaataatttattttttttttaaaactatttcaataaaattaaaatgattcaaacacacaatcgatcagtggacctgtgattttcgagaatcttgaagccaacataatttcgatctcacttctcggccaaattttccataacaaagctgctttatttgtcaggcgttggccggccaaccgatgaacaccatcaatgccaagcagagtcagattgaggaccaatacaagcgcctgttgatgctgggcgagcagcgcaagcgcaagttggaggaggcgtgcaaggcctaccaggtgagtaaaacgacggttagatcattttttaaacaaaatgtttgtcaaaatcttgctcaaagcaatataattttaattttccacctgttttaagtgtgcgcgaagcaaacgatttg

SEQ ID NO: 72690 - DNA, 2147 bp, Heterodera glycines
  Genomic contig location: Contig_ID=SeqID_9791; Location=1372..3518; Strand=+
  SCN-specific regions: Sequence locations=1-366,388-510,557-558,583 -635,657-664,687-732,776-812,834-924,946-974,1000-1033,1055-1153,1175- 1199,1222-1328,1350-1885,1908-1984,2034-2114
atggctttttctttggtttctttgctccgtcgttttcttccgccataccatcaaaatttggtgtatgtcatttgcggtgcgcacattttgtacggctcaattgcattggcagtccgtaagtttatttgttagttttcattttaatattggaaagagagtgatcagcagctgaaaaataaatttttggagatatttgtaattaaaattatctaatgatgatgaaatttgcataaaaatttctgtcccccgtccatttgagatcagactttttgggtgctctcaacgcgcattttccccaccgcttttgacatgttcgacgacacgcgcaacagagtgatggactacgacaccatgtggaattggaccagcaggtgcctccgttccgccaattttttcaatattttatcacccgtttttatgttcagacagcagctggacaggtatcagaaccgactgaccatcagctgggtggtggcgacttttggtagtgattactaatagtattatgtgaaaatttgttttttattttaaaattatataattaataaattaaaatccttttcccttttcagatatttttatggccattttgtgcatcattccccaattttgcaaggtcgaggtgagcgagggcaacagagtgcaggagttggacttggtgagagggggcgggggaggaggcggggaaaaatacgaaacactctattctttttcattttgaatttaatttggaaattatttttatttatttcaatttttattgaaaaaattttatggtctccattttcggcttattatattataaattttacggttgtccaaaagaaaaagcgtttttttaatgtcaaaaaatttttcgcctggcgctaaaaatcgcaaaaatttggcagtttttagtgcaaatctgttaacaaattgcactcgaattttaaaaattttccccggcggcgcctaccggcaccgccggccttcgattccccaaaattttttggaaaaagcgcgccgccaaaaaaatggttttgttaagcagcaaaaaataataagcgataggtttgaatgagttggcaaacatccttgtttcgttggcaaactcaacgtatttttcttttcttggtaaattgaaagcttattaaacggaattttatgcgcatgcgaaaaaaggaaaacttttctgtgatgagcaaaaaaaaaaaaggtcgtcaaaaattttttgacccccccatcgtaaaaaaaattggccctggcgcaccccccctgcgccgatcgtacatcgtatggggtcggccctggcgcaccccttgtacatgtatgatactcatgtcttttatattgtatagctttcgtaattaaggtctgttgaatttttaaaataccctccaaggaacattcgacgaacattatttccttaaaattcaaaattgtccaataaatcccaagatatttggcattgattgtttttatccacctgtccttatttgtccttaataaagccccccccccccttagtgtattcgccgtcccgtcattgccaaactgatggccccgttgcttttgttggccaatttgctgttggccgcctgtttgggtgccgaacgatggtattgcccggctgaggaccgactgtttccactcccttttcgacggtgccatcaaagaggaggtgttcctgaccaacttcgagcgcgagttggaatgtgtcagtgacgaggacaaagaaggtgagtgacaagggtcaattaggcagggcactaattaacagctaatgaagcgaaaacacaaaccaagagtgcattttctaatcccctattagcaacagcgctttttgctaatcagattaagtaaatcatttattcaaaagtcattaggtgtaattaaattgacgcgacaaatttttcttaaatgttaaattccagtgtattaatttagcaaggatttatttatcaaatgcataatgcttagcttccaatggaacgaattttagtgctttaaaattataaaactttattttaaaaatcatatttatttatttttttctgcatattttccccgtctttaggcaccgatgtgtgggtaagtgtcgtcgtttaccgcaacaataatttttcagagtattaaatttggttaattttattttgtttaaatttgaa

SEQ ID NO: 72691 - DNA, 483 bp, Heterodera glycines
  Genomic contig location: Contig_ID=SeqID_45392; Location=151..633; Strand=-
  SCN-specific regions: Sequence locations=1-357,380-483
atgacttttggcggaaaatataatggggagagagataacgcaaaagtgagactgtttaatacagccccagtcatacaaaagaatttttgatgaagaagaataaagaagaattaatttaaaagagagtattaaggaaagagattaagacagagagagaacagagaacataatgatgaatctgcgtctcctaccaaaagattcagcgaagaagggaagagaattctcttcccatagcactctctattgaaattattttctctaccctccttcatcaaaaatattttgtatgactgggactgaaactcatttgtcagcagtctctcatttttacattatctctctccgtaaaatttaaactgttcaaataaactttaaaaaattatcgcaatttttatgtagatatttcagggctcgtatcgtccaaagtcggcttccaaggactggtatgccgatttgcaagggcataatggggaaaactcatga

SEQ ID NO: 72692 - DNA, 825 bp, Heterodera glycines
  Genomic contig location: Contig_ID=SeqID_45394; Location=540..1364; Strand=+
  SCN-specific regions: Sequence locations=1-79,101-179,222-576,612 -629,680-703,725-825
atgggtaggttttaggttctaaaaatgtgaaaataggtgccaaaaagtcccgaatttagggggtgtaaaatcgaaaattttctttaaaaagcaaaaatattatgccaaatcattaatgagatatataatcttaaaaaaaaattctcgtcaaaataaataaattttcgagatgattttttgagaaatttttaatttcttaggatgtattttataaaaattaaggtcgattcttagtggtgtattttttttaattttaggtcgattttagggttgtatttttcgtttttattgcatttttttgataatattttgcgcaaaacgccagaatagaatcaaataggttttacaaaattttttttggtttttaggctctaaaaataaaaatctagaaaataaatgccaataacttgaaaatagcgtaacaacaaccaaaaaaacttgtttttcgtgcgtttcaaaccatagaagctcagaaaaaaaaacagttaaaaacctaaaaatatcatccctagtaataaattggctttcggctctaaaaacccaaaataggcactaaaacctcaaatttagtagtgtaaaataacaaatttatgaaaaataaaacaaaataagccaaaccagtattgaacataattttttaaaatcaaaaatttgtcaagaaaataaataaataaaatttgtagacgaatttttgagaaactttttaggagtgtatattttaagaacagcggttgatttcgacactgagtgatttcaaccgtgtgatttcgacaatgattaaaaaattttcagtaaaattttctaagattttaagcaattttctta

SEQ ID NO: 72693 - DNA, 503 bp, Heterodera glycines
  Genomic contig location: Contig_ID=SeqID_45395; Location=340..842; Strand=-
  SCN-specific regions: Sequence locations=1-21,43-212,235-450,472-503
atgggggaggggagggcgtggcctttgttgttttgtttgctcagtcaagccgtgctcgcccacaacacattgtatgtgagtggccaacttgggcttgtgccggggaagtccgaattggtggcgggaggggtcgaaaacgaagcgcgacaggcgatgaccaatttgggtgccattctaagcgctgccggcacatcatttggcaacggttggcacttttagaagccaagagaaaggcacacccgattcagtggtcaaagtcaccattttgctggccaacatcgacgacttccaaacggtcaacggcgtgtacaaatcctttttcagcggggacactttccctgcacggagcacttatcaggtggcagcactgccgaagaacggacgagtcgaaatcgaagcggtggcaatcattgaggacacaaagcattaaaagaaatgaaagtgacgacggaaaaaatgcccaaacccaccccgagtcaaaaatcgagacatgtgtcaataaa

SEQ ID NO: 72694 - DNA, 312 bp, Heterodera glycines
  Genomic contig location: Contig_ID=SeqID_45396; Location=274..585; Strand=+
  SCN-specific regions: Sequence locations=1-143,166-312
atgctgcataatgggcagtattgctcgccgacaaatacgacgctgaatggagcattcggacggatgatgtcgacgcggaaatgggcaaaacgctggcttttgactctgagcgcagtacgcatccaatcgaggcaatttctataaattgatattatattgtaaatagagaatatttagggtcctattgataacccagatgaacttggagaaatttacgattcgatctcgtacgcaaaatcaaattcaatcattcggatgcgcttcaatcatttgggcgaagcgatttccaaaaggccattcgggattacttga

SEQ ID NO: 72695 - DNA, 635 bp, Heterodera glycines
  Genomic contig location: Contig_ID=SeqID_45400; Location=79..713; Strand=-
  SCN-specific regions: Sequence locations=1-132,189-635
atgtcaaaagtagagatagaatttttcgaatgtacggtaagagtaagggttgcgagcctctaagtcaatgagtatttttgcccattaaactatttattaattaaaaaagagggtgagaacagcaaaaagtgaatatatataaataaaaacatatattaataatatatatatatatatatatatatataggatagaaaatgtaattatatttagaacatattcaaatggacaaaaatttaatttgaaaagcaatgaaaaatgattagccaaccttggcttatcgtctttatcatttatcacaataatcacttggtcatttctttcttccgttttgaaatggcttcttaaattaaattcagcgagtcgtacacttcgtatttttcttctgcttctgcgtttaccaattttgtgctgctgcgggctatgaatccttgctgagtgttgcgcacaatgcttccgtcccgcgtgtcgcccagcagaaagccgaaaatgcccaattcgacggcgacgtcgccgggcacggccccctccaggggaccgaccaggaaattctgcaacattcggaatttggaagtggcaattttatgaacatatactttgcttttccaattattggtcatttcaacattaattaa

SEQ ID NO: 72696 - DNA, 117 bp, Heterodera glycines
  Genomic contig location: Contig_ID=SeqID_45401; Location=94..210; Strand=-
  SCN-specific regions: Sequence locations=1-117
atgtactacaaggaaccactcgcaaaacaaagacaagttacaaatcttgtcgaaacaattctttgccatgttgttgaaaaaatgtcttccattgaagtgagacgagtatgtgaagag

SEQ ID NO: 72697 - DNA, 2361 bp, Heterodera glycines
  Genomic contig location: Contig_ID=SeqID_9792; Location=263..2623; Strand=+
  SCN-specific regions: Sequence locations=1-61,122-178,200-210,232 -355,379-380,402-526,562-711,733-1015,1053-1253,1276-1326,1348 -1379,1444-1466,1674-1789,1838-1889,1912-1920,2033-2102,2126 -2143,2187-2299,2321-2361
atggtatatttacctttttgaaaattttcttaagctttttttaatttccgtgtcaaagcggtaaaataattttttttaatgttaatttttaaataatatttttttaatttatacaatttttgcacttgttgcttttttggccaaaaattgctcatcgccaaatgcttgacactcctcctatttatgagaaatttcagaaaaagccatggagcagattatttgaaagaaaaatatttgctaaaatgtggcatgccatcgaaaaaaaaaattaatttggcgcattatttttttaattctaccgagttttggctttttttaaattcaaaattgtctagaaaccgatgtacggctatgtttttctgaaaaagctttaaaatttcgaattaatttatttattaattcctctttttacagttccgcgtgtgtgccgaaaatgcgtttggccgttccgacccattgaacaccgacgtggaccggcccggcctcccagagggcccgatcacttatccggccacaacaaagtgagaaattttcaaaaatataaaatattttaaaaattttgcaccgaattttggaatggtgccaaaaaaatcggtgccaaattttgcattgcactaatttttttttaatttgactcaaatttaaaaaaaatttcagtgcatctttcttctctttttgatggtgacacaaatttaaaaacatagcaaacgaaaatattgacaattcaattttttccattaaataaaacggaaattgggtcagtggaaaatgcgtcagtgaatcagtatttctttaaattgagatacggtagtaatattactgaattataacttatttttaggaatttgtgaaagttttaattattttgacttttaaaaaattaattgaaaaattcagaacaaaaatattagaaaaattttgaccttttgtaatacaatacttaatgctacagtaactttattataaaaatactgtattactggcaccttttccactgacgcattttccaggagccaaaaatattactattaaattaattttcatttaaatatggcacaaaaattttcagcaaagaagtgtctgtgcaggggccaagtgttgtgccgttgaaatcgcagcgtgccaacgaaaaggaaaaggacgccatgcaaacccgaactcctaaaacggcacaaccttcgtctgcgcatggcatcggaccatccttgggtaagaaatgagtttggatggaaaatcttagataaaaggctttctttaccagttcggcatttagttcaaaaacgattatctgcttgtctctttttcaattttaatttaaaccgtttcattttttataatttttaattagttcaaaaaacagttaaacattttccacggacatttttaatttttaatttaatgataatttaattttaaaatatttgtactttaattatattatttcttcactaaaaaaggaaaataaaatttacttttttatcaaattaatattttcatttatttaaatatatattttttaaattatgtatatatttataatattaaatttatattaattttttaattttttaaaaataattatttcaaactaaagaaaataaattattgttttttttcaaattaaataattatatttcacataattttatatagaatatttttattaaaataatgcattttgtttcagactcatcagaccaaccattgtcctccaccgcccgtcgtcgccagccgcgcagacagaaaagtgccagaaaggatgccactgacatgcagtggttggtttaacaaaaaataataatttaaaaaataataaatttaattcatttattttttagttgtagcaagaatttaccgccacgccacaaaaacacggtgagcaaattcggattttttaaattatttattgggaattttgagaaaaattatttttttaaatttttataatgaactggaaaaaattttttttttaatgatgcatatttttgaatttttataaaatatttacaaatatttttttttgattttttttcaatgattcctcttctgttgatcatgtttccgctaaagcatcaatattcaaaatttttttctaaaattgatcttttttctttgtaaaatttttgctttaaattgtccccataatctaaacaaaacttttaaatatttaatgttttaaaaaatcatgaacaggagcggaccgcgtccggtggcggaaggcaacgcgttggcagcaccgcggcggaccggccggcacaggcggcagcagcggcttacgctggggacgaagaggcaccgaacgaggaggaagtggccgacagtgagggggagcagcagctgctcgacatgacgacggttgag

SEQ ID NO: 72698 - DNA, 1670 bp, Heterodera glycines
  Genomic contig location: Contig_ID=SeqID_9793; Location=2084..3753; Strand=+
  SCN-specific regions: Sequence locations=1-97,119-409,432-772,794 -845,867-916,960-1058,1094-1172,1194-1268,1290-1291,1342-1395,1417 -1551,1573-1606,1628-1670
  Gene Ontology: Cellular component=membrane; Biological process =extracellular carbohydrate transport
gacgacaacccaaaagatgacatcaacggagtgatcactggcgatctgctgattgtcatggcgcaaatcattgttgccatccaaatggtacggattttttgaataaatattttttcttagggggctcgacagcttgaaaaaaaattcctggtcctatccttgacttggggactaactaagacatggactttatttgacaaaaaagaatcacggtccataaaaaaaaccctggaggtagtctcaatttgtacataatcaagtcgatgaattttcattttttttttgcattcatttatacccaaaattctattaatttcagtgttttcacacttatattaacttttttatgtttttcaatttgtaataggcttaagaaaaattagtttgacgactccggctataattcgacatttttaaaataatttttttttctggggtttgaccaaaaaaagcaaaaaaaaaaagataatttattttattccaaattcctaggtttgggagcagaaatatctgatgcaatacgacgtgcctccactgctcgcggtcggactggagggtgggttttgcaattaaaatttttgaaatttcatttttttgttcatcaacaggcctttttggtatgattgtgctcggctctctgatggtgccaatgtattacatccgcgtgccggccaccttttccagagacccagaacatcgtaaaaaccgacaaaaaaattttccgaaatttaaaaaaaaaattttccaaggcctcgaagacgtcttccacgcatttgcccaaatccatcagaggccgatcattttggcaccacttttcctgacaattacgaggtggtgtggcttggttcacagcttgtctttgtgtttaccctgttttgagtgctttaaatttctttttccaagcctgcaaaatttcgaaaatttacattttgtttttcaaaaaagtggccacaaattttcataaacctgctttccctactgattgcgaacatttttgccatctttttgaaatttcgagagatgtcaaatgatttcgaattcgttcaattacacccagcataaattctaatatatatatataatattatatttactttccacagtattgcgttcttcaactttgccggtgttacggtcaccaaacgcctttcggccaccacgcgaatggcgcgttttttttataattaattttagagggcgggacataatttcgccaccgatatattttgccggtcgaaatttcgccgccgtattttttcttgaaatttatgatgaattagtaagttttttcaaatttttttaaaaaattgctaaaaaatttaattttcatataaaaaaattcttaggcgaaattatgtcccggcgaaatttgggatgcatccttaattttattcatccatttttgtttaatcaaatttggcttatctcgtcgcctattattgcaacaggtgcttgacagtgtgcgaacattgctcatttgggccttttccatcccattctttggcgagcggttcatccctctccaggtgtgctaattgtttcggaattttctggtgaatttgttgatgattaattttgggttaggcactgtcaatcttggagccaccaggaaataaaaataaaatttcgataatttttttgaaaattactgctccctgttccaactcccc

SEQ ID NO: 72699 - DNA, 954 bp, Heterodera glycines
  Genomic contig location: Contig_ID=SeqID_9793; Location=553..1506; Strand=+
  SCN-specific regions: Sequence locations=1-314,336-626,662-921,943-954
atggaaaacgcaaagatttcccttttataccaactcgaacaacggaaagtttcgaagttggagagagaaaacagagcattacgggaacgaatcaacggccttttggaaaagcaagacgatgagagaattgaacttttggtagctgacagaacacgggtactaaatatatacaacgaaaattactttaagtactttattttttagcgaaaactcgtccaactccgcgcaataactgaacggaccataaaatccttggaatcaggaatcaacgaatttagagcttttgtaaccgacataaatgaagcgtatgtttattttagttttaacaaaggattgtcgggaagaagtcagctcaaatcgacaaatttgttaagaatggatgaagaagagaataaaggagcgattcaaccgttgaaactcgtcgacattagcaatgaaagcgaccgcattcttcgcaatttctctcctaagcttaagcgaagtctgttttaagcttttgttacttgtgattccattctattctttttttctgtaactaattcagttcccgaatctccgatggttttgtcggcaatttcgacttccaaaagcggctcaaattcgcaatcagagtcattccgtacgggtttggaagaagaggaggaggaaagggcaaacggaatggaagaagttgttaacgaaacgcctcacttggacatgatggagacgagtgggacagggacggaagttgagaacgcgtcgaattccaaagggaagatcgaacagaggaagtcggccatcgcaccaatctgctcaatcactttgcgtcaacgatcgtccgcaatgaaatttgcaccctccgaaatgaagcggactcacagtgggcactatcacataaaagctgggaaaaaacaagagatcgacctgggaaacctgggtttcatggataatattttgacttgttatttcgagtga

SEQ ID NO: 72700 - DNA, 696 bp, Heterodera glycines
  Genomic contig location: Contig_ID=SeqID_45402; Location=114..809; Strand=+
  SCN-specific regions: Sequence locations=1-639,661-696
  Gene Ontology: Mol. function=signal transducer activity; Cellular component=plasma membrane; Biological process=invasive growth
atgcaaaagaacgcacctgaaccggaaaagctgacctcaaagcctatcgggacgcttaatgagactaaaaaaatggaagagacaaatgcgacaaaagcgggaaatcggagccaggaaccgttcatgaagcctactacgattgtcggtgaccattctaacgagacagaacatacgcaaaagccaattttgacctatacgccggaaccaagccctgaagacactgatgagccagaagagtcggacaaaacggaacagccaacgaccaaaaactccacttcagagccgatcgaaaattctacgacttccaccgatcgccatgatgagaccgaaacgtataagccaattgtgaccgaaacgactaaaatgccgagttccaaaccgatcgaaaagcttacaactaccaccgatgactatgatgttgagacgagtgaaagcaccaccgaaaaaaaggagaagatccgcagcggcaaaccgaccaaaagtaccagaaaaacgactaaaagcaccaagtcagtcacggctcatagcactgaaactctgaccaataccacaacggcatcggcaatgccggataatggcaccaccactgaaccgagtgaagggacggcactgccccccgagcaaagcactgcggcaaaatttattttcggctttgaatttggacgtattttttttaaatatttgaaagttggttaa

SEQ ID NO: 72701 - DNA, 725 bp, Heterodera glycines
  Genomic contig location: Contig_ID=SeqID_45403; Location=84..808; Strand=+
  SCN-specific regions: Sequence locations=1-529,563-570,621-725
atgcgcatcctcggcattggcattggcgtggatgagaaatgtgccgatgccacccatgcacagaagagacttcatgcgggtaatataaatggatgaaacaaagtgggagaagggagggatttggtatttccaccaaattaattttggattttgtcggatttatttggcttattttcacttttcaaattatttcgactatatttatttattttttatctcagtttgcctttttcagatggattggttggtcttcgctgcagacaatttgataacggcgcttccgcaggcgccgtgccgctgcgttcctcgctgaccgggcgcagtacgctcgccgttaatccctcgcataaagcgggtgccgttgtgccggtcgatcagtcagtcgttgctgtgccatcgtatgacgacgacgatgacgtaacacatcaattatcattaacagttgattgcataattaacatttatttaaggcattcttctcatgaatatgggaataaagaaacaacacacaaaaattgcgggtgatttgttatttatgccattttaattttgaaatttgttttttctgatgtaaaacagtttttcttgaaaaaagcaataatattccaaatcattccaaatggtaattttgatcaatttgtgcgtaatcgatgagcactttgaaagtctttgaaggaacaaatttggttctggaatattcccgcaagtcattaacaaatacacaa

SEQ ID NO: 72702 - DNA, 823 bp, Heterodera glycines; identical to SEQ ID NO: 45404
  Genomic contig location: Contig_ID=SeqID_45404; Location=1..823; Strand=+
  SCN-specific regions: Sequence locations=1-823
  Gene Ontology: Mol. function=receptor activity; Cellular component =integral to plasma membrane; Biological process=cGMP biosynthesis

SEQ ID NO: 72703 - DNA, 49 bp, Heterodera glycines; identical to SEQ ID NO: 60106
  Genomic contig location: Contig_ID=SeqID_45406; Location=449..497; Strand=+
  SCN-specific regions: Sequence locations=1-49

SEQ ID NO: 72704 - DNA, 471 bp, Heterodera glycines
  Genomic contig location: Contig_ID=SeqID_45408; Location=612..1082; Strand=-
  SCN-specific regions: Sequence locations=1-26,53-68,261-471
atgacacttcggccggaatttttggtaattttttgttaatttcttataatttgcattattgaattggcaaaaaaaaaactatttaattttgaaataatttaaaaattatatttaacttattattttcaaataaaaaaatatatataatataaaattctttaatgaaaaattaattaataattatatcatgaacattaaaaaatatatttatcaaaaatattctttaaataatttattttattatttaaataattttatttgtttttactttttcttttagctgagagttcttccaagatcaaaatccatgatggcgatgaaattccgatcactgaagaccctcctgaagcagtacagctaccaaagcaacatgatacgtttggcaatgatcaacagctgaaaaatgcgcaaatccgtgacgatgaccaattcccggatggacgaaatgccaaagtgatgacaaaaaataaa

SEQ ID NO: 72705 - DNA, 992 bp, Heterodera glycines
  Genomic contig location: Contig_ID=SeqID_45409; Location=254..1245; Strand=-
  SCN-specific regions: Sequence locations=1-20,42-156,179-611,641-992
atgcttgctggtaggaaactaagttgaagtgttttctaattttaaaaaaaaattccaggcctctacctatacttggaagagctgcagaaattggcaacttttcagtaccaactttttccagttcagtccccgttgaataactcattaggctttgacctgagcgcagggtggccagcagacttattgtagagctttggaagctcgattttctgaaatttaaaaatttcgaaaattttaaaaatttttcgagctaggcctaaaaaacggttttttggtttttgaattttaagaatttttaacgatttttcccagaaaaacgaagaccacttccaaaacatagtttttcgagctctatcgactggtatttttttcagaaaaatttcgattttttcccggaaatagaaaaaaattttggcctgagcgggacatttgagtcccgggcccataactcgtcaggagttggttttagccaaaaatgacctcagagcaaaattgtagagctttttaagctctatcgaatggtgtactacatgtttggaaattttcaaaaattttcgagctaggccccctagaaattttcgaaaattttttttgggttgaaaatgggggtcaaaaatatttttctggggttttttggggtgctgagcacgaatatgatgtttgtttttcgtttcatgatttttggaattttttaaaaattctttattttttggcaattttttggccctcgggattttgggcgaatatttgaaaattcataactcaatggaggactggtcaatttaaatgaattaaagctttaaaaatagagaaaaataaggagaattttatggggtttatttggttttataatgttcaaaagaaaaaaagttattccagaatttctggaaattttcgatttttcagaaaaaattcataactcggttctgtaaaggtgtttttgaaattttaaatacttaaaaaatccgcaattttttgctctattaaataaa

SEQ ID NO: 72706 - DNA, 829 bp, Heterodera glycines
  Genomic contig location: Contig_ID=SeqID_45411; Location=84..912; Strand=-
  SCN-specific regions: Sequence locations=1-829
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaagcaaaacgatataaccaaaatataaaggaaaaattaaaacaaaaatttttctccatcttcctttttgatactaaagcatcagagtgctaaaattaagttgtaaataaaatttggtgagctttagagcactttctgaaaaaaatatttatgaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtactggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggactgccccgaaaacaaaaaaaatcgattttttt

SEQ ID NO: 72707 - DNA, 1079 bp, Heterodera glycines
  Genomic contig location: Contig_ID=SeqID_9794; Location=798..1876; Strand=-
  SCN-specific regions: Sequence locations=1-175,197-202,261-319,367 -733,776-1079
atggaccttaacaatggtttttacgacagagaagaggacaaagtgaaattgaccatcgatctcacaactgttgatgaaccaaaagtggacaaattcaatttggatcaaagcaattcgaaaggcacactctttatggaaattgaaaaagtgtcggaatttgcgcgagaaataattggaagtgaacgtaaaagcgaaactgtgcacatcaaaggattgccatggaaaatatgggcaggaatagaaaagaaaaatgaaagcactgagaaaaatgagaaatggatgggctttttacttttgtgcgatgctccaaaagaaggtgtaaaattactaataattaatatatatattaacaacaattaattaattgatattgagcagaaaattggagccgcaaatgttcggcaaactttcgaattgtttcgcaaaagaacggagtgccggattttaaattagaattaaatgaccatgtttttgacaacaaagagaacaactggggattcaatttcatttcatttgctgtgagtgacaattaaacattcccttaattgaccaattatggggtaattaaggaactgatggacccaagcaaaggcttttacgaccaaagcgaggacaaagtgacattggccattgatgtcacagtgaaagaagcaaaacggaagacgaaacataaatgcccaatatgatttggggaaaaatgccattgaatatcctccatcctatgatgaacctgtttttttatttattaatttttcttgattatactttcaaaactgctgatatatgaattaattaattgtcggagctgttttagcagactctcatttttgagtaccgaatttcaatgataaacattttagtcataaacccaattcaaattttaccattttaggtcaatgtttacaattttttggacttggatttattgcattaattttgttaggatttacgtaaacatttttttaaactttttttttaaattgaaaccattcctaattgactgatcattttttccttttatttaagcagaattttttgggaccagaaatttgggaaccgggaagtttgggcttattaaa

SEQ ID NO: 72708 - DNA, 537 bp, Heterodera glycines
  Genomic contig location: Contig_ID=SeqID_9794; Location=1950..2486; Strand=-
  SCN-specific regions: Sequence locations=1-485,508-537
atgccattttcgactaatggacggatttctgatcgaaaaaagggcacacttttgatggacattgaaaaagtgtcggaatttgcacgagaggaggttgggagcagtcggtacagcgaaaaagtgtacataaatggacttccatggaaaattgaagcagaactaaatggactcgttgacagtgagaaatggttgagcatttatctattgtgtgatgctactgaaaaaggtgcaaattaactgttattaaatgctaattaacaacgatgagtaataatcattaagattcgctttggcgctgctgcgttcgttcggcaacttttcgaattatctcgcaaaaaattgggacggagaattcgattgggacattttgtgatcatgtttttgacaaaaaatcaaataatttgggattccctaatttcgtttcgtttgcggtaagtgccaattcaaacaaatattttaatttgacattcgtggaccagccaatattgaagttcatttatttatttgcctggtgtaaagaaatcataacaaaataaa

SEQ ID NO: 72709 - DNA, 1349 bp, Heterodera glycines
  Genomic contig location: Contig_ID=SeqID_9795; Location=71..1419; Strand=-
  SCN-specific regions: Sequence locations=1-92,126-329,354-471,493 -637,709-852,874-919,952-1349
  Gene Ontology: Mol. function=protein binding
atgtcaatggatcggatgaagcatttgttgagcacgggtgagcattcggatgtgcactttttggtgggggacggagacgcaaaagaggcgagtttaattaaaaataaaaatttaattttatttttcaattgcaatttcattaattatccacgttttttaaaggttttgccagcacatcagcttattttgaagagcgtttccgatgtttttgaggcaatgttccgttttgacgccattaattactgctgtctgattgtgagaccgaaaaacccttgactttagactttttttttgtaaaatatgttcctcaaaaaatgaatgtttttttaagtttgtcaaaagccaaacaatcattagagggcttaaagaaatctcggtcttctaaactcgaaaacctagacaagaaaaactcgattcttttctcgctttggcactctcagagaaagactacattttaaagattatttttcctttgaattttagaattttgccaattgttgtttggcttacattggcaaaaatgcggacactttgctcaaatcggatgcttttttgcaaattgaccaaaaattgttgtgcgaaattttggagtgtgacgaattgcaaatccgtggagaaatttcaatttggaatgcggtaattttaacaattaaatttaaaaactaaattttattagtcatttaattatttccattaaatttttttaaaggcactccgttgggccgatgaaaaatgccgtgaaaatggcattgattgttcagcagagaatcgccgtcaaatgcttggcccggcactgttcaaaattcgctttccgcttttgtcaaatgaggaatttacgaagaaaattggtaaaaaataagtcaaaatttcaaactcgttctctgatgagatgccgtaaaaaattcatatttttgtggcgatttttaaaaatgttttttaaaatttatttttcaataagttaatacatatttacagttcccttcggtgttttgtcaaaagatgaagtgatcagcgtttatcagttcaaatcccttccaaattgtcatgggatttccgacggaattttcccaatgcaatttccgactaatggacggatttccgatcgaaaaaagggcacagttttgatggacattaaaaaagtgtcggaatttgcacgagaggaggttgagagcagtcggtacagcgaaaaagtgtacataaatggattaccatggaatatattggcaaaaataaaaacgaaaaatggaggcactgacaatgagaaatggttgggcattttcatttgttgcgatacttcgaaaaaaggtgcaaaattactaatagttaatatatatattaacaacaattaa

SEQ ID NO: 72710 - DNA, 522 bp, Heterodera glycines
  Genomic contig location: Contig_ID=SeqID_45412; Location=24..545; Strand=-
  SCN-specific regions: Sequence locations=1-522
atgagcgctaaaattatcagagtgccgaaaatcgcatgtgatctaagcctagcaaaaaatggtgtaagtaaaaatcgtaattacgctcaaaaagcttctcaaacaattttagcgcatccaattccttctacaatcgcctttatacatcccattatgaacgctaaaattatcagagtgccgaaaatcgcatgtgatctaagcctagcaaaaaatggtgtaagtaaaaatcgtaattacgctcaaaaagctcctcaaacaattttagcgcttccaattccttctacaatcgcctttatacatcccattatgagcgctaaaattatcagagtgccgaaaatcgcatgtcatctaagcctagcaaaaaatggtgtaagtaaaaatcgtaattacgctcaaaaagctcctcaaacaattttagcgcttccaattccttctacaatcgcctttatacatcccattatgagcgctaaaattatcagagtgcagaaaatcgcatgtcatctaagcctagcaaaaaatggt

SEQ ID NO: 72711 - DNA, 762 bp, Heterodera glycines
  Genomic contig location: Contig_ID=SeqID_45416; Location=81..842; Strand=+
  SCN-specific regions: Sequence locations=1-190,214-762
taattaaatccattccttcggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaatataaggaaaaatttttttaaaaattttttctccatcttcctttttgatactaaagcatcagagtgctaaaattaagttgttaataaaatttggtgcgctttagagctctttctgaaaaaaatatttatgaaacaaaaaaatcgattttttcaagtgtccgtttagggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggtgtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcataaatccaacgcagaattaaagtacaggctatagggaagctattcctgaaggattcggtc

SEQ ID NO: 72712 - DNA, 650 bp, Heterodera glycines
  Genomic contig location: Contig_ID=SeqID_45419; Location=498..1147; Strand=+
  SCN-specific regions: Sequence locations=1-43,65-109,132-262,309 -343,379-404,433-548,572-650
atggacgcgatcagtgaggaggaactgatggcacagaatgccgtggaaattgccaggtgggggcgtcatggcaaaattatttgatgcggatctcggcttttatagcccgaaaatcattccatagaaatctatttttcggcatttgttatgctcctaaatgaatgacggcgtccttatttgcattttgtacaatttggcccatatttagggcactattttgggatttttttccgattaaaaaattaaatagccttttctttgcatataatttttaaaaaaatctaaattttgaatttaaaaaaataaatcaaaatcttttaaacaaagaatatcaaactactccaattttttaaaaataatgtaaaaaaatgaaaaaaaggagatgaaaatttcaagacttttggatttttttttgataattaataataatttggccagaaaaaatggatcaaaatttgtaattgcctaatttggaatccatttgatcgttcgtgtccagagagttgcaagcaatccgtggcctcaccgactcgtccgattctggtgtacatcttcaacagcaacaacagcacgagttgcaactccgtcatcgccgtccgttcccagcccaacaacaaattcatccaaacggtgcaaatggagggatttaa

SEQ ID NO: 72713 - DNA, 162 bp, Heterodera glycines
  Genomic contig location: Contig_ID=SeqID_45420; Location=435..596; Strand=+
  SCN-specific regions: Sequence locations=1-23,45-132,156-162
cgcgtttgttaaaactgccaatgggtttgaaaacaaaaaatgggtaaaataattaaattaatagcttggctcaaattcaaccaaattaatatttcgtggtatcattcaatagctttaattgttctctttcagaatataattttcctaaatttttaacttaag

SEQ ID NO: 72714 - DNA, 163 bp, Heterodera glycines
  Genomic contig location: Contig_ID=SeqID_45420; Location=849..1011; Strand=+
  SCN-specific regions: Sequence locations=1-1,25-118,140-163
cttaagttaaaaatataagaaaattatattctgaaagagaacaattaaagctattgaatgataccacgaaatattaatttggttgaatttgagccaggctattaatttaattattttacccattttttgttttcaaacccattggcagttttaacaaacgcgc

SEQ ID NO: 72715 - DNA, 269 bp, Heterodera glycines
  Genomic contig location: Contig_ID=SeqID_45421; Location=768..1036; Strand=-
  SCN-specific regions: Sequence locations=1-54,76-176,267-269
gcatccgtttgacaaatacaaaaagaaatttgaagaacgggaggtgagtttgaagaagcaatagaagttgtagataaatttttgaaatgtatttatagtcacataaggaggatagcacgccacaacgggaggagagcttcacagtgccaaaggtggaggtggaacagcccaaagttgaggaggaagaggcggcagcggaagaggaggtggaagaagaggaagtggaagaggaggaggaagacgaagaggaggaagaggaggaagagtga

SEQ ID NO: 72716 - DNA, 199 bp, Heterodera glycines
  Genomic contig location: Contig_ID=SeqID_1328; Location=2819..3017; Strand=+
  SCN-specific regions: Sequence locations=1-199
atggaccagaaagagactctaactgctgaacagttgcagaaagtgctgttggatgctgagaaaagcggagaatattcatatgaagaacttcttccaatttgggaggaggcgaagggaatgattgaaaacgaagagcaaatggtttcactgtacacaacgtttatttatatgtcgaggcgcttcgccgaaagggaaaaaa

SEQ ID NO: 72717 - DNA, 1575 bp, Heterodera glycines
  Genomic contig location: Contig_ID=SeqID_1329; Location=1023..2597; Strand=+
  SCN-specific regions: Sequence locations=1-491,513-557,579-627,650 -1044,1067-1132,1155-1209,1232-1435,1458-1514,1567-1575
atgcattttcagcgatatgaaattttctctgttactcgcaaaaggccaattccatttaaaccgtaagcaaattccttttcgacttaattttgtttaaaaagtgtccaaaatttagcccacaagtggttcagaggcatgtggcagaagggctattcgtggccatcgttttccagcgaaaattggttcgttgtccatggagagcagaattaaagataaacaaaacgggcggtttgcgataacgttaaaactgatcattgttggcttaagcaaactatcacctgtaatttttttttttttgagtggagcccagcttctccaatattactaaacgtttaacaaaaccatggagtttttctatgatttttttcttgttaatgcattgtcttggtgattgtcccattgtgctttcagcaccggatgtccgcctccgattgtgacggatcatgccgttaatcaacttcgtaacatatggacgcgcaaattgaacattcttaagtggatggccaattcagacaataccttggtttgacaccgcaaaaaataaagcaaccaaccgaaaaatttcaaaataaatttgtaattttagaaaaatgcttcttcaagagatgctgatattttgtcatacgagcagttcgacttgttcgttgcggacttagatgaaagtgatttgttcaatgtgactattttttaaatttttttcatttgcttttttaccttctctactcagatggcaagagactaccagattggcaatcatcaccttagcgcaggcatgtttccaaaatcgccattcacccctccgccgcgcggaaaaataatcctaccgaatcaacggttcatgatctctcttccctgtcgccgagtgccagacggtgaaattctccatgtctggtttttagtggatattggtaagcacccatttgttatcaacatgtcttcataaaactgcaggatcaccttacaccgctgtgtcatgtacaacactgtctgctctttacggcaacagatcggaacccgtggaccacttttttctgaatatcttggtatttttatgtttatttaactaaaaaacataattgaactatgtttacatatttacccgaaatggccgcaaatcaactatttttagcaattcactatttaaaaattttgtcatgcaattttttacaagatctttttcaaatttgtacgcagtttagctcttctttaaaacatgaaatattttggtgtgttttaaggacccacacattaatattggatgtcaaatatcgagaggacatttttccgatcttaatttgttggggacaaacactctggaagcacttcaactcacacccgtcgctgactggggcaataagacttttgtcttagacaaaatgtaattttttttttgataattaaatcgaaaatgacatttttagtaagctatcaatttttgggcgtttttatgttgttggatgatgtacgaggaaaagaagattatttaattttgttttggcgattttggcatttcgttaaaaaaataatttttaaacaattttcatcttaaaaaatatatatttttatctctataaa

SEQ ID NO: 72718 - DNA, 272 bp, Heterodera glycines
  Genomic contig location: Contig_ID=SeqID_1329; Location=568..839; Strand=+
  SCN-specific regions: Sequence locations=1-96,118-272
tgtcactctcacagatggaatcagctcgtacattgtcacagtgtttgagtgaaatggcgcgacacgcgaacaatgaaacggaaccacaacgaaatgtcattaaaaggaaaaccagctgttcgtctggtgatctacaacagaatcagccaagctttgcgtcagaacaaatggatgacaatgacacggcctaacacaactttcatggatcatttgatctattgttaattcgttccttctccgttgcgaatttgagcaattcgaatttctaatct

SEQ ID NO: 72719 - DNA, 3662 bp, Heterodera glycines
  Genomic contig location: Contig_ID=SeqID_1329; Location=1209..4870; Strand=-
  SCN-specific regions: Sequence locations=1-758,798-1161,1185 -2027,2050-2260,2335-2391,2414-2617,2640-2694,2717-2782,2805 -3199,3222-3270,3292-3336,3358-3662
ctaatcattcacaacatttacattccaccaaacagcagctgcaacaactcaaaaccaaacatcaacgggttcctctccggcaaccaggacacactcatcgttggcgatttcaatgcccaccacactacttgggacgcaatatcccccgaagacgagcgcggcgtcgacttcgcagaatccatcgaccaacacccatttgtcattctaaatgacgaagacactccaacccgtgtggccccccgcggcaattccactattctgtcatccccggacatttccctcatcagcgactcgctcgccacttcaacaacctggaaaacaacggcagctcttggtagtgaccatctaccgatcaccatttccatccaaggccaaatctaatggagtcacaccccacgtcgcactttcatcaatttctcaaaagcaaattggaacaactttgctgacgaagtcgactcactcctaaagaccctccctaaaccaacgaacattgtccatggcgaacgacgcctccgctcggcaatcctgactgcacctgcccatcacatcccggccggtcgcataccgaaaattcgtccctccttccccagcgacatggtccacttggcaaatgaacgcgaccatctccaactcactgatcccgccaaccacagaattcacgatttgacaaacactatcacaaagcgtgtctgccaatttcgccgtgaaaaatggctagaacacctcaaacgttgtcctcgcaatagcagacaattatggaaaacaataaaaagcctcaacaacaacaccaaagaacaaaacattccccttcattttaacaatcttccatgttatgacaactcaaaggcggcctccctcctaaatgccgcattccatccccgcccttctggccgaccttcaaaagtcaaccgacaagcaaatcgacacatcgacaaagccatgcgtaattccgcagaatttgcttcatggacggccaccacagtccagttggccataagtaacaccaaaaactctaccgccttaggtcccgacaacatatcctcatcccacattcgtcacctcggacctgtcgccgtcaaatacatggccgacctcttcaatctcaccatcacatcaggcatcattccacaactatggaaaaatgcccgtgtcattcccattccaaaacctggcaaagacacaaccaacccgtcaaactaccggcccatctcccttctatcaccagtggcgaaggttctcgaaagactccttcttccccacctcaacgcacacctcccaccccccgccaaccaacatggcttccgtcgcggtttctctacagtcactgccctccattcaatccacaaatacatcacagacggactcaaccgacaagcaccagttgaacgatcggtcgcggtctcccttgacctctcaaaggcctttgacaccgtagaccaccgcctcctcatccacgacatctcaaacacaacacttccccctatcatcaaaagatggatccgcaactaccttggtggccgccaagctcaagtcgttttccgaggcaaaacctcctcccatcgcaccatccgcatgggtgtcccacaaggcagcgtcctctcacctgccttatttaacttctacaccgccacaatccccattcctccaccaggaattcacatcgtcacctacgctgacgacatcaccattctggcccgcgcaacctcaatcgcaatcgccagcgataaaatcaacgccttcctcccaacaagatccgcgtattcacaccattgacggccctatcccattcctgtgcaacccaaaactcctcggaattaccttcgacccactcctcacattcaatgcccattccgtggaacttcgatcaaaaatccaaaaacgcaacaacatcctccgggctttggcaggaacaacctggggacaatcaaaagaagtactcttgaccacctacaaagccatcgctcgcagtcttctcaattatgcagcaccgatttggtccccccaactggccgactcaaattggtccatcctccagagatgccagaactccgcccttcgcacaattacaggatgcgtttccatctcctctgccgaccacctccacgcggaaacatccatactccctgtaaaggaccacaacttcctcctctcccgccaattccttctggccactcggcaacctggtcacccctcctacacatccggcgaggagaaagtggtcacaactttttaaaaccgtcaacccaaaagtcaattttggtttaaatgtttattttatagagataaaaatatatattttttaagatgaaaattgtttaaaaattatttttttaacgaaatgccaaaatcgccaaaacaaaattaaataatcttcttttcctcgtacatcatccaacaacataaaaacgcccaaaaattgatagcttactaaaaatgtcattttcgatttaattatcaaaaaaaaaattacattttgtctaagacaaaagtcttattgccccagtcagcgacgggtgtgagttgaagtgcttccagagtgtttgtccccaacaaattaagatcggaaaaatgtcctctcgatatttgacatccaatattaatgtgtgggtccttaaaacacaccaaaatatttcatgttttaaagaagagctaaactgcgtacaaatttgaaaaagatcttgtaaaaaattgcatgacaaaatttttaaatagtgaattgctaaaaatagttgatttgcggccatttcgggtaaatatgtaaacatagttcaattatgttttttagttaaataaacataaaaataccaagatattcagaaaaaagtggtccacgggttccgatctgttgccgtaaagagcagacagtgttgtacatgacacagcggtgtaaggtgatcctgcagttttatgaagacatgttgataacaaatgggtgcttaccaatatccactaaaaaccagacatggagaatttcaccgtctggcactcggcgacagggaagagagatcatgaaccgttgattcggtaggattatttttccgcgcggcggaggggtgaatggcgattttggaaacatgcctgcgctaaggtgatgattgccaatctggtagtctcttgccatctgagtagagaaggtaaaaaagcaaatgaaaaaaatttaaaaaatagtcacattgaacaaatcactttcatctaagtccgcaacgaacaagtcgaactgctcgtatgacaaaatatcagcatctcttgaagaagcatttttctaaaattacaaatttattttgaaatttttcggttggttgctttattttttgcggtgtcaaaccaaggtattgtctgaattggccatccacttaagaatgttcaatttgcgcgtccatatgttacgaagttgattaacggcatgatccgtcacaatcggaggcggacatccggtgctgaaagcacaatgggacaatcaccaagacaatgcattaacaagaaaaaaatcatagaaaaactccatggttttgttaaacgtttagtaatattggagaagctgggctccactcaaaaaaaaaaaaattacaggtgatagtttgcttaagccaacaatgatcagttttaacgttatcgcaaaccgcccgttttgtttatctttaattctgctctccatggacaac

SEQ ID NO: 72720 - DNA, 319 bp, Heterodera glycines
  Genomic contig location: Contig_ID=SeqID_1329; Location=2797..3115; Strand=+
  SCN-specific regions: Sequence locations=1-25,48-319
gcatcctgtaattgtgcgaagggcggagttctggcatctctggaggatggaccaatttgagtcggccagttggggggaccaaatcggtgctgcataattgagaagactgcgagcgatggctttgtaggtggtcaagagtacttcttttgattgtccccaggttgttcctgccaaagcccggaggatgttgttgcgtttttggatttttgatcgaagttccacggaatgggcattgaatgtgaggagtgggtcgaaggtaattccgaggagttttgggttgcacaggaatgggatagggccgtcaatggtgtgaatacgc

SEQ ID NO: 72721 - DNA, 145 bp, Heterodera glycines
  Genomic contig location: Contig_ID=SeqID_1329; Location=4231..4375; Strand=+
  SCN-specific regions: Sequence locations=1-145
gatcagtgagttggagatggtcgcgttcatttgccaagtggaccatgtcgctggggaaggagggacgaattttcggtatgcgaccggccgggatgtgatgggcaggtgcagtcaggattgccgagcggaggcgtcgttcgccatg

SEQ ID NO: 72722 - DNA, 3423 bp, Heterodera glycines
  Genomic contig location: Contig_ID=SeqID_1331; Location=1..3423; Strand=-
  SCN-specific regions: Sequence locations=1-53,79-292,315-929,952 -1121,1143-1409,1448-1603,1625-2016,2038-2263,2285-2508,2530 -2663,2691-3027,3051-3181,3204-3423
  Gene Ontology: Mol. function=DNA topoisomerase type I activity; Cellular component=nucleus; Biological process=establishment and/or maintenance of chromatin architecture
gtgtcacttggtccagcgttgactgttcctcgtcctcctccccatttcgcccttttctttgtccatttttgccacttttctgtcctcctccactgtgtgccattctctcttcggttaatgttttggcagacagaacttcgaccagttcgtcgtcctccgcttgtggcgattgcctccgtgacgtaatgacaatgcgccgctcctccgccaacgaatgattacatttgttgctggttgcacagctacaaccgatttgtccaaaaattaatacctaattatagaatctcaatatttttgttgttattgcttttctcaccactttttttgcggcttccgccgttgtgcaaaagtgagaagtgcgccttcggtgtccgcactataaacatcaatgccacttctgaaatcggaaccgatccaaatgtcatctttgtgaacactcccacctcatggccaatattcgcgccactttccgtccattcacttccccaacactcatttcagtggaatttgtcgagttcgctgttgttgaaatcgaactttctttgccattgtaaattgaagcggcactgacactttcaacaagattttcatcctccttttcaatgccttccacttttaaattggcaaaatccatgtcactttcgacttggaccgatcggtcaacaaatttgcaatatttttcctttccaagcgaaaaggcatcgatgaattggaattcgagtacattcttccgcgtcgtattggcaacatcggttttctaattttgtattttatgtattaattaattatttgctaattctcttttaccattttatcaatgttcagttcgtttgctttctgctctttcaaactgatcacttcaatcgattcagcgcattcattcaatgctttttctttaccattcgaatttggcatttctgaaggaaacctaattttataatttataataatgaggtttttgcctttttctttttccaatttatcgtcagactttttttttggttgtttttccaaaatcgaaagcagagtaaaaggttttggttcactgccaatttgtccacttaaaacgcaactaagctcctcctgaattactgtaaatatcataaattgagaaatgcttaattttttatttattataccttcaattgagcatgaagttgtctaaaagcttttacaattggaaacagcaacgtatcattatcagtttgagagtctgttagcaattggtcatcgtccaacaaaacgttaatcaaagctggatccaaattggaacataaatttgtaatacatcggcgaatgctttgttcatcactcatttgtgtacggcggatttggacttaaagctcaaacagagggaaaaggaatgcggtaattgtcagtttttaattttgggttggtgccagacgtacaaaataatttcaattttaaatttaatcaataaattattgtggcattttgtctgtctttaagctttttcgtgctccgtacgtcgtccgcagtttttttacatattcagtttcatttgcgtagcttgttctttaacttagctttcgtgagtacttttactgtttaatcgatcgtaattgtctctctgaattacctaattcttttcttcattttctttgttacaagaattttttttttcatatttaagttttttttattaccgtaccccccttttaactattattgtattgtaatttctgttgtcctgccctaatatggcaatgatggctgaggcaaatggagagaccccactgttgaatggtggtgacctaatggactcgaattcaagccaagaagggtcctccattggcacgggcaccgaaaacggagtatttttccataagatttttgagtcacgaatttttattgtattttttagttgtccaattcctcatctgaagctgctgttattaacaatgagcaccagcaaaatggtgggaacaatgttcctgcaccaaaaggaggacaaagtgaggggaccgacttggacaatgttccatggggcgaacggatacgcgacaccacggggaaacggtaacgaacattttgagcgcttttttatatattaaaagaattgcctttttatggtaacatcacttgaaaacaaaccaatttaagaaaagaagaaaccagcaatgagaagaaaaaggagaaaaaagctgaggaagttatgccgaaaaagtcaaaggagtcgacctcaaaaagtcgaaaaaagaacgaaagcagcggagaggaagaagactttgacgacgactccgacggggaagaggaggaatatcagccaaaggtaaggcgaagagaaggaaaacggatgaaaaaggatgacatacttcagaaaaagaaacaaaagtcggacccatccccggcgaagaaaagcgacagcaaaaagtcaacgaaaacaacaaaagttactaaggtggaggtcaaggaagagagcggcgctggggttgagcacaagaaacggaagacaacgaaagttgaagtgaaggaagaggtcagtcggaagaagaagcgaagggaaacaatgggagggaagggacactcaaaagtagagaaaaagcattctaatttccctggaatattatttgtttaaccctggtatttttggacatttccagccctcctcttcccagggaagtccgtccaagaaacgtgtgaagaaacaggaggaagaagaggaagtgtggcgctggtgggaggaggacgagtcgaacgcgggcgcctccgatgggtccatcaaatggcaaacgcttgtccacaaagggcccgtctttgcaccggcctatgtgccattgccaaaacacatcaagttcaaatacgacggaaaggtatggtggaattacaacttaaaaccaaaatttgatatgggagttttttaaggagatggatttgtctttgccggccgaagaagtggcttccttttacgcgaaaatgctcgaccacgactacacgtcaaaaccggtgttcaaccagaactttttcaaggattgggtcaaagtgatgacaaaggcggagcgaggcgaaattaaagatttggccaaatgcgattttaggtaaacaaaaaaaaaataaaaagacgagagattttgtaactttacatccattgaaaggcaaatgcacgctttttacgtgtcggagtcggagaagcgcaaagcgcgcagcaaagaggagaaaaaggcggagaaagaggagaaggaaggcgagggaaaggtgtacgggttcgccatgttggacggatacaaacagaaaattggcaacttccgaatagaaccgccgggactattcagggggagaggtaatttgagtgaaataagagaacgaagaggaaagcgagacttgttgatgaacaggtgaccatccaaagatgggttctctgaagaaacgggtcccagccggaggatgtgggtcatcaactgc

SEQ ID NO: 72723 - DNA, 995 bp, Heterodera glycines
  Genomic contig location: Contig_ID=SeqID_1331; Location=2509..3503; Strand=+
  SCN-specific regions: Sequence locations=1-601,624-837,863-995
atgccaaattcgaatggtaaagaaaaagcattgaatgaatgcgctgaatcgattgaagtgatcagtttgaaagagcagaaagcaaacgaactgaacattgataaaatggtaaaagagaattagcaaataattaattaatacataaaatacaaaattagaaaaccgatgttgccaatacgacgcggaagaatgtactcgaattccaattcatcgatgccttttcgcttggaaaggaaaaatattgcaaatttgttgaccgatcggtccaagtcgaaagtgacatggattttgccaatttaaaagtggaaggcattgaaaaggaggatgaaaatcttgttgaaagtgtcagtgccgcttcaatttacaatggcaaagaaagttcgatttcaacaacagcgaactcgacaaattccactgaaatgagtgttggggaagtgaatggacggaaagtggcgcgaatattggccatgaggtgggagtgttcacaaagatgacatttggatcggttccgatttcagaagtggcattgatgtttatagtgcggacaccgaaggcgcacttctcacttttgcacaacggcggaagccgcaaaaaaagtggtgagaaaagcaataacaacaaaaatattgagattctataattaggtattaatttttggacaaatcggttgtagctgtgcaaccagcaacaaatgtaatcattcgttggcggaggagcggcgcattgtcattacgtcacggaggcaatcgccacaagcggaggacgacgaactggtcgaagttctgtctgccaaaacattaaccgaagagagaatggcacacagtggaggaggacagaaaagtggcaaaaatggacaaagaaaagggcgaaatggggaggaggacgaggaacagtcaacgctggaccaagtgacaccaatcccaacaactttggaactgagcaattccacatgatgaactaacaataagttattccacgttaccaattaaagtgta

SEQ ID NO: 72724 - DNA, 722 bp, Heterodera glycines
  Genomic contig location: Contig_ID=SeqID_9796; Location=1760..2481; Strand=+
  SCN-specific regions: Sequence locations=1-257,280-287,309-309,341-722
atgtgctcgtatacaatgtttctggcgatgtgtctgctgttcgcagcggtgactttggcaacttcaaatggcagcgaagaaataattgccgacgcaaataacggagacttggcgatgactgtaagggttgttgttgatctttggctgagctttttttggccatggttattatccatattaaaaaacgacaaaattttgcttgtatacaaaatcaaaattggcggtaattgcccaattaaaatataattacaaaacacaaataaattttctttaatttaacatacctacataaatgttttgagtttaaacaaaaaaataaaaattttattttttattttttcaggctgtgaatgcaactcgtggaatgcgcttgaagagatatgcttcgtgcaacacccatttgagcttgtgcaaccagttcatgtgcaaccaatgctgcaatggatgtaacagttttggatgtttcggttttatgtgcagcgattgctgcgcataaaggggatcaaagccggcgggctcggaaatccgctgctgagcaacagagatgaaaacgcaatgacggattacagtgttttttggcccccctcctcataattatggactttacggattgtctccatctttaaaaaaatcgtccctaatttcggattacagtatttccgttcttgaaaacccaataataacaaatgacaccaaaaggtccataatttttggtgaattta

SEQ ID NO: 72725 - DNA, 393 bp, Heterodera glycines
  Genomic contig location: Contig_ID=SeqID_45422; Location=266..658; Strand=-
  SCN-specific regions: Sequence locations=1-393
gtactgaagaagacttattcgcagatttatggaaaaacctcctgatacccatgaagccacaaaagttagcaataaattacgaaagacacggaataaaacgcgaaaattggattcatcaaaatattcataattttgacaaaagtttattaacgacaagcttaaaagctgaagatgttagcagtgagcgtcaaaatgaagaagatattaagccaaaaatattagaagaaatcaaaaaagagacattttcggacgaagaacaaaatgcaatgaatgtaaggacaaaattaaagtttccaaaaaaagaaatatacgacgaaatgatcagtgatggcattgacgagaaacaagccggtgatcagagcaattcgtgttcttcaaaaactgacgatttgg

SEQ ID NO: 72726 - DNA, 687 bp, Heterodera glycines
  Genomic contig location: Contig_ID=SeqID_45423; Location=83..769; Strand=+
  SCN-specific regions: Sequence locations=1-508,562-687
atggcctcggcacaccaacagccgtttttggaggcgccgaacgacaaaatgtccacgccgctcttccaactcatttcggccgccgtgcagcccaaggcggccatcggaaaacggggggagacattcaatttggatttgaataaatgtaatataatttagattaccaaaacaatgttggctaattgtgttccttacaattattttatttttagaaattttcgaaataattcttgataattcattttgccttttctgcccattttccctcaatatttcctcggtttctcactgcgtttgcgaatcgcgccccgtccatgtgcaagggaatgccatgcgaatgcgcaatgttcgcaatacgacggatctgtgccaatgagtagagcgtgccgctctccgtgctttgggtgatggacacagccatagggcggcccgcgtgcacagacacgggatttggcggatagcgttggattgcctcctctaatgcctaatcaaacaaataacaatttacaataatatttaaatgtaattaaattattttacgaaaattaataaaaataaattctttcagtatgtacttaatattagccagtaatcacttatacttaattatctcctaattaaccactaattacttatatttggttatcccctaattagggccactgatcacttgtacttaattatcca

SEQ ID NO: 72727 - DNA, 1222 bp, Heterodera glycines
  Genomic contig location: Contig_ID=SeqID_45423; Location=1..1222; Strand=-
  SCN-specific regions: Sequence locations=1-115,138-579,633-1222
aaaatgatcaatctgagctccgacaattggaccgggtgccattcggccatttcggacgcactttcgcgccattccaccggggcggacgccgcgtatggcgacagtgagctggacaagaaagttgagaggagattctgcgaaatttttgagactgaattggctgtttttctggttgggacaggtgtggccaaattggcacttttcatggctaaattcccactttttgccccaggcaccgctgccaatgcgttgtcaatggcttatgtgaatcgcgcgggtggcatcattttcgcgcatcggcatgcccatctgattgaggacgagtgcggcgcgcccgaatattttacgggcggcgccaggttggtcggcgtaagcggtgccgagggacgcattgagccggaagtaattactggctaattaggggataataaatctgttagtggctctatttattggataattaagtacaagtgatcagtggccctaattaggggataaccaaatataagtaattagtggttaattaggagataattaagtataagtgattactggctaatattaagtacatactgaaagaatttatttttattaattttcgtaaaataatttaattacatttaaatattattgtaaattgttatttgtttgattaggcattagaggaggcaatccaacgctatccgccaaatcccgtgtctgtgcacgcgggccgccctatggctgtgtccatcacccaaagcacggagagcggcacgctctactcattggcacagatccgtcgtattgcgaacattgcgcattcgcatggcattcccttgcacatggacggggcgcgattcgcaaacgcagtgagaaaccgaggaaatattgagggaaaatgggcagaaaaggcaaaatgaattatcaagaattatttcgaaaatttctaaaaataaaataattgtaaggaacacaattagccaacattgttttggtaatctaaattatattacatttattcaaatccaaattgaatgtctccccccgttttccgatggccgccttgggctgcacggcggccgaaatgagttggaagagcggcgtggacattttgtcgttcggcgcctccaaaaacggctgttggtgtgccgaggccattctcgtgttcaacgacttgcagcaggtgatcagcgacggcacttctctttcgcatggcttttgagcttccaaatatcccttt

SEQ ID NO: 72728 - DNA, 56 bp, Heterodera glycines; identical to SEQ ID NO: 52733
  Genomic contig location: Contig_ID=SeqID_45425; Location=675..730; Strand=+
  SCN-specific regions: Sequence locations=1-56

SEQ ID NO: 72729 - DNA, 922 bp, Heterodera glycines
  Genomic contig location: Contig_ID=SeqID_45426; Location=11..932; Strand=+
  SCN-specific regions: Sequence locations=1-158,180-922
gacttcaatcactagggactctattctcctgcttttcatcacctggactcagtttttatgcattccaatcactgggactcattctcctgcatttcaatcactgggactcaaccctccagcagttcaatcactgggactcaatccaccagcattccagtcactgggattctgttctcctgcattccaatcactgggactcaattctcctgcatttcaatcactgggactcaaccctccagcatttcaatcactggtactcaattctcttgcatttcaatcactgggactcaacacaccagcatttcaatcaccgggactcaattctccaggacttcaatcaatgggactcagtttttatgcattccaatcactgggactcattctcctgcatttcaatcactgggactcaaccctccagcatttcaatcactggtactcaattctcttgcatttcaatcactgggactcaacacaccagcatttcaatcaccgggactcaattctccaggacttcaatcactgggactctactctattctccagcattccaatcactgggactcaacacaccagcatttcaatcaccgggactcaattctccaggacttcaatcactgggactctactctattctcctgcgtttaaatcacccggactcagtttttatgcattccaatcaccgggactcattctcctgcatttcaatcactgggactcaaccctccagcatttcaatcactgggactcaatccaccagcattccagtcactgggactcaacacaccagcatttcaatcaccgggactcaattctccaggacttcaatcactgggactctattctcctgcgtttcatcacccggactcagtttttatgcattccaatcaccgggactcattctcctgcatttcaatcactgtga

SEQ ID NO: 72730 - DNA, 128 bp, Heterodera glycines
  Genomic contig location: Contig_ID=SeqID_45431; Location=327..454; Strand=-
  SCN-specific regions: Sequence locations=1-79,101-128
tatggcacggaaagacttccggtttccgacatttttggggtcggaattccgacttccgaaatttttgatgaaaagtcggaaattttttaaatttttttttcaaaaaactagtaagttttgtacaattt

SEQ ID NO: 72731 - DNA, 1867 bp, Heterodera glycines
  Genomic contig location: Contig_ID=SeqID_9797; Location=122..1988; Strand=-
  SCN-specific regions: Sequence locations=1-390,412-568,601-769,791 -876,898-994,1016-1035,1069-1088,1157-1354,1391-1436,1471-1517,1544 -1762,1784-1867
atggaatgtctactctcggacgatcaacggagaagatcgcacgaacaatttcgcagaggccgcacacaggcgactgcagagggcttttactgctctcatccatcagtatggcgtttcattgagacattgcagaaacaacagaagctacgagattccgaagtgtccaagtgccttgctggattcgatccaccgcaaaaagcaaaaagatatcgcgaagcagaccgtagaattctcacattgacacgcaattaccatctattgaatattggtgatcccgatcgtctcaacgttgataattacaacctacatactattattaattttcttgcaggtgtctcacacaattgttctatggacccttgaattttttgcttggtttgttattgtcaaattgttgaaataaaaaatgatcaatagttcgaatcaaatatcgaaaatgcattaattaagtaattgatattcattgccattgataatgtggtactaaaacatacttgcaatgaaaacagtggccgatcatttcgtcactgatcgtttcgtcactattcagtagagaccgaaccgggccgggcccggtaccgggttttcccgggcccggcaacccggcccggcgatttttgggaaaatccgggttgaccgggttaaccgggttgaccgggttttgagaggtcgggcccggaacccggtcgtttttgaaaatgcaacccggcccggaacccggcatttttgaccgggttttaccgggttatgatttaacaaaaatttgttctttttccttcaaaaatctctttggcataatgtttataaatatttttttgtcaattttctggtaaatttttcatttcattcgaaaaattctactttattgaaatgataatttagttctttttaattttaagaaaatgagtcttatttggcaaattggcctatttaaaaaaacgtcaaagctacagcaatttgtcttgaatgtcaagcaaatggaaagctcaaatatgaataccagcttgccaaaggaacagttaaaactttgcatactcatcttcacgccattcacgaaaactccgaattcactgaaaagctgaattctcttgaatcgaaagccgaaaaggacaaaacaaaaacagaagacaatctcagactttcagtcttccagcagaccgcctatttcagactgtaattctttttaattagcttaatagtttgtatcttttttcagcacaactctcttcgtttgataagaaaattcttcattttttggtgcaaaaaaccattcccttcggcgctgtggatgaccaaacttttcattctttgtttccccatcaaaaagtgaatgtttttataggtgatgaattacattaaaagttaaataaaattaatttttcaattttttcagaaaaactgccttgccaattgtataccaacgtgtcagacagaaaattaaagatgaattaaaagaatccgcatttattacactgacaactgattgttggagtggaagcacatgcaaccttttgtggtacaatttgtgtttttctttttaattatgattggttcaataacagcttaactgcgcattcaatttcaaaatggaagtatatgtcacgtgttttggcaattacggaattttcagaatcacatacagggaaaaatatcgctctcaaaattgaggatttactgctcaaatggggcattgttaaagaaaatgtgcatgcgattatatcggattccgcagcaaatatgaaatgagtgataaattaattaatttttctttccatttgtttttatttgcaggctttcgtcgagagggatgaaaacgaaaatcgcattttgccaatgccgaacggaccttgcgctgctcatttattga

SEQ ID NO: 72732 - DNA, 687 bp, Heterodera glycines
  Genomic contig location: Contig_ID=SeqID_9798; Location=695..1381; Strand=-
  SCN-specific regions: Sequence locations=1-88,112-211,233-687
atgggcctgggccagaatctgacgtttaattttagctacatcgtattttacgtgagttacgtgaaattttaggtgcaaaaagttcaaaatttgaaaacaaaaattttaatggttggcataaggcaacaatatttcgtaaaagctcattattgattgcttttagcttgtttccttatatttaagccggttttgaaccaaaaatgcgaaactagaaaaattagaagttttgacataaaaattattagaaaaaaaatttcaggggggtggtaaaacccggaagtaccaaaattttaacgttgaaatgctatttttgagcccctttcttcatagcatatgcgcagaaaaatatgttaatccatataatttataaccctacttattacattaggagtctaaaattgactcgctgtatttaggagtcaaaaacagaacattttgcaaaattatgttatttacaatttattcaatcaaagtgttatcaatagggactcaatttttaggcaaatgcctaaaatttttgcgcacttaatacgcacagataagcacaaaaaacgcattttccacttggtttgcggtgcggtgtctacgatgacttttataatgctatttttgcctatttcggggtttttgtgcctaatgtgcctattttagattttttgaaaaaatccttaacaaaaatgcaataaa

SEQ ID NO: 72733 - DNA, 421 bp, Heterodera glycines
  Genomic contig location: Contig_ID=SeqID_45437; Location=1..421; Strand=-
  SCN-specific regions: Sequence locations=1-421
aaatttattcatctccctttttgatagaaaaagcatcagagtgctaaaattaagttgtaaataaaatttggtgcgctttagagcactttctgaaaaaaatatttatgaaacaaaaaaatcgattttttcaagtgtccgtttggggtactcaaacaattatggggagcaaaaatccaacgcagatttaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatcaacgcaaattaaagtacaggctatagggaagctattcccgaggattcggtctccccataaactgggcgcatcgggtcgggg

SEQ ID NO: 72734 - DNA, 321 bp, Heterodera glycines
  Genomic contig location: Contig_ID=SeqID_45437; Location=853..1173; Strand=+
  SCN-specific regions: Sequence locations=1-87,113-253,279-321
atttataagcatttgaagggttctcagcagtttccctgcaaaatttggtgagctttcgatcagtctagaacgttggggatcaaatgcaaaaaataattaaaaaaaaataatactggtgtggtaagtgtgaagaactgtgttcttccaggcaaaaaattctaagaaaatttataagcatttgaagggttctcagcagtttccctgcaaaatttggtgagctttcgatcagtctagaacgttggggatcaaatgcaaaaaataattaaaaaaaaataatactggtgtggtaagtgtgaagaactgtgttcctccaggcaaaaa

SEQ ID NO: 72735 - DNA, 248 bp, Heterodera glycines
  Genomic contig location: Contig_ID=SeqID_45438; Location=1..248; Strand=+
  SCN-specific regions: Sequence locations=1-19,76-78,133-137,168-248
aggcactgcctctgacatgttttttatttatttagaaaaataaatttattttttttctttttgattattttaattgtatttcatcctgaaattttttaataaacattttcaaactttcaccttattaatttaaggcgaattttgccttttttaataaattctcttgtgaaaaggcaaaaaaataggctcttttaaatatgcctatttaaatgactttaattgctggcctttcgcttacgaccatacca

SEQ ID NO: 72736 - DNA, 417 bp, Heterodera glycines
  Genomic contig location: Contig_ID=SeqID_45440; Location=604..1020; Strand=+
  SCN-specific regions: Sequence locations=1-232,254-417
atgttcccttgtcagcatgctcttagatcgatttgtgagtatgtagaagaaaaccggagatgggcaatctcaactcttttaactgaccctacgggttttgccagaattacatttagaattcccaacatacatgctagaaaagtcggtccgaatttattcagagtttggccttgtgtccaaataaacagtactgattattcttttgctcctctagaggaaattaatcctggtaaaacaaaatgttttgataaaataccgattcgattcaaaacagcgggtaaagaaagatttgcgtacttagatccgtcatcgatgatagtctcccctactgctaagatggcgccttgcactcatttccggaagcaagtgctgcgaatttcgggagatgtgatggaagttgattaaataacagcccaa

SEQ ID NO: 72737 - DNA, 463 bp, Heterodera glycines
  Genomic contig location: Contig_ID=SeqID_9799; Location=87..549; Strand=-
  SCN-specific regions: Sequence locations=1-307,329-463
atggatattcccgacaaccctaaaggggttcgtcgcaccacttccgcctgcgggcacaatacagtatatgagttgagaaatgaggaggagatgagtgaaatgacaatttcggtcattaataggaaattttggtcgggaaagacggcagtgaaagtctctgacttagaggccgcccataacgaattggtcaaattggaagacggaatgaaccgttccattagggctcttaaccgttgcatggacaaaaagacaaaatgggtctcggaggttgtctcaaatgccaactcaaattttgagatagtcaaggcccaaattgaaacattggttgaccgaatcgacgatctcgaacgagcaaatgatggaacagatgccgacagcacagtgcgcgagcaggacgactcctcacaatttgaaatgccgtcgaaggataacaagggcacaaaccgtggcttgttaagcacag

SEQ ID NO: 72738 - DNA, 379 bp, Heterodera glycines
  Genomic contig location: Contig_ID=SeqID_9800; Location=1452..1830; Strand=+
  SCN-specific regions: Sequence locations=1-75,97-226,264-379
atggcacgacaaatgagccttcctctgtttaaacgcaccaaaccgactgtaagcattttcacgttggccaggtacataatattttaatatttttttcaacctttagttttttttaatatttcagttgattctttttgaaaccaaacattcagcaacggggatttggtgtgccgttttgctgatgatgttttttctagtgtggttcctctggtgagtttaagcattcattttatttaaacattttctatttattttattttaaagatggccaatggaacggatgtaccctggcacttcgtcaatgaaacgaaggacggatgaggatggtaaacaaaaattttgataaattatccgccaatttatcttctgcttatcgata

SEQ ID NO: 72739 - DNA, 354 bp, Heterodera glycines
  Genomic contig location: Contig_ID=SeqID_9801; Location=1742..2095; Strand=+
  SCN-specific regions: Sequence locations=1-72,102-103,125-354
atgtgcctcaggaacagtcagctaaggacaactcggagatggccaattcagccgatggacaaccaaagttagtattttaaatttttttaaactattttaaagggaattttcaattttttccagccgagtcgtctcctctgccgaattgccctcagctgacaggtcctgacggtgctatgacgttactcaacaccatcaaaatgggcgttactcaaaaaccatcaaataaatttttttgatataactttgctcagaggcaaccaaattttttattcgtgatttcattcgatagccttaagtgttttctattatcttgcaaaatttgaaaaaaaattcattaacaagtaagtttaa

SEQ ID NO: 72740 - DNA, 662 bp, Heterodera glycines
  Genomic contig location: Contig_ID=SeqID_45442; Location=799..1460; Strand=-
  SCN-specific regions: Sequence locations=1-662
aaacaaaaataaatcgattttttcaagtgtccgtttggggtactcaaacaattatggggagcaaaaatccaacgcagaattaaagtacaggctatagggaagctattccggaaggattcggtctccccattaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaac

SEQ ID NO: 72741 - DNA, 76 bp, Heterodera glycines
  Genomic contig location: Contig_ID=SeqID_45443; Location=811..886; Strand=+
  SCN-specific regions: Sequence locations=1-76
aattactggagttagcatcatagcagtgcttttccttgtctttttgaggccctcgcaaaatctggttcgcttctga

SEQ ID NO: 72742 - DNA, 325 bp, Heterodera glycines
  Genomic contig location: Contig_ID=SeqID_45445; Location=578..902; Strand=-
  SCN-specific regions: Sequence locations=1-325
agtaaaaattgtaattacgctcaaaaagcttctcaaacaattttagcgcatccaatcctttctacaatcgcttttatacatcccattatgagcgctaaaattatcagagtgccgaaaatcgcatgtgatctaagcctagcaaaaaatggtgtaagtaaaaatcgtaattacgctcaaaaagctcctcaaacaattttagcgcttccaattccttctacaatcgctttatacatcccattatgagcgctaaaattatcagagtgccgaaaatcgcatgtgatctacgcctagaaaaaaatggtgtaagtaaaaatcgtaattacgc

SEQ ID NO: 72743 - DNA, 49 bp, Heterodera glycines
  Genomic contig location: Contig_ID=SeqID_45447; Location=1..49; Strand=-
  SCN-specific regions: Sequence locations=1-3,25-49
ggcttcgccttcggcttcggcttcgagtgctaagccgagcttcgcccag

SEQ ID NO: 72744 - DNA, 397 bp, Heterodera glycines
  Genomic contig location: Contig_ID=SeqID_45448; Location=653..1049; Strand=-
  SCN-specific regions: Sequence locations=1-397
  Gene Ontology: Mol. function=structural constituent of cytoskeleton; Cellular component=ribonucleoprotein complex; Biological process =epidermal differentiation
atgaagaaccattctgctcttcaattctcctgggcttttcttcgtctttttctgtgttggctgacggataaagcgcaaaaaacggagggcggacagaaaaagtcagtgacgcatcaacattaaacatacttttcggcatttgatttaggcaaaatttatttttcattttttaagccctgcgattgctcgtccaaaacgaggccacggctatgggtacaataattggggaggcaacggtggatatggatacggtggcggatggggcaacaacggtggatggggcaacggtggatggggcaacggtggatatggatacggtggcggatggggtaacaacggtggatggggcaccggtggatatggatacggtggcggatacggttacggttggaagtag

SEQ ID NO: 72745 - DNA, 662 bp, Heterodera glycines
  Genomic contig location: Contig_ID=SeqID_45450; Location=414..1075; Strand=+
  SCN-specific regions: Sequence locations=1-70,115-124,160-214,364 -414,436-457,504-573,596-662
atgtctgttttgcacaaaatttcggctgcaaaaagccgacgaaattctctgtcagaacaatttcatatggctgaagaaatttgtgaggttttggaagaagcaaaaatgtatgtataaacgatgcttaattttaattattattataattatttatttattcagctttatccaacgacaaaattctactggatttccaccatcggatgtaatttggatttatttacaatttttaaaatttataaaaaaaaaatttcggagttttttatttaattaattcactgaaaagaatgaaaatgatttcatataaattaatttatagtaatactttattaaaattaattaatttattttttaaataattatgttgaattttgattagatttgttttcctcagtggacgcatttaaaacaatacaattcataaaaaatttaaaatgttaattatttcataattcgattttttattatttctatttatatttgttttttaattatttatttttctacacaaattttacacacattaatttaaattttaggattttcttttattatgctctctgcgtgacctattggaaaattcattggttcttgcaaaatcggcagcagaacaaactaattttgagagacgaagcaatgaaacatgtaaactttttttttga

SEQ ID NO: 72746 - DNA, 386 bp, Heterodera glycines
  misc_feature (20)..(20): n is a, c, g, or t
  Genomic contig location: Contig_ID=SeqID_45451; Location=132..517; Strand=+
  SCN-specific regions: Sequence locations=1-206,229-386
ctgcattcgggacaacaatntagaccatcaactcggaacacagctatgcggctaccccagtacagttcggcatcggctcaccggcaccatcaactcttacgtggacaaccactgtgagtccacgggagcagcttgttcaatactcgttgagcccgctatcgacttcggcagcgccttcaggcagaattatttaatcaattcatccgtttaaatttaataaaaaaaattctgttccagcatgggagtacgaaatcgttcgggcaccacattttccaattccgccggcactttttttcaaattgagggatatgcattaaaattgaaggattcgaaaaatatgatgattcaattgtccatgtcccgtaatgaattttatttaatgttta

SEQ ID NO: 72747 - DNA, 466 bp, Heterodera glycines
  Genomic contig location: Contig_ID=SeqID_9802; Location=284..749; Strand=+
  SCN-specific regions: Sequence locations=1-466
atggccgtgttggagaatttattttgcgcggcaattccaacagttaaacagccgcagaaggaagtgagtgcctaaaaagtataaaatgcaaaggaaaagccacggcttaaaagtcaaggtgtccgtcccttttcaggcaaatcattggcacggccaatggcagcagaaaatgctcgccaattccctttttcaactgcgaacggcacaaaatggagacgaaattgggaaaaacaatgctcaaaaaacaaaagaatttgagaggaccaccgaagagaaattcaaaaaaggttttgaaaaagcagcgaataacagagtgaagcattctgattggtttaagcgtcgcttggcgaaaaatgcaacgatttcctcggagaattttgtgccgaccaaaatgcccgctgtgaagagagccgttgtcgttgtgttgtgccaatggttgaacagaatgggaagtgccaacaactga

SEQ ID NO: 72748 - DNA, 613 bp, Heterodera glycines
  Genomic contig location: Contig_ID=SeqID_9803; Location=481..1093; Strand=+
  SCN-specific regions: Sequence locations=1-613
gccgggcgaaaggttggaccatttgcgaagataatactcaaaagtcaaactcagctgtgccgaggacgaattgtgcacgggcggctcattttgtggcgaaaactctatttgtatgtgcgccccgggggaaagcgttcaaatagaaaacggaaaagcgaagaaatgcatgttgcaattggaggaaaaggcgcgggacagcagccaaccggtcaaggcggagccgggccaactttgcgtggagggcggcatggaatgttccggaggggccaagtgccagaatggcatttgcagttgccctgagggtacgtctgcttttggcacgaccattggccattcatctgtcgtcccgttgccttttctatcctccctttttttcttcaggccacactctcttccgcaatgagtgccttccgcctcgggcattgccaataagcattgagaaaattcacactcattctgccctttttgcgccccaatcagcagtgatggacagtccatcttcagtcggcacaaatttcgaccccaatttacaggatccaatcccatccaaaaccgtttcgcccggggcaatgtgtcggttggtatttagtctgccgatgtttcacgtttattt

SEQ ID NO: 72749 - DNA, 4322 bp, Heterodera glycines
  Genomic contig location: Contig_ID=SeqID_9803; Location=1216..5537; Strand=+
  SCN-specific regions: Sequence locations=1-30,54-523,545-879,901 -1343,1365-3712,3734-3858,3989-4078,4101-4322
  Gene Ontology: Biological process=regulation of protein activity, epigenetic
atgggcaaatccattcactaccaacatcgatcactgctgatcggtcaccctcgccaccaggtgttgcccggggcgagatgcgacactcaaaaagggttggactgtgtgggcgagtcgcactgcttctacggcatttgcgtgtgtctgtacggcttggtgaacatcggcaacgaatgtgccaatgcgaacgtattggagaaagtggcacccggcaaaaggtgtctgccagggcagcattgcctgggcatgtcaaagtgtgtaaagagcaaatgccaatgcgaaaagtgagcataatgccgccataaccttatgaacggttcaactcccaggggacaaaagttagactcgaaattgcgccggtgcatcaaagtggcaaatgcagcaactgttacaacgccattgttggcatttccttcgggagcggaagtggtcgtagggccaacgtcaatcgtcgaaattcctctgggcaattcggcggatggcatttcgcaaagcgatggcgcgagagaaaggccgaccaaattcatttacgccatccctgcagctttagcagcagcggctgaggaggggaaattccaacagattttgacggctaatcaaatgtcaataaatttgatggacggcgaaatgcgatcactgatcagtaaactgatcgaacagcaaaagcagagcaatgaaacggttgtgaagagacaaaacatttgtggcggagaaaggtcggcggaagggcgacgaacggaggaaaggcccagttttggtttcatttcagtggtccaacaaattgtcagcattttcctccaattgtcacttcaaagcttccattcagtaaaccaatccagcaacaattcttccaatccgtccctaaatcggcttcatcccttcaaaatcccttccaatccatccaattggccgcttctttcaattcgccacaccttcaaggccagcctggctttttttgtgctgctggcaatgtttgctatggcggtgccatttgcttagctaacctttgcatttgccggcccgggttcagacccattgatgggttctgccaaattgccaaggttaatttgggcgaacagtgctttctggacgaacaatgcaaggcgaatggcttttgcatcgatggggtaagcttcacaatcgcttgtcattcggtgcctttctccgctttctgttatgccattgccgtgcccaattcggtgccatgcgtcgcactttccttcgcaatgttttccatcggcaccgttgcccaacgcggcccgtcgctgccgtgggcgaagactgttccaaagcgcaagcgtgcggatggaactcaatctgcggaacattcagtggagtgtgcgaatgtgcaattggcatggaaagtgatcaggtggggacaaccggcactttggaggtgcgaaagggcatccaaatgatcactaattaccgcaattagcgaggacgctcactcccctttagggcgcgtgtgtcgttgctcgccgtcctcgaggaaccgaatgtatgaacaaatggcgaaacaaaatgtttcaggtctttaggccttagcagttccgactgccacaaatttgccttctgcgacaacggattctgctcgtgcaaaattggctttgaacgtatcgccggtttttgtctgccgcccgctcgccccgtcgtcgacgacccaaaagcgtactttgacccggaaaagatgaacaaaaatgccaaccatttggacgtggaaaaggacaactcagaaggccaattttggccgagcaagcgaatttcgccaatcgaagttttccaagcggagaatcgacgggaaaaggctggcggaagttggacggatgagcagagaatggacgactcgccgaatttgggagacaatggacggaactcggcagaaactgcttttgccaatgccgagaatgcttctccatttccgtcccaacaaagcaaaaccttcgctttttcccgccactttccctttgccaattcccaacttcgctttgtttcctcagaaggaaatgagtttttgtcgccaaattcaaaaggacaatttcaacaattaatgcttcttcctccaacaattggtgcttctttccaacattttcctgcgcattcgaaaggaaaaaaagcgacggaaaaagcgaaaagaaaaagcgcaaaagataaagccaaggagaagcagaaaagtggcaaacagaagcaaaacggggggaacgaagtggcgaagccgggcgaatattgcggcactaacgaaaagcaatgcgcaggcaattcgaagtgtttgagtgggtggtgccaatgcggggagggagcccacgttcagacagagggaatgtgcgtggaagagccgggaaaatcgctggtaggctcatgaaccgttcttgaagggcattccctgtcctctgtccttgagaaggaatgtccggttctgtctttgaatgggttatcctgttctgctagggctgtcctgcccatcgtctttttcctcctccgcttccgttcagcgtttgccctccgcttcttccgagttgctcccccataagcttcacctccccttcgactcgtgcttctcaaatagaccttgcatccacggcgcctcttgtgtccgatcagctgccctgcttttcgttcaaaagttgggtatgcttttcctttgcttttattttgtccccgtcccattgactcatttcctcccccaaaggtcccttctgtcaatgcaatcctggactcgttttcctgcataaccaatgcattccccgtcgtcccgagcttaaagttgccaaggtttgtccgtgcaaccataaaaaaacattttgcaaatttagcccggcgagcggtgccgtcccccctcagtcatttgcgattttggcgcaatttgtggcgaagaaagcatttgcaaatgtcctgcgcatcggaaattactcagttagctttacataaatgcaaagttaaaaagcattgttcgttttttcagccggcctttgcgtccgtttggcattgcccggcgagtcgtgcgcaaacggcgaattttgtgccgacgcggcgatttgtgctcctggactaaatgcatgtgtatgccaagtgggatggaacgtacggaatgggaaatgccaaaagggagagacattgaggaaattgatgaccgaagggggagagacttggaatgggcagagagaaggccaaattaggcccaagtcacacatggcatcatcggtggccaaactgtcgcttctgctgtacgggcaggtacttaggcattcgagctgagttggacagattggccaattcagcactgccaattcgactcagactgtgcccaccttcgcaacgcccattgtgcgcctgtcacacggaaatgcgcctgtgaagacggcttttcccagttgtattcgtccatttgtgttcctgagaacaaaatcaaactgccgggcgatgagtgcctttcggtaattcgaattttggcaaattaaacaatgaaaaacaatgccttgcgcagagtgcccacttttgtggtgggaagtcgtggtgcaaaaacggacgatgtgcttgcattgggagggactctcaagctgtggaagggcgatgtgtgcgcaaagcgagcaaaaagaggacaattcggagaaatcccccgaggggacagtcaatggcaaaggcattggactgctcaaaggacgggaaaagtgagttgttttggagaacttcatggaaaagtacaaaagcagataatgggacaaagggacaatgcgccacggagagggaatgccccgaggggacgcattgcgcgcgggagaaatgccattgccgggaagaagccgaaaggggagcgaaattggcttatggagtgacttcgaaattggcaccaaagcaggcaaaatgagaaaaagggaggaaaatgaaaaaatgatttaaaagcaggagaagaaagagcagaaaatggagaggaggaggagaaaagaagggaccgaagcagaagttggagaggaagaagcagaaggagaagcggatttggaaagggattacgcgttgggagagccaaagtcggtggcggcgcccaaaacggaggccatcgtcggcggagcggcactcatcaccgccgccgccaacagcagcgcaatgccatgccatttttgccgggcactttttgtgactcgtttagtcagtgcggagaaggggccgaatgctttttcggcaaatgccagtgcatttttctaggccagcgattggcatttttgaacggagttacaaaatgtgtggcagaggaagagaaaaaagggaaaggagcagagaaaaagacggagagacgaaagagaggtgaaatgattggagagacagaa

SEQ ID NO: 72750 - DNA, 545 bp, Heterodera glycines
  Genomic contig location: Contig_ID=SeqID_9803; Location=1523..2067; Strand=-
  SCN-specific regions: Sequence locations=1-308,330-545
ggaagaattgttgctggattggtttactgaatggaagctttgaagtgacaattggaggaaaatgctgacaatttgttggaccactgaaatgaaaccaaaactgggcctttcctccgttcgtcgcccttccgccgacctttctccgccacaaatgttttgtctcttcacaaccgtttcattgctctgcttttgctgttcgatcagtttactgatcagtgatcgcatttcgccgtccatcaaatttattgacatttgattagccgtcaaaatctgttggaatttcccctcctcagccgctgctgctaaagctgcagggatggcgtaaatgaatttggtcggcctttctctcgcgccatcgctttgcgaaatgccatccgccgaattgcccagaggaatttcgacgattgacgttggccctacgaccacttccgctcccgaaggaaatgccaacaatggcgttgtaacagttgctgcatttgccactttgatgcaccggcgcaatttcgagtctaacttttgtcccctgggagttgaaccgttcataa

SEQ ID NO: 72751 - DNA, 411 bp, Heterodera glycines
  Genomic contig location: Contig_ID=SeqID_9803; Location=6323..6733; Strand=+
  SCN-specific regions: Sequence locations=1-92,114-411
atgacaaaaacactggcggaagggagggaaagcggaagaaatggcacggagacagagaaaggcacagcaccaaaagcaattggtaagtgttgagaatgagaagaagatgaagaggggggggggggggatgggagatcattaacggatagccaaaaacaactcattaactaataacagcggagagacggactaaccaaacaccgaacgaaccgacaaatgtgccaactgctgatccgctcaaaaacgtatcaaagtctgaaccgacaccaaatgtgccaattgctgctgacccccgcagcccattaaccgatgtccgttcactgcgaatattcaaccaaaatttaacggggagagaaacggtttctcacgcatgcaatgttgattttgtataaataactcttctcattacta

SEQ ID NO: 72752 - DNA, 1610 bp, Heterodera glycines
  Genomic contig location: Contig_ID=SeqID_45452; Location=118..1727; Strand=-
  SCN-specific regions: Sequence locations=1-1610
atgcggcaaatcagagcgccactggatttggacgcatacgacgccgacacttatgtgccgctggtcatcaaccattggaacaacgcgcaccaacagcagcaccgctttgctgttttcatctttggaacaactggccactacaaaccactttacaaatgcggccatgacaactacgacacaccattggcgctttattttaacaacagtcattttgacggtgtacacttcctcagcggactttttggtggaaaaaagtattgcctggagtgcgagaagccttataagaagccgtcggaacacaaccagtcctgcaaagcgcactgtctgatgtgctcgcgcgttggacctgcgtttccgtgtccctcggagcctgacttcttccgaaaatgcaaagaatgccacaaaaacttcaacaacgcgggatgctacaatcaccatcttcagtccaactactgcacgcgctcaaagaagtgcaaagactgtggtgtgatttggaacgttgccgacaacagcaggcgtaaacgaaagggacatgtttgcggagaaaaattctgccttctctgcaacaacttccacaacacagagcgcggctgctacattgcaccatttgagcccaaggaggagatggacgcttatcggttcgttgcatttgacctcgaggctgaccctcatctgcctgaacgacgcaaccacgagccaaacttcattgcagcaaaagtgtcttgccccgcctgcattgaaaatggcagatggaagcaaggaactgccggatgttgggtgtgcggcccacaccgaaccgttgccttctgccaacgaccatttaccgacactccggttgacaagcaagtggtcaccgacaaccccatgcaagcatttgttggttggttgatcaacgacttgccgatcaaggccaacaccttcgcctactcacattttggtggccgtttcgacatggtcatcacattccgggagctgttccgtcgcggctataacccggagatgatcagacgggtgagtatgtttttacatatattttattctgataaacaaattaagggcaataaaatgtatgaaatgaagctgagggcgcagaagaaccgacaccccaacatcgtcttccgagattcgttcaatttgatgccctgtgcgctcggtcagctggtccccgcctacggcttggacgtcgaagagaagccattcttcccgcatatggtcaaccgcccggacaactatggccgcgaaatttttccgacccccgacgactacctcgcccatggaatgatgccagaaaagagacgacagtttgacaactggtacgaacaacatcggagtgaaccattttttctggacgaggcattggccagctactgcaccaatgacgtggagatcttaatggcagcgctggtggcatttcggcgggagttcttggaaatcacaagacgtcaagaacctgtggacggccgtgaaacgcacaacggaattgatgttctgaagcagtgcatgacaatcgccagcgcctgcatgaagcacttcaggacaaatcatctccctgctgatcatttggccatcgtaccggaaagaggctacgacaacgcccaaaaccagtccct

SEQ ID NO: 72753 - DNA, 328 bp, Heterodera glycines
  Genomic contig location: Contig_ID=SeqID_45453; Location=466..793; Strand=+
  SCN-specific regions: Sequence locations=1-87,109-307
atgcaactcagacgtcagtttgaggagatccgccagagcattggcaactctcagcgcgtcaccaatgcgtctgaccccgacaacgcgaaaaccttttgggcctcttgggacggcacccgtgatggtgccattcggcgccatcactacatgcagctgggcgaggaaggaaggtagttgcctttaataatgcaaatgcttttaattgttaatttctagaggcgcaaagagggagactgcagttggaacgggactgagcattggaccatgcgaagagatgcgacaggaagggtatgtgtgcattccatttaaaacatcaccatccacatag

SEQ ID NO: 72754 - DNA, 108 bp, Heterodera glycines
  Genomic contig location: Contig_ID=SeqID_45456; Location=589..696; Strand=+
  SCN-specific regions: Sequence locations=1-108
atggccggctttctgatgaagcaaatggtgggcaataagtttgacgaggtgaccaacaaattgggcggcgatgatgagcaaaaaacggtggacggagaggacccggag

SEQ ID NO: 72755 - DNA, 285 bp, Heterodera glycines
  Genomic contig location: Contig_ID=SeqID_45457; Location=176..460; Strand=-
  SCN-specific regions: Sequence locations=1-285
atgacttatgaagaactaaagttttgtgatcgctcattgggtactattggttgtgaattcattcacaagtgtggaatctgccgtggccatcaatcaacagctttctcagactgattttaattgcgtcatcaaagtttactgggattaatttgttttgagttatattttggtttgttctgttaatatgatgtaaaatttagaaatgggaaccatcatattgaagaaatgctgttggattacaattgtgaagtgttgaacctgtcgatcggccactcaactttttga

SEQ ID NO: 72756 - DNA, 160 bp, Heterodera glycines
  Genomic contig location: Contig_ID=SeqID_45458; Location=163..322; Strand=-
  SCN-specific regions: Sequence locations=1-32,59-160
taagcctaaactttttggcctgtttaaaaaggaattaaaaatttttaaaatatttattcatctcccttttgatagaaaaagcatcagagagccttatttaacttttaattaacatttggtgcgtttcagagcactttctgaaaaaatacttgtgggttaa

SEQ ID NO: 72757 - DNA, 818 bp, Heterodera glycines
  Genomic contig location: Contig_ID=SeqID_45459; Location=106..923; Strand=+
  SCN-specific regions: Sequence locations=1-183,205-256,278-347,369-818
taattaaatccattccttcggggaaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttctccatcttcctttttgatactaaagcatcagagtgctaaaattaagttgtaaataaaattttggtgcactttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgagggattcggtctccccataaatctgggcgcatcggttcggggggactgaccgaaaacaaaaaaatcgattttttaaagtgtccgtttggggtactcaaacaattatggggagcaaaaatccaaagcagaattaaagtacaggctatagggaagctattcccgagggattcggtctccccataaatctgggcgcatcggttcggggggactgaccgaaaacaaaaaaatcgattttttcaagtgtccgtttggggtactcaaacaattatggggagcaaaaatccaaagcagaattaaagtacaggctataggggaagctattcccgaaggattcggcctccccataaatctgggcgcatcggttccggggggactgcccccaaaaacaaaaaaatcgatttttt

SEQ ID NO: 72758 - DNA, 95 bp, Heterodera glycines
  misc_feature (36)..(36): n is a, c, g, or t
  Genomic contig location: Contig_ID=SeqID_9805; Location=62..156; Strand=-
  SCN-specific regions: Sequence locations=1-95
atgttgatggatgcctgggggtacctcccaggcggngatcgattagccattccactgaatgactcccgactgaactccgattgtccctttggctg

SEQ ID NO: 72759 - DNA, 802 bp, Heterodera glycines
  misc_feature (748)..(748): n is a, c, g, or t
  Genomic contig location: Contig_ID=SeqID_45462; Location=34..835; Strand=+
  SCN-specific regions: Sequence locations=1-147,169-172,216-289,312 -315,347-647,679-767,789-802
atgcgcgactttgactttctgaaggaaatgcaacgcgccgaaatggaaacaaataagggatttcggcaaatggttgatctcacagaaaattgttataaagacggattcaaacaaccgctgatttggttttgccaacgagcggtaaaaaattgaatttcaatttaaatgaaccttttaaatattttattttaaatttaaataaatttaatttatttgaggattatatgacacatcaaagtgaagaaaatgatgagaagaaattggaattgaagcaggtaaaaattgaattttatttccaaaattttgtaaatttgactaaaagtctaagaaataaaacattttctttttctggtggaaattaatgccggcccaattggcggccttggcacttcgtcccgtgtcactatgcttcatcagcatgtcctttccatggccaatgccgacacttcgcccgcggcgctgccgcctaatcacacggacacaatggtggccaaagcactgcacatggcatggtaaaagcaaaaaatgttaattaaaaatcactgaaaagttctgaaatgaataaactgacaatttttttagaaaacggaaaaaaatatcgaatttcaccccagcgcatccgaatatttgcggggtggcgaaagtcgataaaaatttatataattttgaaatttaattctcgggttttgagaaaaatttcccaggttaaatttcaattaaaatttcaaaagaaaatataaaaactttngggggtggaagtttgggcgccagaaatttgggcaccaaattaaggatttaaaaa

SEQ ID NO: 72760 - DNA, 735 bp, Heterodera glycines
  Genomic contig location: Contig_ID=SeqID_45467; Location=347..1081; Strand=+
  SCN-specific regions: Sequence locations=1-68,91-553,575-735
atggaccaaggatttaaatgcaaaaatatgtgcggtcgtctgttagagattgaaaacgacaggaaaatctgtgttttcaaaactgaaaatattttgagacaatgtagtcggattaaagaagttgtcaaagaaaattgggacatgaatgtatttatccaagggagcatatacaatggccttggaagaaaagaagttatgataaactcaaaaggaataccgaatgattggacaaaagacgacagttgccaattttttgacaaattgcgaaaaaagttaagagaatctggaatggcattaacccggactctgataatcccttcccgaaatgtctccattttggaaatcacaattaattctgatgaccaagaaataaatgctcaaattagttgcaataatttgattggattgattaattcgaaatggttggcatgttgtgtgcagttggatgtacgatttaaaactttatattttgccattttggaatgggctgacgttttaccaaatttgatcaaaattttaccagaaatttttgaaattcgaaatgttacatacacaaagaaacaaatttttgaagtactgaaacaaaaacttatttgggagacaaccaattcccagagcatttcttcactactcattggattttttgaattttatacaaaaatcaatttagaagagagccggttgaatatgaatgaaggaaaaatcgatttttgggagaaagtgctcaggaaatga

SEQ ID NO: 72761 - DNA, 704 bp, Heterodera glycines
  Genomic contig location: Contig_ID=SeqID_45468; Location=1..704; Strand=-
  SCN-specific regions: Sequence locations=1-704
tttggtgcgctttagagcactttctgaaaaaaatatttatgaaacaaaaaaatcgatttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaactccaacgcagaattaaagtacagactatagggaagctattcccgaaggattcggtctccccataaatctgggcgcatcggttcagggggactgccccgaaaac

SEQ ID NO: 72762 - DNA, 206 bp, Heterodera glycines
  Genomic contig location: Contig_ID=SeqID_45468; Location=1152..1357; Strand=+
  SCN-specific regions: Sequence locations=1-129,163-206
tgtggtaagtgtgaagaactgtgttcctccaggcaaaaaattctaagaaaatttataagcatttgtagggttctcagcagtttccctgcaaaatttggtgagcttctgatcagtctagaacgttgggtgataaaatgaaaaaaataattaaaaaaaaataatgctggtgtggtaagtgtgaagaactgtgttcctccaggcaaaaa

SEQ ID NO: 72763 - DNA, 177 bp, Heterodera glycines
  Genomic contig location: Contig_ID=SeqID_45471; Location=707..883; Strand=+
  SCN-specific regions: Sequence locations=1-76,103-177
atgtcggcatcgaacgccctttggaaggcacccgacggaacagtgggtggcaatggtataaggaatttgatgaatgattttaatgattttaatattaccacaaaggcagttcaattgggacggcgggcgggccgggcccgagcagtgttttggccggttcgaatgccaaagttggcg

SEQ ID NO: 72764 - DNA, 193 bp, Heterodera glycines
  Genomic contig location: Contig_ID=SeqID_9806; Location=785..977; Strand=-
  SCN-specific regions: Sequence locations=1-193
tcaagtgtgtttatacgaaaaaatccaaatttattaacagtctttatcaatttcgcgaaaacaattgcaaatcagatacatttcgaggtgttcgggggtaaaactcattcgattatcggccaaaattgatttgtaaattgaaaaactgcgttcaacgtcacaagaagtcaccggcgcatatttcatagatgcc

SEQ ID NO: 72765 - DNA, 193 bp, Heterodera glycines
  Genomic contig location: Contig_ID=SeqID_9807; Location=215..407; Strand=-
  SCN-specific regions: Sequence locations=1-193
tcaagtgtgtttatacgaaaaaatccaaatttattaacagtctttatcaatttcgcgaaaacaattgcaaatcagatacatttcgaggtgttcgggagtaaaactcattcgattatcggccaaaattgatttgtaaattgaaaaactgcgttcaacgtcacaagaagtcaccggcgcatatttcatagatgcc

SEQ ID NO: 72766 - DNA, 173 bp, Heterodera glycines
  Genomic contig location: Contig_ID=SeqID_45473; Location=906..1078; Strand=-
  SCN-specific regions: Sequence locations=1-173
gctcaaaaagcttctcacccaattttagcgcatccaattccttctacaatcgcctttatacatcccattatgaacgctaaaattatcagagtgccgaaaatcgcatgtgatctaagcctagaaaaaatggtctaagtaaaaatcgtaattacgctcaaaaagcttctcaaaca

SEQ ID NO: 72767 - DNA, 819 bp, Heterodera glycines
  Genomic contig location: Contig_ID=SeqID_45476; Location=57..875; Strand=+
  SCN-specific regions: Sequence locations=1-69,91-158,180-495,519-819
ttatcaatgccgtgcgttcactctcgggctgacacccgcgcagcaaatgccggccgaatgtttgcaatatgtgtgcgttgtggctggtgaaattttccagaaggcacatgagtgcgaatgtgacttgacgggtgggtcggcttttttttgacagcaaaaaagggaaaaatgcataatttttacttaatttacaggttctgtgtccggtatttgtgagccaatgggtggtcaatgcgagtgtaaaccaaatgttattggaagacggtgggcatccttttttaaaagttatctatgactagagaccggaaatttcaattttggatcttgctgcgggattataattcaatttttttttgctgtacgggttccgccggattcgtcccgcaaaatcccccaatttgctttgcggaatgggataccgcgaaatcccacccttgctctctatctctgtgacaatgtcggcggagttgacaaatatcggggtttttgggggagtcggtagcacaagggaaaatatagcgtccgggtcggaaatttctccgggaattgttgtcaaggttccgcttaaccttgtttcttaatactgaagttgcgaccgttgcgcggttggcacttacggatttggtccgtccggctgttcgtcatgcgattgtgacagtgtagggtcactctcaaatgtttgttttacctcattgtggttactgtaaaaaaaaaatgttccttcgtatttaaggcgtgcgacaaacagtctggccaatgcgagtgtcgcgaacgcggcatcaccgggcgccagtgcaaccaatgtcaaccaggattctg

SEQ ID NO: 72768 - DNA, 454 bp, Heterodera glycines
  Genomic contig location: Contig_ID=SeqID_45477; Location=88..541; Strand=+
  SCN-specific regions: Sequence locations=1-432
  Gene Ontology: Mol. function=electron transfer flavoprotein; Cellular component=mitochondrial matrix; Biological process=electron transport
atggtcgccggatatttgaattggccacaggcgactttcgccagcaaaattgaagaggatggcgcttatataaaagtaacgcgagaaatcgacggcggattagacactgtgaaattgaaattgccagccgttgtcaccgccgatcttcgactcaatgaagtcggtcttgtttcaacaaacattgattgtttttgttttttagcctcgttacgccaccctcccaaacattatgaaagccaagaaaaagccattggaaaaaaagacagcgcaagaatttggcattgacatgactaatcagacagaaactttggaagtaataaatataaaaacgatatcgtaactaaagtttatatatctaattaaggtctccgatcctccagttcgacaggcgggcggttttgtggacgatgtgcctggattagtttcgaagctcaaggagaagggagtgatttga

SEQ ID NO: 72769 - DNA, 203 bp, Heterodera glycines
  Genomic contig location: Contig_ID=SeqID_45477; Location=744..946; Strand=+
  SCN-specific regions: Sequence locations=1-19,52-203
gtttagatgtttcagaaagttttcttggttcttttgtttttacttgcctttacagtctcaaatttgcggtccgatgaaggaattggggaggtattttttatccacttccctctaaaattgaattctttttacgtttagatggatgcgaatcaaaaacctttgaattcggctcgaatactcgcttccaaattcactctttctca

SEQ ID NO: 72770 - DNA, 49 bp, Heterodera glycines; identical to SEQ ID NO: 51181
  Genomic contig location: Contig_ID=SeqID_45481; Location=516..564; Strand=-
  SCN-specific regions: Sequence locations=1-49

SEQ ID NO: 72771 - DNA, 1149 bp, Heterodera glycines
  Genomic contig location: Contig_ID=SeqID_9809; Location=1..1149; Strand=-
  SCN-specific regions: Sequence locations=1-185,207-472,494-523,549 -1149
  Gene Ontology: Mol. function=4-aminobutyrate aminotransferase activity; Cellular component=intracellular; Biological process =nitrogen metabolism
ttggctccggttgtcaatcaatcgtcaatcgcttcgctcattcgttgtcttctattgcttcttctgaacctgatgcgccctcaatgctgacacaaatcccgggcccgaagtcgaaggcactgaaagaagaaatggagcaagtccatgtaggaggattataaaaaaacaattgtaatttttttgaattttcaatttccttttaatttgattgaccggtgcccaaagtgtcatcactctaatggaaaagttacaattcagcaaacaacgtccatcaatttcttcgcggactacgagcgttcctttggcaattatttgattgacgcggatggcaacgcactactagtacgaggacgagaatttgacaaattaattcctttttttccattctttaggacttgttcactcaaatttcgtcattaccgctgggctacaaccatcctgaactgatcaaattggccactgatgcacgactaattgtgagtttttcaatttactcaaaaataacaatgctcactcgttatgcttcatttactattttaaaattaatgctttatcgtcctcagaccaccgcggtgagtcggcctgccctcggtgcttttccgcgcagcgattttgcccagttggtcgcccgttcgcttcattcggttgcaccgcgcggacttcgccatgttcagacgatgctttgcggctcatcggccaacgaaaatgccatcaaaacggcctttattcattaccaaactcgtctaaggggtggcagtccgccgacagcgcaacatttgtccagttgcatgcgcaacgaggcgcccggcacgccacaactctctgttcttggcatgtgttgtggcgtttttggcttattttcaatagtttttcagggtttaacgggtctttccacggacgaacgcttggcgtactgagcataactcggtctgtctgtccaaacatttgttataattttggtacttttccattttgggcctacacctcaaaataaaaataaaaaatcaacaaagagcacgcttaagagacaatttaaacgttccatccccatagcataaattagcgtagcgattaaggaccttttcggttttgcgcataacttagtgaatgtggaactttttaaaatcttgaggtgtaggacctgccagg

SEQ ID NO: 72772 - DNA, 1314 bp, Heterodera glycines
  Genomic contig location: Contig_ID=SeqID_9809; Location=2162..3475; Strand=-
  SCN-specific regions: Sequence locations=1-145,168-534,556-1314
  Gene Ontology: Mol. function=ATPase activity; Cellular component =mitochondrial outer membrane; Biological process=mitochondrial translocation
caatgcccgaggatggaatcgcccttggccaggtcggcggctgcgcctcactcttggaccttttggaggagaacctcatcctccctctccgtctcatctccgcgaacatcaaaattccatcttcgctgtacagtccgccaaaaggttttttaagcaacaatgttttcgtttgctttgaatttctgcttttaggtgttcttttgcatggtccgcctggctgtggcaagacactcattgcgcgcgcaattgccaaggaaatcgacgcgtttttcatcaatttcgacatttctttgctcagcggtttgtggaaattgaaccactcacaattattgctattcatactttttcagatatgtggtacggagagactgccaaactcaccaaggcattgttcactttggttggtttcttaagtgcgacagattgtggacttgaatgggatttcatttttcaggccggaaagattcagccatgtgtcatattcatcgatgaaattggtactcaatatgtttcaacgattaattccgttcggttatttgtttgttccttagattctgtgctgcgcgatcgtcacaaacttgaccacgaagtcaccgctgtgatgaaaacccagttcatggcgctttgggacggctttctcagctcaaactccgcagtgatcattatcggtgccacgaatcggccgcaggacgttggtaagggattatttgttaattaaatcaaaaagttgtctcggtgacgctgtctgaatcataagtttgctcctttttcgtcaataatattttcataatcctcacccattcaaagtgctcattttttctatactccctccccttaatccattgagtgtggctgcatttacaataaattttttcagataatgccattttgcgtcgtctttcgctcaaaattcacgtcccattgcccgatgtgaatgctcgcgagcagatccttcgtgtcatcctgaaagatgagaatttggaggacaatttcgacttcgaaaaaattgcacaagcgtctgaccagcggagtggggccgacctgaaggaggtcgtccgtctctcctttctgtcgagctatcggagcgtcgtcaaggaactgttcatatcgggcggacggtgggtgaaaggagtgacggagaattataataaataacaacacagccattacaggggaaaatgcgtcagggaggtcgaattatcacacaatgacgtcatcctggcacttcgtcagttcaacggctgcttaaacgactcccaaaaggctcattgctctaaaaattatttgacggaagaagtctttgaggtggattga

SEQ ID NO: 72773 - DNA, 376 bp, Heterodera glycines
  Genomic contig location: Contig_ID=SeqID_45482; Location=682..1057; Strand=-
  SCN-specific regions: Sequence locations=1-67,156-332
acaattgaacgtgaaattgacggatggtgaaagcaactttgcctacaatgttttgttgatggaacggtaaatttgaatttttattttttgaaaataccaaaaagaaaatttaatttaatgattaactattttttcaaattatatttcatttatttgccaataatttttcataaaatttggtgtccatttttcagtctttgtccaatggtcaataaaatgggagtagctgcaaacaaaagcaacctgatcatgcagccacttgagtaaatcttatttaaaatctaaatccttaaatattgcttagagaatactttagtgtgtgtggttaaaacaatttttgatatatttttaattaaatttagtataagataataaa

SEQ ID NO: 72774 - DNA, 174 bp, Heterodera glycines
  Genomic contig location: Contig_ID=SeqID_45482; Location=1..174; Strand=-
  SCN-specific regions: Sequence locations=1-174
tcactcgcaataaattaagaattgttggtgttgttcgatagctctatgtgtttattattaatttgcaaaatctcaaaaattttggttaagtttcaaaaaagttatggccagaaggaactcaaaaacccagtaaatggactttttttttgctctgattttttgtgcataaataaa

SEQ ID NO: 72775 - DNA, 657 bp, Heterodera glycines
  Genomic contig location: Contig_ID=SeqID_45483; Location=14..670; Strand=+
  SCN-specific regions: Sequence locations=1-121,227-258,366-368,390 -438,460-545,567-627,649-657
  Gene Ontology: Mol. function=glucose transporter activity; Cellular component=membrane; Biological process=glucose transport
atgacattccaaatttgtactcttccattttgtcctgaatcaccaaaattcagtttggtgttcaaagacaacgctttagcagctgaaaggggcctgaaaaaacttcgtggacgagataatgtaattattattattatatgtcaatttaaaaaaacacttttaaataaatttttaatttctggtttgttatcaaaaattttcaaaataataattaattttataaattgaaaagttttgacaaataactaactgttttcaaatttaattttttcatttattttacatattttatactatttaatttattgtgtttttgtattaattaaccttaatttattactaattttttaaattaatttgttttaggtaaaggaagaattagagcaaatattgtccgaaagttcatcagcagaaaaagggacatcgaacaattttcaattttttgatttgtttaagaaaccactgaattggccacttacgttggcaatttttatgcatctctcacaacaatttagcggaattaacgccggttagaatcttaggattaaatcaaaatgataaaaaattttcattaagcaattttctattctacaacaatattcaagaagtctggccttgctggtcaaagtatatttttatgataatgaacatataaaa

SEQ ID NO: 72776 - DNA, 453 bp, Heterodera glycines
  Genomic contig location: Contig_ID=SeqID_45485; Location=515..967; Strand=+
  SCN-specific regions: Sequence locations=1-265,303-327,364-453
atgggtgctctatccacccaccaaatttcatttggaaatctcacggacacctggggaccttcctttgtgagtcgttttaaaaaaacatcataaagggcattagtttttcaacaaaaaaaatattcataacttttctcaaaagcaacaaaatgttaataattcataatatttaatagccctaagttttttcaattagtctgcaatatttcaaaaaaacttgaaaagtttcattatgaccaacagaattcaaaattcctgggttttcaaatatttaaaattttaattttttagtaaaattataagcaataaattttgtattttgatggttttttaaattatctttttatggaataaaaattggaattttagtacttttttgttttaaaccaatctgaaaaatttttcctatttttttaggatactgttaacacagttacgatgattcgactttag

SEQ ID NO: 72777 - DNA, 217 bp, Heterodera glycines
  Genomic contig location: Contig_ID=SeqID_45487; Location=1..217; Strand=-
  SCN-specific regions: Sequence locations=1-130,158-217
cggagtaggaaaaacgtcgtcagccgaaacgtcgtcgaacgaatttttcgaccattacttttttctttctcaaccaaattaaacattcttggtattattcgaaagcattcgaaaaatgctattagcctgcaaattttcaaatatttttatttatgcacaaaaaaatcagagcaaaaaaagttccaattactgggtttttgagttccttctggccata

SEQ ID NO: 72778 - DNA, 915 bp, Heterodera glycines
  Genomic contig location: Contig_ID=SeqID_45488; Location=130..1044; Strand=+
  SCN-specific regions: Sequence locations=1-20,42-275,297-552,574 -807,829-915
atgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaaatggtggatttgtcaa

SEQ ID NO: 72779 - DNA, 1081 bp, Heterodera glycines
  Genomic contig location: Contig_ID=SeqID_45490; Location=252..1332; Strand=-
  SCN-specific regions: Sequence locations=1-95,118-176,218-234,340 -365,387-676,699-801,838-1081
atgggtgacacgtcaatcggacaaataaccgacagatccaaagaactaaaacttggcagcccgaaagaacaattcaaccaaagacggataaaatcaaaagggcaaaaggcctacagtccaacaggacaaatgaacgacgaattacaattcgttagttctaaaacacaacatttcccaattgaaacttgcttaaatatgctgaaacaaataagaattgaaaaattttctggtaagataaaaactaaaaaataatcatttatttgagaaaaattaaaaatgttaaaatttatttatttatattgttaaaataaaaagaatagaaaaaattaattttttatagattttctcaacgatttacttttggcaaatttttacaaattttatttggaaaacataacagatgaaaaatgcacaatttatttgcatattgcaatgcttattcgaacaattgaagccaaattagaaatgtcaaatgctctgggcttcaaaattccaaattttaaacagaaatggcacacatttaaatgccgaacagctgcatctgaggaagagcctcaatttctattggaaaaattattttttgtacaaaacaatttggatgatttcgcattttggtaattaatgaaaatttatatcatgttttcgattttccttgtttctatcccttccaagacctgcctcagcaaaatttcccaaaaaatttcgctaaatttttaagaaaaccatcaaaattagcaattttgatgaaaatctgggtaaaaaaaagtttggccaaaatcctcaaagcctgggacctccctgttttattttaaaattaaaaataaataataaaattaaccaataaatcaattagattttaaaacaaccaccttaagctctgcgaacagtaaaagatgtatggaacaaagtgccgttgcacttttggacagtgtcaaaatgcgacgtgtgggcaaaaatgttgaagccgaagtaaccgaagacgcattttttgatggcaatctcatttactcactgatcgatcaaagtgccgtgactgatgacgatgctttatcatcattatcattgggaacatcgtcctcct

SEQ ID NO: 72780 - DNA, 99 bp, Heterodera glycines
  Genomic contig location: Contig_ID=SeqID_45491; Location=367..465; Strand=-
  SCN-specific regions: Sequence locations=1-99
cggcaccaagtccgaatctgtacccatccgcgaaccgagttgagacatttcggaacatgcgctgtcaacccgggccaggaattgttccgctgcggcgtc

SEQ ID NO: 72781 - DNA, 838 bp, Heterodera glycines
  Genomic contig location: Contig_ID=SeqID_9810; Location=370..1207; Strand=-
  SCN-specific regions: Sequence locations=1-403,425-472,494-838
atgaatactgataaattttgccttttttacgcgaggatgtcgtcaattaattatttaactatggataaatattcgtttattcgttttatgaagaacttagcaagacaaaaggaagcggctgttgaacttttacgtaattgtggaattgatggaaacgaaattgcatttgagaagtccgcagatccgcggaagtcgatccgagttttgtggaagggccctatgggccgtgaaaatgtagtgccgatatttttggagaatggtcactgggatggattaaagaaatatgtttgctttttcaaccgtgggaggaagttctgtattgattgaaaatttatgaatttaaagtgcaaaactcgaagaaacattcgatgctgatttggagagactcatgtttattgatgccggtgaagcttgagtcgctgaaggcgacatttaatttggactgtgaggacaagccctttttcccctattattacaataagaaagaaaattatggaatacgattggaacatctgccaccgatggaggactattcgccgggatctatgaacaaggctaaatttataaaattcgaaaaatggtaggaaaatagaaaaatttttgaataaaattcttttttttcaggtacaatgagaacaaggagacgcccttttatttggatgaagaattgagaaattattgcagaaacgacacggagattttattgttgtcgattattgagtttcaaaggatattgattaacgacattactaagggatttgacccactaccgaggagttgtacgaatgcgggggttgcgatgaatatttttaaggcaatgtttttattgacggagtag

SEQ ID NO: 72782 - DNA, 539 bp, Heterodera glycines
  Genomic contig location: Contig_ID=SeqID_9810; Location=1548..2086; Strand=-
  SCN-specific regions: Sequence locations=1-14,62-346,368-539
atcaatcgggtaagtaatttttaataatatatttaagagataattttattcaataatttttcaggaacaattttactgaagaaatggaaaattataaattaattgacgaacggtcgatgatttgcgaaaaatttggattcacgaagaacattacggaatttcggatcaattcggatgtgagacgccctgacgtagcgatgagggacgcaatcgacacaatgattaagatggctttaaaaactacggaagaaaaaatgaagcgaaaagtgcggatgtttggagtggcaattacgggtgctgggcttgcttccccggtttgggtaccatacagggcgtacccgcagaacaatgcggatgttattatgcaggagattaataagttggggcagagtggggacggagatgaaaataagaaaacgcttttgttgtcggagcctattatgatgaaaattactttcgtcacactgcccagtggagaagggccgaggaatgtacataaatttgatttcggatttaaggaacaccaacggataagataa

SEQ ID NO: 72783 - DNA, 429 bp, Heterodera glycines
  Genomic contig location: Contig_ID=SeqID_45492; Location=540..968; Strand=+
  SCN-specific regions: Sequence locations=1-62,90-105,138-154,262 -272,295-301,330-429
atggcccacttggagctcaaacattcaacgcctgggttcagagtcaagcaaccctggcttcatacccatttagagtttgagaataggttaaggacatttcgtccaccaagtcctctaatcattcgctttaccgagtataactgcttaccgagctccagctatcctgggggaaacttcggagggaaccagctactagatggttcgattagtctttcgcccctatacccaagtcagacgatcgatttgcacgtcagaatcgcttcggacttccacccagagtttcctctggcttcatcctgctcaggaatagttcaccatctttcgggtctcagcgcatacgctctgtctccgccccatcgcatgcgatcgagacgggactatgttgcgccccaacaccgcagtgccagggatcacacatcagctccgtaa

SEQ ID NO: 72784 - DNA, 64 bp, Heterodera glycines
  Genomic contig location: Contig_ID=SeqID_45492; Location=1477..1540; Strand=-
  SCN-specific regions: Sequence locations=1-38
gtaaacttcatctaagactaaatacggccacgagtcctatagcgaacaagtaccgtgagggaaa

SEQ ID NO: 72785 - DNA, 1019 bp, Heterodera glycines
  Genomic contig location: Contig_ID=SeqID_45499; Location=1..1019; Strand=-
  SCN-specific regions: Sequence locations=1-226,249-370,392-590,612 -754,776-987,1012-1019
  Gene Ontology: Biological process=glutamate metabolism
accctaaccctggtaagaaaaaactaataattaatcaaaactctattatttagtactaattgtaagatgagtaattcaggtgaacaaaaaggcaacccttctggagtttggccagattttgcacaaagtgtccttgcaatttccacacattaacacccgaggcggtgccgtcaagcaatttcatgccatcaacgacttggagaacaatttaatgaagaatgtaagtacaaaatgtacactaaaaattgcttaaaattattgcaggaattgcaaggatttttcgacggtccggccgtgaagaagcgcatcgaacgtaaacaaattgtgaacattaaccgaacatttggggctcggcttagctacgaagtgattgttgtccctttatcttttttaattgcttttttttttgttaattatagatatccgttcgttttggcgagaatgggttgccggaagggcatcgtcttgagttggacctaattggtgctgcagggcaaagtttttgtgcctttttggcgaatggaattactgttcgattggagggcgaagcgaatgattacgttggaaaggttttagtgaaatgcggcgtttttgaataattatttttaattagtgtttgtccggcggcaaaattgtcattcgcccctaccgcaattcgatctatgcctctgaacagaacactttgattggaaatgtggcactttacggagcaacttccggtaataaatgcatgattttacaacaaaaatgacggaacacttccttcaaaggaactgccttctttcgtggaatcggcggagagcgattcgcagtgcgaaattcgggcgccacggcggtgattgaggcggttggggaccacggctgcgagtacatgacgagtggaagagtggtcgtgctgaatagcatcgggcggaactttgcggcggcgatgagcggcggattggcatttgtttatgacaagtgagtggtggagaagagacagcactcaaaagggcaaccaccaaatgggagaggggtgc

SEQ ID NO: 72786 - DNA, 770 bp, Heterodera glycines
  Genomic contig location: Contig_ID=SeqID_45501; Location=107..876; Strand=-
  SCN-specific regions: Sequence locations=1-168,191-317,340-525,548 -704,727-770
  Gene Ontology: Mol. function=protein binding; Cellular component =actin filament; Biological process=intracellular protein transport
atcgtcttgggctcaacccaccaacatttcaatcaccgggactcaaaccgtcagtatttcaatcactgggactcaatccaccagcattccaatctctgggactcaacccgaccagtatttcaatcactgggactcaatccaccagtatttcaatcactgggactcaacccaccagcattccaatcactgggactcaacccaccaacattccaatcaacgggactcaatccaccagcattcaatcactgggactcaacccaccaacattccaatcgcctggactcaacccaccagtatttcaatcactgggactcaacccaccagcattccaatcactgggactcaacccaccaacatttcaatcactgggactcaatccaccaacattccaatcaacgggactcaatccaccagcattcaatcactgggactcaatccaccacattcaagtcactgggactcaacccaccaacattccaatcgcctggactcaacccaccagtatttcaatcactgggactcaacccaccagcattccaatcactgggactcaacccaccaacatttcaatcactgggactcaatccaccaacattccaatcaacgggactcaatccaccagcattcaatcactgggactcaacccaccaacattccaatcgccgggactcaacccaccagtatttcaatcactgggactcaacccaccagcattccaatcactgggactcaacccaccagcatttcaatcactgggactcaatccacca

SEQ ID NO: 72787 - DNA, 1948 bp, Heterodera glycines
  Genomic contig location: Contig_ID=SeqID_9812; Location=109..2056; Strand=+
  SCN-specific regions: Sequence locations=1-20,42-467,496-651,673 -1457,1479-1916,1938-1948
  Gene Ontology: Mol. function=1-phosphatidylinositol 4-kinase activity; Cellular component=Golgi vesicle; Biological process =synaptic transmission
atgacaataaacgctgtgctcagctgcacggaacgggaaacggtcaactcgctgatccatgtcactggcggttcagcaaccaatttgcaagttttgcacgctgctgccgacacgggttcagtcggtagtctggcgggtgctgccttttggaggcattcgaggcaaacatttatgcatttcagggtcggatttgtcttccgccaccagtccattagacatttcgacttatttgtcggcaattaatctccgcgcgggttatttgggtcaaatcaaaggaatgttcgaaatgttgcgtgatacgcataacagtgaagaaattgcgcatcagcttctgtcggatcacttggaaaaacttttggactctgccatcaaatcttctgacccggacagcatcagcaaaccgttgcatctgatgacagcttattgcaatttttgttcacgtatcatcatttttagaatttttggagataaaaaaaagtattatttaattttaatcgcagaaatcaatcagagaattttgcacgcggtcatttgggctccattacgaagcttcacggaacagacaatgcgcaattgcataatttgttggaattggattttggtttcaatgaaagacattcaaattgatgttagtgaaattgataaattaggtaaaaattactgaaaatttcttttagtttttacaacaaatgaccagctgttggaggattgtgtcacagcaaaatttgggtcttttcagcagagagtacgactcttttgcttgtccactttcctctcaaaactgtgggcaaaggccgacgccaaatgccattccgcataatatttggatcaacgtacgttttcttggagccggtgacttcattagtattccctcttaataaatttagaaatatgaatatttcgaacatttttgacaaaagttagaaaaactaaactaaaaataataacccataaaaatgcaattcattttaaaattcaaatttccctatactcatttctcagtatcttttgctttttgagttgtttttattctcccacagtttttggctgaaagagtgagcctcgcgcggtattgcggccgagaacaaatcgacttgttggagatgatgttcattcagtccttctctctgagcattggcgagagtgtgccttcgtctaattcggcgtctcctgaccaatttttgttcattcccgaacaaaacaaagtggcagataacactcgtaacttctttcttcgcaatatctattcatggattttccgttttttagctcttatttcccgtaatattgtcgctgtcggtccccgtttccgcttactttcgtccgcactgacgatggtccagggcgagacaagcggatgccgcatttcgaagaacattctccgccatcggatttatgccgtggcattcgattacttttctatcggtccccaaacgccattatatggaggggcatctcttcagaatgacattcgcagcattgtcacattttggcaagcactttatgccgattcaaaatacattcggaaggagtcattctccaccaatggtctttccacttccttttatgactttttctgtaaaattgttaagataatgaaattcttttcaacggtcttccgccacaattttacggaggtcaacacacaagcgaagctgcgaagtttaattacgggaaaaacatcacattaatacggttgtgattaaggaaccaaacttggcatggttcgactccgatctccggcggttggatgacttcgacagcaattgcaaacagaacactgatggggacagtaggacaaaacccactttctaatttacgcatccaagcgaaaatcaacgaggagaatgctcaaatgattgatcgacaaatgaagaacattttacggaaacgacaacttctgctgatccttttggtgattggaatcagcttttattattatgattag

SEQ ID NO: 72788 - DNA, 585 bp, Heterodera glycines
  Genomic contig location: Contig_ID=SeqID_45502; Location=348..932; Strand=+
  SCN-specific regions: Sequence locations=1-585
atgcacgcgttttgcgctcgagctatttatcatcgggcttgtcaatccaaagcgaaacaacaaagatgctgttttgaacgaataaagggcataggttattttgaagaagtgtcaaagaacatgcagcaataagcctgcaaaatctaataagtggaaaatacatgagtatagaatttattttcagaaagtgtcaacagacttttggaaaaatatatttgcaatttatcaaaaattttgagaagtgagttagaaatgataaacttcacgattcaaaccaattttcgttgctctaattaatccaaagcgaaacaacaaagatggtgttttgaacgaataaagggcataggttattttgaagaagtgtcaaagaacatgcagcaataagcctgcaaaatctaataagtggaaaatacatgagtatagaatttattttcagaaagtgtcaacagacttttggaaaaatatatttgcaatttatcaaaaattttgagaagtgagttagaaatgataaacttcacgattcaaaccaattttcgttgctctaattaatccaaagcgaaacaacaaagatggtgttttgaacga

SEQ ID NO: 72789 - DNA, 691 bp, Heterodera glycines
  Genomic contig location: Contig_ID=SeqID_45504; Location=2..692; Strand=+
  SCN-specific regions: Sequence locations=1-38,68-315,337-375,397 -440,470-669
atgttttgtaatggtaagcaaacaatttttatcacaactttaaatttaattttttatgttttttaaagaacccaaggcaacgaagcacttgctgaatatgatcagagatttatcgacattttgcgcaaaaatttggagaattctcgtgactttgggtatgttttactcaaactaactgaggaaaagatggacatattgtcgaccagcagtgagaaacagaaagcgaagaaatacgaacaattgtccatgtatgtataactaattaaaattaattagtgagctaattagttgttgataatgaatgggaaattgggtcattcattaataacaaaattatttgacgcctctgtctgggttaactcatttatcttttcttttccatattttcaaattcttgcagattatatgcctatttttaatttattttggaattttggttcacattttgtgtaaaacatttatttttcagcactcgacattgcttttctagaaaattttgtcatttcttgataaattataacccaaaatcggacgttttgcctactggacatttcgcctactgaatatctcgactactaacctaaaatagatctttcgaaaacgaatttcaccaaatatatctgaattaatttatatttagctattttagaatgctaatgaaatttagcctaaaaaagcaaagaaatattta

SEQ ID NO: 72790 - DNA, 412 bp, Heterodera glycines
  Genomic contig location: Contig_ID=SeqID_45505; Location=578..989; Strand=+
  SCN-specific regions: Sequence locations=1-412
atgtggggaatcacagaaactttggtcgccaacatcgcggtgagcatttgcgctgggtttgccgcccaccattttatccggcagttcattccggtttttgttgagcggaggttgtacggtttcgacatgtgcaaggtccttttacgcccaagggaatttgtgtctaaaactgttccatggtgggaggacgttaatgctcttcccgaaattcatttttaatttccgaaaaccgactaaatttgcagagggacaaagaaaagatcgctgagccaatgggcgtcgttgcggccgccgtctatttgattttcgtgttcgccttcatccccgtgcccttttacgaatggctcagtcaaaacattctcttcgccggtgccgctgacaatcgccacggaaaaggcactcaaatcgaacg

SEQ ID NO: 72791 - DNA, 80 bp, Heterodera glycines
  Genomic contig location: Contig_ID=SeqID_45508; Location=892..971; Strand=-
  SCN-specific regions: Sequence locations=1-80
ggaagctattcccgaaggattcggtctccccatcatagcagggcttttccttgtcttttggactgccctcgcaaaatctg

SEQ ID NO: 72792 - DNA, 288 bp, Heterodera glycines
  Genomic contig location: Contig_ID=SeqID_45509; Location=746..1033; Strand=+
  SCN-specific regions: Sequence locations=1-12,174-288
atgggacgaaacggaggaggggaaaagcgggagaagaagcagaagggagacaaagaggaggcgcaagaggagaaaggaggaaaaagtggagggaaaggaggagaaagaggaggagggaaaggaggagaaagaggaggagggaaaggaggagaaagaggaggagggaaaggagggttttttcatcggcggagagtgaagcgcgcgccatttgctgaacggactgataacaatcaaataacccaaaccattaaattgtattttgcattcgacacatatgaacaaaattaa

SEQ ID NO: 72793 - DNA, 1054 bp, Heterodera glycines
  Genomic contig location: Contig_ID=SeqID_9814; Location=873..1926; Strand=-
  SCN-specific regions: Sequence locations=1-389,433-782,810-890,913 -942,1010-1010,1033-1054
atggctctctccaaggatatgcgtgcccaatttatgcgaaccattcacaaaacggtgcggttcttttggaagggcaatgcagcaggaacaacaatatcaacaagagcactgcaaacggtagccgactcaaaccagtacagtagccaaatacggtatgtcaatgttcatgctactggaagaaccaatcggattactggacaataattacgcaaggaattcgaagattatttgcacaaattcttttgataattaaagataattattaattttacatttgtaatgctaatttttgtaatttaatagcaattttaatttttcatcgttttattcgaacttttgattgataatctatctagtcatataaaaaaataaatcatcatccttaacaatttttgtccaataattaattacttaatttattttccatttttcgtcttcatcacatccataactttgtttctgctttcatcgcgcttctctgaatttttgtatttgtgccgaattgtttaattgaaaatttcacctaaacattttaattaacagcgctttttaggtgccgtggacttcctttgaggaatgctttaaattcctaaaaaatatgtttttaatagggtaggtcgggaccgggaattttgggcaaaaccgggaccgggacttttcgggttgaaaaacctgagggaaaaaaccgggaatttcccggttccggtcaaaactggtcaaaaccgggacttcggtactcagttgtccgtgttttggtcccggtcccgacctactctagtctttaatcaaaaatcttttttaaaaaattttgccaaaaaaaaacctttgcgcaagcacagtttgcttcacttaaggaaacgaaaatttctaggcatttttattttccggtcaaaaattttaattaaaaattaacgaataacaaaaatgtctttttattaatacaaagcaaaaaaaaaagaaaagaaaaaaatgcaaaatgggcaaagaaagaaaagtgaaaaaataataattttcagcaaaagaaaaaatcatttttaattagaattacaataaa

SEQ ID NO: 72794 - DNA, 386 bp, Heterodera glycines
  Genomic contig location: Contig_ID=SeqID_45515; Location=673..1058; Strand=+
  SCN-specific regions: Sequence locations=1-129,230-386
atggttgcacaaataaggcctttgcttgccgattttgtgggggaaaaccaagtggacaatattttcaaaattcttggcattccgaccattttggaaggttcgaatgatgcattattattagtagacacggaaagagaagaaaatgttgaaagtaacaaaaaaagtacgacaaaaaagaaaaagccgaagaagaaacagctaaacactgaagaaaatggaggagaagaagcggacaaaacagcgacaagtgacaaattgtcccaaaaaggtgttgctaatgagagtgagcaaagtgacaaagtgtcggcaaatatttcaggggaacaattaacgactgataaacagccaattaatgatgatggtgatggaataattaaaactaatag

SEQ ID NO: 72795 - DNA, 89 bp, Heterodera glycines
  misc_feature (85)..(85): n is a, c, g, or t
  Genomic contig location: Contig_ID=SeqID_45517; Location=1031..1119; Strand=+
  SCN-specific regions: Sequence locations=1-89
attttgttacggttattattcaagtcgcccctaaaactcggttgtcggcggtacgcttcattaattgctccaatttgtgccctgngtaa

SEQ ID NO: 72796 - DNA, 721 bp, Heterodera glycines
  Genomic contig location: Contig_ID=SeqID_45518; Location=497..1217; Strand=-
  SCN-specific regions: Sequence locations=1-94,116-506,533-721
atggatttaattcttgccaccgattggataaacaacgcttatcccgaaatggatttagaggacgccaacaaagataacaaagagccaacgaaaaagcaagaggaggaggcggaggatccaagctggatcagtctcattgacgaggagatgaagcgcgagccgctcgctccaattggtgaggaggcgccagcaacaagttacttttgttgtcattgacatgtaaattttaaattaggcactccaaaaaagtgtggttgcgccgaacgccgtcgccccgtgccgctcgtggaccacctctgcaagcggttcaaatgcagtgcccatgaactgcatgtgcttttcaaaagcctagagaaacgccgggacattgtggagcatttgcgctccatccaactgcgcaccgcccacctgcgcccttccgtgcgcaattttccagtgcggtgcaatgacctttccatcctggacacccactccgccccagcttaccgaggctacctcagcataacggtgtttttatttgttttgttttgtcggtaccacgcaatttaaaggtacggatgcactactacataaaacatggcatccgcttgcgccaccccaatttgccgtgcgtcgttgaatttggaggcggagaccacaaaaccttttttcctcttgaaattttgtccattgttttgtagatgtattcaatttccaattgtactgttgtttttaaaataaa

SEQ ID NO: 72797 - DNA, 464 bp, Heterodera glycines
  Genomic contig location: Contig_ID=SeqID_45521; Location=566..1029; Strand=-
  SCN-specific regions: Sequence locations=1-173,203-259,284-464
atggctcttcgcgttcttcccatcgtcattttggcactgtttttcatttttgatggcacttttgcaaaaacggaggatgaaattaagcaaacgcaactgctgaagatcttaagcacaaaaacaacgaaaaactcttctgtgcaaacggaggatattgaaggtgattcaatgagaaaaataaaaatttatactttttaatattcgtgagactcgtcaattaaaattaaaatttaacgagaaggcataatttaggataagttttaaaaattctgcccaaatttgaccgtttctttgaaagtgccattcttggccatagacacacaaatcatttttatatacgaaatatatcattggcgatttaagacgcaattgcgtacatgaaattgacaaacgaagaaggatacgaatcgcggatgacgaaaggcactggtgcaaaacaggtcaagaatttattacatcattaa

SEQ ID NO: 72798 - DNA, 843 bp, Heterodera glycines
  Genomic contig location: Contig_ID=SeqID_1332; Location=47..889; Strand=+
  SCN-specific regions: Sequence locations=1-779,824-843
gactcaaccctacagcattcaatcattgggactcaacccaccaacattccaatcaacaggactcaaccctacagcattcaatcagtgggactcaacccaccaacattccatcaacaggactcaaccctacagcattcaatcagtgggactcaacccaccaacattccatcaacaggactcaaccctacagcattcaatcagtgggactcaacccaccaacattccaatcaacaggactcaaccctatagcattcaatcagtgggactcaacccaccaacattccaatcaacaggactcaaccctacagcattcaatcagtgggactcaacccaccaacattccatcaacaggactcaaccctacagcattcaatcagtgggactcaacccaccaacattccaatcaacaggactcaaccctacagcattcaatcagtgggactcaacccaccaacattccaatcaacaggactcaaccctacagcattcaatcagtgggactcaacccaccaacattccatcaacaggactcaaccctacagcattcaatcagtgggactcaacccaccaacattccaatcaacaggactcaaccctccagcattcaatcagtgggactcaacccaccaacattccaatcaacaggactcaaccctacagcattcaatcagtgggactcaacccaccagcatgtcacagaacaaaccactaatgttttttcaaaagcattcttcattcatccacccggggggataaatagaatttttattttttcgaacaaataatttctttaaaaatttaattaaaaattaattaatttaaacgaaactcattaaatgttta

SEQ ID NO: 72799 - DNA, 443 bp, Heterodera glycines
  Genomic contig location: Contig_ID=SeqID_1333; Location=543..985; Strand=+
  SCN-specific regions: Sequence locations=1-341,364-405,427-443
cgatccaaattgggggccagggttggaataccagggttagaccgttgtcatgattgcggtttaaggggtaacggtcgaaatcgacgagacctgcattgtgcgcagaaaatacaacagagggcagttgagggggaatgtgaatgagtggctttttggaggcattgagcgcggggaaccaatggacaaagggctttcatggtgccagtcctccgcagacgagcccaagatctgctgccattgatagagcaatacattgcccctgggagtataattcatagcgatatgtgggcggcttatggggggattcccaatctgccacagaggtaccacatcatacagtaaaccataatgaaaatttccttaatcccaacgacccaaatgttcacacccaaaacatcgagggtatgtggtccacatacaaacgcaaattccgccccaatctg

SEQ ID NO: 72800 - DNA, 4572 bp, Heterodera glycines
  misc_feature (1105)..(1105): n is a, c, g, or t
  Genomic contig location: Contig_ID=SeqID_1333; Location=1..4572; Strand=-
  SCN-specific regions: Sequence locations=1-315,366-409,442-493,515 -789,812-817,839-909,972-1003,1029-1034,1058-1343,1365-1390,1412 -1731,1753-1933,1956-2017,2044-2114,2136-2434,2458-2484,2519 -2598,2620-2636,2661-2901,...
  SCN-specific regions: Sequence locations=...2923-3234,3261-3286,3308 -3479,3520-3559,3584-3604,3626-3667,3690-4021,4043-4474,4500-4572
  Gene Ontology: Cellular component=cytoskeleton; Biological process =microtubule-based process
gacgaccccctccctcttttacagccgccccccttacgacgaacgagggggggggggggtgtccgaggcctcttatgacgagggggtgggtgtcgagacaccccttgtacatgtatgtttttgttatgttcgggatcgagcatttaaaattatattgacaatttcatcgattagcaatgaaatatttcgaaatttaagttttaattttgcatcggcattattaatggattagtaattaaaaagtttatagaatttatgggcaacaacttatcatcgcatgcaaaatgaaaaattttattttataatcaaacctacaaaatttcataaatttaaataaatttaattttttttaatttcaaaattaagtttttctaaaatcttggttaattttcaaaattcttatatgtaatagagtgattttattttatagatgaataaaatgatcagaggatagagcaatgattttgaatcccattatggaaaaatttaccgttgaaaattacaaatttcacccggatttaaatatcaagaatctcgctcatccaactactgatatttaatgattgaatgattacctttttaatggttggtgaccatgttttgctgccatttagctgctccatcacgagaagcagttcaacgacttgcaaaatcagggcgccgcgctgatcaaccaacgccacccggcgggcgaagtgatcgaggtgtacctgcgcaaaatgcagaaccaacgggattggatgctgaacctgagcaagtgcctggagggccacctgcgcgacgcgtgcaatgccaaggcttttgtggaggagtcggagcaggtggagcagcagatgcagcaacagttggtcagtttggctaatgtcagcactggggagggaatgctttccgaaaaatttcggaattccgaattattttaaaaaatttttaaatgttagaaaattttaaaaaaagatgttttttttttaattggaaaataagtttatacaaagtcttaatgcgtttttaaaacttgcacaatttccttagcgaaatctatacaaaattttaaaattttccccccctgtccccccaaaaagttttttaaaaaccacgccgcaaaaanaacgttttttttttttaaaaagtcgtagacttgccaaaacatcgcaaaatttggcccggaccaccccaaaaaaaggtttttttactttcttttttttctaagactttcgcttcgaaaaataatccatttaaaatgtgacatacctacacatcaaatagtgtagtggattatccaaactgactccattaggggtcgattaccgtctctgatccctgacaaatttttgccggtttctgggaaaaaatatatttaaataattcgtcttactcattccccaacgatttcgcttccccgtcctcatccccgttgtctcctccatcactgatgctttcggattttcagaaattcttgtcgcaaatcaaattcgcgacattccttggccgcaaaaaaagccgttttaagagaaaaaatttgttgatttacatgactggctccgacacccctccccccccccgacttattcttagattttgagaattttgtattgagttttattattttgcccaagaaggtgaaacctaagcgtcggattctgaaaaatttttgaaggttgatggtctttatggccgtgttaacaggagagctcatcttgaaaatctttttaggaaatttgaaataatttgttcaattttgaatttaatcatttttaaattttcctattagtcaaacaaatgagatagtgatcagatttcgaatttgatgcttttgaggtggtgtcaactccgggaacaagcggcgccacgggtgccaccgctgtgtcacaactcattgaaggtactaacgcttgtctttgacacttcataaaattaatcgtaattgtgaccaaattgaaatttagaagacgaggaaaaatgtgcccgttgtgccacagcatcagccactgtacgaaggattgcaacaagcgttgaatcggaagaattatttttattttcatttgtgcgtttgttttgatgtgttaagcataaaaatttttcaattttttcgtgcctatcaaagtgcctttttcacgatttttggcgcctaaaaatttttgaaattcttttttttaaagggagcccactttggcgattttttgaaaaatttggttttttacaaaaatgtcttttttggcactcaaattcggtaatagtatggtttacaggtcccacaaaaaaaaggcaaaaagggggttttatgcaattcttcaaagtcctttagggttctcgagggcgctgatcacgaatataatattcatttcgaccaatttcgaaccccgaacccgaattcgaacctgtaaaccatactatcactatgggtcaactccactgtgcagagaaaagcctagtactatctcgtcgtttctctttttctttgtaatttctctctctttggcgtactatctcttcattttaatggtgtaaaaaacaacatttgcttttctatgtctagctttttttctctatgttaaatccgcaccaaattttgcatagcgatagagaagaaaaatctgcatttttctatactgattttatttttgtttatactcccattcaaaaattataaataataataaaaacgtatttcttttttctctcgttttggcgtactattttcatgtctctaacacatgaaaaaacataaattcgaaaattctaataattttggttataagggtacaaaatcactttgaacatttagaatcaataggaaaaagaataaatttagcattttggttagaaagagtctgcctaggacttgagttataacatgataaaagtttgaaattcccacaacttttttctgagatgacaaattacttaacattcgcttagaaaaagattccccttttcaaaatctttttttagatgccaaatttgttcagtttgattgggtatgaatttacccttttcatttttgatccgatttcttaaatattttgataattttcaaattttatgccatcaaaaaatcagcatttggggttaaaaatcaggattgtgtgtatgttttattagtataacaaatgttttgattctgatttttcatttgttttttctatttgccaagaatggtgaaattttggattagtaaatgaaacggaaggaatttgtctttgggttagtgaaacaaaaagagttgcattgaaatagtttttaagaaatgaaatattctaattagttttggttttgtttatggattttgcttctctcaaaattagtcaatatggaaaattactgaatttgaatttattagtacgaatattttggggtaatagtagggtttgtcccccccccctccccaccttttttctaaaaaatgattttttttttgaaattcatcaaaacgtctttcctggggttttccatttcgaccaatttcgaacaaaaagtcaaaatttcatttttcaacaaaattcacatttatcttccaaaatcgattcaaatggatggaatggcaatacaaatgcgttgaagacatgagaaaagaagaaaacaaacattaccagattggggcggaatttgcgtttgtatgtggaccacataccctcgatgttttgggtgtgaacatttgggtcgttgggattaaggaaattttcattatggtttactgtatgatgtggtacctctgtggcagattgggaatccccccataagccgcccacatatcgctatgaattatactcccaggggcaatgtattgctctatcaatggcagcagatcttgggctcgtctgcggaggactggcaccatgaaagccctttgtccattggttccccgcgctcaatgcctccaaaaagccactcattcacattccccctcaactgccctctgttgtattttctgcgcacaatgcaggtctcgtcgatttcgaccgttaccccttaaaccgcaatcatgacaacggtctaaccctggtattccaaccctggcccccaatttggatcgggtgtcggacaaaatactcagcgcaaacatcgcggtaaaaattcagccaatcagtgatgacctgtctactgatcccggtatccttttcaatgtcatcaaatgtgccgaatttgcgggcccacaaatatgacagatgaataatttcttttgttgtcaatggtgaatacaaaaggcgttaaaaatgcagagcaatggacaaaagccagcacattttttaacgaagagacgaacgacggtcagttattggccattccatccatttgaatcgattttggaagattaaaaataatcattctgctcagattcgaacataaaatgaatttttcaaaattttgatttttcgactttttgttcgagttcgagtctggggttcgaaatagaccaaaataaatgccatattcgtgatcagagacccaaaaaacccttagaagcatgttttcacggctttttaaaacaaaaaatttttctgccgaaaaatgggggggggcaccacgtcgggaccacaattctgcattattacccaagaattcgaaccttttacg

SEQ ID NO: 72801 - DNA, 2071 bp, Heterodera glycines
  Genomic contig location: Contig_ID=SeqID_1334; Location=1..2071; Strand=-
  SCN-specific regions: Sequence locations=1-375,397-604,628-1096,1119 -1343,1365-1536,1570-1670,1702-1732,1754-1765,1834-1903,1933 -1988,2016-2047,2069-2071
cttggcctcagccagggagcacgctacgtcactgaacgatactcgaccgcatcgtccggcacgcgtggcaacgcttttcgtcgagttgaggatgccatccaatggattcgtgatcgaatggtgtgtttgatgcggatatactcaataattaaatgcttgttatgtgttgattaaacaaccgggttagggtttaggtttgaattgttttgattttttaacccaataaatatatcaactgatcattatcatttttcctatgagctgaacgtattataaaggctgtgatcacttcaactccgaggtttaacagacctaaaaaatggtctgatcaatttcttccttcggttttaactgatccccatattgaattgatcataaaaatagcagtgttttaatcatttacgtgaattaggactcctaattatatggtcgcaggcttaataaacccatttatttcagcataagctgaactcgatgcaattcagcgagacgctggaagtgttggagcaaatctttgaacagcacaagctggacaaccgggacattcaggactttcgacaaacggtggacgaatgcattgccagacaagtaaaaaaaattgccaaaaataatttaataaaacaattggagtgatcttacaatccattttttgatcgggggaaggtgagacaccaaatttatgtgataaaaatattttgaattgtttctggcctacaaaatgccaaattgttagagtcaaaatattggaatattttaaatctctgatattgaaccggtggttctaccgtatatttcatataataatctcgaccaagatgactatgatcaagaatcattcctcgttccttccaacgtctacgttctctgatcacttttcactttctcaggctgaagtatcagcagaagattcatacgattattgtgagctgttgaaaatgatggagtcggagtaccaacagttgcgcgaactgtctgccgggcgcatggtcgatttggtgggttgggctttataccatgcttaattaggtcctttaatagggcaattaaattatgcgttagccatttccttaatttttgccatggtctcttaatttgatcatattttctttcttgtttattactgatcaaccaaaatgctctctctctgatcacaggactcgctgatcgccttcatccgtgctgctcagcttgaactgtgtttgagccatcgtcgtcgtgaggcattggaagtgaagcgtaaccggagcgacttgggacgcctggacattccgatgctgaaaatttacttaaagcaggtagttgggcgggcgtgactaattgggcataattggccagaaaataaattgtgaaaaaagttgtttttgttcatacatgtacaaggggtgtctcagaccaagggccatacgcaggcccgtagccatggggggggggaagggagttcatgattaattactcactggttgaattttttattgctttattattcgccaaacagtctgttagtaattatgtttaatgagtttcaattaaatgaaattggttgaaaataattatatttatgtacagaaataagaattattattttttcattataaattcttttagggttttctttgtttgcataattgcctatgttaaaattgatttttgcttcacttttttatcgaaggaaatattttctttttaaatttttttataattgagatgatttgatcactttttgtcgccaataaaattaaacaatttatttttaatcccttgaatcattttaattatatatataatttttaaaatcatttatataaaatttttgcttttcttccacttttcctaacgatttaaaattgaaataccattcactcgttttaataatttacggccaacgttctgccacaaattggccaattaataaaaaaatataatatatttaatgatggtcccataaaaatccaatccattaaccaaacaaacatatttttaaaattcttcccaattttaaagaaataaaaatttttggcgcctaaacgacgtgaccgaggacgggggagaaaaatgatcatcatcaccagtg

SEQ ID NO: 72802 - DNA, 2263 bp, Heterodera glycines
  Genomic contig location: Contig_ID=SeqID_9816; Location=693..2955; Strand=+
  SCN-specific regions: Sequence locations=1-358,383-563,596-802,831 -891,915-2263
atgccaatcaaacaaaagccatcatcccaaaccggacgcagcggctccaaaaacggaagcaccaaaaccggcagtgcctcgccccacagttggcccagcaaaaccggagcagccgagccgaaaggcccaattgcaaccggttaaattgccaacaccaaacaagcagcaccgatccaaaaagtgatcaaaccaaaaacggtgacgactagagaccggaaatttcaaatttgcggatcctgttgcaggattggagttcaaaattttttacaggacaggatccggcaggattaatcctgcaaatcctgcaatcctgcaaatcctgcatttaaaatctgcaggatcctgcgcaggattgcggatttttggaaattttgaaaaaattctgtattaataaaaaagtctttcaaagtataaaaaagtattcaaatatatttttaaaccaaaaaatgatgaagatgaaaattaataacgtttttttgcttacactccaagcaatcgactgaatcttctttaatgcgtttaaaaagaccgatttgccaaattgggtggctcataataatagcttaaattaaagtaaaataatttgtatttaaatttctttgcaaaaaagccataatccataatgtatagggatgggatttttaggcacaaaaaatcgcgaaataggcacttaaaaaggcagaaaaatcctaaaataggcacgaaaatagtaaaaaaaaattattaacgctttttaggtaacaaaacacataaaaaattcaattgtataaacttttttcgaataaggataagtttttaaacgaaaaatttttattaataaaaaaatttttgaaaaaagaaagtttctgaatatttggcattctatttttaagaattttcaaaaaatcaatgcatgatcctgctgaatcctgcataaaaatcaaatttgcgggtcctgttgcaggattggaattcaaaattttttacaggacaggatccggcaggattaatcctgcaaatcctgtaaatcctgtattttccaaaatatgcaggattgcggactgggatcctgcaaaatcctgcgcaggatcctgtcctgcgccggtctctagtgacgactacgctgaagtaccagccaccgaggccaacgacttctccaaaagctgaaccgccaaagccaatcgtcgtagccccaaaggtcacaagcccggtgaccacgcaaacggtacaaccaacctctccgccagaaggacaaccgaaaagtcggaaccgaggaagattccgaacgcgatacgttatgcacagaaaccaaagcgaacctgaaaaggtaagagtttacgacaattcgagacgaaagagagcgacggtccacacggagcaaaagtgggcactgttcccgtactacaacaccccaatacagggagcggaaagagccaacccgtggtgcgctatgaacgcgcaagacgagcgagactaaaaccagggctggagcaatcactggaggaagcaacgcggcagttggaagaatacggacgagtgacaatttcgaatccgagggcagtgtgttgaaagcaacaaggggaatgatcacaagggatcaatgatcaagggggaacgatcgggaaacgataagggattgaaccaagccaatcccgcccagagcggctcgattcagaattggagcgcattcttcaaggcaaaaaagagtaagcgcccagcagtctcgaggtcccgctacagcaatttgtcgaagcacgggcccaccaagccgaagaggtgaacaccaacgtgctcaacgtcaacacgacagagtcactggtcgtggtcgcagcttgcacatcagtagtgcagcagccgattgaacacctgaagtacaggtcgcagctactcaagcggaagatctcctggacttgggcaacgaagcgttatttcgttaacgacgccaagttcagcgagacaaaaaagacggagctggacgaagcactggaagctctgatcctgtcccaagtaccgccaccggaagaaagggagctgaagcagaagaccttcgatgccatcggacgcatttcgcgaaggaacctggaaggaattcgaaatttgcatcgctgggtccacgcgggcaaacactgccctaagaaatggggatttgcacatcgttctgaagcccaagtccagtgagccattgagccaagagcgaaggcttcgcgagctccaattcctggtcagggaattccgactgatgaagcgtgagtacatttactgccactgtgtcttcatcgccaaa

SEQ ID NO: 72803 - DNA, 351 bp, Heterodera glycines
  Genomic contig location: Contig_ID=SeqID_9816; Location=899..1249; Strand=-
  SCN-specific regions: Sequence locations=1-351
attatgagccacccaatttggcaaatcggtctttttaaacgcattaaagaagattcagtcgattgcttggagtgtaagcaaaaaaacgttattaattttcatcttcatcattttttggtttaaaaatatatttgaatacttttttatactttgaaagacttttttattaatacagaattttttcaaaatttccaaaaatccgcaatcctgcgcaggatcctgcagattttaaatgcaggatttgcaggattgcaggatttgcaggattaatcctgccggatcctgtcctgtaaaaaattttgaactccaatcctgcaacaggatccgcaaatttgaaatttccggtctcta

SEQ ID NO: 72804 - DNA, 372 bp, Heterodera glycines
  Genomic contig location: Contig_ID=SeqID_45522; Location=459..830; Strand=-
  SCN-specific regions: Sequence locations=1-372
atgtcccatcgtcgttcacatgctgataatgtggaaacaatggtaagtacctaaaatgtatggtggcatttttgtgttaaaaaatctgccgaataaaaaaaattttttcctattttttggtcaaaaaattctttttcaaccattttgaaacttttaattgtcatttaggctctaaagtactttataaattgaaaattgccaattttccaggcccaactcatcgccggccttttgcccccgttggcgttggaagcgcggatcagtggagggaatgcgctcggcgaccaattggtcacgcagttgggactgtccgtccaagcggcacagaatgtggacatggccattttgggtagggccaaattaaaaatttga

SEQ ID NO: 72805 - DNA, 93 bp, Heterodera glycines
  Genomic contig location: Contig_ID=SeqID_45523; Location=20..112; Strand=-
  SCN-specific regions: Sequence locations=1-93
atggggagcaaaaatccaaagcagaattacagtacaggctatagggaagctattcccgaaggattcggcctctccataaatctgggcgcatcg

SEQ ID NO: 72806 - DNA, 150 bp, Heterodera glycines
  misc_feature (127)..(127): n is a, c, g, or t
  Genomic contig location: Contig_ID=SeqID_45525; Location=143..292; Strand=-
  SCN-specific regions: Sequence locations=1-150
atggcgcagggcggcgtgcaccacaaattggccgacaattattacttggaacgcgacggacgccgcgaagttcgtccaccgaagcccatttacaaagcgctgggagagacgccgttgtgggaaaagnccgagcggtgggcgatcgctgac

SEQ ID NO: 72807 - DNA, 751 bp, Heterodera glycines
  misc_feature (571)..(571): n is a, c, g, or t
  misc_feature (651)..(651): n is a, c, g, or t
  misc_feature (737)..(737): n is a, c, g, or t
  Genomic contig location: Contig_ID=SeqID_45526; Location=60..810; Strand=-
  SCN-specific regions: Sequence locations=1-107,134-217,239-263,292 -533,555-580,609-751
atggagaaggcctgcaaaatttggagagattatatcgattttagtgcgctaggttcgatgaaactttttaaaatataagcctaaactttttggcctgtttaaaaaggaattaaaaatttttaaaaattttattcatctcccttttgatagtgaaagcatcagagagccttatttaacttttaattaacatttggtgcgtttcagagcagtttctgaaaaaatatttatgaattaattttgctaaaaaaataaaatagtgaagctttaaaaattaataaaaaattttaaattcagaattactggagttagcatcatagcagtgcttttccttgtctttttgatgctctcgcaaaatctggttcgcttctgatcagtttataaaaaaaaagttaagcctaaaatttttcgcatatttaaaaagcaattaaaaatttttagatttttattcatctccctttttgatagtgaaagcatctgagtgcctaaaataacttgtaaataaaatttggtgcgtttcagaagcagtttgtgaaaaaatatttatgaattaattttgctaaaaaaataaaantagtgaagctttaaaaattaataaaaaattttaaattcagaaattactggagttacaatcataagcagtgctttttcctntgtctttttgatgccctcgcaaaatctgggtcgcttctgatcagtttataaaaaaaaagttaagccctaaagtttttcgctcgttntaaaagcaattaaa

SEQ ID NO: 72808 - DNA, 138 bp, Heterodera glycines; identical to SEQ ID NO: 50950
  Genomic contig location: Contig_ID=SeqID_45528; Location=73..210; Strand=-
  SCN-specific regions: Sequence locations=1-138

SEQ ID NO: 72809 - DNA, 677 bp, Heterodera glycines; identical to SEQ ID NO: 63383
  Genomic contig location: Contig_ID=SeqID_45528; Location=212..888; Strand=+
  SCN-specific regions: Sequence locations=1-60,82-677

SEQ ID NO: 72810 - DNA, 2092 bp, Heterodera glycines
  Genomic contig location: Contig_ID=SeqID_9817; Location=872..2963; Strand=-
  SCN-specific regions: Sequence locations=1-100,122-209,231-455,477 -509,531-534,575-588,617-1110,1132-1208,1262-1590,1688-1781,1812 -1888,1911-1956,1999-2019,2061-2092
atgccaaccaataatgctgtggataggccagaatttggaagccttgttggcacaactgcaacaataggcgcagcagttggtgcaccaattggtgtactcgttggtggattcattggctcaacagcttttcctctccttggaacagcagctggtgcgtcaatcggttttgcagtcggtggggcaatcggtacacttgttggcgctgcagttggagtatttgttggaggaattattcaagcagccaaagacatcgtctgctatgtaagtagggatggcgaaaagtcgttctccaaaaggatcaaaaaatatgagaaaaaaattatcggttcatttcaaatgtaaaaattaaataatatattgatgtgaattatgtaggaatggagaggaatcagagataaaagagaagcattgtggattaaacaaaatgctttgggacagagtcgttatttaaacaaaaacccatcaatgtgaaaatgtaaaaagttgtggctagaggaactcaaaaggccttgtttttcgaacattcttggtcataactttcttgaatcttcgaatgtatcaatgataaaaatttagttgctttatagcaaaattataagaaaaaaatttttattttgggcttttttaaatacgacaaattttgatggattttaaataatgacatacagtatagacaccaaatgcttaatcttttttaatgagtttttgtgcatttttgagagagtgtttgtgaactgaaattgatatttcctttaaggacaaatgtccggcacgtaccgcatgcgtttactatgacagtcctgattcatacttatgctgtaagaagcgttacaaacgggaatgtgtcaaggattttgccgaggtaaaaaagtgttgacaaataatgaaaattgtttaaaattttaaatcaatgttaattgttaaaaaaatgaaaattatgtaaggaaaaagctgactgggcggttaaaacgcggaaagcggggttgataagatccataaaaggaagggcggatgagcctcggtagcttaatggtagaactgcccacggaaagggtgcatgagtgggttcgattcccacccgtggtttaacatttttcccatttcttattattattaacattttaaaatcaatgttaatttggggacgggaccaaattacgccgccgaaattttcaacgatttttcttgaaatttatgatgaattagtctaaaaaaaattttctaacatttttttagaaatttgaaatttttaaaaaaatttcttttgcgaaattatgtccccggcgaaatttcgacaggcaaatttcgggcggcggaattttggggtgcacccgttaatttatattttttgtttttgtggagtaatttttaaaaatttccaaagatcaatcaatcccatatgggtaattgaacaattgtgtatgtacaaaaaaggtggctaaatattgaattaatttggatattccttacaaagcacaaatttctcgggttttgggtctatctcgactctctatgaattctcggtctcgagaattacaatttgaattttctcatacgaaatttagtttcgagaaagagaattttacactcataattatttaaatgtataatattaattatctaattttttatcagttattttcttttaattcatttttatttttcataaattatatagataatatttgtttgaccctaaaacctgtttcggaagggatgttttcgcattgcttttttcctgcttttaattacccttttacgatgtattatttcaatttctgattttcagctattttttaaaatttttctgtacaatttgatgctgtgaatatttctttttcattgaaagttcgaccgcttaaaaaatgattaatttttgcgatttgagtaaatcccattaaaaatttcttcgcccagccctgctaacataagaacaaggcgaatttggggaaacctaaaaaatacaaaagttaaatgcttgtatctacaaaatttaaggttgaggcgatgttttcgaccacaacaacgacgacgacaaccacaaccacaacaacgacgactccaacgccggctcccagagagcctaaggcga

SEQ ID NO: 72811 - DNA, 822 bp, Heterodera glycines
  Genomic contig location: Contig_ID=SeqID_9817; Location=3400..4221; Strand=+
  SCN-specific regions: Sequence locations=1-301,339-414,436-547,573 -635,659-822
atgctaggttttcgatccagtgattttccgatccagggattagtgattcatggatcatgtgtggttcgagggtccgattctcaacttctgatcaattggtgggaaattcataataatgatgaggaatgggaagcagacgaggagagctcggcgaagcgcaaccattttaaagcagtacaaagcagggggttcgatctgaaaagtttctaaatgagaatattaagttaaaaaaaactaacgatttcggtgataattagaagatttataaaaaatgattgcacttcaattggaaagaaatttgttaaaaaaaaattcgaaaaaattatattttttattttcagtatttggtcgtatcttattatttaacactacccaaaaataaccaaattcggaattagaaatgtgataaattagaaaatttttagcaattactcctaaaaggaatctttctgaaaaacctaaacatatccgaaccatagtataaagaatatgagctgtaaaagtaataagctgtttaaaaaaaaccgaataattaatatcgaaaaagtaaaaaaatataaaattatttaattggataaaaatgatgaaaatgtactcagtaaatcatattcaaaagggtgtgcttttgctatgttctgctgctgattgcttatggcttccaaggatgacggatccaaacaatttatttggatttcaaatggaactgctgaaaaaaaagtaaagctaatcatcactttccccggaaaacgtataagcactgctgctattccatatgtattaagatgaatcatcacaaaatgggaaaatttattcagcacaaaa

SEQ ID NO: 72812 - DNA, 304 bp, Heterodera glycines; identical to SEQ ID NO: 51570
  Genomic contig location: Contig_ID=SeqID_45532; Location=426..729; Strand=+
  SCN-specific regions: Sequence locations=1-304

SEQ ID NO: 72813 - DNA, 101 bp, Heterodera glycines
  Genomic contig location: Contig_ID=SeqID_45532; Location=1009..1109; Strand=+
  SCN-specific regions: Sequence locations=1-101
atttctcaaaaaaagagatagacatttttctgggatagagtataaatttaaaaattccctcaaaaataaaaggtctattgcgcaccgccctccctatcatg

SEQ ID NO: 72814 - DNA, 786 bp, Heterodera glycines
  Genomic contig location: Contig_ID=SeqID_45535; Location=263..1048; Strand=-
  SCN-specific regions: Sequence locations=1-706,730-786
atggtcaaacgcttttgcggcgaattttccgacgaagaggacatggagaaggatgctgcggtcgatcaaaatggtgcagaactaaaccaacagaaggaggatgacgacgacgactcatttgtgcgcggatcggacgaggaaattccgggtaaacgaacatttaaaaaattgaattgaaaattctttcggcaaatttatcattgtacccgatctttttgctcggataaatcctatggacttacattatttttgttggcacagatgacgacgacatttcgatggatgaacagccgagtgggtgtccgcctccgtcccgttgggatgagaaaagggcgaagaagacgacgacgaccgccacaacaatcgctgcggtgccgggcgccgcaatgccacgctttgcccgtttcgttgaagagctgttggagggcaccatttacgcgctgtggcccgaggcatcgttgacgttgccccgctttttggccgaccggaaattcttcgacgcactgatggtggcaaatttttaaaaaaattgtaaaagtttgcctttttgtgcacagagttattgcacaatgagttcacgtccggtgctgccgcccgagctggcgcatgccttccgcttctttcaagcaattgcactgtccggcaagggggagccggagggcgcttggtgagaaatgagtattctgtccagtccctttaatctatgaaaaagaaagaaatgtaaaaaagtgagatttttttaaaaagacgggtaaattttcaaaaattctaataatttttaataaa

SEQ ID NO: 72815 - DNA, 625 bp, Heterodera glycines
  Genomic contig location: Contig_ID=SeqID_45537; Location=646..1270; Strand=-
  SCN-specific regions: Sequence locations=1-42,81-225,247-460,482 -548,570-590,612-625
atgcatcacaatgtcattatgatccaatcagctaacgggataagaatgaaaaaagtaaataaattaaaataataagggtagaaatgaccttatagtaaaaagttgtgtttaaatggatcatttttttaatttttcgatgatatgtgtctaaaaaattagcaacaccaaaaaagcgctgaaatttatttctgaaataaattcaaaaaattcaattatatgtggcgattttaactgtccttcaattaattggtctgaatgcaaaataacaaaaaaagataaactttcaaaacaataattgagttcacggcacaaaatcaacttttccagcatgttaaagaaccaacaagggaaaataatattttagatttggtttttagtcaacccaaggaactcatttataatgtaaaggttggctcccctttttctattctgatcataatactgtttggtttgatataaatcaaactattccaaaaacagatagtcaaaaaatttttatcagagatttacgccagaaaaattttactaaactcaaccaagaaattctttttaatgggccaaattcccttccaattacagtttcagacataaatgagaaatactgcatatttaccactgaattaaa

SEQ ID NO: 72816 - DNA, 1079 bp, Heterodera glycines; identical to SEQ ID NO: 45540
  Genomic contig location: Contig_ID=SeqID_45540; Location=1..1079; Strand=+
  SCN-specific regions: Sequence locations=1-591,620-893,917-930,953 -1079
  Gene Ontology: Mol. function=zinc porter activity; Cellular component= integral to membrane; Biological process=transport

SEQ ID NO: 72817 - DNA, 499 bp, Heterodera glycines; identical to SEQ ID NO: 60789
  Genomic contig location: Contig_ID=SeqID_45541; Location=469..967; Strand=+
  SCN-specific regions: Sequence locations=1-107,134-263,292-499

SEQ ID NO: 72818 - DNA, 66 bp, Heterodera glycines; identical to SEQ ID NO: 53398
  Genomic contig location: Contig_ID=SeqID_9818; Location=678..743; Strand=+
  SCN-specific regions: Sequence locations=1-66

SEQ ID NO: 72819 - DNA, 93 bp, Heterodera glycines
  Genomic contig location: Contig_ID=SeqID_9818; Location=110..202; Strand=+
  SCN-specific regions: Sequence locations=1-93
acattgacgaaaatgccgacactttgatcgaatcggagggatttttgcaaattgaccaaaaaatgttgtgcgaaattttggaacgcgacgaat

SEQ ID NO: 72820 - DNA, 114 bp, Heterodera glycines
  Genomic contig location: Contig_ID=SeqID_9819; Location=2071..2184; Strand=+
  SCN-specific regions: Sequence locations=1-114
atggtgtttggatggacattctcctcttttgaccgtcctcaactcggcctcaaattggcactgtttcggcccgtttcgaagcgctggtggacaaacatttcaacggctgaaggc

SEQ ID NO: 72821 - DNA, 93 bp, Heterodera glycines; identical to SEQ ID NO: 72819
  Genomic contig location: Contig_ID=SeqID_9819; Location=637..729; Strand=+
  SCN-specific regions: Sequence locations=1-93

SEQ ID NO: 72822 - DNA, 93 bp, Heterodera glycines
  Genomic contig location: Contig_ID=SeqID_9819; Location=1142..1234; Strand=+
  SCN-specific regions: Sequence locations=1-93
acattgacgaaaatgccgacactttgatcgaatcggagggatttttgcaaattgaccaaaaaatgttgtgcgaaattttggaatgcgacgaat

SEQ ID NO: 72823 - DNA, 747 bp, Heterodera glycines
  misc_feature (26)..(26): n is a, c, g, or t
  Genomic contig location: Contig_ID=SeqID_45543; Location=558..1304; Strand=+
  SCN-specific regions: Sequence locations=1-48,71-124,283-329,360 -573,619-673,696-747
atggaagcgcaagaattgggaaattnggcgataattgaggagagcaatgaagaaaatgaagaagaggaagcagacgaaggaaacaagaatcgtgtgggatgtaaaaagcgagatgataatgatcgaagaggaccgaggggaggaggggcgggagcaggaggatctgggagcggagctagagggggagaaggattgggaggaggaacaaacgggggagggagagcagaaagaagagatgcgggaacgggagcgggaatttacgaaagaggcaaagaaggaagaaaaactgcaaataatgatgtcataattgatgagcagcgttgcagaacagttgaaaatgatgatgatgaggaagatggttgtgccgaagttgaccttccggaattggagtttgaaaaaaaggtgaacgagacggattgttgtgcagtcggacttctgattgccgatctggaaggatcggctttcggacttatgattgccgatctggaaggaacggctttcggacttctcgatcaaaagtcagaatggtatttgatctgaattattcatcttatgctgttcaaggcttctgcgaaaacattaaaacgaagactacaaagaaaaagaagaaatgcaaatgaaagaaccgatgagcataaaacaaaaaaaagatcaaacgaaaagcacagagaatgaacaacccaaatgttcatcatatatgttcgtaaaaatttgtcctaaatttatcaacaaaaagaaatggtgaaa

SEQ ID NO: 72824 - DNA, 835 bp, Heterodera glycines
  Genomic contig location: Contig_ID=SeqID_45545; Location=217..1051; Strand=+
  SCN-specific regions: Sequence locations=1-23,45-608,649-732,754-835
atggcgatagaggcagaagcggagagaaaagcgcgggaagagaaggaaaacttggacagagaggagcagcggttgaaagtggccaacaacacattgcaagtgagtggagcagcgcggaaacgcacgtccattctataaggggcacgtattccatgatacgttcccaattgacatgttgaaattaaaaaaacatgacaacattttcatgaacgtaagtttggccattaaatccgcccctcctctttttcactcacacttttctttctcttcgctttttccttttccattgatgaaaagccctttctttccgtttttctttatttccttttcctttcactttgttttgtggtggttgtcttccttcacaatgtgttgtaaatcgttgcagaatgtcagcgaagagtttctggaactgttgactttgaagcggacaaaccgtgcctattccatggacatgcaaatttcgctgcaggacgaacgaattcagaagcaagtgcggaagcaccaggagaagcgacgtcgaagtgtatgtgcacggaatttggtggttggcccctcccaaagagttttttggtggtcgttctttctcttttacactttcatttcctttcacacttgcacttaatttttaaaagctgaaaatttaaaaaatcgctttttgtttcagattatccatcaacgacgacgcaaattctccaagggacttcgcgacgtcgattttgttggcttcgaggccactgaggacattcaggacatgcatgcggagaaggaggacgaggagatggagcagttgtcagacttggactcaggggacgacccatctggtcaaacataa

SEQ ID NO: 72825 - DNA, 323 bp, Heterodera glycines
  Genomic contig location: Contig_ID=SeqID_45549; Location=15..337; Strand=+
  SCN-specific regions: Sequence locations=1-69,99-160,194-323
atggtccaacagctgctgatggtgagttgcgcttcaacaatttttttgtgtgactcagataattttagctaaaataaattaaataaaaatgataatttgaacattttttacctcaacatgagaatctgtgctccgccagctgttgtcaaaattggaatacaagaaataaaagaaagtaaaaaataatttactaacagaacattttgagtatattcttgaatatccttaataaacaatatgaagtaattgatgaaacggttgcaattatacatccgatcaaaatgatggcgacatgaaactgatcgttacattcagcggattga

SEQ ID NO: 72826 - DNA, 1044 bp, Heterodera glycines
  misc_feature (55)..(55): n is a, c, g, or t
  misc_feature (783)..(783): n is a, c, g, or t
  misc_feature (819)..(819): n is a, c, g, or t
  misc_feature (822)..(823): n is a, c, g, or t
  misc_feature (1019)..(1019): n is a, c, g, or t
  Genomic contig location: Contig_ID=SeqID_45550; Location=54..1097; Strand=+
  SCN-specific regions: Sequence locations=1-154,178-251,273-407,429 -449,472-485,508-631,662-928,950-1044
atgatttatttattcattaaagatcagtcggacctgatcagctgctacaaatatntaatgagtgctggtcagccaatttcaaaaagtgatcaaaaattgctgatagtgaatgcgacatattacaaaatgaaagcactgataaacggagcattatcaaccacaaagcaaataaaaagtggaggacgcaaacacaacaacaaattgagacgaatggcaaatgatattgaaatgacagcacaaaaagcccatctgttggaaaaccccaaaaattttgatgagaaattggtgaaaatttgctatttatgcagtttttggacgcatgtcatatcaaatcgcaacttgtacaaagaaagcgaaatttggcgaacatttttagcttatcgctttggtggagaagtaattttaaatttgaaaataaatatttgcatttttattgcatgtagtggcacttttttaatttgtttatttgttgttaatcaaaagggactccattttaggcacaaaaaatcgcgaaataggcacctaaaaaggcagaaaaaaatcttaaaatagggattaaataggcacaaaaatcctcgaataggcatttttaaagaaaatttttatcaagaaaaaataccaaatttagaagattaatttttggaaaatttaaaaaattcttattggtgttttctgatgtttttttcaagtcatttcttagaggggttttttcgaaaatcccgaaaataggtgccaaaatggcgaaataggcacaaaaataggcacttaagcattaagcacaanaaaatccaaatagtaggcataataaatttgatctanatnncatccagcggaaaatcgtttttttttgtagaaatttagacatttgcataaattgagtccactattaaatcattactatattaggaaatgccaccttttgcacaagtcccatggaggagaagacataatgggacaatccattgtgagaaagtgaaaagttctgaagtttgcagcattgctgaagtcaccacatcggnaacacgcacgaattgtgctgcatga

SEQ ID NO: 72827 - DNA, 950 bp, Heterodera glycines
  Genomic contig location: Contig_ID=SeqID_9821; Location=467..1416; Strand=-
  SCN-specific regions: Sequence locations=1-8,35-367,394-662,684 -689,711-730,757-783,805-950
atgaaatttactaaaaaaggaaagaaagaaaatgtaccggatcgtaagagagtgagaaaatgttgtaggattggttcgtgtttatgatgtaatcacgactaaatgacaagaatatatgtgtgtaaatgccagcattcgttctttacttaggcaaacggaacaattcgccgccccatccgtcggtgcctaatgtccgtataattgggtctcctcttgcctgtggaatgattaattacctaattatacaagatataattaattcacacacagttatccaattggccaaaaagccgttctttatgtaattattgctgtctggggagcccattagcaattcactgtgcaggatggaatcagcctgaataaaaacaaaattacatatttaaaaatgttctaaaatgaattgccggattctcaagtcgccagtccaaggacgagtcccaaaacggaagacaaactgttgggtcgacagcacgaagagcaatttccaatctaacggacaaaagggcacaaaaataatcgtaatataattttatttctgtgccaccttttcaggtattccctgtgccaacaaatgaaagtcgggccgccatgggccccgggcattttgctggagtccgaatgtaaaaaggcaattcggtcgtactcataggaaccgtagccttgcttcagctgcagcagcgcattgtgctaaaaaaggtgcgccttttacgctaattactagggattccatttttatgtaaatacatatttgtttcctggattctccatagcctaattagtaggaaaaacactttcttttttgtgtttgtgaacaaaagttgggacttttatttccaatttttgaggattttttaaggaaaattttttagatgccccaaaaaagtcgaaaattttgcatttttttttcatattttgtaaatttagaaaaacatcttctaacaaataaa

SEQ ID NO: 72828 - DNA, 749 bp, Heterodera glycines
  Genomic contig location: Contig_ID=SeqID_9821; Location=1059..1807; Strand=+
  SCN-specific regions: Sequence locations=1-749
gctgattccatcctgcacagtgaattgctaatgggctccccagacagcaataattacataaagaacggctttttggccaattggataactgtgtgtgaattaattatatcttgtataattaggtaattaatcattccacaggcaagaggagacccaattatacggacattaggcaccgacggatggggcggcgaattgttccgtttgcctaagtaaagaacgaatgctggcatttacacacatatattcttgtcatttagtcgtgattacatcataaacacgaaccaatcctacaacattttctcactctcttacgatccggtacattttctttctttccttttttagtaaatttcatttttgaaattatttttaaatttcatttcaaattatctttttccagtcagatacccaatgcagtggtcaaaattatgacaatttgcttgagagtaaccacgacggtgtgcacgtttgggtgggcggacatatggtacgaatgggcggggggcggcagcagcagatagagcagggcacagggatttgttagtccaaaaagtgccatgaaacggagccaaattgccgaattcgcagtgcttttcatggcccgggtttcgggagtttatgagctcatctaaattaatgaccatcattatgctgccattgcgcatttatttatttttgttcagagtatgcttgagactgcgccaatggatccaatcttttttatgcaccattgcttcatggattat

SEQ ID NO: 72829 - DNA, 502 bp, Heterodera glycines
  Genomic contig location: Contig_ID=SeqID_45553; Location=241..742; Strand=-
  SCN-specific regions: Sequence locations=1-160,182-424,446-502
caagttttttacaaccacatattgccaatttaatttcttgcagttttaaagccatccattgcctgccggttctcggcacagcaaagcactaatagggtgtttgactcacttcaaaaaataattccatacccaaatttttttacaaccacatattgccaatctaatttcttgcagattgaaagccatccattgcctgccggttctcggcacagcaaagcactaatagggtgtttgacttacttcaaaaaataattccatacccaaaagttttttacaaccacatattgccaatctaatttcttgcagattgatagccatccattgcctgccggttctcggcacagcaaagcactaatagggtgtttgactcacttcaaaaaataattccatacccaaaagttttttacaaccacatattgccaatctaatttcttgcagattgaaagccatccattgcctgccggttctcggcacagcaaagcactaatagggtgtttgattc

SEQ ID NO: 72830 - DNA, 860 bp, Heterodera glycines
  Genomic contig location: Contig_ID=SeqID_45555; Location=505..1364; Strand=+
  SCN-specific regions: Sequence locations=1-225,247-465,490-730,752 -752,774-860
  Gene Ontology: Mol. function=inositol/phosphatidylinositol kinase activity; Cellular component=1-phosphatidylinositol 3-kinase complex; Biological process=regulation of cell cycle
atggccggtgtttgtcaaagtaccggctatgtggtcgagccgtacaaagattacccggaactgctggacgcactgttgaagttgtttaagacggaactgtccagctcaatgcgtcgtcttacaatgaaagtgctcggtgtgattgggtgggttttatcaattaaagaaaattgtaacaaaaaccaaaaaaaatttttcagggcttttgatccgtacacacacaaagtttaccttggaaaagttcattcgcacagcaagtcaaggtcgttggcacttaccctgccaaattctggcgaaactgcggaacactgtaaacattttttcacttaacaaaattattgcatacattggtgtacaacagggatgggccgaggtttcgcatttcgcctttcgcattttttggcgtttcgcatttcgctttttggcgcgaaacgcgacttttacacccctaagaattggattaaattcccataaaatttttcaaaattttacctataaattggctaattttcagtgaaaacctgtttataaatgatcaaaatttccaatttttttccccggcggcgcctatcggcaccgccgcgcccccaaaactcctattttttcttagaaaatggcccaaaatcgcaaaatttggtaatttgatgaaaaactgttctcagcggcgccccaaaactcttatttctcattagaaaaatgataaaaatcacaaaatttgatcattttttagtgataatctgtcaacaaattttaatcaaattttcaaaaattttcccggcgccgcctgccccctcttcccaaaaagtttttttggaaaaagcgcgcctcaaaaaagcgttttattgatttttaaatttgga

SEQ ID NO: 72831 - DNA, 105 bp, Heterodera glycines
  Genomic contig location: Contig_ID=SeqID_45558; Location=220..324; Strand=-
  SCN-specific regions: Sequence locations=1-57,79-105
atggacttcatggaattgcatgtacaagcaaatggaagcagtcaaagtgttgatcaaagaaatcaaaaacacttgcaaaaaggtctaaaagtaaaggccaaaata

SEQ ID NO: 72832 - DNA, 605 bp, Heterodera glycines
  Genomic contig location: Contig_ID=SeqID_9823; Location=899..1503; Strand=-
  SCN-specific regions: Sequence locations=1-72,94-584
atgaattgtgctctcgcttcatcgttttcgccagtcgggaaacatttcgctgcagtcgttgcggacaagaaaggaatgagggctgatttgtacgtcaatggcgaagaattggtagaacgtcttggttcatgcgttagaacacacagatcgaacttcaaaatttttttgtgaaagttgaaggtaattgtaattgtgtcggcattacctttggttttaatttgagttttcaagtttttttttattatcatagatgaatgccttcagctccattgcgagatttcatccgttaaaattggtgctgggcgcgttaatcttgaggcgattttgacgacaccaattaaacgtcgtagttcggaaactttggagccaattaagaagtcgcaaaaaaatgggtagtatttcgtttgttgtccgttgcttagatttgatttgtgactcataccttttcgattacgtattttatgtttgatttttgatattttgttcgttattgttatttaattatatttgtgatcctcacacattatcaaatacggatataatttccattttgtaattgcgctttaaaattgttgatttgtcagaaaaatgttgaatttattaaa

SEQ ID NO: 72833 - DNA, 358 bp, Heterodera glycines
  Genomic contig location: Contig_ID=SeqID_9824; Location=961..1318; Strand=-
  SCN-specific regions: Sequence locations=1-77,99-211,233-358
atgcttacgactctggaagagctcaaagccacaccatgtggcactcagcttgcgtaagtgcttgaattagtaatttgttttaagtaaaattgttaaggtctttttgtgggcagattgtaagcattttaccgtctgagaagaagttgacggctttgttggcgtgtgcttctggggagaatgttgttctcgcagaatttaagagcgtgtcgtccaaattttcaaaaatttgttcccttggaattgtaagtttgctgtttctatttacagatgcttaccttactaaatacaggtcgtcaaattttacatgctgaaagctcaacgctttcaagagcgtttcgatggaaagattggtttgtaa

SEQ ID NO: 72834 - DNA, 422 bp, Heterodera glycines
  misc_feature (159)..(159): n is a, c, g, or t
  Genomic contig location: Contig_ID=SeqID_9824; Location=2624..3045; Strand=+
  SCN-specific regions: Sequence locations=1-231,253-422
atgaattttttttatgctcaactcaaaagttacagcattctaaaaaggtaaaacaaaattatccctagtcatattctattattttaccttttttaaggaattggtattccacgtctttgtctgcaatgtcctcaatttcgtgcagtatattgaccagtntaacatattgtttcgcctcccattgatttggaatgttgcattccatatttgcgacacggtttaaatactgtaacaagtttttcgaagttaaataagtactattgaattttttaagcttctaataatcttttaagtgcagcacagtggcatgcatttttcgttgacaaatgagaatccccatgaattcaatttgcgaaaacgagaagtcatgaatctatggaaaagccaaagaaattggagtgataaaactaatatatttttta

SEQ ID NO: 72835 - DNA, 494 bp, Heterodera glycines
  Genomic contig location: Contig_ID=SeqID_45562; Location=4..497; Strand=-
  SCN-specific regions: Sequence locations=1-107,134-263,292-494
atggagaaggcctgcaaaatttggagagattatatcgattttagtgcgctaggttcgatgaaactttttaaaatataagcctaaactttttggcctgtttaaaaaggaattaaaaatttttaaaaattttattcatctcccttttgatagaaaaagcatcagagagccttatttaacttttaattaacatttggtgcgtttcagagcagtttctgaaaaaatatttatgaattgattttgctaaaaaaataaaatagtgaagctttaaaaattaataaaaaattttaaattcagaattactggagttagcatcatagcagtgcttttccttgtctttttgatgccctcgcaaaatctggttcgcttctgatcagtttataaaaaaaaagttaagcctaaaatttttcgcatatttaaaaagcaattaaaaatttttagattttttattcatctccctttttgatagtgaaagcatcttgagtgcctaaaataaa

SEQ ID NO: 72836 - DNA, 614 bp, Heterodera glycines
  Genomic contig location: Contig_ID=SeqID_45563; Location=311..924; Strand=+
  SCN-specific regions: Sequence locations=1-93,115-124,158-300,323 -416,438-614
atgagcatcaaaaccaaaaaagacttgttaattgtgggtaagttgattttgtaaggtaataaaggaaaagcatcttgaagcaccagaattagcttatgagtctttaaaaattttcatttgcttagaaagagtttcttttcatcaagagcttttgagtggccaactttatatatttttattgcgaaaattcattttaatttttttgaacaaaagaaataaaaaaacgatgctgtatagttttaagggctgccactgatcaatgtttcattttttacgggtgtatttaaaatgttcaggtcaattcatatatatttcctggactgtgggggacctgaaacgcacgaaaaacatgtttttagcttggtttgaagcttctaggatggatttctatatccatatttcgcgatttatgtccatattttggcatttttccaaaaacctattagaacggcccccaacagctaattggccgttttgacccctaaagacctacaatcaggtccaaaagttttacaccaaaaaatattttagtgaaaaacccgattttcttaaaaaaaggaatggtggcaataatgttttgtttatgccaaaagaaacgccaattagtgcactaa

SEQ ID NO: 72837 - DNA, 87 bp, Heterodera glycines
  Genomic contig location: Contig_ID=SeqID_45564; Location=578..664; Strand=-
  SCN-specific regions: Sequence locations=1-87
aaaggagactccaccttctgctgctggtgacggcgtggcggtgccatcggaacgcgtggttgatgagcagcaaaaggaggacgaggg

SEQ ID NO: 72838 - DNA, 587 bp, Heterodera glycines
  Genomic contig location: Contig_ID=SeqID_45567; Location=160..746; Strand=-
  SCN-specific regions: Sequence locations=1-587
gtttcaaatatcgtaagattgtttgatagggccagacaagagaaggcaactgttggtaccaattttgcgtttaaaaaatgagaaaaaagagatagccatttttggtcaagaattttttttgtttgcgtttcaaatatattgtttgatagggccagacaagagaaggcaactgttggtaccaagtttgcggtaaaaaaatgcgaaaaaagagatagccattttttggtcaagaattttttttgtttgcgtttcaaatatcgtaagattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaagagaaggcaactgttggtaccaattttgcggtaaaaaatgagaaaaaagagataaccatttttggtcaagaattttttttgtttgcgtttcaaatatcgtaagattgtttgatagggccagacaagagaaggcaactgttggtaccaagtttgcggtaaaaaaatgcgaaaaaa

SEQ ID NO: 72839 - DNA, 225 bp, Heterodera glycines
  Genomic contig location: Contig_ID=SeqID_9826; Location=842..1066; Strand=+
  SCN-specific regions: Sequence locations=1-225
atggttaaaatttcaagatattccattattgattccaacaatctgccgctcctcggctttccaacattggacgatataaatttgagatggcttttttcccaaaattctgaagagattctacaatttttggctcacaacggacttatccaaaacaaaatgatgtgcctaatttgttcaaacaatatggctctgacaaaacgtagccaaataaaggatggatttgaa

SEQ ID NO: 72840 - DNA, 1061 bp, Heterodera glycines
  Genomic contig location: Contig_ID=SeqID_9827; Location=208..1268; Strand=+
  SCN-specific regions: Sequence locations=1-522,544-594,624-646,669 -987,1010-1020,1042-1061
atggttaaaatttcaagatattccattattgattccaacaatctgccgctcctcggctttccaacattggacgatataaatttgagatggcttttttcccaaaattctgaagagattctacaatttttggctcacaacggacttatccaaaacaaaatgatgtgcctaaattgttcaaacaatatggctctgacaaaacgtagccgaaaaaaggatggatttgaagtaattataaaaaaattatcttttgttaatccttttttaagtggcgctgtcaacaatgtcaaagtttttttcacaatagtgctttgagtctcacgcaaatgttcaccatcatctacatgtggattgaagactatcgaaacaaaaacgctgtcaaagaattggacatggcaacatatactattgtcaattttttcaacttttgtcgtcaacaatgttcaaaacaggcaaaaattggaggaaaaaacaaagtggtcgaaattgacgagacatgttggacgaaaatgaagcatcatcgaggaaaaaccaaaaaggggagccaaatttggatgtttggcgccattgaacgtggtgaaggtgcaaaaaaacttccataaacttttaattttttaatttaaaggtggtcaagcattttgtgtgcaagtgaaaaaccgcaaaagaaggactcttttccgtcaaataaggaaatggattcgtccaggcacggtgatcatcagtgacgaatggccagcatatctgaaaatgtctctacatttgccgcaatatgaacatctactaattcgtcacaaaaaaacaactggtggtggtttctcaaaaatcatcacgcttccaaacgggactgaattcaatgttaatacgaacaaatgcgaaggaatgtgggcccaattgaagcagaagacgaaaagaattcatggcaccagcataaaattgacagaatcatatatgcatgaacaaattttccgattgaatgctagggctaaaggattgtctgtatttaaagcttttgttgatttgttgcattttaattataattttaatgattaatcttgttaaatcta

SEQ ID NO: 72841 - DNA, 2600 bp, Heterodera glycines
  Genomic contig location: Contig_ID=SeqID_9828; Location=478..3077; Strand=+
  SCN-specific regions: Sequence locations=1-35,57-288,310-782,804 -2044,2066-2600
  Gene Ontology: Mol. function=calcium ion binding; Cellular component =lamellipodium; Biological process=small GTPase mediated signal transduction
atggcgtatcctttctgtttagttggtgacatcgaagtgaaaaataatgaaattgttcaaaatggcaaccaattgagcaaagagagcgtttcaactgtaccatatgaacagcagcatggtcaggtgatcggacaagtgaagacggtcaaatacaaagcgctcttcgaattcaacgctcgctccggcgacgaattgagcatacaaccgggcgacttgatcctcgtattcgagggacaccaatccgagccgggttggcttggtttgtgttatgcttttttcgccgtcgtcttttcaagtgccgtttaagctggccaaattcgcgacaaagtcggctggttccctgcctcttttgcggagcccctttccgccgctgctgctggcccattactgaagaggggcggcagtttggccggctctccttccggcgaacctttggccatcattcgcgaggagtgtgagccgccgccgaccgggcaaattcaccccacggaacaaaggcgtggaaatgctttcgacaccgacttcactgctggtaagaatatagagcactaacaattagtgagataattccccatttagcatttacgaaaagtgtttcattcaccgattctgccacaattggaaaagcggcggcggcactgaccaaaggcaattcaatgagtgccagtccatcagtttctgctgctctgtacgatctcccgcctgcggacacagaaactgtggtgaaattgacaaatactactattccatcaccgaccgccactatcgaaccggtaatattcttttcttatctttgaaaaatttccaaattgcgtttcagtcatccgtgccattgtacgaattgccacccgacaatggtaaaatgccaccatcgaaagcgtcagttgctgacagtatggtgttgtctgtgggtgtagcgttatatcagtggaaagcgcgcaatgaacaggaaatgacatttggacgaggcgatgtaatcgaagtgttggagcagagcgaaatgaggtggagaggacgacttcagaaaaacaggtgggagaattcaaattacacccagtgattcggaaattgttgtgccatttgcttgtcttctaattttagacaaatcaccggatggttccctaaaagttatattaaaatttctgctccttcggagcagcaaaaggatgaaagcgcaacaacggacctttatcagacgggtcaaagtgcagcaaaaaatggaggcaaagcacgcgtgggtgaaagtggagaatggtttattgtgagttatacggacaataaatgcactgaaagctttagaattacctgaaacctaatgagacatgagttgacgacaaattattattctttttttttttgcaaaaggctctttaccaatttgatgctgtcgagtcaaccgatctctcattgaaacccggcgatcgaatttgggtgaccgaccaacgtgatcaatggtggcgagggacttgcgacgggaaaagtgggatttttccggcaaattatgtacaaaaggcaggcgaaattgcatcatcaatgcagagtaagctatctttattgttatcagcatagttaatccaaaaagacatttatatcttaaatagaagactcgaagatcgacgggcaaacaattggacgggcaattgcgaatttcactgcgacagcatccaatcaaatttcacttgttattggcgatactgtcaaaatctaccagacaacgccaggttcacaaagagagtggaatttaatttgggttttaaaggggatgttttaggcggttggtgggaaggcgaagttgataaagcaggcgtcaaacaaattgggtggttccccggcaattatgttcaggtgtgggaaacagcgcaatccaatactttcgctgtaatcacccggaattccaaatttagctgttgaatgcatccgatgagacggtaattgctgtggcagcattcgattatacggcgcaacatgaggacgagttgaccttcaaattgggcgacatcatcgaagtggtggaccattcggactcactttggtggaagggcaggaagaagggacagccagaacagagcccattactctttcctgcaaatttcgttcaattaaacaaataaccttctggatccattaaaatcttttcacatcagccaactttgaccaaattctttctttctaattcataatggattttttcaattgacccgatattcataacgcaactaataacttaaaatcaatttgtagaaattttgttaattaactcattattggtttactgtgttttttgtgacatattttcccgcaatatacattgtaattattataaattaaagctatagaagatttacttgtagtcaattccattgtttcaagggtgtgatgggtgctgctaccgcgtgacaaatcacatttaggcaatcttttccccgaatttttcacaattgtcacattttttccattttagttttgtaggcgatggtcggcgctagttacacaaagcaacctatattttgaaaattttttcaactttttggtcaaattttttttttgttttttttacacataatgatgaatattaagtattaacagcacaattatggtga

SEQ ID NO: 72842 - DNA, 805 bp, Heterodera glycines
  Genomic contig location: Contig_ID=SeqID_9829; Location=312..1116; Strand=+
  SCN-specific regions: Sequence locations=1-313,335-438,460-805
atgagcgaccatgaaggggacttagcggcagtagccgaggctcgtgcagcggcaagagctcgtgaagctgctgccaatgcaaatgttttggtgagtttttaatgtgataaaaatcctaaaattttcggggccgttgatcacaatcctgtatccattttggcaaatacacatagccgatccgatttacgcacaaaaaattgcaagttctagttttaacattttcatctaaaaattgcttaaatacccgaaaacgaactgaaagccaccaattctgcaacaaaatttaatgaaaattttcggtttttgagagggtgcgaaaataaatattgtcgtggatttattgtttgcagttgggtgcagagcagggcgttggaggtgaacagcagcgagagcgtggggcgggcaacaacgacaaccagcaaagtaaagttttttgacaataaattttttaaataatttcccattggatccgattggcatttttaaaacttgaattttgaaaccagtttgttgctattcataaagagacatttttaagttcgttagagcttgggccaggctttgccaataggcatcactcagaaattttaatgaatgggataagaaaatagtgaaaaatttccgaaatacagattagtgaccccccccctttaattttatatagttcgagagaaattgtgaaaaactattgaactttggtgctctagtacaattttggatatcaatgagcatcatcagtttcttatttcagttgctgcacttcatgctcggatggacattcttgaacatcagcaaattcaaaacg

SEQ ID NO: 72843 - DNA, 697 bp, Heterodera glycines
  Genomic contig location: Contig_ID=SeqID_9830; Location=505..1201; Strand=-
  SCN-specific regions: Sequence locations=1-81,112-183,209-634,660-697
atgcctggccaaagcttccaaaatcgaatcattcaattggtcgctgaggtaaaagcagaggcgagtctgaagcattttgacataaatatttttcaattaaaatattaattaccaaattccgaccaaacattggccgtgacataagcccaaagcacagttcggagtttaactgaagcggattttggctaatcaaagaaaaaatggcacaatcacttggtcatgggatgcgaaaaactccatcaaacgttgtttacagtcgcaggggagaagagaaaggtcggcatcgaacaccaaactgcgctggcaaacggaggccagacaaatgtcgaacaaagaacggaccatcgcaagaggaagtgatcactggttggttgaaggacaatcaattagtgatggacaacagcagcagaatggaagggaaacattcgcaggcgaattactcgcaaatggactgatcaattgatcagctgggcaccccaaatgattgccatcttttacacaaattaatttcaaaaatcttttctgtgctagaacggaagaaaaaatgatatctcggagatatttcagctaattttgatcagaaattcccctcacaccacttttttttctttcttcttgttcaattctctgccataaaattgttttattttgccttttctcatcaaatgtatttttaacaaaataattaactaataaa

SEQ ID NO: 72844 - DNA, 2231 bp, Heterodera glycines
  Genomic contig location: Contig_ID=SeqID_9830; Location=1322..3552; Strand=+
  SCN-specific regions: Sequence locations=1-93,155-236,262-409,434 -1167,1190-1208,1230-2000,2022-2231
atgcatttgccaatatcatttgtaaatatagatagcatcagttttcattactctttttaaagattgtccgtcaatttaaaatttgtattaagcaaaataatgtattaatttttaatcataaattattttttaattaattcttttatgattttttcaattcattccagggaattgtcagcgtcactctccgccagaataaactcgtctgcctcgagttagtcggaattccgctgctcacttccaatgcgctcaaggctgtgaattcgaaccgtctgagaagcgtcgatttgagtggatgccgaaaggtgattaattaagccaggcaaaacgcctaaaacacggacacgaacccccccccccctccccaaaaaccaggcaaatgcccgatttctttgataaaattgaaaacatttataaaaaaattttaaaaaatgatcacattttatattccattgacttatctcagatcgcttcagaaggcattttctacttggtgtttaataatccgtcaattgttagcctttgtttgaatggctgcaggggattggacgaggtgtttcttctttgttttcagcaaccattcgttaattaggccaattattcagcaagcactttacgacatcgcgcgatgcatcggcgaacgtttgttccgtttggagttggaccaattgcacaattcgaacatggccgagcacaccgaggccatcagcagtctctcgcgccactgtcctaacatttcccgactttcactttgccaatttttcccggttggcgccttttgttcccattttttgattccccccccccccctttcccttaagtcctttgaggaagatgaacagcaagaggagcagccgccatgtctcatcgaaggcaccggcctccgtgacgtggatttatacggtgggaatggcacaaaatgccacccaaaccaaacgaatggcatttcacttaaggcaacttcttctgccaacttccccgccttcccctcaccatttattcaattcgtttgtcggtgacgggccaagagaacgttcagactcttctcgactccctccgggagcagccgcatttagccaacattcacttgcagttgcattgtctcgaggaggacgcagtaaacaaattttgacgagaaatttgacaaattaatcataataaccaaaggaattgttttagaattccgttgaacgtgccaattccttcctttgccaatttcttccgttaatgggcaccaaaatcactcggcttcatgtgtgttttgcaatttatttagtgaattaaactgatcaatgacaaattacagtatcctgcctgtttttcaggttactgtccaacgcctcgtcgactcggcctttttggttcattgatttgatgtgatttgttcgttaattgtttctcgttcagctgatctctcaaattccttccctcagccatttggctttggatgtcgcctttttaaatgcccattttctccgccgtctcttcgccggcggcgttcattctccgggtgctggtctccgttccctcagactttgccgacttcgcatcacttaccgggcactgttttcgattggccgatgggtaagtggcgcggcagccaaagtgccctcatccttttaccttgataaataatgcggcattgtcaaacaaattcccatttgttttgaaggcccgttcgcttgtcgacttggaaacttcgcatatgccagcggtggacgaccgttttttggttttgttgggaaagaattgcaaatatttgcaaaatgtgagctccgtcattccaggaacattgctgttgtgtaccggcaattttaggttaatttcaacggatgcaaatgggtgacagacaaaggagtggcgagtttggccaggtaattgggaaacaattaaggcaatcccgagactaattgtaaatgacaacatattcaggaattgcaagcttcgagaagtgcggataaggtaaattaattaattagtggggctggcaataacaaatgtttctttctgcagaggcacttcctgcaccgataagtccgtctacgcatttgcacagtgcgtttttctgggatttaatgagtcttaaattagttaattagtccatcattactttaaggttctgtccaactctcgaatggatagcacatgccgatttcagtggaaggccaaatttcagtgacaaagcattgaaatgccttcgcgactcgtgcattcagagagtcatttgctga

SEQ ID NO: 72845 - DNA, 740 bp, Heterodera glycines
  Genomic contig location: Contig_ID=SeqID_9831; Location=304..1043; Strand=+
  SCN-specific regions: Sequence locations=1-97,122-172,195-740
atgttcgccttcgtttgccgcttcgttctgccgcttttccttttcgcccttttggcacttcccccggccaatggcattggacttcccatgcagaaaatggagtgctgccaacaacagcaaatgtgttgtgccgcaccaatgcaatgcacgccatcgtgcggagggtgcggacggcgccggcggagagaggcgagcgattgagaagagagatgttttaacagttcgaatttttaggccgccgttcagccgctgctcagagggaaagaaacgccgtgcccacagacggagtggcaacagctgatggaaaatgtgggaaaaagtgctaaactcagcagttgctaacccgggacaatgttaaggcaattgtgccactcgacgacgtccaatcggtgaactccgtccaaaaggcgctcctccgacgctttccggacaacaaatttttggtgatgtgcgcaatggcgggggagggacgcgcggaaggcaaagagccgctgccaaatgaggtgagccgagaaatttggaggatttaaacaaacaattcattgccttttcgtctaaaatccgtcgcttatttctaccgtatgctcaggtccacctcagctccagtggccacgggtactgtaacgtggtcagcgaacgcatttggtgccaagcggccgcagtcgtcggctgatggcacttatttattacttgtttattgatgttcagccctttttttgctttcatatttattgttatta

SEQ ID NO: 72846 - DNA, 118 bp, Heterodera glycines
  Genomic contig location: Contig_ID=SeqID_9832; Location=2171..2288; Strand=-
  SCN-specific regions: Sequence locations=1-118
ttttggacgaatgccattgccatttaaccgccccgccaaccgaccgccgtctgacaattgatcactttttgagtgatttttgtccgtcgatcagtgcgaaatgaaaccgttgatgagc

SEQ ID NO: 72847 - DNA, 1579 bp, Heterodera glycines
  Genomic contig location: Contig_ID=SeqID_9834; Location=92..1670; Strand=-
  SCN-specific regions: Sequence locations=1-5,27-312,366-575,597 -776,801-904,934-1060,1082-1223,1269-1431,1453-1579
  Gene Ontology: Mol. function=pre-mRNA splicing factor activity; Cellular component=nuclear matrix; Biological process=mRNA splicing
atggctaataaatttttgcttgttccacaagaaatttaccgagggctaacctcagcgtcggatacgggagtcattaatttggatgcggtaaggcatgacctggagcgtgccaggcgtgaacggactaatccgacaacaaaaaatgtccggtacaatcaacagcttaggcgttatctgcaaatgagaagggagcttgccgatagacctaccaaagttgagttaaccaagggcttgagtgttttgctcaagcgagatgggggtgttgatgatgacgacggcgaagtcgtcaacactcagccacggcctcccgctccaccaccaccaccaccacctcctccacctcctcatcaataccaccgtcaccatcccagccctcccgatcagcagtcttcctcatctgacgatagtcatccgcctcgcccccctcgtccaccacgtcctcaaagaacaaagaaaaaccatcaatcttctataaaacatggtcggctgaatcaatggaagcaaaggcgtcgtgacttgcaacaacaaccggtagtacgtgatctactcgctgaggcagcagctgctcctttacctgaaagtgacgatgacgatgaacaaatgctggaaggtgggtatctgctgccaacaccatcacaaaattatggagacatgccaatattgcctgactatgcagatgaaattgaggaaatggacaccgcccaacaaagacttgcaagcagaagaaagattaaaggagaggagggaatagataaaaacaaaaaatacaaaatttactattctcctccaccatctcccacactaccacccgtgtacaaacgaccagaccatccccctcctccgcctcgttctatacccaaagttgaactgaaaagggatccacaaccaacaaagttgaaaaaatccgcctcgccaccgcctccaccattgcctccacatcgcgcaaagagagaaccaaaaatagagctcgcccctcctccacctcctcgcactgtctccaaaagggaaccgaaagttgaactagctcctcctcctcctcctccgcgtcacttcaccaaaaaggaaccaaaatttgaagttgacccacgaccatccacatcgaagcaagccgggtacttcccgcccccgaaaatcaaaaccgagccaaaacatgagttgcaacctacaaagaggccagtgccataccgtatcccgaaaaaagagccaaaaattgaagaaaagccattacagcagcagcaacaacaacctcctcctcctccagctgttgtcgtcgaagaaatgccctatattcctccgcctaggagggggaccaaacgcacctacccccagaatgatgatgatgaggtgcacataagaaaacgagtgaggcaaccgagaagggtaagagtacagtactcgcccgagccaggtccatcaacatctgcacaaagtgaagaagaacaacaacagcaacgtgagctgtttgctattccgtcaaatcaactgaccatgacacagagaatagaacgattatatctcaaatgtaaccattatgccgatcgtatgggtgttcgggtgaatacaattaacaccgcaaacg

SEQ ID NO: 72848 - DNA, 926 bp, Heterodera glycines
  Genomic contig location: Contig_ID=SeqID_1336; Location=1100..2025; Strand=-
  SCN-specific regions: Sequence locations=1-26,48-78,100-122,144 -185,207-218,241-303,325-350,372-598,620-626,655-700,728-926
atggaaatggaggcattcgaatggaaatttgaagatgaaacaaaccaaattacaattgaattggccgatgacgacaccgaagaagggtgagaaaggaagtgaattttgggaattttgttaattaaaatttgaattgctcagcattttggaggacgaaccatccaccgccagttcaagtggccagcaacagcaaaagtgaatgaatgtggcggcaatttgtgttttatgttggaatttttcggatttgatgccgttttgttgtctgtcggactttggcactctctaaatggcggatcaaaccaatttatttttccgttttccccatattttgtgcatatactatatatttcaatgcttttcaaaccataaatcttttaatattcacttgttcactattgtcatgcttttcggcttatttgaatttaaattgcctaaaattcacaacatttaatgattaatttagtggcatactttatttggtcaattattcattgaacgaatatgttagagtgatttatgtgcaaaactcacggctaatcacaattcgggaaatttttggacccttggaatgacactgatgcctatgcttagagctctaaaaaattgccaaaaatgggagaggatggttattaatatcatttttatttttaaaaacccattttccgtggtaaatcactgcccaattaatcaacaattattaaacagcagcagcagaagtagcagcaagattaatgaccttccactacccggcacttaaataccctctcgtccgaagagtaattataattgcgctttttaaataactgttgcgcgctaccattggagcttttttaaatttggaggtgaggccgcatactcagggcttccatttgttcttatttataagaaatgttctgatttggagggtccaaatcttacaaaataaa

SEQ ID NO: 72849 - DNA, 490 bp, Heterodera glycines
  Genomic contig location: Contig_ID=SeqID_1336; Location=2746..3235; Strand=-
  SCN-specific regions: Sequence locations=1-490
atgacgctggacattatgacgcgggacattatgacgcgggacattatgactgcgggacattatgacgcgggacattttgacagcgcgccaaatcggtaggggtcaactccgtctggccaactccgtctcagcaatgttcaaaaagctataacttttttctttgttggccaaacttcacaatcatggtatcattcgaaagccctagatgtttagaagatatttataagctatttctcagtgattaagcagctctcaaaaaagttgtcagttgaaaaccgcaaaaaaggcagaattttcaaagttttttatttctatctttttttatagttcgaaattttctgtaatttttagtaggctaatagagcctgtgaagagctttcgaatgatatcaagattgtttgattcggtcaataacttcaagagttatattgactcaaagttggctcagacggagttggccagacggagttggcccgttccgcagtgttag

SEQ ID NO: 72850 - DNA, 973 bp, Heterodera glycines
  Genomic contig location: Contig_ID=SeqID_1337; Location=613..1585; Strand=+
  SCN-specific regions: Sequence locations=1-16,49-162,184-749,771-973
atgtcggacaatccagaaaaagtggaaaaacagatggaaaagcaaatgtatgtgtaaataaataaatgtgccgtttttcagtaatagagaacccataaagaatatgcttgctttttccgctcaattcgtacaaaaagcggccctccttatggagactaattgagtaattaatacttaaatagggaaatccttaatgtgccaacccagtggcgtgacaattcgtacatgtcttaggctaggcgccgaagccttaggcctagacttaggcttcttgggcctaggcttaagcttatgctttcttttgtaaatttttttattgtacgagttgcctttgtatgtgtagccattaactcgctaatcctgaatttcgtctgttaaactggatgtttaatgacaaattttgccgaaactggggtactgaattcaaaaatccgtgcacagagacccctaaattgagcaaattccaaggcttttcggtgcctaatcttcaaagctctgcttggggtgcaaaatggcacttcatttgccatttatatgaacattttgttccgttttgaaaagaacttgtcgttatgtaagactgatgtaaaccgcaaaaggaggctttgagcttttttttttttgtgaaattggcattagggctatgattacgcgattaaaatctcggttttgccgagatttgaatctcgatcctgggattcaagtcctgccttgatgagatccagatcgcggcacttctttcacaaaaggcgggatcgggatcccgggaaaatccaggcgggatccagaccaggattatattatcgagattcaactcggttttactggggcataaatctcgacgctgggattcaaatcatgattgagatccggatcccggccctcttcacaaaagccgggattgggactccagggaaatcccggcaggatcccgaccacgtctggcgagccctctcccgctcgtctttacaaa

SEQ ID NO: 72851 - DNA, 696 bp, Heterodera glycines
  Genomic contig location: Contig_ID=SeqID_1337; Location=3439..4134; Strand=-
  SCN-specific regions: Sequence locations=1-36,59-81,103-230,252 -266,328-400,423-592,615-696
atgagtgataagaaatgtgtctgtgaagcaaaaagatttgcaattttaaggaaacaaacttacagtaagctattcaaaatacgatattgcgtttgtgtaaaactgattaaatggaaatgaatttacaacatcgacctaatcacagtatgtctttgtcgcattttgtcaaactgatttaattagtatggagagaaacttacagtaatctatccaatgagtgatcaaaattttattaaaaactgatcaaaattgaataagtgtgattaattattattattattacagtcaacatcttaataattattataattgttatcatcatcattaggaaagggaatcaacatcatcactaagtgtaatgacgttccatttggtgtttaaattccattcaatcgcctccttttcccatttggcccatttgtgccgatcccgcgcaattggacagcggcgaatcatcaccacatagtattgcatactagcaccaggactttcaaaatgttgaagtgccaattgttcgccggtcaatgcgttggtcacgcaaaacggttcaattgcttgggcatctctaacactaaaggtccaattaaagcacgtgatgatgatgatgaagttggcacgagaagaagcattggcaaatgactgaaaagcatagcgccaaataatgaatgggtcacacattggatagagccaaataaa

SEQ ID NO: 72852 - DNA, 2020 bp, Heterodera glycines
  Genomic contig location: Contig_ID=SeqID_1337; Location=4459..6478; Strand=-
  SCN-specific regions: Sequence locations=1-75,97-105,137-313,335 -944,966-1194,1228-1750,1772-1848,1870-2020
atgattgagcagcagaataaaaaacaattggctggaaacgttttggattacataaatcatccgcttacaggacgtgttattggatttgaagaaattgaaatcaagtaaaatatttgaaaattttaattaatttatacaatttctgagggagggaggggggggggggggcttttacaattgggctcttcaacggctcccaaaaaattggtaataagaaatttgtagaccaaaaaatgggcactccactaattgatgctgaagctggaggggggggggagggccgaagtgtatcacgtataactaagagttacggtaatttttccttgaattttttcagatacatcagccaacaagttatggaatttttgaacaaatggaggaccacagttttcaatttatgtccactttatgtgagcatcccaaagggaagtgatcgcatgttggaatttgtttcgctcaatattttgccactattctcgcgcactaccaatggcttggcctttaacaatgacgtcattcgtgtcatcccgtccattctcaccgattgtccaccacttcattctgtgctttaggtgcacaaaaagttttccacggaaaccgctacttttgctgcgctgcaagcttttgtcaattggttgtgcccatcatcggcacttccgtacaacagcgatctgttgccattgaaaaaacttaagtttttatgcacgaagaaagttgctcttgcgtttattgcacaacttaaaaaagtaagcaattaatggatttaccataccttaaatagggggcgggggtgacgaccggagccccgacttttgcgcctctgtccaaaatcggagtcaaagttgattttatttaaagcactgatagcctaaacagcatttaaattatgaaaagatcactactgtcttttgatttttaagaacattaattatgttgtttgaaaattttattatttttcaaaaattcattgacgatcaaatgatcggatacaatcactttcaatcgcttatttaaagctgtttaggctgtcagtgatttgaaaaacttaatttgaacccgattttggacaaaggcacaaaaaaatgtgaagcgattaggggaaaagtcagagacgaaggggtaaaagaaaggcgacttcgtaagacacgaagaaattaacgcaaactcaaacaaaaaaaaatttaaaattcagatttttacgatttttttaaatttaggttaagaagtaggaattttttttaacttatatttccagaattcttttaaattttcttcctttttttgttttatttatagcagcgctattcgagaacggaaattacacgagaattgggacccttagacctttagattttgagatccattaatccgtgactcaagaccgataatttcctccccccgtcggtggtccgagacttcttcatttgatccccgtgacccgagaacatatccccgggttcgtcgcggtgcgattcgtgaccccgaacagccgacatttctcgagtcaagactctcgaacagcggcaccattggtttaggaattccattcggcgacaacatcccgcttccgcttcattgttgtgttttgtcttccgcataaacttgaaattccaacattttccatccgcaacacattcaccggcgaacatatgagcctcagacaaaatgacaatcaaacatacactttggtccggcaatgtcctcccaacttgatttcacttgaggcggaaattgaagcgtcaaatcggaaatttaaagatgaagaaaacaaaattattattagtttggcggatgacgacaccgaagaggggtaagaaaagaagtgaatttgtgggcatttttgttaattaaaatttgaattgctcagcattttgggggacgaaccatccaccgccagttcaagtggccagcaacagcaaaagtgatgaatgatgcggcgattagtgttggaatttcttcggatttaatgcccgtttatcgtctgtcggacactctccaaatggccaacaaaaccaattaa

SEQ ID NO: 72853 - DNA, 844 bp, Heterodera glycines
  Genomic contig location: Contig_ID=SeqID_9835; Location=4..847; Strand=-
  SCN-specific regions: Sequence locations=1-265,290-707,747-844
atgtcaagtcctcaaatgtcgggtcctcaaatgtcaaatcctcaaatgtcgggtcctcaaaagtcgggtcctcaaatgtcgggtcctcaaatgtcaagtcctcaaatgtcgggtcctcaaatgtcaagtcctcaaatgtcgggtcctcaaatgtcaagtcctcaaatgtcgggtagccatgaaatgcaatttcatttcttcaatagaatgcatgactaatttcgccctttttcgtccaaaccctcagcagattaaatcattaatgatggaattattttcattaaatcaaatattttgtgacgtataaactcttgaagcaatttaattcacaaaatggtaaaaggatgggttaaaatttcctttttttattcactttaattattttgttgaacagaattttcaaatgatcgaattaagttgaaaatgatcatgcaacatttgtaaataaattcgttttttattgcataatatgtcaaaccaattacctaattgtacatttttttgtttcaaatttcactcatcaagggcaagtgtatttttcatttccaaactgaacatcaattagatgaccataaaaaatgccccttggctgtttcttaaattaattaatttcagcaaattaataaactcaccatcaatgataaatatacaaaactatttaagcggcaagtcagtcagtataaatacccactgattaacctcattcgatattaaaaatacaataattatttctttaataatattaagattcaatgaatatcaacaatttgaaattgtgccttgctctgctgcttgtcggcttctgcctgcagttgttcatcggcggcactgatgccggcggagg

SEQ ID NO: 72854 - DNA, 382 bp, Heterodera glycines
  Genomic contig location: Contig_ID=SeqID_9835; Location=1985..2366; Strand=+
  SCN-specific regions: Sequence locations=1-287,316-382
atgtcgggtcctcaaatgtcaaatcctcaaatgtcgggtcctcaaaagtcgggtcctcaaatgtcgggtcctcaaatgtcaagtcctcaaatgtcgcaccacggaatcatttacccgaaatcggaatttgccctttttgtcgcatttttggtccgtcaattggtcgagcaagtccggccagctcagtcccgggtttgtcatcccgtttctgcacgtgctgctgcatgacgattccagcgacacattcgtgtcaacattgtagaacacttgacagcagttgagacctgtattattaattattaattatgaatattaggtacttttccgttttggggccacagattcaaatcggtgcgaattcctttggccagaggactgctaa

SEQ ID NO: 72855 - DNA, 905 bp, Heterodera glycines
  Genomic contig location: Contig_ID=SeqID_9836; Location=254..1158; Strand=-
  SCN-specific regions: Sequence locations=1-9,31-446,471-506,529-905
atgaccgcactgaccgccccgttgtgtttggtggcaccgtgtctgatcgaaagttggggacggcgtccattgttcctgctgatcactgctctgtcaacgcttgagctaacgctgcttacggttgctcagctactgtatgacgtactcggtaagtctaacaaagcaaacgatctataaaaacagaattgattcaggaggcggtggcatttttgtctcgtcaatggcactgatcgggtgtacgatgggccaagcgagcgtcaacctggggctgtttaacatgacgcccattctcgtgggtgaattgttcccacacccggcacgcgctagagccactcaggtacggttatgataataattgtttggtggtatttatgaattccaaaattcgttatttttctcctactgtgccaataggtacagccggttaataaatcactccaaatttgatcaaaaatcctcaaaaaacaacagtagattcttttgggcaatatgttagaaaattacaccacaccaaatttcaaaattttccagcgacatttttttttcaaaccgtgacaattaaattcttaaagggcaccacagcaaaaaaaaaaaaaatagaaaaaaagttgtcacgcaacattggagaatatcgcgtcccatttgcacaggtggcactgcttttgcccaactttgtcgtcgttggcattgtgctcgcctacccgtcactgatcgtctccatcggtgcgctcttcttcctcccgttggccgcgttcagcagtttggtccttctgttgatgctcaaattgctgcccgagacaaagggtcgtccggtggacgacattttccgacgattggccgactcgcgcaccaattcggtgacggattacggcgccatcggcgacgacggagcgatgccaacgaaa

SEQ ID NO: 72856 - DNA, 277 bp, Heterodera glycines
  Genomic contig location: Contig_ID=SeqID_9836; Location=2235..2511; Strand=+
  SCN-specific regions: Sequence locations=1-277
atggtaaaacattgcggactgtttggcctcctccttggcaccgttgccgatgtacagttgcttgggcgactctgggaaatgggcggcgccgaacagatgaaacatggccatgaggagacagccggctggcagcaaccaccaggaccaactgttgccgaacaacgccggcaggcacaacggggaggccagcaacagcatgaggttggcaccggagccaattgcggtcgaggaccagcctaacaaatgagtggattaataggcaattaaaatttcaaaa

SEQ ID NO: 72857 - DNA, 1345 bp, Heterodera glycines
  Genomic contig location: Contig_ID=SeqID_9837; Location=602..1946; Strand=-
  SCN-specific regions: Sequence locations=1-28,51-350,373-745,773-1345
atgtttgatgtgttgattaattttgattttagaatcttcccgattttgaatcgtcaccgtcgggaatatttcaatttgccccctggcaaagccgcctcgaatagcccaacagttcaggaacatattttgagcggtattgaggaacagaaaattgaattggacggaaatgccgcaaaggaagagacggcggagagtggggacgaatttgaggaagtgaaacagcggaaaacggagacgacggccgaggagggcaacgaacacgagcaacttggtgggtttgaccacaaaaaatgaaattttaccgaatttgcagcaaaggagtgggcgagggacttcgaaacatttcatcactttttagacaaagttggtggccactctactccgaacacaattttggctcaattagtcgacatcgctcgaggcggtggtgacaagcgcagcacctctccaatcgtgcgccaatcttccgactccgtcggtttgattccgtcttcgtcggcctcccaagcgcatgacgaaggaggaaacaaagtgcagaattcgatcaaatgcggcaattgcggcgacttagtgatcaaccaggaatggattctgctgaaccacgtcaacaccaagttgttcggttgcgattcgtccacccgaatcttccttttcagacatttacatctccctctttacaaatgcgtcagttgtgacaaacccttcgagaattaccttcgcagttacgctggtgggcaaaactttcaaatttatttattttaaataaatttttgaatttcagttcgccatgccaaattttaccatgccggggatgagagtttgttgctcgatcagagggacttgttctggggaaagttgcgcgaggcttgctctcgacttttcaggatccacaaaaatgaagttgatcattgaacatgaattacgcatcaactctttcttatcggacttaattatttgttttccgtagattcagtttaattatgtttatgtctcaattcgtttccttaccacccttttcactacttaactttcttcagttggctgttcctacttttggcacattttttctcttattttctcccctgaaaatcctccattatttcaacggccttcacattttattagtggtggcacaatgaaaacaacaatgagaatatatgggtgaaagggacctgcaaatccaacggtcatttcagtccaatccctctcaaggccatccatcccttttttgattcatttgaagtgccgaactgttcgcctattttccctggaattgtcatgcgcccccaccacttattttttgtttaattatttttccattttatttttctaatacaaaaataaa

SEQ ID NO: 72858 - DNA, 1101 bp, Heterodera glycines
  Genomic contig location: Contig_ID=SeqID_9838; Location=37..1137; Strand=-
  SCN-specific regions: Sequence locations=1-45,72-86,108-279,307 -321,344-384,408-628,658-691,720-724,748-748,770-838,882-916,938-1101
atgcatactgtactctatctaaagttgtcgtttgactcaagaaacgggaaaaaagcaaaacaaaactcaaatgcatttgctaattatcacattatttgtttgtttgtattcagcttaaacaaaatgtcactgacggcaaaatgttccctttgttctgatgagttctccagcatagacgatttggaggcgcacatttctgctgaccattttaacgtgcgttttgtgctgtgtataataaataagtgttgatgatatatgtacatatcagcagtggtcgtgtttattcattcattctttctttcctattcataacatttctcctttcatttccaataattccttttatcatttccctcccccccccccttttttttacctccaatgttttgttcttttttctcccaaccatcgaaagcgtgcatatttttcttcgtgacaacaatttcctttaataacaattattctttcagtgtcttcctttcgaatgcgaaaagtgcaaatttgccaaattcccaacagaatttgcaataaaacgccactacgaagaggaccatggcttatccgaatacttcgtgagtttttcaatttttaatttggactatctttttggtcagtaatacgaacataagaaatatttctatttgaaaaattgtattattgaaatttagcgttaatgggaaaatattatacctattttgatttttctttttatttacataaacggacataatattaagataatattttggcaaaacaaatcaataaattgttccaaatttttgcattccatctttttttgataagtccattatagattaaaaatagcagattttcgatcaatttattttgtattaatacaacaaaaaataaaaataaaaattgaagaaattttaaggccaaaaactttttctttgctgaattttgggcaaataaatgattatgcaaaatgcatttgtatacaaattatctttagaaataactttttacttaattttaattctccaaaataatattttgctgaatgtttttttatttttttttcaggttcggaatagggtctgtcgcgaaatttacgaagaagaagcaaaaggtccgcgaatg

SEQ ID NO: 72859 - DNA, 538 bp, Heterodera glycines
  Genomic contig location: Contig_ID=SeqID_9839; Location=355..892; Strand=-
  SCN-specific regions: Sequence locations=1-538
atgcgggccctgacaccaacggatcccagtttttcattaccacggttatttgtttttgctagttttttaatttttgttttgtctttgctcaggtccatactccatggttggatggacggtgaaattttacttttctaagttttaattctaaattgtttttctttaagccacgttgttttcggtaaagtgctcgagggcatgaacattgttagagaaatcgaagacggcgaaactgctggcggagaccgtcccaaaaaagacgtcgtgatcgttgacagtggaggcaattcacaaatgttttctgacttaaaaagcattaaatttttcagagctaacagtcagtgaaccgttcaaagttgcacgtgaacctgtggtttgataaattattgtgatgatgagaagcataatcgcaaaaatgcatttcattgatatttaagcattcgttgtgttgttttttctgtttcttattttgcatttatggcgtaaaactgtgattgataccggcagtttatttggtcaaatgtttcttttaattaaa

SEQ ID NO: 72860 - DNA, 141 bp, Heterodera glycines
  Genomic contig location: Contig_ID=SeqID_9840; Location=732..872; Strand=+
  SCN-specific regions: Sequence locations=1-42,64-141
atgccatggaaattgggggattttcatggaaaatatgggcagaaatcaaaagcaaacatgaaagaaatcagaaatggttgggcttttacctttacaacaatgaccataaaaatggtaaacaaaaaaacgctgatgcttttc

SEQ ID NO: 72861 - DNA, 2111 bp, Heterodera glycines
  Genomic contig location: Contig_ID=SeqID_9841; Location=21..2131; Strand=+
  SCN-specific regions: Sequence locations=1-116,139-252,285-342,366 -425,447-485,585-781,806-945,983-988,1012-1061,1083-1151,1183 -1650,1672-1751,1773-1833,1857-1900,1962-2044,2068-2085,2109-2111
atggcacagactgatccaccgcagacatctcgcagcccccgaggggaaattgagtggacttatatactggcacaattgggatggacattggataggatgtggggtatgacggcataaacacaaagaataagagagaaagggatggcatatgcaacagaggtgaatgggatagaaacggcacgataacattggaaatgagagggataggactggcttgggatgggatgaacattatgaatattaaaacttagcttattaaaatatttaaaaagtttattatatttcaggcgaaaaattaacttttacgcgcacttgaaaaaacttgctagcaaaattctcacattttttcaatttcaattttaaatgtcccaatggataaaattaattttgtcgttttccatcttcaaaagcaatgatggtcttcattattttgccataatttatttatgtcctcccttcctgcggtagccaataaaaaaatttaaaaattgaatttaaatcataataaattaattttaaatatgatcaaattcattttagaacgaatcaggtgcaaaattaatcaaatcaaatcaatcaaattattaactgttccacttcttttttttgggtcgtcgttttgccgttatattttatgccagaaaatttttcattttatcagcagtttctatacatacaaatttgaattagggcatttttaatagagtttgaattgttaggaaaaattccgaaaaaatcataaggggattttttttttttgaaaattgactaggcctaaaacaattattatttattataaaatatagatgaattccattaattattttctgatcttttcctccagcagaaaatactttacctagtaatttttttattgtgttcgaaccgagtctcatattttcattttaatatctggacgcaacttttgcattggactgtacataatccaaaaaactgtttttaaattaaaattacataaacagtagggaaataaattaaaaataaaaaatagctccaaaaagatgcttattcagtgagatttttcccaaaactttgttgcttatttaatatttatgctctgtttttgctcattttacattcaaatcatctatgcgttcttataaatttatttgggatttcctaattgttggaatttatttttagtttaaatttttaaataatccgatagattctatcaactaaactccgttcataacttgacaaacttttttccattggtcaatggagatgaattttttttcccaaattatccttctcacctacatcgaaaagaagagcctgggcattcgcaaaaaaaaaaacattacgcaattttgagattggaattagcaaagaggggccggcattaattatggtaattagcaaagactaattgatacttaattatgatgataaattgctggaaaaattaacggagattctactaagattcaaaaaaaaactttcttagtctccataaaaatttgcaaaaatagaaaattttctaacaatttaagttccattaaaagtggtctaattggaataatcaacatatatacatagcatgtataaaacatatattgaatagttatagccagtatgtaatacaaatattaatactttgggtacttaactttgaaaaattatggctaattttgtatgaaaatgctcctggcgatttgggagttgaggaattcccttctctcgccctccccaagtcagagataaaattaatagaatacaatggaatttatacaattctccgtccattttgtcccaaattacagtattatggccaaatagtatcgtatctcaaatgttacgtaaatttccctttattacacaaaattagccccacttcggggttttaaacgaacaaagccaaattgataagaccaggaaaaaaataaaattaattttacatattttcttcataaatttgttaataaattaatatttttcagtttatgcgagttttcttattcttcaatttcatccatttgggttcatcgataaacaaatccaaattctttgttatctgtgttccttgattccaatctctctcttgtttttgtcatcgatctgacaaaaataattttctttttcgataa

SEQ ID NO: 72862 - DNA, 508 bp, Heterodera glycines
  Genomic contig location: Contig_ID=SeqID_9842; Location=324..831; Strand=+
  SCN-specific regions: Sequence locations=1-46,71-208,266-423,446-508
acgacctcgatctttggcgcgaattggatctgttgttcgccgaaacggagaaggaggagccggaggaggctgacgacaacattttgcaacaatttccgcccaaatcagtcgagtgtaagaacgaaaatttttgatataataattcaaaaatttttgcttaatatttaggaaataatttataattgaattctgaagggatttttttgacttatattcataaaattatttatttaaaaaataattgaataatataaagttaaataatcattttgtcagtttgcaagcaattttaggctggtttgaagcatcgtacaaacgtccttcttggaccgtaatcgaggaggctgcggacgcagaaattcaggctaacggagtgcaattgtcatttggtaagtattttacacatcctataaaattctaaaatttttattgtttgtaatcttttaggtcccacaaaaaatactgtatacgtttagtgaatttgtgcgcatttttttggtttttgaaa

SEQ ID NO: 72863 - DNA, 4719 bp, Heterodera glycines
  Genomic contig location: Contig_ID=SeqID_9843; Location=1..4719; Strand=+
  SCN-specific regions: Sequence locations=1-368,390-558,582-930,952 -1331,1354-1623,1646-1817,1839-1841,1863-2312,2335-2388,2410 -2465,2501-2758,2826-3226,3248-3290,3312-3468,3490-3672,3694 -3833,3859-4445,4477-4719
tctgaagaaaattgcatatttttcaagattttcccgatttttacctgctttacagtagtccgcaatgacctcacggaggtcaaagggcgtgttgcggttctcctcgtaccactgctccaacttcttgcgctcctcagggaagtgcccgccagggtagtagtcctcaagcggcggaagagtgtccagcacaacaccataatttgcagccttaattattgattatttttggttttatttattgattttttttactttgttgaacttgtgcgggaagtatttcttgttgtccactccctctatttccaagccgaacgtcttcacaaaggaggccagcttgatggggatcagtttgtaactgaaaaataatcgattatttatgttattttacactttttacctgtcccggaagatggtggtagtgattgctcctctcttgcgggccttcatctccagcaggtgattcccctggcgcacgagttcgggacgcacacccatgcgcagcatctcgccgtagatcagcacgtgatcgtaacgtgacccttaaagttgttttctgcatcgttgtcatcgctgtcgtcgtcttccgcttccatgtcgatgaaggcatttgcagcaggattccgggccttgttgttgttgtctccattcgcacgcttccgtttgcggcgcttctccgcagggtcaaggccgaggacatcagcttcaaagtgcaggagccacttggtgaaggccgtcagggggtcgtccacaacgtaggcggtctccacttcggtgttgtagaactcgaacggtgcccatgcgaaggtcctcgtcagcccacagattccacagcttcggtccagtggctggtcccagatgccctttgcaatgcattccgtgcaagtgacgtgcgcgtagcagaagttcacctgaaagaaatacctaattttcgtatattttgtgttttatttacctgatgcttgaagcgcaggagttcagggtcgggcttgaagtccgtagtgcattcaaaatcgaagaagatgatgcgcttttcggtcttcttctttggccggtacgggatgtagcattcccgtggcacatggaatccgaggcacactttgcaaaacttctgaccgcattcgtgagccttttgtttgtggtgcttaaaagcattttgttttcaatttaaaatatcaaatgctacccgaatttggtaaataactccacagtcgatgcactttttcgagcttttgcagatcgatttttcgattgttgccacttcggtgccacgcttgactttgcattttgtcacttttgtatggtgatcatagcactctcggcttttgaatgtctaaaaaaatatattaaaaataacaattcattctgtggtactttggagcattcaaggcatgagtgaaaaaagtcgtcatcggcatcgacgcagtttccacggaaggcacccccgacgcgttggcagttatgacatttccatttgcaagtgttgtaaaacgaaagaaacatacccaaggtttggtagtggcgtaatacagccaaattcacgagcaacttcctcaaggattggcacacattcgatgagtcggaattcggtgttggatgtgacggtcatttttttcaataaaaatcgtaaaataagattgaggaaaattaaagtatgaaatatttgtacagtaaacagtacgcgaaataattgaacatttcaaagcactttatgaatcaacactgaagaaacacatgacattgttacggaggaagttatagaattcatcaattcccttttctttgtcgaagtagatagtctcaacgcttaggacgtatccaaactgcttgacaattcccttgaactcaatttggtctccttcttcgctgatgtagatgaaacgcggcttgtcctggtgctcgaaaacgtaacgcttctgctcctcctcgtacggcaccggaattttgcagtcgaacataaccgcaaccagatcaaatgctgtgcaacattcggcgagagtgaacggctcctcctttttgttcagttcttcgtccattttctaaaatattatttctatttgatgatattaataaaggttaacctcaacagatcgtagctcgtttgatggttcatccaaagacaggctttcaatcattgtttgttcatcaatcggcgtagtcaaattgttgaaattcatagttggtttggctaaacagcattgtaaaagacagaaacagaaaatattcatgttaataaataatgaaagaagataagaatgattttgaaaaaagggtaggattaaggatagaaacaaaaaaaaacgactccaagccacttttcccgccaaattttgaatttgaatctaatgcgaaaggttttcgtctcaataaattatggcgttatgtatatattgtggtgttttgtcttgttttgcgtattttcaaagtttttccaccggactacagtacccctcgcagtgatgacgtcatcatctttgctgcatatagttgataattatcctttttctggcaagtggtttcgtggcagagtggtaatgtgttgggttggtggcagaccaaaagttcgagtccacttgcctgcgactaatttattgcgatttttcaccggactacagtacccctcgcagtggtgacgtcatcatctttgcagcatatagtggacaattatccttattctggcaactggtcttgtggcagagtggttgtgtgttgggtggcaaagcaaaagttcgaggccgcttgactgtggcagaatttttcgaataaaaattttaaaaaattcaaaattaaaaattataaataattttagaaaaaattttacaaaaaaagtcgcgcacccctgcaataggtttaggcttgcagaaaaaaagtcgcgcacccccctgcaataggtttgggtttccaaaaaaagtcgcgcaataggttttggtttcagtactgaaaattttggcgctcagttggcccgcgctcacttggcggcgctcacctggctggcgctcagttggccgtgcacccctcccataggtatgggaggctaccgtaatccggtggaatttactgccctaactacttagaaacctttcagaaatggaggacatcaattgagtttccggtgtgtcttttccctaacgagcacacccccgtttggtatcggatggaatttgtcaacacgatgaccctcagacacgaggatggtaattcctatcaaattgatttgagtaaagaacagaaaaatgatccagaaatattggcattcattgaatttttagcaaatggcaatatgccaccagacttttcggaaaatgaaaaagaccgattttcagccctgtgtttaaatatagtctacgaatcagaggtactttattttaaaataccctcatcaagtacacgaatttttgtaccaacttcgttaagggccttaattttcgaatcgttccatacatctccattgggaggaggtcacatgaacataaaaaagacactacggaaatgcaaaaatatttttggcccaaaatgcattctgatatcgtctcatggacacgtcaatgtattacatgccaacttaggcataatcccacccctgcatatcgtgctgaaatgcaactcgcacctagcaataccctttttgcgaaagtcggcttagatttggcaggtccatttccaaccacatcgcgtggaaacaaacatattttgaatataatttgttggttttcaaaatatgtaatatctgttccaattccggatgccaaagcaaagactattgcaaaagcttttctttcaaattgttacttaaaatttggaggttgtactgagctcattagtgacaatgccactgcttttacctcagaattttttaaggaattttgtagtatgttatacataaacaaaacttatgcaattccccactggtcacagggcaatgcggtaacagagaggtcatttcgtacatttcataatattttatcaaaatacataacgaaagaggaccccgattttgacgaatttttagatttcgcctcattttgttataacacttcttgtcactcatccacatccgaatccccatttttccttgtttttggtcgggacccaattttctgtgtagaccaaatattggatgctcgcattcacagtcaagtccaacaagcggaggaaaccgatttcaaacaaaagttagtcagctcattaagaaaagcatggaaaagtgcagccgatgccaatgaagcagctcagcagaaaattaaagagcaatatgaccgaacagttagacaacctcaaatttgtgtaggagaccgagttttattaagaaattatgcaggtaaagttggaacttctaagaaatttcatctgccttggaagggcatttttagagtgatagaaattgatggcatatatgccactatcgttagctgcatttcgccgcaacaaaacccgaaaagagttcacttaaatcaaattaaaaaatgttttgaaaactttggtcctaattgcaccttgccaaaattaccaatcgatgaggaagagagtcttgataaaatgcatgcaacaaatttggacaatttccctggtcacaatcattttcccaggactaacagacaacctagtaaagaaaatcctgaacaggaaaatgattcgcaaaatttggccgaaaaaacagattgtcaagaagaagatggaaataattcattagacgaatcaattaagcccaaaaagggaccggag

SEQ ID NO: 72864 - DNA, 1091 bp, Heterodera glycines
  Genomic contig location: Contig_ID=SeqID_9843; Location=516..1606; Strand=-
  SCN-specific regions: Sequence locations=1-253,276-655,677-1025,1049 -1091
atgaccgtcacatccaacaccgaattccgactcatcgaatgtgtgccaatccttgaggaagttgctcgtgaatttggctgtattacgccactaccaaaccttgggtatgtttctttcgttttacaacacttgcaaatggaaatgtcataactgccaacgcgtcgggggtgccttccgtggaaactgcgtcgatgccgatgacgacttttttcactcatgccttgaatgctccaaagtaccacagaatgaattgttatttttaatatatttttttagacattcaaaagccgagagtgctatgatcaccatacaaaagtgacaaaatgcaaagtcaagcgtggcaccgaagtggcaacaatcgaaaaatcgatctgcaaaagctcgaaaaagtgcatcgactgtggagttatttaccaaattcgggtagcatttgatattttaaattgaaaacaaaatgcttttaagcaccacaaacaaaaggctcacgaatgcggtcagaagttttgcaaagtgtgcctcggattccatgtgccacgggaatgctacatcccgtaccggccaaagaagaagaccgaaaagcgcatcatcttcttcgattttgaatgcactacggacttcaagcccgaccctgaactcctgcgcttcaagcatcaggtaaataaaacacaaaatatacgaaaattaggtatttctttcaggtgaacttctgctacgcgcacgtcacttgcacggaatgcattgcaaagggcatctgggaccagccactggaccgaagctgtggaatctgtgggctgacgaggaccttcgcatgggcaccgttcgagttctacaacaccgaagtggagaccgcctacgttgtggacgaccccctgacggccttcaccaagtggctcctgcactttgaagctgatgtcctcggccttgaccctgcggagaagcgccgcaaacggaagcgtgcgaatggagacaacaacaacaaggcccggaatcctgctgcaaatgccttcatcgacatggaagcggaagacgacgacagcgatgacaacgatgcagaaaacaactttaagggtcacgttacgatcacgtgctga

SEQ ID NO: 72865 - DNA, 327 bp, Heterodera glycines; identical to SEQ ID NO: 64469
  Genomic contig location: Contig_ID=SeqID_9843; Location=1707..2033; Strand=-
  SCN-specific regions: Sequence locations=1-171,193-195,217-327

SEQ ID NO: 72866 - DNA, 809 bp, Heterodera glycines
  Genomic contig location: Contig_ID=SeqID_9845; Location=962..1770; Strand=+
  SCN-specific regions: Sequence locations=1-413,450-586,611-809
atgctgaaaaaggaagaacaagtaagtttcaaattaatttttttggttatcatttaaattatgggtctctgatttatagatagataaaaaattcgaccatccatccttttttgaagtttaccgacttttttcattttttgacaactttagccatttgagatagccgatagaagataaggatatgtttacaataataaactcctaaactatggcagattcataaactagtagaattagattactccaaataaactaaaaatgccaaaaattctccccaatgagctaattctggaagtgaataacttcaccaaatttaatcgaaaatggacaaattgccgtgtttcatttgcattcgacaaatttttactcgaaaaaatgggcgcttggttaattcaattgaaaaaaatggtcactaaaataaataaattagttattttttgattttaaatgtttttacaggcccaactttgcgcacaatcgatcgatgagttgtgcattacgatcaattcggtggctgatgatcagtcaaaattggcggcagctactggtgcttataatggcaagttttacaaaaattagcttcaacaaatttgatattttttaatatgcagcttgaattgaattcatttttctatatttatgttcgatcccactttaggactgaaaaatttcatcgaccaactgcccaatttgcccccggcgccggcattggctgacctcagtcttgatgaggaggaggattatgtaagtttcacttggaatttttctaaattcaatgcttatgatttctttcattttgcgtttttaaa

SEQ ID NO: 72867 - DNA, 248 bp, Heterodera glycines
  Genomic contig location: Contig_ID=SeqID_9845; Location=3386..3633; Strand=-
  SCN-specific regions: Sequence locations=1-42,89-248
atgaatatttattccgattgtatgccgaaggtttgttttttgttttatattaatttgaaattttaataattaaacataattttattaagctaaaatccgaattgtcgaaacaattgccaccattggtgaagccaatattttataattcagcagaaagtatatcggaaagtttaatcgaagtagtcaaaaaactgaatgattattccaaatatttttggcaaagatgaagaaatcctttatggaataaa

SEQ ID NO: 72868 - DNA, 775 bp, Heterodera glycines
  Genomic contig location: Contig_ID=SeqID_9845; Location=3703..4477; Strand=-
  SCN-specific regions: Sequence locations=1-199,234-285,307-473,496 -638,660-753
atgctaattgcctttgtgagaaatgatcagaaaatgcaaatcagtgaatttacaaagcaaaaatatgaggcacaccttggcatttactgttttatgagaatgaattggcaatcgaagtggattaatgggccaataatttatgtggtgaattgcctcgtcgaaatttcagaattttattttattgaatgggtcggacaagaaaatataaaataaaataaatttattcattatttgaaattacaaccaaaattgttgaatgagaagagattgaattatggaataaaattgaaaaatgaacaaaaattgccattaatcaaatgattttgcaattggcaattgaaacaacgaatgaatgccaaacaaatgaaagtttaaaatgaataattcaacaaaatttaaacaaaaaatttgaagaaaagttagggaaaatgtttcaaaaagcgaaaaataaggaaaaaaagtataaaccatggaaaatcaatcaatcaaaagataatatgcataaatagtttttatattctaaattcgatgataaattggcatgggtgagagagagtaaacattcaatgaaaattaaatatgtaattcaaaatttagaacgaagatgctctatttttggaatttatcaaaggattagcaacaatttagagaaattttttaagaaggctaaagaatattcaaattctattaccaaggggaagtgaattttcagcaaaaatatgagactcatcttggcattatgcatttgatgcgaaaaaattggcaatgtaataaa

SEQ ID NO: 72869 - DNA, 871 bp, Heterodera glycines
  Genomic contig location: Contig_ID=SeqID_9846; Location=461..1331; Strand=+
  SCN-specific regions: Sequence locations=1-402,452-871
atgagcggcccattgacgaagttgcaagttcggctcggattccttctgggattgcgcctctggcaatgtcaactgcatgacgagttggcgctgggttttcagcttgagcagaagctcttaaattcgtttgagccgttcgaatcgattggtgagaagcggatggttatgattggcatttttgaccggcgttaaccgtggttaaaaatccttaaccggtatgctcgtccttccctttttaaccgtggttaagactaaaccacggttgagttaaccgtggtttactccctccttaaccacagttaacgcaggttaaccgtggtttatttccaaccggtatgctcatctaaccgtggtttaatctttcttaaggaatcttaaccacaactcgagttgtggttaacgtaaatttatttaataaatttaaatagtaaaataaataaataaattttttctagggtaattttacaggcagaaaaagaatctgactttttttttttgtctatgatataaattattgacggattagtgttatttcatcaaaaaaatttgcacacgcccaaaccgctaaaatagctttttaaaaaaggtgacaaaattgctgctgtttgtagcatgttgcataacaacgtaattgtttgtaatgcactattaccaagaaattttggctccattgcagttcacacggccataaaaaaataatttgacaattttaatgcagcaacaggtcaataagtcgtacggtgtatgcagcgataaatttcaatgcctatgatcaaaacgcggcgctactgcattttactggccaaatgcacggactaaccatctgcaattcggcttagagcttcaaagcaatactcgaaaccgtcggcca

SEQ ID NO: 72870 - DNA, 249 bp, Heterodera glycines
  Genomic contig location: Contig_ID=SeqID_9847; Location=1742..1990; Strand=-
  SCN-specific regions: Sequence locations=1-8,30-40,62-88,125-249
ggatttggaataagtaaaattgtaaaaaatgagcgaatgttaattaaacctaacttataccaattggcgagggatccctaaggcttagtttttagaatcttaatttttaaaaaagcacatttttctatttttgggttggggcccaaacgaccccggggcccaaaaaagggggcccaaacgaccccggggcccaaaaacgggggcccaaacgcgggggcccaaaaacgggggcccaaacgctctggtccc

SEQ ID NO: 72871 - DNA, 1354 bp, Heterodera glycines
  Genomic contig location: Contig_ID=SeqID_9848; Location=213..1566; Strand=+
  SCN-specific regions: Sequence locations=1-72,94-218,254-281,322 -350,372-568,592-757,782-834,856-902,925-1354
aaaatccatccgacaattgatgaggggcaagcagttgagcacaacagagaaacggaaggccaaagagagcatcaacagcagcagacgcagcagccgaagaaccgacgcttttcgagagggttaaaaaacgaaatgaaaaaagaaatttaaaaggaaatgccaatttaaggggcacaattttggaacatccgccgaacattgaattttaccgcaacactttggagaaggaggagaacggcacggtacggccgacaatgttcgacttggtggagggggacaaacagcagcaaccgcagcaacagagaagggaaagtgggaaggccgtggagatgttcagggtgatcagaagcaaaaggggggagggaaagacaaacgaaaatgaaaacggaaatgacaggaaaaaaatgcgcaaattttggagggccaacagcggacaatgggagccaaattgacatggcgaaaccaaccgaaacgcagcgaaagtgacgcgtccaaggtgaaaagcattaagcatcgccaaaagcgcacaaatggtgccaattcgttggacagaagtctctgcaagtgacgccgcgccgcgtcgtccgtccgagcggcgccgacggagccaaagcgaagctgaccaaattcggatgggtcgagggcgtgctgatccgctgcatggcttccatcttcggcgtgatgctttacctgcgcctcagttgggtgtccggccaggccggcatctgtttgttcttcccccccccccttccgttgactatcccttctcttttcccccatttttgtgctcggttcgtgcattgttctcctcgccactttgatcaccataatcaccactttgtccacctcagcaatttgcactaatggcctcgtaaagggcggcggtgcttattttctggtcactttgtgttgctatgccaacaattttcagctgatggcacccttttcagatcagccgatcgttgggccctgaatttggtggttccattggcattattttttccattgccaatgccgtcggtgcggcgatgtatttggtcggtgaaatcatttatccaatttgtgaatcggcatctcatctttaggttggatttgcagagacggtccgcgacttgctgaaacaccacggaatttttctggcatggaattcaaattttgaaatatttttttttacaaattttagttggacggcgacataaacgacattcgcatcatcgcattggtcgcatgtgcagttcttgtcgtgattattttggtggggctaagctttgaaagcaaaatgcaggtgaacactctcaacgcggaagaggagggagaggggcataattggccattaattagcgttaattactga

SEQ ID NO: 72872 - DNA, 960 bp, Heterodera glycines
  Genomic contig location: Contig_ID=SeqID_9849; Location=161..1120; Strand=+
  SCN-specific regions: Sequence locations=1-3,26-328,350-598,621 -648,670-764,790-932,954-960
  Gene Ontology: Mol. function=sodium:chloride/potassium:chloride symporter activity; Cellular component=integral to membrane; Biological process=transport
ttgctcccgcctttgcccctcccttccgacgcccttcgctttcaaacccgcgtcaaacacggcaccatcgacgtttggtggctgtacgatgacgggggactgactctgctgataccgtatctgctaacacagcaaaaatcctaccttgaggttatacatattcatcccccaagggtttcccgtccatctgatttatgcttttttccaaagaatgccaaattgcgcgtctttacgctcgctgggcagggcaaaaacctgcagcaggaacaccacggattggtcacaatgctgaagaagttcagaataacggcagatcaggtgatgaaaaagggaattgaagggaatcctttggactttcaggtcaatgtcattcccgactttaccagcaaacgcccggacccaaaaaggtgggccaatggacgaatgaatggcaaatgtttggtcaattcactatttgagtttggcaaagtttgaggcgcttatcaagccgtttatgagcccaagcagccgaacggaatcgaatgtgacggtccaattggagtcggacaatgaaaatgaagagacaaatgttggacaagccgagggattgattacggagactgagctgaatgcccagcaggcaatcaaccaatcattcgttagcatttcacaaatatgtcttaaatttctccaggcacgcacttggcgccatttgcgcatcgccgaattgttgcgtcgttatagctccgactccgaccttgtcgtcgtgtgagaattggccattggaattaattaattaattgattgatgctctctttgggtcattcatccgtttcccgacacttcagtactttgcctgtgccacgtcgcggactgataaatgcggcgctttacttggcgtggcttgaagcgatgagcgccgaattgccgcccacgctgatgctgcggggcaaccagcaatctgtgctcactttttattca

SEQ ID NO: 72873 - DNA, 1477 bp, Heterodera glycines
  Genomic contig location: Contig_ID=SeqID_9850; Location=1..1477; Strand=+
  SCN-specific regions: Sequence locations=1-146,171-176,198-320,362 -373,411-448,474-497,522-709,731-789,811-908,941-971,1200-1361,1392 -1477
gcgcgccaatgatgagcaggaaaccgaatcatcagacgttgatgaagacgaatatgtggtcgaaagcgatgacgacatcccggcggttgaggtgggaataaatttgaaagggagggagggggtcaaacaaaaattttgcaactatgaaaattatatatttaaaaataaaagttacctaaaaaatttttcagcccaaagagcgtgaagagcgatgggtggacccattaccagaaaagttgcaatttcagcagcaggtgaacaaaattgccgagctgaaatgcaaatactcgcgggccaatgccaaaggtgaaaagccatggatttaatttataaaatttacaaaaattatttttgaaaaattgttcagttttcactattttaaaaattgagaaaaacacttatttttaaaaagcgattgtttactgattttactaataatttaaatgccaaaaaaatttaaaaaaaaaattttagctaattttttttcaagtatttctttccaaaattattattttttcagtgcactggtacaaggaccgaaagaagctgttctcggacggtctcaagtacaaaattttgatcgacaaacagtccgtcacgctgatcatcaacaacccggacccggacgacagcggcaagtacacatgcgaagcgaacggagtgcccaccaattcatttgtcactgtggagggtatgttttggacggggcggacaaaacatggaaaattaattttgatttgcttcatgtgtttattattgtattattggcctataattttattaagctctcaagaaaaatttgaatttttaccacttataaacagattttcacgaaaaaaattactaaatttgcagttttttttttttgaaaatttgggtgcgagagatcttggagaggtttcgattcgtttttttttataatttttaattgattaaaaaagtagttaaacattttccacggacatttttggttttttatttaataataatttaattttaaaatttacttttttatcaaattaatactttcattttatttaaaatatatatttttttaattgtatataaaatttataaaaatgttttaattttttttaaataattatttcatattaaagaaaataaattattgctttttttcaaattagataattattatatttttcacataattttatatagaatatgttttattaaaagaatgcattttgtttcagactcaccagaccaacaaccattgtcctccaccgctcgtcgccgcgactcgcgcagaccaaaaagtgccagaaaggaagccactgcattgacccccttggacgccatgcagtggttggtttaacaaacaaaaaacgaaaaagaaagtttaattcattcattttattttttagttgcagcagccatttgacgccgccacgtcccaaaaacatggtgagcaaattcgggttttttaaaattatgtattgggaattttgagaaa

SEQ ID NO: 72874 - DNA, 2388 bp, Heterodera glycines
  Genomic contig location: Contig_ID=SeqID_9851; Location=106..2493; Strand=+
  SCN-specific regions: Sequence locations=1-491,514-638,660-720,742 -753,804-1110,1236-1262,1312-1430,1453-1585,1635-1716,1740-1822,1940 -2388
  Gene Ontology: Mol. function=structural constituent of cytoskeleton; Cellular component=cytoskeleton; Biological process=muscle contraction
gtggccggcgtcaaaccgcagcacacctacgagttccgcgtggctgcagtgaacgtggcgggccgaggcgagtggagcaagaactctgtgccaattgctgccacatggtccccctgtaagccgttgatcaccatgggaccgttggcatgcgacatgactgtgctggtgggtgaacaggccaagctgctggtgccctacgcagcgaaaccacgtccgaaattcgagtggagcaagaatggcgaagcgatggatccgcgtgacgacccacgcgttaaggaggaaaaaagcggtaagtgagcgcgcaatcctggcattaacagggtggaggcgcagagccatacaataaaaaaaagggagggggattaaccaaaatttttgctaaaatggtctggaaggagggggtcgacgggaggggggtcagcggccaattttgcgaaatggtccagccatgaatttgacgttctttcaaacagatttttttttgggtgcgctttttaaaaaaaaatattttttggggaggacggtggtgcggctaggcgccgccggaaaatttttgaaaattcagtgcaatttgttaacatattttcactaaaaactaccaaattgcgattctttagcaaggcgatggctttttttttgtgtttaaaaaacctttttttcgcggtacacttttttaaacaactttttttttgcaatttgttagaagattttgtctaaaaaatggccaaattttaaaattttggctaaatgatctttttaaatttttttaattaaattttattttttatcatattttttattttcacgtttttttctcccatttttagacattctcatccagctgtgctaccagaaatgcgaacaatcggacaccggcaactattccattcgcattgtgaacgacttcggctcggattcggtggacttgcgcctgaaagtggtcgatcgccctgcaccgcccgaggggtcattgaaggtgcaaaacattggtaatatttttgtaaacagaaaatgatatgagagtgacatatttgtaaaacaattaggagtggatttttttaagtttttttttagaaatcaatttttaacggagtattttcgtttttactgtattttatttttacaaaatatttttataaaaaattgatgaaaaattgttaaaagcatttttgtaaatattttatttatgaaataaattgtacaaaaattgatatttaaaataaaaattttaatttcctcgcttaaaacaggtattatgatgcatatttttgaatattttataaaaattttttaccaaatatatatttttttgttttttctcaagaatttcgcttctgctgatcatgttccagacaaagcatccacattcaaaaattttttttaaattgatcattttttctttgtaaaaattttggtttaaattgtccccttattcaaaacgaaaactttaaatatttaatgcataaaaaatcatgaacaggagcggaccgcgtccggtggcggaaggcgacgcgttggcagcaccgcggcggaccggtcggcaaaggcggcagcagcggcttgcgctgcgggcgaagaggcaacggacgaggaggaagtggccgacagtgaggaggagcagcagctgctcgacatgacgacggttgaggtgggaataattttgaggcgggagggggtggggccaaattttgcttcttgccactttttttctctgtgtttttttttttaaatttttttttggggatgggtggtgagatccaatggtgccaataggcagacgcgccgtggaaattttgctaaagtgaatgcaatttgctaattgattttatttaaaatttatttagtttttataattaaaatttttgtatttttttttatttaaaaaatttattaaataagatttaattaatcaactttaattgatttaatattaataaaacatgcataattatcattaattaacgaatttatgataacaaatattatgatttttatccgttttatttataaaatccaaagcttttttagactcaaattttttgtgtttaattttttattacaaaaaacccagaaattaaaatttctgctctttgttgaaataatgaattaatattttccaatttttaggtgcgctgtgcggacgaacggctgctggccaaggcgccattgaatgtgccagtgcggcccggcccgccgaagccactgtacaccaccgacaaatcaatcatgctccaatggacacgaccgttgcgggacagaggcacgccgatcactgactacgagctggagatacgcgagcgtggcaccaagctgtgggggaaggccaccaccaacgcggagctgtgggagaaagacgcatttggcaatgtaccggacacacgattcaag

SEQ ID NO: 72875 - DNA, 399 bp, Heterodera glycines
  Genomic contig location: Contig_ID=SeqID_9854; Location=714..1112; Strand=-
  SCN-specific regions: Sequence locations=1-236,287-399
atgcgtcccgtctcaaaatgccaatgtgcagagagagatatgggcaaaaagcacacttataaggaacaaatggcacgcaaagatgtgaataattatgacgaattcgatgaagctctactaccaatgtttcgcatgatttttgatgaaattaaaaaattaagcatggcgatgatggcagcgaaaaaaagcaaattttttttaatgaggaacaatactgttagtcctttcaagagagcaaataaattttttcaattcattaaaaaattaattcattaatataaattttggttattaaagcaaatttcaatttgttttacatttcatttgcagagaatatatgcctaattttcaattgcttcaatttgcaagaaactattcagaggtaaagaatataataaa

SEQ ID NO: 72876 - DNA, 636 bp, Heterodera glycines
  Genomic contig location: Contig_ID=SeqID_9855; Location=1701..2336; Strand=-
  SCN-specific regions: Sequence locations=1-636
  Gene Ontology: Mol. function=1-phosphatidylinositol-45-bisphosphate phosphodiesterase activity; Cellular component=cytoplasm; Biological process=response to abiotic stimulus
gtgcctatgctttcgagtttttcgaatttttagaaatcaattaaaattggtgcacttctgagcacacaccattcggagaatatcagtgaacaaaattttaagaaattcagaaatcgtaagtaattcaccagaatcaaaattttgaggcttaaaaaaaattcgaaaccggaattccgatgataaaaaaaagtcggaaaccaaaattctgacatgtccaacaaaatcggagattgcgctattctcatgccttaaaatttccgcggcgcaaaaaattttcagaaacccccctaaaaatgccagaattcgtactcccagcagccataaaatattcatggccatcctcctccacctgttgatgaagtaatggcacaatggttggtccatgtcctggtaccgctcgttccaggacaggaacaccggggcattttcgtcggacaacagaaagcgcaggaagccgtccccggacatttttccctgcgcaatgtacgactcgtccgactcgtacttggcgatcagctgctgcacccgctcctggtcaaagtgggggaacaggatttcgttcagccgcgggtcgcgctgctcctcgttgagaaactggagcagccgctcgcgcgtcagatactccttttgacccga

SEQ ID NO: 72877 - DNA, 4644 bp, Heterodera glycines
  Genomic contig location: Contig_ID=SeqID_9855; Location=1175..5818; Strand=+
  SCN-specific regions: Sequence locations=1-115,137-523,545-1235,1258 -2152,2175-2221,2243-2382,2404-2468,2490-2550,2572-2965,2987 -3042,3064-3305,3329-3638,3660-3755,3777-4319,4342-4423,4448 -4474,4496-4644
  Gene Ontology: Mol. function=1-phosphatidylinositol-45-bisphosphate phosphodiesterase activity; Cellular component=inaD signaling complex; Biological process=response to abiotic stimulus
gaacgtgaagatttggatgccactttgttcacgtttgaaaagttcttgcgcctctaccataaaatttgtccacgcacagaagtgcaggaactgttcgttcgactgtgagtttcttttgttggcacactcttttgtcggcatttttgaattttttcctgatccttaaaagcaaattaatgtgtctctggcacttggcaccagttaagcaaatcccaatatattgcttttttttttgcccagaaatcctcgtgaatcaaggacaaccaaacatatatgcaagaattaattttggcccaaagaaccatcaacaaatcaaggacaaaaactaattcctatatacaggaattaattttggcccagagaataccttgaaatcaagtgcaactagttctatatcccggaaattaattttagcctagagaattctcgaaaattaaggacagacagacatttcagatgcccaggaaccgattattaatttttcgggctaaaattttcaaggacaaaccgccacccttttttcaggtcgggtcaaaaggagtatctgacgcgcgagcggctgctccagtttctcaacgaggagcagcgcgacccgcggctgaacgaaatcctgttcccccactttgaccaggagcgggtgcagcagctgatcgccaagtacgagtcggacgagtcgtacattgcgcagggaaaaatgtccggggacggcttcctgcgctttctgttgtccgacgaaaatgccccggtgttcctgtcctggaacgagcggtaccaggacatggaccaaccattgtgccattacttcatcaacaggtggaggaggatggccatgaatattttatggctgctgggagtacgaattctggcatttttaggggggtttctgaaaattttttgcgccgcggaaattttaaggcatgagaatagcgcaatctccgattttgttggacatgtcagaattttggtttccgacttttttttatcatcggaattccggtttcgaattttttttaagcctcaaaattttgattctggtgaattacttacgatttctgaatttcttaaaattttgttcactgatattctccgaatggtgtgtgctcagaagtgcaccaattttaattgatttctaaaaattcgaaaaactcgaaagcataggcactttcccttttgataattagctttcttttttgccaaatagacaaagtctattaaaatttggtgcggtttgatcatttggaagagttaggggctcctaaattagcatttttgattttttaaatattatgttctaatccatatttttaatcggataagattgtcatgtcatgatgattaaatgatcttaattaaaatcacgctctttacagttcccacaacacatatttgacgggtcgtcagtacggtggcaaaagttccaccgaaatttatcgccaagttttgttgtccggctgtcgttgcatcgagttggactgttgggacggcaccggggagaacaaaggcgagccgatcatcacacatggtgagttaattgcttaacgaaatgaagagacactccaaatttccaaaaaaaaaatggctaattgattgccccgagtattcaatcgaagtaaaaattatcgttccgtttctagctgatcagttggaaccaacaaaagtgatctatggaatatccaactgatcagttaaagccaaaagacaatcaatccgatatccaactgatcagttaaaagtcaaaaacgattgatcggaagtcaaactgatcttgagaaattgaaagtggtcgatcgatcggatatccaactgaagttaaaacccaaaaacggtcgatcgcttacccaactgatcagttaaaagccaacaaatggttgatagagcaattggtcactaatcgggctttttccaatttccactccccccccccccccctcaattcccaattcaaaagccattacattggcataatgccaaaaattgataaatttgtttgtaataattccccgcttccttcagggaaggccatgtgcacagacgtatttttcaaggcaattttgctttcgatcaacaagctgcttgcttgatcaccgatcgcctcattaactaattaattacatttaggaagtgctctatcaaatcaaagagaccgcctttacgcgcaccgatttccccgtcattctgtccttcgaaaaccattgctccaaatccaatcagttgaagatggccaagtactgcttggagatctttggtgacatgctgctcagcaaaccgttggacgaatatccggtcggtcttgatccattttttttgcattttaatcgaataatgaccggatttccgaaatccgcactaattttatttaccgttaaatttcaataatttttgtgcttgtaaaataataaatatttcagttggagccgggcgtgccgttgccgtcgcccaaccgattgcggcggaagattctgatcaaaaacaagcggttaaagaaggaagaagagcggcgacaaatggaggcattaaggtggggcttaattaattaaattattgttaggcattaattaaattaattaattaggcgaatcaataaatttatcttttggattttcgggtgggaagataggcctaactaattataagcgaatctggcacacatttaataattggctgagtaacctagtgatcgcaaggcttaaaattataaaactgggtttttgatcaggaggatttggagttgtcattgactctttgtctttgctatgcaaaaatttccgggaccttgatcccggcttttttgaaaaggccgggattgggatcccgacaaatggggatttgaatcccggggtcggaaggatttaaatttcgacaaaatccttgctcccccatttgacttggatgtcacaatttgccacaaatcttgatcaaaattcaatgtttttttatttattttagccagggccgtctgcttgacgaggaagaagcgcaggaggagcaacaaccggtggcacagccggcggcgatgccatccaccgccgccgccacaacggcacaaccaccagcagcagcagtaggggacaacaacaatgctgttgttgtggaggaatgttgctgtaacggtggtgaaccaccacaacagcagcaacaagggacgacgacggcggtggcaccgcgtgagtttggcaccgtttcttttctcgggttgtgccattggcgcattgactgttcggatctcgagtaactaattgggtggactattagtgccacgctcgagactgaaaatccgagtctctagcttatcatctcataattacaaatttattattttcttctgatgctaattgtttatcaatcagtaatcctacttatctcattttattgtttaccaaatttttaatttcttatatttatcattatgccaaaaaatgccaatattgttttttaactatatttggcatttgtgtcctttacaaacaccaaattttggtggcattagcccgccatcaaattttggcataatgtgctgtgtcgggcaccataaaaacccatcttcgccatttttggcaccaataggcgcctctccgttcggcacgccgccggcaaacagcgccgaattggcacggtcttttgacttggccgaatgccgttgctcaccaccggtggcacccgggtcggccaccagcaaccgttgtagcaggcacacgttgtctaccgcctcttcgtcgtcgccgagcagacgcgccagcatggaaccgatgttgtcccatgttgtgtcgccccccatgatggtgttgggcatcgagtcgtcattttggtacatatgtacaataagtactaattaccttagcgcccgctagcgtaaacaaaattgatgccccgagacttggcacgaaaccgaaaatgttttcgaaaacgaaatcaaaaattttcaaaaaccgaaacgaaacgtaaaagaaacaattttttttaaattttggaaaccctaacaaaaacgaaatgaaaatttaaattttgaaaaccaaaaacgaaatttttaaggacgaaaacacgatcagaaaaaactcagaaagtgccaaaaaagtgggggacgaaagtttctacccctccggcgctttgtgtccgtgtttgatgccctcatcattcatttcaccccatattgggctcttgcgcagttcgtcccgcaactgttcccagcgtaactcgttcatcttctcgccgtccgccccaggcggttcggccaacgccgccgcctctgccgaaccgcgtctctcctttctcttttccgcttttcatcccgcggaattgcgccggtccgccaggcgtcgccgggagcagcagcaacaacaacaagcggcggcggcggcggctgaccgtatgccaacggtcgccactggcggtaaggaatcgttgcgtcgaaccgcgttgcactcgcacagcggtggcggcggcagtggcgacgcggaagcgactgctactgctgggtcgccgcgctcgcggccgccgtcgcaggttggcgacgcgggggcgacaacggcacgctcgccgtcaccggcgagcgccaagtgcccgtatcaccagcagcagcaacgacgggagtcaaagaaagccaggtagatttttttatgcatttaatggtggaaaatggtttactat

SEQ ID NO: 72878 - DNA, 563 bp, Heterodera glycines
  Genomic contig location: Contig_ID=SeqID_9855; Location=4423..4985; Strand=-
  SCN-specific regions: Sequence locations=1-35,57-152,174-483,507-563
atgtaccaaaatgacgactcgatgcccaacaccatcatggggggcgacacaacatgggacaacatcggttccatgctggcgcgtctgctcggcgacgacgaagaggcggtagacaacgtgtgcctgctacaacggttgctggtggccgacccgggtgccaccggtggtgagcaacggcattcggccaagtcaaaagaccgtgccaattcggcgctgtttgccggcggcgtgccgaacggagaggcgcctattggtgccaaaaatggcgaagatgggtttttatggtgcccgacacagcacattatgccaaaatttgatggcgggctaatgccaccaaaatttggtgtttgtaaaggacacaaatgccaaatatagttaaaaaacaatattggcattttttggcataatgataaatataagaaattaaaaatttggtaaacaataaaatgagataagtaggattactgattgataaacaattagcatcagaagaaaataataaatttgtaattatgagatgataagctagagactcggattttcagtctcgagcgtggcactaa

SEQ ID NO: 72879 - DNA, 595 bp, Heterodera glycines
  Genomic contig location: Contig_ID=SeqID_1338; Location=8427..9021; Strand=-
  SCN-specific regions: Sequence locations=1-595
acatacggataaagtgaagtgaaatcaaagtacgagatcttctctccatctcgtgcttcatggtaaagcgttagcggtcccgtgcgcccgcccatgaatgcatctctgatcaacagtggtccatcatcaacgtattccgcaaacttttgccgcatctctttgcttctgctcagcatacactgaatttcgcattcccaatacacatccacgtgtgccacttgggagtgaatgaattccaggcgctttgcgtcccgctcgcgcacttctcctgccgactttccatttggtagcagcatgttatcacttggataacactttttgcacccgtgccacgcacaaccttatttttcaaatgaaacgcataatccaaaaaaaaaatcaattaccattcacttcgatggccctccgctcggcctggatccatccatcaaggctgtactggccaatcctcttttctccttccggtgagtgagcggtttgaaccaccacaccgtgttcctctgcaaaccacttgaagaagcgaagtgccaaaaggctttggttctgggcattgtcgtagccccgctccggcacaatggccagatgatccgctgga

SEQ ID NO: 72880 - DNA, 1061 bp, Heterodera glycines
  Genomic contig location: Contig_ID=SeqID_1338; Location=4278..5338; Strand=-
  SCN-specific regions: Sequence locations=1-128,170-301,345-438,468 -683,713-758,780-906,928-1061
atgtctcctatcaagagaaagcaagacttaattgttgtgagcaagaagccaagactttgcaggcccttgacacgtcaaatgcttgacgaaattatcaattggattccttttatgttcttatttggcggtaatattttaaatatttaaaattatgtttaaaaaatttttagtggcattgtgcaagccgaagcctaagaaattgaaggctcgaagacgccttccagccgagctcgtttacgaaatgttcaatttcgtgcctgttatgcagttgtatggtggaacgacacccgttacaagtttgtttaaaaaatacaatttaaaatttattacatttttaaatttaagacggatttctccctccttgcggaattgggctcattaattggtcattcgaaaatcttcgaacaaaacgctgcagtcttttcgtccaattggtgcataaaaaatttttaatgaaaatattttttcgcattttagaaacggctgtcacttgattttgaaaccatctgtgcaaaactctggcttccaactggtcagctccatattcaatttaagtttgcgttccagctgctggaccctttctacttcaacgatttcacccgttatttgctctactctcgttcgggccgaatcgcaacaacgcgcattttagtccacctgccttcggatgcggtaaatatgagaaaaattaaaaaatatatatttttaatatgttatagtcagctgtgactggagcattgtgtggcatactgctacaattcgttttgaacagtccaacaccgaccacactgaaacagcacattgcagtctcattcttgcgccgttcggactttccgacaattctcaactctacggctcgcatgatgtcgtcgcagggcattcaccaggtcgcgcacaccgacaaagaacaaatgttttttctaaaaaacagtcattatgggcattatgtggggtttctcatgattgattcccgaaccagtaatcctgaccttcattatatgattttctcagtttactgatcaaataacacatgcaagcatttaaccattgggcgtaataaa

SEQ ID NO: 72881 - DNA, 2613 bp, Heterodera glycines
  Genomic contig location: Contig_ID=SeqID_1338; Location=6031..8643; Strand=+
  SCN-specific regions: Sequence locations=1-74,96-1266,1288-1412,1435 -1702,1724-1848,1890-2241,2263-2613
atgtccaatcgccaataccccaaattctttatcagcaacattttggggccatcacagccgaagaagccacgccaaggctttctcatcaaccaattgcttggtattgtgcagcagcagggagaaggggtctcttcctcatcatctgctcaaaagaaagcaaatgaatacgtcaaaaagttggacaacagccttgaacatctgccagggttcaactattcaaaagtcaaatcgcggttcagcatcgaggatgttcctgaaaatcctgaaacattgttgaccgccatttttacgcattgtattgatgaggcaaagacggacagcagcgatcgcggaattgtgcccacacatctcggatgtgtcatcagcagtcagctactgacggcaggcgacctctttatcccgatcaggcagataacagacaacacagtcgacacaattctcaacctttttttaaaagtatcgcagagcaaaaagactgaaggggtcacgctgtggggcgaaccctttacagtcacagtgactactgttaaccgcgacgggcttcctgccaaacggcagctcaaagggggagcacgtcggagaatagctgctgtacaccatcgcattcatgaccagtctttgataaaggttttcgaatagctgatggagaaatataaattgcagtttaagatccgtaaccccgatgatcgaaactactgtttgttctattctttgcaagcaaccatggtggccaagacgcgtggatggccccgctggaagttttacgattatttgcacagccagcatggacagcgagacaaatttctcagtgacactttgtcgttaatgcgcacagttggcatccaaatggatttgaatggttacgatgctgatacgtttgtgccgcgcataatcaaccactggaacaacacacagcaaaatcaccgatttgccgttttcatctttggttcaaatggacaatatagaccgctgtacaagtacaatgacaacacatacgacacaccgctacttctttacttcaatgacaaccatttcgatggtgtgcaggctcaaggagggttgtttggccgtaaatattgtctcgagtgtgaacggccgtatcgaagagacagcgagcacaacaaatcatgcaaagcacgctgtctgctttgctctcgggttggaccagcatttccatgccctgccgccgccggcttcttcaaaaaatgtgatggctgcaacaaaaaattccggaacaacaattgctacactcatcatctgcgcacaaatttctgcaacaagtcaaaattatgcaagcattgcggcgtaatttgggatgtaaagcctaacaacacaaatgaacgaaaaggtcatgtatgcggtgaacagttttgcacattgtgtaacaactaccacaacacggaaagaggatgcttcatcaaaactcttgagcccaaagaacaggacccataccgcattgtggcgttcgatctggagaccatgcagcatcaaccagttaatccacaacagctcgatcggcgaagtcatcagccaaattttatcagtgccaaggtcatttgccctgattgcattgaaaacgacacatggaagaggggtacagcaggatgtgcggtgtgtgggccacacaggacagtcgcattttgtcagcggccctttaacaacaccgtcgttgaccaacaagtggtgaccgacaacccattggaagcatttgttgagtggctgatcttccagctgcccaagcaatacgacacttttgcttattcgcactttggcggccgctttgatatggtcattgtgtttcgggagctgttccggcgaggatttaatcccgaaatgttgaaaaaagtgaaaaattaatttaattttttgtaaaaattaaattaattttagggaaacaaaatgtaccagatgaaggtgcgaaagcaaaagaagcgcaatccgaacgtggtcttcagagactcgttcaacctgatgccaatggcacttgcgtctcttgtgccgtcgtttggtcttgatgttgaggacaagccatatttcccgcacttgtcaaatcgaccagaaaactacggtcaacagatattccccacgtccgacgactatctggcaaatggaatgatgccagataagcgacgcaaattcgacatgtggtatgagcaacatcgcgatgtcccctttttgctggatgaggagctcgccagctattgcaccaacgacgtggaaattttgacagctgctctcgttgcttttcgccaagagttttttgaaatctcccaacgacaggagggtgttgttgcagaacgggccgcatcagatgagcatcatgatggcattgacgtcttgagggagtgcatgaccattgcgggggcatgtatgcgtcacttccgcacaaatcaccttccagcggatcatctggccattgtgccggagcggggctacgacaatgcccagaaccaaagccttttggcacttcgcttcttcaagtggtttgcagaggaacacggtgtggtggttcaaaccgctcactcaccggaaggagaaaagaggattggccagtacagccttgatggatggatccaggccgagcggagggccatcgaagtgaatggtaattga

SEQ ID NO: 72882 - DNA, 1418 bp, Heterodera glycines
  Genomic contig location: Contig_ID=SeqID_1338; Location=8726..10143; Strand=+
  SCN-specific regions: Sequence locations=1-1005,1028-1169,1206-1418
atgctgctaccaaatggaaagtcggcaggagaagtgcgcgagcgggacgcaaagcgcctggaattcattcactcccaagtggcacacgtggatgtgtattgggaatgcgaaattcagtgtatgctgagcagaagcaaagagatgcggcaaaagtttgcggaatacgttgatgatggaccactgttgatcagagatgcattcatgggcgggcgcacgggaccgctaacgctttaccatgaagcacgagatggagagaagatctcgtactttgatttcacttcactttatccgtatgtaaagtgagttttgatccaaaaatgggattcaaaaattaacgttacatttcagctttgtcacgcggtatccggttggtcatccaaaagttcacgtgttcaacgaggatgtcacatggacacattccggggacaacccttacccccttgccttgctcaaagtctttgtggtgccgccaaaaaagtgtgatgtgccagtgctgccagtcaggatcaatgagcggctatgttttccgttgtgccaccgttgcgctcaagactatcccatgggggacgtggacccggactaccactgcgagcacaccgatcaacagcgcggatgggtgagcacgtgtacatcgattgaacttaacgccgcgctggatgaaggctaccgggttaccaagctcttccgcgtgcttgagtatgagcagagcgacgacaaactcttccgtggctacatcgctgaatttatggcccaaaaaatacaagcatccgactttgcggccaacatcaaaggcaacaatgagctggaggagcagtttgtcaatgagtgccatgagatgttcggcatcaccatcgacccggagcagatggcagtgaacaaaggaaagcgttcaatcgccaagctatgcttgaataacctttgtgagtgtcttaatcggcttatgcctagtttgagctcattattttaagggggccgtttttctttgcggaactttggcctggcccaaacggtgatcacagatgaccctgcagttttggctgagtacttggacaacaaatccatcgatgtgatgtccatcgacgaactgaatgagacaacgattctgatcagttacatgcagaaaaaggaatgggttgaagaacatgaatgttcaaatattggtgagagacaattaaattgaaattttaattgaaatttaaaattttcagttatttctctttggacaacatctgcagctcggcttctccttttgagagcgatgcaaatggttgttcgaacaccaggctgcagacttttgtatacggacacggactcgctcatatttgctcatctcattgccaattgccctcttcaaacgggtccacacctcggtcaattcacggacgaatatccggaccatgaaattgttgagtactgca

SEQ ID NO: 72883 - DNA, 530 bp, Heterodera glycines
  Genomic contig location: Contig_ID=SeqID_1339; Location=277..806; Strand=-
  SCN-specific regions: Sequence locations=1-530
atggtcttggtcagcgaatattgcgcgcaattttttggttgttctcctaaaacacttcgcgatcgtctaaaccatcctgaggatcgggaacgcgcactgaaagagttgaccggcaaaaaagttcaaacaacctacaaagaccgaaatggcatgcgcaagactttctttattgatgggataacagaaaagggagcggcattcgtgccagcctacggccgtcttcgccagccgtttaatataaatgtggcggcacatttttatgcccgacaccgtgtgaaactgcatcacccctacattccgtgcattgttgaacgctttgagtgtggggagaaccgtaactacccgatggaactgctcgaaattgtgaaagaaggacaacaaccgatcgggcaatggctgggcaacttgttcaaggagagggatgacatttgcagcagctcgtcaaccctgtcggacaaaactttagttttgcgtgatgaagaagacactggacgcgatcaatgtagccagaaatctcctgagttttattg

SEQ ID NO: 72884 - DNA, 488 bp, Heterodera glycines
  Genomic contig location: Contig_ID=SeqID_1339; Location=951..1438; Strand=+
  SCN-specific regions: Sequence locations=1-25,47-47,69-488
atgctctcgacccaatcttcccgcaatgaaagaaaggaaatggagggtcaagaagagcagtgtgaaaattcgcccacaaagaagcaaaaattggacaagccaaaggtgtatgacagtatgctgtggaagatcctcaagggcaaatacatgatcagcatgtatctttgtgcaggtaataaacattaaaatatttttcacatttttttattttgcagatgattggcgaaaactgttcgagaaccgcgaaaaagtgcagcgttccgcgaatgaccgagtgcgcattagctttgacatgtgtgaagagtgcgcgcgtgtcaattgccgtatgactgacctgattgcaccaccaaaaaagaatttaattttgtaaattcatatttaaattgtaattgcttggataaatttaattctttggccttttggtttattaccatttttgagggagggagggggaagggtctcattgcgtttccctaaattattaagaa

SEQ ID NO: 72885 - DNA, 374 bp, Heterodera glycines
  Genomic contig location: Contig_ID=SeqID_9857; Location=608..981; Strand=-
  SCN-specific regions: Sequence locations=1-53,82-247,272-374
atgactacatgggcatcattggagctcaagtggaacaggtaatacaagtcaacaattaattaataatcataaataattaatcacattttggcgcctgttgtaaaatagtttattggcccgtacaaaatttcaaaaaagtctaaattggaacatgtcaaattttgggaaattttcgatttcgagaaggcaataatttaaaaaatgcacaaaattctcactcggcttttgttttgtcaaatatttttggattaatatttttataaaataatttgcaataaattaacattggtaaaaaaaaatttagcctgagaatgaaatcagctccacgagaagaaacgcacgcaataaaaagactacttttttgtttcgcgtaa

SEQ ID NO: 72886 - DNA, 1885 bp, Heterodera glycines
  misc_feature (48)..(48): n is a, c, g, or t
  Genomic contig location: Contig_ID=SeqID_9858; Location=1..1885; Strand=-
  SCN-specific regions: Sequence locations=1-175,223-380,414-529,567 -684,706-760,813-1220,1268-1274,1298-1434,1468-1476,1593-1813,1835 -1885
  Gene Ontology: Mol. function=sodium:hydrogen antiporter activity; Cellular component=integral to membrane; Biological process=sodium ion transport
atttgaaatatattatcataaaagggtgtgttgttcaatgcgctgttntgaaccttttccgacgcaaaaaattttcattcaccgaccaaatttgtgctttcttatggaggacttcgtggtgcaattgcatttggacttgtcatgtcaacaaataattcagctgatcaattccctgtaatttttttaaatttaaattaaaaattaaatttgtaaaatttttaaggcccgttcaatgtttatctcaacaacattggctgtgattttcttcaccgtttttgtgcaaggcatttccattcggccattattattctggttaaaagtggagaaatcgggcctcgatggccttgagacaatgatgagcaacaaaatttttgagagggtaattaatatcattaaaattttaaaaaattttaggatgcacaaaattttaaattgtggctaaaatattgtaaatttttttaaaaactaggttaataaaacaaataaagaaatttttcattttttaaatggtttaatgattttcgcatgcaaaaaaattacttaacttaattttttataatttttaagctcatttttgttgttaaaataagttaaaaaatgtttttgttttctttctttatttaagaaatactaaagttttaaaaacttgggcatttttctgattttcagctcataaaaactcattaattcatgtaccaatattttatgctaatccttaatgaactgaatcagttaaaaatttttaatgaattgaaataccattttattaaaattaaatattctttaattttctttttcatttttagtacactgatcacacaatgagcgggttggaagcaatcattggacataaagggactcattcattacgcgatgcgtaagttgtttttgtttttgatcaagacaaatcaaggacgttcttgtaaattgatattggcagcaatgttaaagaattttcaaagaaaattttattaaaactttaaaaagacaaattaaacgaaattaaaaaaattagtcagttcgccacaattataattgaaaaaaaaattcgtttagatttgaacgtttcaacaacaccgtgttgaccccatttctgatgcgatctggtgaacagcagcgcaaaacatacgaagcgtcaccaattgttcgggcatatcacaaaatcacgctacaagaagcgcttcagcttgcgcagagcggttcaaaaatttcaaagttggaaataattttaaaatttgaattaaaaataaatcaaataatattttttgcttaaatatcaaattcaaataaacaatttgttttatctttagaaaaacaaaaaaaattacacgttgccaaagtcaaagcgaaagtttaccaccaacttcaacaattttgcgcagtgttagtcgagttggagcgcagcaaatgacagacattgatcaggtaattaactatatatatatatatatatatatatatatatatttaatttttaataaaaataaataaaaattccaattacaaagaacaaattaaaataaaaacatgtaatttaaaacaaatataaataataataacatatagtgcattaaaacaaaaactaaaataaattctaattaataacgaccaggagcggtgtggtgtaatacggaaacccggaaactcaaaaaaattctccagaatttcggacaaaaaccccataatcggtagtttggaaccaccctgatttatatgtttctatgaagcaaaaattgttctaagttaaaaatataatttattttcaatgccaaacaaatacctatacaattgtttgagtcaccattattatattatttaattgatttacagtttctttcaaatcgtgaaaatgtggaactgctttatctcatgttttctcgaatgt

SEQ ID NO: 72887 - DNA, 829 bp, Heterodera glycines
  Genomic contig location: Contig_ID=SeqID_9859; Location=3472..4300; Strand=-
  SCN-specific regions: Sequence locations=1-176,212-358,380-382,408 -701,723-808
atgtttgtcacgacaacattggctgtgattttcttcaccgtttttgtccaaggcatttccattcggcctctattgttttggctaaaagttgaacgtgatgatgatacggcacgaccagcagctgaagaaaaaaaggatgataatccagacgaaaaattggacagagtcagtatgccaaaaataaataaataatttaaaataatttaattttcagtacacagattatgcaatggctggcctggagacaattacgagcggagcgggcaaacatttcttacgaaaagcgtaattttttttattttaatggagaagacaaaggctattataatattaattgatttaaagaataattagtgatttatgaatcaaagttacataacccaattataattattttaattaattttgagaaattctttattaagaaattaataactaaaatgctgtaattaataattgaatgtttaagtttggcacggcatttgcataacatgccaactcgaagtcgaacggaaagtgaagagggccgaccattgttaacatgatgaaacatgataatggatgacaatgacacttcttgttaatctcaatataaactttcattttattgtaaatccaaattggattttagtaaaaatttgatttccacaatttaaaaattttgaataatcaaatgggcaaatttgatggcatttgtatcaaagaatttaaagttatttatgtgccactctatgcaaatatttatgggctatattttgtatattttgctttgatatatatttgctcatctataaatgggtatgggatatatttgcttattgtaaataaa

SEQ ID NO: 72888 - DNA, 1108 bp, Heterodera glycines
  Genomic contig location: Contig_ID=SeqID_9860; Location=1552..2659; Strand=-
  SCN-specific regions: Sequence locations=1-268,291-692,715-804,826 -1037,1060-1108
atgaatcgcagtggcattgcttcttcgattgatgtcaaagtgcgccaatgccttcaaatgtcttattatctggtcttcgttctgtttctcaccttctgtgtttaccctttgatcaaattggctcgagaacgcttggctctgtacattctgatcagcaaagtgcgaaggcgaacatggggaaattaaccaaaaattgaacacttaattaatcaattagccaattcagtctaattaaacagttaattattgttgtaagttaagtgatttccttccccatttagctttttcctgccttcatcatgatatgctccttctttttgggcattgattcggtcgttcgtttcgtcagtattggccaaatggtgcgccaaagtctgatcattttcggattggttaactatcgtttgcatatcatggcattggccgtaaacagagcacacgcactgttctttccatttcattacaacgaaaaagtcacaaaaaggtaattaattaattagtttaaaccctttttgcgtaataaaatagccttcgccccccattttgatgatttttttacggttcattaagggttgttctgttccaatgtgcgctctttcatttgttgtccatcctcttcactgttttggcatatttctaccctggtaagtgaatgttttactgtaatgattggttactgtattttctacagtatcaattccgcttctcttctcttttagttatttcactttacacttggccttatctgatcgtttcttcctcactttatgtggcaattgcaattcgtttggcgtggataaaaggtaaaataaataattaatttttcgaaattcccaatttatccacttttaaagcgcataatcgcagttggaactccgaaggggcgtccgcccaatcgtcggacaaagacagcggacgaatcactgcgacatgctttgccattcatatccaagcttgggcttatgtgggggccaattcagcggccaattacaagtggtactccgactttatcaactgtcatccaatcggacaaattgcttttttccccatccaacttttcgtgtgcatttatgtgatagcggacgaggcaatcaaaattaaaatttaa

SEQ ID NO: 72889 - DNA, 627 bp, Heterodera glycines
  misc_feature (595)..(595): n is a, c, g, or t
  misc_feature (607)..(607): n is a, c, g, or t
  Genomic contig location: Contig_ID=SeqID_9861; Location=75..701; Strand=-
  SCN-specific regions: Sequence locations=1-138,186-365,388-399,421 -576,616-627
atgtgcggtatgcttgaattgagttcaatgcatgaaaatgcagcattttcctttggtgggattggcatttttgtctgcgaatttatttgctatttgtccatttgggcaatcatttggtgtcgggaagaacaaagtgccaatttattaacaaatttttttaatttattaatttattttttaatttagtgccacaaaatatgaagaaaataatcttttcactaagcataattatggtcaataatctcatctgttttattggagtttgtttgcttttgtttttgttgtataacttttttaaaaattctttattttagaccaccattttttctacgttaattatacccaatttcgaaattaatatatttgctttggaatatgtttttgtgccaatttgcaacgcattttaaaaataataaataaccataaaaaactaccgaatgttgcgtgaataatgtaaatatgttcatcttaaatattgaattcttctatttaaaaatcaatttaataatcaaaaaaaggcccaattaagccgatgtaatcaattttacctgtctcttttctacagatttttgagtcaaataataaaatttttcanattatgaattanatatatttgttcacaactaa

SEQ ID NO: 72890 - DNA, 414 bp, Heterodera glycines
  Genomic contig location: Contig_ID=SeqID_9862; Location=216..629; Strand=-
  SCN-specific regions: Sequence locations=1-414
atgacgtcaaacaagcaacgacaattggtccataaggacgttaaactacgtcaccaattcaagcaaaagcactcgagcatgcagctgacagcacgtttccggaagcaaattcacatgtcctcaacgattgaggaggttcagcagcgaatgaaccacaacagaccgcaaccgcggaggtcacaacagaggggactaaggccaactcaagcgcctaaaatatgccaatccgggatggcacagtacaagcagggtcgagggatccgccttcacactgcgtcttctgcaatggcactcactggaccacgacgacgactcagcgaacaacccttgcaacaagagcaaggacacgaatccagtacgtcaccagggcgagaacgcagaccacgaaaaagccaacgacacgccccagatcgc

SEQ ID NO: 72891 - DNA, 719 bp, Heterodera glycines
  Genomic contig location: Contig_ID=SeqID_9863; Location=37..755; Strand=-
  SCN-specific regions: Sequence locations=1-448,471-661,683-719
atgtctgggccaatacaaaaagggatcatcaatgcactcaaagctctggacaacgccaaaagcgccacctcactcattctacaccccgacccggacctatcaaactgggaaaatgccgtcaacttggaggctcaatttgatcgcgtcgtcaaggaaatccgtacaatggaaatgcagatggacagtctacgagactcatccaacgcttggattgaacttctcgcccgcctgaccggagacgacaaagacaacggcgaaaaagaatacatcaaattcgacaaaaatgaaaaaatcgccgaccgatacgacgcagcaacaaccaaacttcgggatttgcgagatctcgaagcaacacttagtgccgcagccaaactgcacagaggcagagccgacagagaagcaaaggcggatcaattggccaatccgcagcaacaaccgcccatgccaccagcaatggcagcaccaatgacaatgccaacattcacagcaccgctctaccaattccagccaattcaactggataaatttttcggccaaaagcgaaaatggcccgaattctacgaatccttcaaatcggcaatcggcagtcaatcaatcagcaaagcgcagaagctgaacttactccgcaatctgctgggtggagaagcgcgagaactcatagcgggcttccggctagaggacgcaaactacgagacggtccttcagctgtcacataaagg

SEQ ID NO: 72892 - DNA, 422 bp, Heterodera glycines
  Genomic contig location: Contig_ID=SeqID_9863; Location=2406..2827; Strand=+
  SCN-specific regions: Sequence locations=1-114,136-385,415-422
atgactctttgtatgtataatgagagtatgaacattttattggtatgccttttttaatatccaaaaaattctgcttttctgtttaacataccactaaaaattttggatatgtgtccaaacaatttaataaaaattcactaaattacgcgatagttttctgggctttttattgacaataataactccaaataaattgtaattatagcattttatgactctttgtataatgtatccaaagagtcagaaaatgggcagattacaatttatttggagttattattgcctttaaaaacccgcagaaattattttggaattttctggaattttattaaactgttttgaaatatacccgaatttttgtggatgcgatgttaatgagaaaaagcaattttgcttttttaaatattaaaaaaggcataaca

SEQ ID NO: 72893 - DNA, 1181 bp, Heterodera glycines
  Genomic contig location: Contig_ID=SeqID_9864; Location=206..1386; Strand=+
  SCN-specific regions: Sequence locations=1-317,376-417,439-480,503 -1181
gcttatagagaaaaagcttggctaccgaatgaaactaagcacgcaaaatttggttgcttgtaagcaaagttatgccatgctcatgcttaatgaacaaaattactggcaacggaaaacggtaattatttcgggacaaatgccaaatttgtcgtttgtaattgtatatttttggaagttcagcctgtagaaatcttccgctgagctctcattcaccatacactcaatgccactaaaaatgaaaaaaatattttaaaattggtaagaaattcatgaaaaatgtatgcctctcaaaatttttttccatcttttacgatttgtttatttatattaaataatgttaatttcatttaaaatcaatattgaataaatattattctacgcaaatattctttctctgaacatttaggtatatgatcattttcccaactttaaaaaaatcttcttttttttcattttcttactacaatgatttctaggccctagattttttggcacttaaaaacgccaaagtgcgagaggtttaagcacaaaaaaaaattgccaaacaaggtcgaggctcagatttttaggcacttggagaagtttaagcccaaaaaaattgccaaaaaggccttgccccaaaaccgaaaaataggcactaaaaaggttaagtatttaaggggtgtaaatcaggggtagtcgctgaattcgattattattttttctattttttttatacgtttttctttcgaagctatttagggaagtgtattatgcgaaaaatttttagttaattctccgaactgctttggaatggtggttttacgacgcatctgcgaagtcaagcgggagtgcattcctgaatattctttttccagccttagcggagaggaattttaataattagaattattaacttaattgcattatttggggtgttatatatacgtcattttgccaaattatatattttttttttcttaaaagtgattggaatgactggcgatttcctgatctgatttgatacaattattatttcaactcaaatcaaacgtatcatatttttattcgaatgatgattctataactaggaatcactattttggtgcttcgccactaaaaaaaaactatttcggaagttggccactaaaataattttttgccaatattttggcatttttggaaaacttcccaaaattgca

SEQ ID NO: 72894 - DNA, 1195 bp, Heterodera glycines
  misc_feature (19)..(19): n is a, c, g, or t
  Genomic contig location: Contig_ID=SeqID_9865; Location=455..1649; Strand=-
  SCN-specific regions: Sequence locations=1-57,93-146,170-205,239 -404,437-876,904-1068,1090-1195
atggccaaggattcgtacncacggtttctgaagtcggagcagtacctggaattgctgaacaacaacaacaataacaacggcaataacaataatgagaatgatgggggagagcacatgcaacagcctaagggactgttaaggtacggtaaatataattaattattaattagtggtacggtataaaaataaaacgggaaaatgtaaataatatgtatgtgtatgtttttaatagagatcggaccggtcggtttttttcggtatttttcggtttcggtttttttcggtttttataccgaaaccgaccgaccgaccctcttgtccggtctctagtttttaattactttttttaatcggaattttaactttcttctggaaaatgttaaaattattgtttgatttagtgcattttttcataatataaatataatttaaaaaagccattcgtttaaattttgtaaatcaaatttatgcgcatttatttttgaattttaacacgcaaccgggttctgatataagcagacaaaaaaagaagcatttaaaatcattttccaagaattttagcatcaaaaaattatttttgtaaaaaatcgaatttaaaaaaatcgctaaaatatgtgacaaaaatctcaaaaatcagccaaaattccaacatattatgtgctcaaaactcacggaacaaatgctttatttttgggcttttcatgcgataatatattcgaaaaaaatctgtaaaggcataaaaatccttcccttataattagattaattaaatattgtatttaagagaattaaaaaatcaaaccaaatattgtgaggtttcatactaaaatttgaaaatttgaggtctcaaattttccatagcgacaaagctaatggatattaattaattaattatttataattgctctttgcagggttgccagtgcccgtgagggatgtgccgtcacaaccaagtcactgtcatcactgtccggcgccagttgcagccgaagtccgtcattgtcgccgcgcagcggcggcgctggcgccgggcgttggcacacgcgccggaacacttgcgcaccgaccacaacgccaatgccaatgttggccggcgcccacacaaaaaagggcgccaccggcgctggcaataatggcacaatatccaccaacattctgtccggcagcagtggcgtcggcggtccgacaccgctga

SEQ ID NO: 72895 - DNA, 482 bp, Heterodera glycines
  Genomic contig location: Contig_ID=SeqID_9866; Location=593..1074; Strand=-
  SCN-specific regions: Sequence locations=1-40,62-167,192-214,236 -433,455-482
gcctcactgcagcatcactactcgccgatgcgtgtgcatcgcggaggcggcggcggcaccaacggtggcaaccgttcgtcgccccaaaaagttgggcccacatcaccgctcaagcagcagcaggcgtcgtccgccgagctggtcgacccgtacaacaacaccaacgccctgcagcaacaacaacaacagtcgccgacaacaaagcgacgaggcggcggcggtcgcctgcgcagcgcgctggccgcaaccacagacaacacgatggtgcgccgtgttgcgtcgttcactttttcaccgccgctacgggccggctcgctgcaacacaaccagcttcagcaccagctgcagcagcaaaattttttgtcagcactggacaagcactgcagcagcaacagtgcggcgggcgcgttgcggttggacaagcgcaactcggttgcaaccggcggcggcggcactgacaagctgcagcgacgcatggcact

SEQ ID NO: 72896 - DNA, 646 bp, Heterodera glycines
  Genomic contig location: Contig_ID=SeqID_9867; Location=215..860; Strand=-
  SCN-specific regions: Sequence locations=1-27,49-506,532-646
atgccaaagactagagaccgagaccctcataaattagacatttttctcgagtggcgccgaagtccgtttttgggcacctgggtcggagataaccccgaaaaatggccaaatcccggaaaaggtctaacaatgccggttactctcgagcatcactagccatgctcattttgtgtattaagtataatgtcaacatttctgaattgcctatttataccacggataaatgataaatataccgtatattgtattcaactataacaacaactgcaattttcagctgactcgaccacctccgatttcacatcaagcggctttacctcctcgtccccaacaaattgtggcactgttcaaatgctcatcggacaccagcaccaccaacagcttccaacaatggcaccgggccccatcgaaacatcgtcgtcattggccaacagtttcagcagcggttgtgccgaggtcggtgccggcggcgcggacgctggcggcggttcgtcgtcgtcggatgagtcatcatcctcttcctcatccgcgtcgtcctcaccggttgtggtcgaattgtccacaaatattgttggccaagcagtcccagcagcatcagcagatggacaacaacaacagttccgaaaagtgtggtggaatggaataa

SEQ ID NO: 72897 - DNA, 2175 bp, Heterodera glycines
  Genomic contig location: Contig_ID=SeqID_9868; Location=489..2663; Strand=+
  SCN-specific regions: Sequence locations=1-139,179-317,339-417,439 -670,693-935,957-1277,1300-1521,1647-1781,1806-2032,2108-2175
atggccgtcggcccagggccaaatcccatcaaagaattgacggacaaattccaccaaaaagcattttataacactgaaagaagcgatgccggcgcaagtagcagcagagcactgataacgaacacggtggtaattagtgtaattatataaatttaattaactaatcatattttaaatagaacagaatttggaagaagcgaaatcggaaaagccatcgccacgaaggattgcggaagcactcaggaaagcacaagtgccaacgcgactaatgccggaatggttgtcaagcggaaaccaaaaagcagcgaaaaaggcgcaagaagcaaatcggggtaaaagtggcacatgccaattggcccagattagcagctgacattcccaacttttataatcggttcaattcctttgacgaattgcattttaatttccccttttgtctccctcctcattttgcggcttttccctatgctcaattcattaagcaaattacccgctgattgggtcgcgttgggcttccacaaattcatttgaaacctttcaaataattccctccccgtcggtccaccgcggcacaaacgacaaaaagcagcagacaaacaaccaattggactcacaaactcttcagttcatcaagctgataaagacagtaagcatttgctaatggcaacagaaaatggccaatgaatgattttggcaaaattaaaattcggggataaatgggagatgagtaaaagaagcgatttcggaatggagacgtgcaattttgttgcaattatttaaaaaatctcatcattacagaaacaacggtctccgtcgtcgcagtcgccctcagagaattttgtcgttggcactttgcccatggacagggatttttcgccaatactaaacccaaccattgggcaaagctcgctaatgcggaggcgtcaacatccgggaagagaggagaagcagctaaatcaatcgggagaagcatcgacagaaaaaaccggcgaaacaactgacgaattggtggtccgtgcgattgccacaagcattcgcgcagtcggaaagcccacgcgccaattgcgcttcggctttgtcgcctccggcagcggaccctttccctacgcgttggatgccgacgtgaaaagcatagtcaaattgattagtgatcgcaaaatggagtcagcattgaaagcggaacatttaatgggccaaatgaaagagatggcaaatgaacggattgacaaaatattagtgcaaattggggacgaaagcagcgaattccacgcgaaaattaggaggaaaagccaaaaacagagggaattgagcgttctgttcttttttgttagactttggcgcaaattgggcacacttttggtattggaaaatttggacattaattcgacagaatttcacgagcaaattttgggctgtctaaacgcactaagagcagagatttggaaggaattcgcttcttcatgtgaagcagcaaaaaatggaaaggttatgaaaaatagagttttctaacatataagtttcattaatttttgtttttttaatcgtaaaatacatttttatatttttatattttttaattttttgtttattgtaaaataaaaataatataagtttaggccgaaaaaattatttaattatttttttatgcattggtttttattagctttttaaataggcttttttaaatgcatttttctttagttcatttattattgataaaaagtattaaccaaaaaaagaaaacatggtcactttcgataaatgaaaaatattgtttaagtaattttgttttcatttcttttttaggcatttcaatgggttgaatcattaaatcgctttgacgatgcaattgaactgactaattttggtattttgttgctttttacaccgccaattgtccaagcggctgaaatggtaaatcggccaaccacacaaaacgaattcttcaacacacatagtccccaatttattgttcaagaaggaaccgatgacaattattcgacggaattggcagatcaaatgacatggaaacaattaagtaattagccaattgattaattaatcatgcaattatatcaattaattagctaattggttaattaatcaagtatttttttcaacatttgtatatattaaaattgcatagcataaagaattaaaaattggtttatttaa

SEQ ID NO: 72898 - DNA, 2999 bp, Heterodera glycines
  Genomic contig location: Contig_ID=SeqID_9871; Location=57..3055; Strand=-
  SCN-specific regions: Sequence locations=1-240,262-593,624-981,1003 -1325,1353-1359,1396-1611,1633-1760,1783-2498,2520-2921,2944-2999
  Gene Ontology: Mol. function=histone deacetylase activity; Cellular component=histone deacetylase complex; Biological process=chromatin silencing at ribosomal DNA (rDNA)
cataccccgaattgattgacggcttcaacacttttctccctcatggctacgaagtgcgagttcatggcagccacatattcattttcgaaccgaacggaagcagcagtatgatcaataattgttagttattgtgggagacggacctaacaaatcgggagaatgaccaattcagaaaaacggacagaaagcattatcttggggattggacaatatcttgccgaggcaaaatctagcctcagaaatttttaaaaatttttccaacaaattttttgagaatttttttttttagtttcaatgattttttgaatttttatgataaattactgtttttttttgaaattttcttataaaaagtgtctaattttaaaaatttgtttgaaaaaatttctaattttgaaacttttaaatttctgcggcgaaatttggggtgcacaccgttatctttcgttattcaccgacactaatttgtaaggaaattgatttaatgtttggaaattaggactatgttatgttctttcatttttttatttgtttttttagcttttgcaatcggtggcgatctgatcgaagatgggatggaacttgctgttgctgctgcttctccacaaattcctttgccttcctcgtcatctgttcctacaattcaaagtcattcagtctcgaaaccgaatacggccatcagcgagtcccccacaggaattggccaatctgtccgatatgtacacgtccatcaccaaatagaaaatgtatttaatttttactttttcgattcattgtttttttaatatagcctcttacgacaattccaatggaagttgaaaatgaaatggttcgcccttcaattgatggaggttctcaaaggataagtcaagagggcactcaaacccagcaaaaggttttatcttgcgaatcggagcataatattcaaaatcagcaatcgcaacaacaaactaccaaaacaggacaactcatccatttcagcgaggcattgggctacctaaaccgaataaaggtgagaaatgggggctttggctgatcgttcgatggaaatttcgcttttaggggagatttgcggacagaccggatgtttatcgtgaattccttaacattttgggaaactatcaacagtgtgagggcgatcaggtggttttttggtgaattttctttcgaattgccactttgttcagaaatggagtgaggcggaggtttaccaacgcgtttctcggctctttcacaacgaattggatttgatgcgcgacttcaaatcgtttttgcctgacgccaaattggactttattgagcaccaaagtgagcagcaaaagccaaagttggaagaagagggaaaaagggaagtgatggagcagaaacagaagcagcagaaagaacaacaacaaccaatgcaaacggcacaaaacgcaaagccaacggcggcgaagagtgcggacattgttcataaaaggcaattcggaaaggagcaggcgaatttgaatgcaaaagttggtaaaaaacattatggagagaaacagggacacattatttcaatcggataattattttttacagaaggctaaggcttctgttaacaagatcacttacgatgtgggagttgcggaaattttggaggaaattccgctgagagactttgtgattttcgagaaggtattttattgggcttttgctttttgcatcatggcactgcctttagatccatcgggcattgcaaagcgaaacgatttttgagaatttcatgcgtactttggtgatgtacaacaaaagtttggtttcgcgttcggaactcgtcgatttgatcacaccttttttggcgtaataccaattgtttatattcaattagcctaaaaatgccattcaagagaacatccagaactgctcaagcagttcaaagacattttgggaggacaaacggcgattggggcgcattcgcggaagcagcgaccattggaggaacgtctcccacaggaccttgccgaacacattggtctaacaattaccattttcatccctattattgccataaattgtggcaaaatcctaataaataagtgtctttgtttcagactacaacacttgcaaacagcacggcgtcagctaccgttgcctacccgaggacggcattcgttctgtttgttcgggacgcagtgctctctgcaaccaagtgctcaacgattcgtacgtctcatttcccaaatggtaagccctatcattttacggaaatgatcatgttattttggctcaagtttcatacatgaaaagagtgggtcgacagaaattttagcgacggattttgtccaaaaatgaccaaaatcactaatggaaaaaacaaaacaaaaatgttatttatgacattaaaaattctcgtaggattggcaaccttcatatttgcgtttaaatgcgatcatttgttaaggtcctcggaagattctgctccgatctcttcgaaaaagtaattgctgtgagatatggaatcatctgctgttccctttatttcacacttttcaagagtcaaatccattacaaatgatttgcatggctggcctatcaaatgaaatccctttaccatttcccacattttgttcaggtctccctatgaggatttaatgtatcggacggaggacgaacgctttgaggtgttctgacaattaaccttctgaaattcaaaattctccaggttgacattttcatcgaagtcaattcggccgccatcacagcgttggaatgcgcgcgtcgcaaaatcgagtcgatgggacacgaagacgcgaagaagttcatgagcgaggaggacttgggctgttcccccacctttttgacgagggcggtgaagaaactctacgggttcggccatttccagcctcaaattcgtcgtcggccatgcttttcagtgaacacggaggcaaaattttgttcgccctgaaggagaatccgctggtggccgtgccgatggtgctgaggcgtctccgggagaaggacgtggagtgtcgcgg

SEQ ID NO: 72899 - DNA, 2391 bp, Heterodera glycines
  Genomic contig location: Contig_ID=SeqID_9875; Location=65..2455; Strand=-
  SCN-specific regions: Sequence locations=1-197,245-468,514-583,605 -618,738-836,859-1694,1738-1851,1919-1966,2010-2100,2123-2216,2246 -2246
  Gene Ontology: Mol. function=general transcriptional repressor activity; Cellular component=nucleus; Biological process=signal transduction
atgaatatttgctcaaggaattgggcctttggtgaaccgtacgacgaagcaaatgggcgagaacgttgcgcaatgttgaacatcaaattggatgccaacattgatgatattgactgtgacatgagtgccggccccgaactcagttaccgattcgtgtgcgaacgaactcatgaaaagcatattgaggtaattagttctaaaaaattttagacttttataaataattatttttaattaattaattgtctaatttgttcaaagttggaagaaatgtccgaaaattagtttggaataagcttgggagctaaattctataattaaaaaaacaaaattttgtcaaaaaaaacaaccattttttttttggtaattaattcttattttatatagatgaaatttttgatttgtcaatggtaagaacaaaaaaatttggaaagattgaaatgatcacaatttatgcataaaatcatgtttaaatttttattaatgaaaataattataatttaaataattaaagcgctttcttctatgcttttatgttaatttatatattatagtttcaaatcaaattttaatgtttttaattcagaaaattagtagaaatgattcagaatttctgtcaaaaatatataaaattcatgaaaaatatttttatttttagaaaaaacaattttctttaaaatctcggcttttttattgtttaaaataaatattttaattcaaatttttaaaatttttaactcagcatgaatccctgaacaacccattatggaaaaagttggaagacattctcaactttttcggcattcgtggagcacaacaggacgacacaaatcgtacaagcggacttgaggaggaaggctattgggacagagtgttgggcaaaagcgatgctttcaagaagcgaaatagtgctgaactgcaggagaggtctgagaagcagataaatgccaaagcatcagagcctgaaaatcaacaacaaaatgccaatgcgcaacaaagtgccaaatcatctgagcctgaacaacaaagtgccaaagcttcagagcttgctcaacaaagtgccaaggcttcagagcctgttcaacaaaatgccaaagcatcagaagctgcaatccagcaacaaaaggccaatgcgcaacaaaatgccaaagcatcagaagatgtacaacaaaatgccaaagcatcagagcctgcaatccaacaacaaaatgccaaagcatcagaagatgtacaacaaaatgccaaagcatccgaagctgcagaacaaaatgccaaagcatcagagcctgcaatccagcaacaaaatgccaaagcatcagaagatgtacaacaaaatgccaaagcatccgaagctgcagaacaaaatgccaaagcatcagagcctgcaatccagcaacaaaatgccaaagcatccgaagctgcagaacaaaatgccaaagcttcagagcctgttcaacaaaatgccaaagcatcagagcctgcaatccagcaacaaaatgccaatgcacaacaaaatgccaaaatggagaacataacttcaaaagatgcgccaaatgccaaaagtgataccagcattaacaaacagtctatgaatggctctgatacaaatgagaaaaatgccatggaaacaaattttgttgtgccaagctctattgagtcacgggttattgagcctgttcgagaaaaggtcggtcaaaaatttttgaatatttacagaaatttttatttatttttttagcacccggtggaccatgctaaaagcttaatgctagataatacaccaaattcactgattgctgcttcaacagacactgttggcacatcagtggaaggcgttcaaagaatggacggtaaaatttttaataatttaattttaattttcttaattatctttcatttattaaattagttattaaaacgtttaaaaattggaaatcagcgaaaaattttaagtttggacattttgtaattatttaaaaataaaataaaatttttgattaaaaatatttgtccaaaattatttgtgataattgttaaaaatagtattttgtaaagtgaaaatttttttaaatacatttagaaaattagtgggtgttaaacatttatttaaaaaaattaatttcagatttggacggtcaaaatggaaccaacaaatttagagcatttcgaacacagtttaatgaaaaccgcttaacaggtaataaaaaagtattgagaaattatacaaaaaaaaaaataatatttacagaaaaaacgaaaaacgatggcaaaaaggaagtgaaaaaagaggtaaaagaaaaagcagaggagaaagaagaagaaaagagtaaaaatgaggagagaaaagaggaacaaaagccagcagaagaaaagagagaggaaggaaaagaa

SEQ ID NO: 72900 - DNA, 3512 bp, Heterodera glycines
  Genomic contig location: Contig_ID=SeqID_9875; Location=3062..6573; Strand=-
  SCN-specific regions: Sequence locations=1-14,37-404,426-585,608 -624,646-887,909-1371,1394-1942,1964-2288,2310-2405,2427-2783,2805 -3023,3046-3218,3240-3466,3488-3512
atttcagttgtctcctgctgctgggaaaatgaaaatgcgaagaatgacagcttcaataaacacaattgatcataagtcaaaagacaaggacaaaagcaagaagatccgtaacaatggacgcgttcatgttgaccagcaggacaatggagaagtagaataagtgttaattaacaattgatggtgatcatttttaagggaggagcttgttgttgatcgatttgggcggaatgacgaggagagtgaaaaccaatgcagaaaatgggagaacggcagaactttcggattttctttgggtggataaattttatctttttctttccgtagattagctttttttccttcgctttttacctatcgataaatttattttgaaatcatttcgttgttttaattatttaccaattttttctgaaaataattttctcggataaatccttaaaaattgttgggacgacattttaaatgttattcttttggcattttatttatatccacttcagtccctcacacaattgtttatccccattgacccagtaaattctttctgtcttttgcactcatcttctcctccgctttttgtcctcctcttaaaatgttgttgttccccaaatattgatttgaccctttgctgtttctttaatttgtttcaccaatttccactgacaataaattgttcaacggcacaacagtggcgacgcccgtcctagttcgaacaaattcaacaaatttgtgcaaattcgaacaaagtcagcggtgaaataaattcgggcgaaatgtcgaacaaaaaaaattgtgtcgaaatcattcttcatcgccgccattatttcgtacaccaattgtgtcgaaataaattgaaggttaagtgtcaacaaaagccaacactgttagccaagtgctacagattaacttgtcagcaacaagtttggctcatcgatttaagcccaactgatagcaggtgctacagacgactttgtcagtaacaagtcgggcaattatcatttctgtggacaattcaagacaaaatggacaacaaaaatttggaaagcattttgactcaattgacaaacatcgtcaagcagcaacaaaacacggcaaaccaaccagtgcagagcaacatcacactgccggacattctgccattcttaaatgcggcgaatacaagcgctcatgcttgccggatggaattacggcattcaatttcaatgagacgaaaacccgtcttatgaaattgtttgctcgtccgccgtcattggctatcgatcggtatgagtgcctaaaggcaacacgtaaggaaggcgaggaattcagcgtttttgtcaaccgactcaaatcgcttttccgaaaatttcggtactcggaactaaacgaggaccaattcaagtgcttagtgcttttgacttcattgaagtcatcgagtgaagcaaagctacgacagcacatcctcagccgactcactaccgaagaaacaaaggcaactccaacgccgaaatttttcaaaacatttcagaggaaatcatgacaatgctgaaaacggaggcagaagtcaaaattctcgaacaggcaaagcccaaaataaatgctttcagccaaaataaaccgattcgcaaaaaggaaaattcgggtaagccaagccaaaatatcggaaacaaaggcaaaacccctcctaataattgctttcggtgtggtgaaatgaattgggcacaaaactgtcctaaattaaattatgtttgcaaaaagtgcaaccaaaagagacacatcgagaagtaatgcgaccgaatccaggcctacaataaaaccgaaaggccaagaatccgaagttgaacacgatagtaatttctgtcgctcgcatcaacaaaaatggtacttcaaaaataattcggatttccataatcatgaacggcaaaacgatcaaattcattgccgacagtgggtcagacatcaatattattgatgaaatcgcatacaaatgcatcggatccccgccgctggaagaaagcgacgaagagggcattcttttcgatggacgccgctgccaattcatcggcaaaggatgtgctaccttcaaattcaaaggatcaaagtcaaacaaccattttatgttgccaaagcgggagcacttaatttgcatggcgcagcaacaatggataagtttgggttccttgaaggaatcaaaaatgcaatccgcgtaaatcccaattccatcaatcagatcacttccaaaaataatgagacaaaaattcggtaagcaatcaaagaattgcaatcaaaatttgagcaagtcttcttagaaggccttggtctttgcaccaaaatgaaagcctctctgatgcttaagtcggacactaaacctgtgttccgacgagcccgtccagtgccatactcatctcttccaatcgtaaacaacgaattggaccgattggagaaaatcaatgtcatcagaccagtggaacacaccgagtgggccgccccaattttggtggtgaaaaaggccaatggatcaacgaggttgtgtgccgatttttcaaatggtctaaacgactgtctccagctgaacaagcatccattgccacttccgtccgacatttttccaactttaaatggcggaaaattcttttcaacaatcaataatggataatatgctttctgattatccatttgcaatcgcatatttggatgatatcatcacagtcagcaaatccatggaagaacactgcgaacatctcgacaaattattcgcccgtcttcaagaatggggtttgaaagttcacatagaaaaatgctcatttttccaaaaggaaatcaaatatttgggagtcacgatcaaccaaaatggcagaaatcccgattacaacaaaatcgctgcaattgctgaaatgccggctccttcaaatttaaataaactgcgttcataccttgggatggtaaattattaccaggaatttgtcaaaaatttccgtttcattcgccaacccttggatgatctgctcaagaaggacaaaatttgggattgcacatcggcttgtcaaaaagcatttgacaaaatcatcaacatgcttcaatttgttgcagctgatgcttcacaatcaggaatcggtggagttctttcacatgaacccccgatggcaccatcaaagccgtgagccattctttgttgtgattcctatattatttgtatgtattgtatgtggagtaaaagcccattaattatataaacaatatttctaacaacttcatcttcatgcgcacctttttaaataattcgacggttaggcatccaaattagtaagctcaccggtacttatcccgtttacagaccataaaaaaatagtttttatcaatcatacatataaaacatttctaggtggttctcgggatcactgatcacgaatctgacatcgatttcgaccgatttcgaatcccggacctgaattcaaacaaaagtcgaaaattcatttttcacctaaattcactttatgttagaatctgaacagaattcaggtccggggttcgga

SEQ ID NO: 72901 - DNA, 378 bp, Heterodera glycines
  Genomic contig location: Contig_ID=SeqID_9875; Location=3991..4368; Strand=+
  SCN-specific regions: Sequence locations=1-157,179-274,296-378
atgtcggacggaagtggcaatggatgcttgttcagctggagacagtcgtttagaccatttgaaaaatcggcacacaacctcgttgatccattggcctttttcaccaccaaaattggggcggcccactcggtgtgttccactggtctgatgacattgattttctccaatcggtccaattcgttgtttacgattggaagagatgagtatggcactggacgggctcgtcggaacacaggtttagtgtccgacttaagcatcagagaggctttcattttggtgcaaagaccaaggccttctaagaagacttgctcaaattttgattgcaattctttgattgcttaccgaatttttgtctcattatttttggaagtgatctga

SEQ ID NO: 72902 - DNA, 1471 bp, Heterodera glycines
  Genomic contig location: Contig_ID=SeqID_9876; Location=588..2058; Strand=+
  SCN-specific regions: Sequence locations=1-224,246-256,278-299,321 -484,506-1173,1206-1390,1412-1471
atgtccgtctttctgttcgtcctcatccaagcgcatcggcagcagctgatccgcgaagtgttggagctgatccccatctttgtgcgctttgtgaacatcgccgtgccgcggcacatccgcgggcacaagctgtacaacaaagagttggtggaggagttccactgggcacaagtgcgagcgctttccttcattgcctacatttcacgacaagctcaagtccattttttatttcatcatttttgtggtctttctatattttttcaattaaaaggtttttgttataatatgcaaattgttatttttatgggcctttttaaaaaggcatctaatttaaaaaatggctccaaatcttggtcattttttggacaaaattgttaaatttttcccgctgacacctatcggcaccccccccccccccctccggttccccaaagtttttttttggaaaaatcgcgctgcaaaactaacgataaacatcccccttttttaaatgtatgaaagttattttaatacaattatcacatacgcagtgatcagactaaaactctcccccccctgtagatggccccggtgatcagtgagaatgacaaggtgttgtcggatgtcattgtcagccttttcgacagtttccatgacgaagtgatcacccaacgccgtgaccttttggtggccatcaaatactttttttaatgcgaagcacgcgctctgttcattggcatcattcccaaaatgtgcgacgattgttcactgctgggccgctcgttcacttcacaggaccatctgaggtgggcaaaaatgtgccgaaataaatagccccgttaaaaacatacaattttccaggaaccaggcctattcatttttggccgacattttacaccatgttcggatgagcttggactacaaacttctcaagcagtatttgctttatcttcagttcttaaattttatttttccgggaatttaactaacgctttttgatttactatgtaattcaatttcttaccatttttaaaaaaattcagcatttttttcattgcgtcccgcaatttgcacgacgcccaactgctgccttatgtgcaaacgatgtacggcaaactgatgatgaacttgatcgaagccgttttggtgcagcccaaagagcacagcaaaatggttggtttttatagggaattgaaaaaattggatttttaaaaaactgattatttgttttggaatacccttcaaaatttacacttttttactgaaaatctgtttgcccaaagtaccaggaagtgctttgcgcatcggtcgattcgctggtgcgaaaggccaaatttgttgccgagtaccatttgccattgattgtggagaagcagcgcgcccaacaaacagaagccaaacaaccacagcaagtgccatcatcatcatcatcgacggcagcagcaacggctgaggaaaacaaaagcacgggacgaagtgatgaggcttcaaa

SEQ ID NO: 72903 - DNA, 817 bp, Heterodera glycines
  Genomic contig location: Contig_ID=SeqID_9879; Location=2374..3190; Strand=+
  SCN-specific regions: Sequence locations=1-12,35-432,454-729,752-817
atgctggagaacagggatttgagcttctacatttctgatgatgatgatgcgcaagcaatttgtctgatgtcacggagaattgctgacaaatacaacccgggccttaagtacaccattttcacaaaacgagttcctgccccgtttgagacgatcagtttctcaaatcgacagattatcgaggtttgtcctttatggacagacgttttcacgtattgttcttttgtttagcaagtcgtaaagggtcgcttcaagcagcagaccaactctctcgacttgagcagctttcagaacgacccgctcttcgaacggagtcaactttcttatggactttttcacaaccacgtggtggtcgccgttgccaatttaatcgcgcaaaattttccctcaattcgtggcattcgtttaaatgtaattaaattgttactttgatgggatgtttttctttgtcttctttagaacaacagtctacgcactttggacttcctgagttgtctcgtctacgccgcaccaaatgttgttgaattggatttggcaaacaatgcggtgagtgagtgagtgtgtccgttgcgagatagtcgtaattatgtattccatttaccacagatttcacgcgttaatgaattggacaaattgaaaagttggtccttggaaagtgtccactttgaaaacaacgaatttgtcgcgagttatcagggcaatttcgtcgcatattcacagttcgtcttcctgtgacattcatttaattgttaaacaatttttagagcaattcatcagtttttccctcgtgtcacatatttggtactttacaaataaataa

SEQ ID NO: 72904 - DNA, 390 bp, Heterodera glycines
  Genomic contig location: Contig_ID=SeqID_9879; Location=807..1196; Strand=-
  SCN-specific regions: Sequence locations=1-390
agtcggtaggggtcaactccgtctggccaactccgtctcagcaaggttcaaaaagctataacttttttctttgttggccaaacttcacaatcatggtatcgttcgaaagccctagatgttagaagatatttataagctatttctcagtgattaatcagctctcaaaaaagttgtcagtttaaaaccgcaaaaaaggcagaattttcaaagttttttatttctatctttttttatagttcgaaattttctgtaatttttagtaggctaatagagcctgtgaagagctttcgattgatatcaagattgtttgattcggtcaataacttcaagagttatattgactcaaagttggctcagacggagttagccagacggagttggcccgttccg

SEQ ID NO: 72905 - DNA, 838 bp, Heterodera glycines
  Genomic contig location: Contig_ID=SeqID_119; Location=69..906; Strand=-
  SCN-specific regions: Sequence locations=1-33,56-838
atgaaccgacggtaagcacaaattcgtcatttatttacctaacaaaacttttttcagttggatttgcaacgatgtttggatggacattttcccatcctttgaccgtgctcaactcggcctcaaattggcacttctttcgccacgtttcgatgcgttggtggacaaacatttcgatggcaaaagcgaattgactatttggagaccaatcgaaattcgtcgcaaggacaaaggaccagaaccgaagctgtctgtacgaatcgattacgaatttgtgccatttccattgccggaccgtccgttgcccagcaaaattcgctttaagaaccttcggattgagtaattaaaaatcagagagctatgacaataaaagcattccttccattttcacagttacatcgatcacttcgtcatcgcttttcttcgtttaaatcaccaaatttttgagaaaagaggcaccgatttatatttgtggatttcatcatcacactctacgaatggccagccgatttgggatgtttttgttcgtgaaatttggcccattttttcgacaaacattcgctgtttgggctttaccggtggtgatcatttggaccatttgcgtcgtcgcacttcgccaacaattctcaccgatctcaaccaattgaattcaatctgttcctgtgatttgtcgcccgctgcgtttggtgatgattttgatgggccaaattcaataatttctgctggccaagcattgtccaaatggttgcactctccgagaaaagatggacaacccaagcgattgcgttgcgaagactttaaaggacaaacggacttcgattgggccaacaatttcaaggag

SEQ ID NO: 72906 - DNA, 104 bp, Heterodera glycines
  Genomic contig location: Contig_ID=SeqID_119; Location=2613..2716; Strand=+
  SCN-specific regions: Sequence locations=1-104
atgtctggtgacaattcggcacttattgcagcggagcaagcggcgtatggcccattttttggctcacttggcgtcactgcggcgatgattttcaccgcggccgg

SEQ ID NO: 72907 - DNA, 1150 bp, Heterodera glycines
  Genomic contig location: Contig_ID=SeqID_120; Location=786..1935; Strand=+
  SCN-specific regions: Sequence locations=1-24,47-90,112-178,202 -327,349-679,702-1150
atggggttatacccaaaaaccgggctggctggcgtggcctcagtcggtcggtgctcagtcgtcccaattcgtttcgaaactgttgggtaaatttatttgaattttctttttgctctgttcaggtgctcggtctctacggaatgattgtctcactgctgctaagttcctcctgaacaatggaaggaagaaagaaggaaagaatggcacgtctgctgaacattgtgccgaccgtcgtgttttgatgatcaaaatgaccagccaccgtatataatagataaataccgtattttccatccattcttttttactgtgcccccttttctcattttttactattacattttaaaacgtccaaaaatttggaaaatgagtgcggtgagcgggacaccattaaggcttgggctactgtacatattttgctgaaaatctatatgtaaataccgcattaaaataccgtatttgctctaattatcccccaatctccattaatcccccaatctccaattatcccccagtctaggaggggtttgaaaaataatcccccagtctccatttatcccccagggggataaatagaatttggtcgtaacatttttaggggatgcataataacggaaaagtacctccaatttgtgaaaattttggcctaggaattccgttttttgttaatttgaataaattaggtataatatttcttctgtagcaattggtgaaaattagcagcaattcgccgtgttcatgtgtgacatcatcgtttggaagcaataaaattttttggaaaattcgattcggaatttaattttatttccattttcaattttttttgtaatttgtccataattttatcagttggatttgcaacgacgtttggatggacattttcccatcccttgaccatgctcaactcggcctcaaattggcacttctttcgccacgtttcaatgcgttggtggacaaacattttgatggcaaaagcgaattgacaatttggagaactatcgaaattagcaaggacaaaggaccagaaccgaaactatctgtgcggatggatgacaaatttgtgccatttccattgcccgaccgtccgttgcccagcaaaatcctttttaagcgccttcggattgagtaattaaaaatcagagttatggca

SEQ ID NO: 72908 - DNA, 449 bp, Heterodera glycines
  Genomic contig location: Contig_ID=SeqID_121; Location=262..710; Strand=+
  SCN-specific regions: Sequence locations=1-449
gttcatggacaattacaccgggagaccgtggttcaggtgctttgacagtgcctcggtttgcaccggaagaatggagtgtgcacaaaagaacgttggatggaggagacagaaccaacaattacgcagaagccttccatcgaaaacttcaacgggcatttgattgtacccatcctactgtcttccacttcatcaacacaattcgatgtgagcaaaagtcaattgatgcagacatctcacgatgcatcgctggtgaagtccctcctctaaagaagcccaaatattgtgccgccgatgaaagaattcttcgacttttgcagggctacaatgccatcaacaataacccggctatccaaaatgatcacaattaccatgccaatgtcaatgttaatcccgataacatcaatcatttgctcgttggtgtttctcgcaattatgaaatgcgcccgtaa

SEQ ID NO: 72909 - DNA, 269 bp, Heterodera glycines
  Genomic contig location: Contig_ID=SeqID_122; Location=47..315; Strand=-
  SCN-specific regions: Sequence locations=1-112,134-140,162-191,228-269
agtcaattttactttttgttttttggttgcaattgggttagccatttctgaaaaatgtccaaatcagaatgtacatcaaattggttaactattaaaaaataataggatttggaataagtaaaattgtaaaaaatgagcgaatgtaattaaacctaacttatgccaagtggcgagggatccctcaggcttagtttttagaatcttaatttttaaaaaagcacatttttctatttttgggttggggcccaaacgaccccggggcccaaaaa

SEQ ID NO: 72910 - DNA, 1011 bp, Heterodera glycines
  Genomic contig location: Contig_ID=SeqID_122; Location=5063..6073; Strand=+
  SCN-specific regions: Sequence locations=1-19,41-970,992-1011
atgctgaacgaagcgaggaaaaattctgatgaagaaagaatgagaagtaaaatttggtacgattcccagccgaaagtgacggctaacaaatttgaagcggggcaacgcgtaatggttgcctttcccggactgaatcgccgatctcggcacaagaaattgttgtggtctcatttcgggccttatcttatcctagaaattaacgaatcgtcggcatttttagtcccaattgacaacagaaatgctgagcccataaaagttccgattgagcgtctaattcgaattcctccaggaatcccggacatttcaacacttccaaaggggaaaaacccatttaaaaatgcgttaaaatcattaattgtcagcattttatcgagttttgaagtctgtgaatcagatggacaaatggcccattatgagcaattaggggcaattgctaatttaaagggtggcgaaggaatgattagaaaaatggaaaaggcggcgcaatcaagagaaattcccttttcagagatggaaattgacaacgaagatgaagcagaggacacgttcggttggaatgccaagtgtgacgtcggtcaaggcgaacatgaattttgtgccattctccgtgtcgcagaactcgatccagcgcttggaaatgctgaattgggctcaatcacagtgaagacaccactgcaggcacttttggcggtgttccttttgaaggccgggactgtcaaatcaatgacagccgcaagaagttttgtcaaatcgataattgaaggagcgccaaaagaggagctcagtctgttcgtgaccaaaaagggagactatgtggcgacaggacaatgcccaactgaagaagaccaaatgaaggcgctggagtgttggttcgaaaagtgctccgtggcaaagcatgctttggaagagagcggattcaaaaaaatcggcatggacgaacccgtcggactcaatcatttggccgattctgagaagaagaaatgggaagaagcgatgggagagacaccgtga

SEQ ID NO: 72911 - DNA, 978 bp, Heterodera glycines
  Genomic contig location: Contig_ID=SeqID_122; Location=4038..5015; Strand=-
  SCN-specific regions: Sequence locations=1-40,62-257,279-978
atggacgaacccgtcggactcaatcatttggccgattctgagaagaagaaatgggaagaagcgatgggagagacaccgtgggtgctggagaaattgagggccaaaatcattcacaaggccacaaaactgatcgccttgccacgtgtcataatcggagattcgacagcccaccaattggccgaaatcttggatcaaacggcggtgatcgggccaaaaaatggaacattggcggagacagtgcgaagcctgaagcccgtggtgctctccagcaaagtgaaggccgcactgatcattgtcggacgagattcactcttgggcggagaaaccattgaagtgatgatggagcaatacgagatgattgccaatttgtgccgccgattcccgcaagtgaagttcttttggacatgcccaccgtacgtgcacgacaaacacgacgagtacgaagaactgatcgaaagcttggtgccgatgatgagccaaaaaccttttcttcctgtttgggtgacagaaaaagggcgatcgcttcacgaagtgttccgattcgccaattcattcgacaaccaaagagtgacaacggatggactgatgcaagaggccggtttgcgagcgctgaaggcatggctgttcacccaatccgacttcccgggcgatcagaagctgaaaattcggtcaattcgatcgaccgttcgtgccgttgctacgataggtctgggggaccatcgccaagcaagcacttcgtctttggccgtaaatgactcgataggtctgggggaccgtcgacgtcacacaattggatcagttggacatcgcgatcgtgatcagcgacgtcagagcttgggctcgattggtctgggggaccatcggcgccacacattcggagaagtgcccagccgtgaacgccatcatccatacagccgttggaacaaccgcgccgtgatgccgtaccgtggtcgtggcccgtcgcactctcgtcgttag

SEQ ID NO: 72912 - DNA, 1530 bp, Heterodera glycines
  misc_feature (1331)..(1331): n is a, c, g, or t
  misc_feature (1487)..(1487): n is a, c, g, or t
  misc_feature (1492)..(1493): n is a, c, g, or t
  misc_feature (1502)..(1502): n is a, c, g, or t
  Genomic contig location: Contig_ID=SeqID_9881; Location=1..1530; Strand=-
  SCN-specific regions: Sequence locations=1-892,914-1118,1154-1530
ggagccgtgccgcccttggattattacctcggccaaacctcgttgaacagcactcagcgggaactgttcgtctcctgggggctttaccaagtgttggtccgatttccaagtttttcctcaatttactttagtgccaattgtccctttaccacagaattgtctcaaattcctgcataacgaggcaaaaatttcgcacaacaacctaagaaatgccatttttatcactgagtcgggcgattggaagttggcttccttccacctcagcggcactttcaggtccaacaaaaacaaatcattgcccacccccataaatctgtttcatttccttcagttcaccgcaatgcgacctcactgatttggcggatactctcaacagaatttttcgaccaaattcttccgcagattcgacgcaacttccgaagagagtccaaccgttgtttcgccgtttcaatgctcgcggaaggtccgtcatggcagtcgcggacattctaaacggtgattcactaacaataaaatgttctcaattatgatttccatctttcgtccctcccctttttattggtgtcttttttcagagtgtcggtccgtcggcggttttatgaagaacaaattcgttgatactcttttattcctcgacgaatttcaacttcgggacgctgcagaaaggcagtcctttttcatgcagttgaattcgaatttagaccttttccccgacgatatttcttgcaacaaaattttgccaaagctaattcatgtccgtttttggctcatttttgttttattaacaaatcacttaccaattagacgtacgaattcggagacgcgggtgcccacattttggtgccaatgttcaaattgggcagacttcttgacgagaatgaggtgacaatgactcttttcaactgggttttaaccttttggtttagtaccagcagagaatcgtcccatgccttgtcaaattgttcagttcgacggatcgaacgacacggtgatgcaccatttgcatgggtttttaaatatttttcttattaaagggtcaaactgttggagagaatcgatgaattttccagccatttaaggccacaagtggttaatgaaaaaatctacgggtattgcacaaaattaaaaaaatagttttatttgaatttttaaaggaatttaattacgggtttcatggattccaattctgccgttcgggaaagcactgtgaaggcaatcgtttcgtttgccgacaaattaaaccacagcaatttgaacactgatctgatgaagcatttggcacgactccaaggcaaacgaaatgggaggggggggggggaagccaaatcttnttaattagactttgccaagggtttcaggttccgatcccgagcccagcattcggacaaacacaaccattgtacattttcagtagtaataattcatccccaactacgcctttcttttttagtgtctcggcaaaatcggctgtttcatttgaccgtccnatcgnncacgcattntaatctctgctttcactcgcgccctcaa

SEQ ID NO: 72913 - DNA, 2317 bp, Heterodera glycines
  Genomic contig location: Contig_ID=SeqID_9885; Location=1406..3722; Strand=+
  SCN-specific regions: Sequence locations=1-648,670-2068,2090 -2259,2281-2317
atgactcagactggcgaccacggcggggacagtcccgccgaaataactacggcacttttggtctatgcaaaggggctgaatattttgacaaatttgtccgacattttgaccgttcaccaggtcatttccctttttcagttggtcatctctttttgaccccttttcaggtcgacatcgtcccgacattgtcccttttgttgggtgtgcccattcccttttcgagcattggacttgcaattgactcgcttttgccgcagaattcgctgcatgaacttcgcctgaactcttttcagctgattcgttatgctcagcaatactttcaccactacccgccaatgcaagtcagttaatgaataaatgcatcgattaccccccccctccttttttcgtttgattttacttttttaattctttaaattctccaggttaagcttcgttacatcattcgccaatacgaaactgctgcggatgatttccattccaatttgttcgtcataaaatccattcaaaagttgctccgtctctccctcgaccaattccatttctccgtttgcgtcgttggccttatttcgctgctcgagtcggtccttttcaatggttttttgttgttggacaatgccgacgaatggatttcgatccgtctttgggtcttccgttctgctctcttgtttttgcaggtggatttttgtttaaattaaaaaaactatgctcgatggatcatctcgttattccgttgcttttgagttacgttcaaatttatggctgtgtttattaagttggatatgatttatgggtcgactaaatattttaattcttgtttttttatttttttcatttaccgtcgctttgttttaaaatctgccaaaaataattcccgctttcagctcagtttggtttttgctgctgaaccgagtgttgacactgtctttttctctgtgacgagcctcgccgtgtctctgtgttcccagacggtggtcctttcctacaaaatatttgctgccgtcactaacaaatattcgccgtttccgtcctctccgtgcctaacccttttcgccaatttcgtcctttctctgctccctttgtctaacagtttcgtcatttacgaatccgacgtccttcgcttttcactccaaagtgtcatctgtgttcttttgctgtacagtttgaacaccaaaaggtcaatgaaacattttgttgctttttgtttcatgttttttttattttaggtcatttaatcttcgaaatgtcagtgctgaggtgagacttgctttgctgcttctattcattacgcgctttttaaaagcatttgagaattgccgtgaagaacaggttctctgtctttgccgttgtttctgtttggttattctacggtgtttccctaaggtcggatgtgttcctgtcaaattcgctagtcattcggcctttcttctgtccgttctgttcgtcatgggcgtcctttgggctctttttgagcgtttttctccccgcgcgcactctctgaccaaagcctttgtctggtcgatggccgtctttctcattttgcattgggccttcgagctcagcgcactcagttttgttgagtcaggtaatgtttatccgggtaatattttggtcctaattgcagcctaacgacctgctggttcactaatgctcttagacataatggtcggctcgctatgtctttgtccattaactttttcggctatccaaagcaaatatctattcgaaattatttattttttttgcatttaaggactcattgaaagtgcttcaactgattttgtcgtttcgctcgggaacattcggctcatcgaatcggtctctcttcgcttggctcaattcgtttacttcgctttcttcgtccacctcctcgccttccgttggctgtccgtttcggcctccgcttgggtttggccccatttccatgcgttggctgttccgctggtgatgttgtccggctattcgtacggacaaataatttcggtgattgtcttcgctttcgctgtctccgaccctttgacttcgtcaggtgggaggacaatgaccgtttgtttcaacttttcccctttcccagagagtgtttggaccggtgcctttctcctccatctcatcgcattgctttccttttatgccaccggccatcaccaaacgctcaattcgattccgtggcacgccgcctttgtcggtcttccgggcaatttccccttcaaatggttgtccgcacttctcatcttctttaacatgttctccgggaaaatgttggcttctttgttggcattcacaagggaaagagaggacacaatcaaagggccgctct

SEQ ID NO: 72914 - DNA, 2205 bp, Heterodera glycines
  misc_feature (1188)..(1188): n is a, c, g, or t
  misc_feature (1236)..(1236): n is a, c, g, or t
  Genomic contig location: Contig_ID=SeqID_9886; Location=411..2615; Strand=-
  SCN-specific regions: Sequence locations=1-119,141-920,944-1064,1086 -1246,1271-1295,1317-1425,1447-1552,1574-2011,2038-2205
caagcaaatggactggttgttcgcaaacggcccgaatatttgctcatgtacaaccccaaatacggactaagcatactgttgcccaagtacgccaatgtgcagaggtccgaacgttaatctttttatttcatattgatatacatatatattttgtagcgcgtgcgaattcgatgaaaaattttcacttggcgaattctattcatgcgcatttattcgtgtggccgagcgagaggcgcgtcgtttgacctacgaatggatgtgtaagggtgactttaaattgcatgaaccaatgctgaaaacgcggctgatcatggaccgatttgtgcatgtaagaaattatacttccctttaaaaaacttttttttttgggttcaaattgatattttcccggtacctaatcgtgtcaattgctataacttcctttttcaggttcatgtcaattgcgaatttaccaaggaaaaaataacgaagcttcatggcgatcattatgttcttaagacaggtatttttgcaatttttattttttgctaatttaaaccctttttgagacttgggaaatgttcgattcggcaaggaatttctaactcacaatggttggtcgaataaaaatatctaactcattttcgtcccattgctttttaatttagacttgtacgacaaatcagcgaatgtttgggtgacttttgtcaaagaaactgaaggctgtcactgggaaattgtgcaggactcgtggggctcactgctggtgcggttttgaaatttataaactgacaaggacaaaaagtggacgaaacttttttttgcaaaatttggtttttattgattaatatttcccatgccaccaggttatatatttatactaaacggtgctttaatattctcatttttcatattatccacattttaggtgttgttttgtgtaaaaatttaaaaaaataataaagaatgcttgtttaaaaaagccgtttcaatagtcaaagtagtttttcattttacaaaacctatttcgaaatccctctctttttatgactcatttccgatttttaggttgtcttggtgcttccgatgacatttgaagcggcttttaaagaatgggagtctatgcttttcctacccatttttactcatttctttttcaacttacttttttaaaactatgttattttattgttttactgctcaatattntgttaagttctctcacctatctctctgctgctgatttctgctttttcncagtaatctatgagataaattcatttttattgccgataaatgcaccaagcaccataaattatattgataaagcattttttgccaccatgtttatacgtatataggcaattcttttgcaaaatgaagatgtcactaatgttttggtacttaaaatgtcaagttggtcggttttgaaattttggatgaaaaaagccccagggattttggttctaggtcgggaaatccctcatagaaatggtggaggggcattagttatgcaggtctcggttaattctaatgtaaattaatcacatcttcccgttattgcgcaggatgacgagccgccgccacaaatgttgaccacaagtcagccggaacaatctgttgttgctcaacaacaaaacctgcaaaatcagttggtggaacagttgcgcagcaaattgtactgtcaagtgggttttttaaatgcatttggttttgtaatccaaatcccgaatgcaaattttataatagaattgtatgtaggccggctatgttgactttttgttcggttccgaggtgtgcgacggattggggggtgaacgaaccgcagcgcaacgttatggcatggcaaatgactcggacggagacggggagtcggactctgacgattttcggcaagtagacaattgggatgacagcgcctcgacaacggacgatggcattgacgccgatttgaacaagttggtgctaacaataggcattcattttggcatcatctgttatgaaattggagggattcggaacttctgcaaaaatgctttgttttgttttttgatttcattgaactttacaagttaatcaaaaataaccgttttttaaagaattgggccatgtgtggggaaaagagaaccaatttttcagcgattccgaatatgattccgacgcagaggagaaaagaatgcgcatcattggcggtgcttcgccgccacgtccgcggcattttcaggg

SEQ ID NO: 72915 - DNA, 1558 bp, Heterodera glycines
  Genomic contig location: Contig_ID=SeqID_9887; Location=108..1665; Strand=-
  SCN-specific regions: Sequence locations=1-319,341-563,586-833,856 -942,964-1558
atgtccattttcaccgacgaatacaagtgccgttggatggcatttgcgatggagaagcaaaacgatgtttaccaaaaggtttgtatttgattcacatgttttgcagcaaaaaatgtataattttttgctgcttcaaaaaaaatttttgttgagaggtgacattttgtcggttccgacaggcgtgttgcctgacaaagagtaatttactggatcaattaatagtttttcccaaaatctgtctatttaaacctatttttaatgtttcattatttttttatattcatgtgtttaagttggacgaacttcccgcagtgatcgatgccaaagttcagccgtttttcaatcgaatcggcggcagaagaatgcagcaagcagacgaacagatgcatttggtgaatgttggtgcacgttttcaggttgtacggaacggacaattttaagacaaatactggcaataatttatacaaacaccgaaactcattgttttataatttagccaccgctggactggaagggcccaagagaatgtggaaacactgtaaatttttttacattttcatcaccaactcatcgtcattcaacattattttaggtggtcaatgtgctcggagtgaccattggcaacgagcaggacgagaaagtgtcagtcatcgccacttcgtatggcattgcgcgacagccgaagcgcttggagctgggcacttgggtggaggcgaccattcaggtggagagtgacgagcaagcggtgcgcacgcttgcctacgacagcttcatgcacgagcacacgtaccgtgtgctgtactcaaagaagatttcaccgcccatgtcaacacgggtggtcaacaaaagtggggccgaaaaattgctggtgagatggacttcggtcaactgggtcatgtctgtcgaggggattcgcatatttgttttgccgtatttgtgcccagtttcttgagagttaaaaatattgggaacataacaaaacgtcgttgcccgtaacgtcgtcggatgaaaggtcgccggaacataatattgccgcaatgggggtgtatccgaaaatcttttgggattcattggcgatcgtcctccaatttgtttaccaatttaatgcataattatgatatctattccgtcaatttttttaaaatttttttgacagttcattacccctccccctcctttttttagttatgtggtgatgtgaaatgcgtcgttaactgtttgcgaaacgattatttggggcgagtggaggacacaaaacaacatatcagaacaaaacctggtgaaagctatttggtcgaaattggcatcaatcgtcagccggagaatcgacgcaattgtttctggaatgtgctgaaatctcatggcaaatcggtgaaaagtgtgcataaagttccactccaggtcatcacatttttcgtttttggattttctcaattccatttattttacccatttaagttgtcaatttattccgtagaggatggtaagacttgtgacgatgcacaccggattttaattgaccaagtttttgatgcaagagacaacacatgggacacca

SEQ ID NO: 72916 - DNA, 414 bp, Heterodera glycines
  Genomic contig location: Contig_ID=SeqID_9889; Location=274..687; Strand=-
  SCN-specific regions: Sequence locations=1-137,159-414
atgtctcttttcggccgtttggctgagttcgctttgtcctccaattctgacgcaattaaacgcccaccattagcaaatgcttccgatctgctaaacagcccaactacgtcatcatcgtcagttgatggtcataagtgtcaaattatgaataataaaaagagcacaatcagttggccaatgccaaacggtgccgtcgtcgatcaaaatgtgccgtcagtgcccgccacagttatcagtccgtccaaaataagcaaaaggtacagacagctgaagagacaatgcgcaaacacgggcaaattgttcatcgacacggaattcccacccgacaacacgacactgttcataactgacgaaaatggagacggaagtgccgaaagagcggccgaattggaaattgagtggaaaaggcccggg

SEQ ID NO: 72917 - DNA, 101 bp, Heterodera glycines
  Genomic contig location: Contig_ID=SeqID_9889; Location=1..101; Strand=-
  SCN-specific regions: Sequence locations=1-101
aagtcagcgaagggaatgaatgggagaaaggtgttcgattttcggaattcctacatttatggagaatttctaagcatttccttagtttcatattttctctc

SEQ ID NO: 72918 - DNA, 932 bp, Heterodera glycines
  Genomic contig location: Contig_ID=SeqID_9890; Location=915..1846; Strand=+
  SCN-specific regions: Sequence locations=1-163,187-292,315-693,715-932
atggaagacaaaagcgaagggacaccgtacagtaagacgatttggaattacggtaatctacaatccatgatccatgattggaccaccccggtggaaatagacactaaaaaatgccattacagtctcacttttgccgcacgcttttttaaaaaaaaacttgaagaaaaattttttaattgatttaatgggacaaatgccgttttcaaagggcatcttcgaaaaaaggatgttcaattaattttcgaaggatcaaagaaagtacagatacaaacctgtttttacacatttcttgtttttccttttaaaattgtgttcatatttttatcatttgttcatttgtctgtccctcattaatttttcgtgtccaatcgatgctcaaaggaaacgattctcggcccaaccgattgtcatccatccaattaattaataatgattcatccattcattcatgcattattcaaactcatcacttcacgtatgctccgaattgtctttttcattttttgtggaaagtttttaattgataatttttccaagcgataatttgttaatttgtcaaactttgtgtcgttggcatttccgtgatcgatttaaaatgcacaaaatatgcactaaattattttaaagaatctcatggttcttatttatatctaatggtcccttcttctgctttgaaattgaaatgtccggggatttcaatttgacacgaaaataaaaagcaaagataacaattgagggacacgacacagctgttcaaaatcaaatcaaaaacgatccaatttattttattcagaggcgaataattcaattaaatttaggagacgacaattaaagatggacagcaacacaaaaatatcataaaattagaaagaatgtcaacaggaaaaatatttgattgtaaatgaatattcgtctgatttcgcacaaatcga

SEQ ID NO: 72919 - DNA, 1415 bp, Heterodera glycines
  Genomic contig location: Contig_ID=SeqID_9890; Location=2025..3439; Strand=-
  SCN-specific regions: Sequence locations=1-94,116-143,165-256,278 -769,792-1057,1080-1085,1107-1415
atgcatcggatgtatcggagaagacggaacaggacaacaaaagttggagaaaaaactttgaaagagaagaaagttggtaagtgttacgttttgcaattattatttattgattgacctaattgcaattgttaattgatgtgagtcactaaattatttaaatgagcgtgtgtaaaaagttattgcttattgccgggccaaaaaaataataatatgaccgtaaaatgcattatgaacaggcccaggcccggatttatacatgccaaaaaatccacaaatatttgttaaaaaccacaaaaaggccaaaaataataagtttttatgatccaaaagtccaaaatatttttatgcactaaaaaatcgcgctgattgataagaaacccggataaaatgctctttttaagcttttctgcaatagaatattcgcaaaaaaaaaatggtgtaaaacatataaagccgggccctgatgattaagtatgctttagttttatgaatttggtaatcttcaagttttattatatttttaatgcttccaaaaagtgaattaagacacttcagaatctgctttttttatatgtacaatcatttgaagcaaactctgatcatgatcataattagggaacggatttttaagcgcgaaaaagtccaaaataagtgcttaaataagggcgaaaaaagcgcgaaataagtgcgaaaataagcatgaaaaaattccaaatgtagaggtgaaatttgttaaaattgctgttttctctatgtaaattagttaaaattaagtcaaacaattttatttactgattgcagttagaaatgaagtacatttagaaattttcaggatttaagggtcgattctcaggggcgtatttttccgaaattttttgggtggattcttaggagtgtattttttgaaaatttttaggtcaattctcaggggtgtatttttccgaaatttttttggccgattcttaggggtgtatttatcatttttattgcatttttgttaataagtttcccaaaaatcgcgaaataagaacgaaaataagcataaaacgctaaaataagtacaaaaacttattttaagggcgaacctctaaaataagcatttttaagcacgaaacgccaaaataagcatttctaagttcgaataagtgcgttaaaacacaaaattttcgaacaaaaaatgtgtttttcgtgcatttctcgtcgaattaaagccgcagaaaaaataagcaaaaattttgaagcatggcttgggtcatttgaggatgaacttacagcacatttaattttttgaaaaagcgcgtcgcgaaaaaaagtggtataaaagtaaaagaaaaagttgtcggagaatggaaaaacacaaaaaattcaaaagaaatctcacggcaaaacgaatcttttagaattttcaaaataaa

SEQ ID NO: 72920 - DNA, 1596 bp, Heterodera glycines
  Genomic contig location: Contig_ID=SeqID_9892; Location=1679..3274; Strand=+
  SCN-specific regions: Sequence locations=1-223,246-568,591-883,905 -1176,1198-1395,1418-1457,1481-1596
atggaaaaagtcaattatttgccctgtcccaaaaattcaaaatccggtaaacccagtcgactttcgtccgatttccctgctatgttctgtttccaaaatttggaagaaaatatagcaggaaaaataaaaaattttgttgaaaaaaataatttgttaccaaattgtcaacatggttttcgtaaagcacattctgttactactcaacttcttgaagtggtggatgatttcagttttgctttagaaaataaaaaatcaattgatgtaatttattttgatttggctaaagcattcgacacggttccacataaccggctaatatctaagctaaaaagcattggtataaataattccttattaaaatggattcaaaattacttagaaaatcgaaagtttttcgtcaaaagcgggtctgatttctctgatgaatatccctgtctcagtggtgtgccgcaaggctcaatattgggaccacttttatttcttatttacatttacgatttaccaaaattctgcgaaactgaaaatgttaaaattaaactatttgccgatgatcttaaggcctatcatgttctttcaaatatttccttttctccactccaaaattttattaacaaatttaatcaatactgtaaatttaacggccttaaaatcgcttcaaataaatgtttaactttacatttaggacacaaaaatcaaaaaataaattattttattgatgactttcaaattcctaaaaatcccggaaacgaaccagtcagagaccttggcatttattttactaatgatttgaaatgggcacaacatattgacattatctcgaaaaaagcattacgatctgctttcgctatactaaagtcaatcaaaactcgtgatacgaaaatacttgtaaatttgtttaatatttattgcagaccaattttagaatttggatctccaattttcaatccttatttaaaaaaggatattgaaaaactggagaatgttcaaaaaacttttttgagagtaatatttagacgtaacaattatactgttgatttacctaattatgctgaattgttaaacatttatgatcaaaagtcgcttgagagtcgtaggttaaaaatagacttaaaactttttcatgaaataattttaggtaaaataaatttacaaaataacgaatccttttctttttccaaaaaccctgtaaaaaatgaattcattataagaacagcttattgctcaaccaatgctagatacaactcgttctttattcgaacctctcgtctctttagacttttacctaaagagacgagattactaaatccaaatgagtttgccaaacttcttgaaagatctgatcttaatttgttgatttctttgccaccccaactccaaaagtgaccaattgattgttttgacattattatttctttatttttcggcgtcacgcttctgcgtacttttcgccgccataattaaaaaatcccgaaaaatttttgcaattatagttaaaaaaccgctaaattatggtacgattgctgaatttgttttgagtcttcgtataactgattatttttgaagctgatgtcggccatacttgtgcatcttagatta

SEQ ID NO: 72921 - DNA, 1491 bp, Heterodera glycines
  Genomic contig location: Contig_ID=SeqID_9893; Location=73..1563; Strand=+
  SCN-specific regions: Sequence locations=1-115,137-617,639-707,1208 -1311,1333-1491
gcgacttcgaacggcgaatgttacgcgccttttctggccaatcccttcgtgaacatgggcatgtatttggcctattactggaccacactcgtggccatgttaattctttacaaggcaaaactttttcatttattttggtccaagttgctttaagggcattcacaaagcggcaaaaaagttggagaagcgaagccgagcccgagagcatcggcacattgcacttctgttaacgcaacgattgggcacacaggtgatcagagaaaaacaaactgatgatcagaggaaaagagactgataaagggaaaggggcgactgataagggaaaagaaaaggggactgataaaactgatcagaggaaaaaagagaaacgggggaaaagagaggatgatcagactgacataacagaggtgaagggaccgacaaaagcattactgatcagcttttcagtgacaaaagttttggggaagaggcagtgacatgagaaggaaaaagcaatgagtgtgaaaatgaaaaacggaggcattccatgacgggaaaagtcagtgagtgagtgattttgcattggttgaggtcggagtcggtttgatgcttcacgcgaaacgataccaagaggaggcgaggcacgagcagagcaaacagcagaaactgacaatgcgatttgaagcgaaggacagcggatacataacagcgaatacggtgggagtgtcctctctctgtttctctcctccatctcactctctttctcccgctctttctctctctttcctttctttctctctctttctcccgctttctctctctctgtttctctcctccatctcactctctttctcccgctctttctctctctttcctttctttctctctctttctcccgctttctctctctctgtttctctcctccatctcactctctttctcccgctctctctctctctttcctttctttctctctctttctcccgctttctctctctctgtttctctcctccatctcactctctttctcccgctctttctctctctttcctttctttctctctctttctcccgctttctctctctctgtttctctcctccatctcactctctttctcccgctctctctctctctttcctttctttctctctctttctcccgctttctctctctctgtttctctcctccatctcactctctttctcccgctctttctctctctttctcccgctttctctctttctctgttattttttctccctcttttctttttaattgttcgtcgaccattttcagctttccaccaccgattccgctgaacggcggcgcagttccttctcaactttggccaaagccgttcaaagcactcagagattggcacgatttcgccgctatggcgcgacttttgcatttcgcagcaaatcagccgctttggaagaaaaaggcacgacggaaaagaaaatgaaacaataggaaaatggggcacagcaggtgacagaagagaacagaaa

SEQ ID NO: 72922 - DNA, 1313 bp, Heterodera glycines
  Genomic contig location: Contig_ID=SeqID_9894; Location=1015..2327; Strand=+
  SCN-specific regions: Sequence locations=1-204,232-233,256-433,456 -489,518-569,591-598,623-660,688-852,1034-1097,1245-1313
  Gene Ontology: Biological process=N-linked glycosylation
atgttgctgctcagttttgggttgatcgttctgctgtttgcgtgtgccaattgttccacggaaggtggcacaaccgaacatccgtcgagttcaccgccgccggcgactgatcggaatggagacaaaccatcgccagtacatccggtactgaaaaagtttactaatgcgcgtgatgcagttaagaagcacgtggaggctgctcagtaattttatttaaaatttattttttaagtaatttggggttattttgcatatggacgaaactgtcccagagatttactttttcggcaataatcccaccaatggactatggcaccacctttctcggcacaagggcagtccataggtgtcgggttggcttagacggggaccacatccccagattgtcttacggtggccaaaatttttttttctagggcttagtatagatttcataaaaattacaatttaaaaaactacaaccgaattttgctgtttttgactatatgcttttattattaataaattattaatttttcaactgaattcattagttattaaattaatttttgatagaatttcttatttaccaaaatagaggaaaaattattgaattctgaaatatattaaaatttaattttaacagcaaagttgtagtgccagcagtgaacaaatactttgacaaatatttgctaccaaatgccaaaaaggttggcgaaacggcaacacgtggcttcagaaattttcgccgaaaatttttgcgtccaactgtcaacaatgttgttgaacggagccattcattgggagaacgattggcatcaatgaagaaatgggaatcgtcggacgatgaggagacggaaaagcagaaagataaaggaggggaaaaagaggatgaagagaaaaagaagatgaacggcaaaaatgataaaaaggaagagagaatgaaggagaacgaacatgcgaagagacatggtgagaaaaaagagcatcatgcagagaaagaggggaaggaagtgaagaagcacgaagagaaagaggagaaagaagagaagaagcacgaagcgaaaaaagagcatcatgcagagaaggatggaaaacctaagaatgaagttgggttgggagaagagaaaaagcatgaaactaaaaatgagtttgaggaggaaaaggtgcataaggagaaaagggagcacgaagagaaaaaggagcaagaagagagaaaggatgaagaaaagaagaaggagtgcgaagaaaatagggagcaggagcatgataaccatgaagcgaaaaaagagtcaaaaagcgacgagatcaactcaattgaggaaaagcttaat

SEQ ID NO: 72923 - DNA, 73 bp, Heterodera glycines
  Genomic contig location: Contig_ID=SeqID_9896; Location=642..714; Strand=-
  SCN-specific regions: Sequence locations=1-73
cgacgcggcgaagccgcgtccctgagcgcgaagcgctttccccacagcaacagaactcaattgataatgtttt

SEQ ID NO: 72924 - DNA, 208 bp, Heterodera glycines
  Genomic contig location: Contig_ID=SeqID_9897; Location=2560..2767; Strand=-
  SCN-specific regions: Sequence locations=1-108,131-208
cgcccgtcctgaggctgcgatgaattgctaaattacatcaatttctagcgacgcggcgaagccgcgtccctgagcgcgaagcgctttccccacagcaacagaactcaattgataatgttttgtatgttttaaaataacaaatgagggccatatattaccaagccacgcatgcacaccatagccaactgggcaccctagtttatatact

SEQ ID NO: 72925 - DNA, 709 bp, Heterodera glycines
  Genomic contig location: Contig_ID=SeqID_9898; Location=534..1242; Strand=-
  SCN-specific regions: Sequence locations=1-258,280-351,376-441,463-709
atgattgaagaacgtccgctgatcgaatgcgctgtgatcggtccgacgaattcggggggagccgagaaaaacgcagcggtaaggcgaaaatggccttacagtattattagttcattatcgtaacccatttcagattttcgagttccgtacgaaagaagggtgtacggtacttaaaacattgacggaattggaacaactctttgaacactttcgcaatttgttgcctcagggaaccgaaaagatgccgaagaagaaattccttgtgccagaacaaaaattgatggaaaaacgaaagaattgggccgaagcattggtcacgcatttggtggcgaatcattcggaaaagtgggaaaaaggaggagggaaagaaaagggaccgatcagaaaaggaggggaaatttaggattgatcaggaaaggagggggaaatcttcaattcacatttcagttgtgatgtccaatcgcttttcggtcctttgttgacccaatcggacgaggaccacgtgattttgggaccatcggaaaagaaaacgtgcgaatgatcacgaataaccaaatttggcttttttagagtgaagccggcgaattttgattatttgaaaacggttggccagggaagttttgggaaagtgtacatggtacggtaccatggagacggtaaaatttatgcgatgaaagtgctgggaaaagtaagaaaaattggaaataaa

SEQ ID NO: 72926 - DNA, 555 bp, Heterodera glycines
  Genomic contig location: Contig_ID=SeqID_9898; Location=2196..2750; Strand=-
  SCN-specific regions: Sequence locations=1-236,258-555
tttaaaaattgtttttaggcggaaacggaggagaccaaagcgattgactctttggggacacaaagcaattttaattgcttgaaatgtcaatttatgagcatttatttaggcttttgcgggcccaaaattccgtcgaatgagcttcggtcgccctccaaacagcagagaatgctttcgccgttgaaattgctcttcgccaattctcagccggtgctttccttcgcttcgcttttcccataatttcccattttctcagcaccccgacgccgtctcctcaaattccgtgggccccggcggcgttttcttcccgcccccgggcgattctttcctttcgttggaccccccttttgaggagaatgacccgtactgtccgctcttcatgaacgaccaaaacacttcactgaattcgctgttcggctgatcattcgctgcggcggagaaacgaaaggaaaaggcaaaagaaataacggaaagtgccaaaaaaaagagagaaaagtgcacacatttaacattttctcatcagatgttctacttgcttctcataataaacgtttt

SEQ ID NO: 72927 - DNA, 2565 bp, Heterodera glycines
  Genomic contig location: Contig_ID=SeqID_9901; Location=140..2704; Strand=+
  SCN-specific regions: Sequence locations=1-1019,1097-1574,1641 -1816,1839-2331,2366-2450,2472-2565
ccccttggtccatccgagccaagctggtcccgggccaacatgacctcctccgcctcgtcgcttcctctcgccccacttccaccggtgacgaattgggcggtggcccttccacttcttcacagccggaagaagtgccgtcgtcctcgtcgttttccgtcttcgctgatggcgcccagcagtcctccccattgaagaaggacaacacgggtcagtttagccttgcaattttaaattcaaattagatcattttataaatttgacaaaaatggaatatagcccccccccatcgaaaatttaagattactttaccttttttgtcctgaattttcatattttcaattttagctgacccggtgccgagcagttcaccatccgtaaaagagacggcggcggcatcgaaaaatggcgaaaatagctcaaggatggcaaaaatttcagccattttcgaccgccaatggacggaatggaagcgtctgtaccacagcctggccgacccaccgccgtccggccaagcccaaacgaccgactcagtgccacattcggcggcaccgtcgccacaaacgaacgcacaggcgacaacagcaaggagtacagcaacaacgacaaacgcatccgggctaacaggttcatcccagaaaagtgtggatttttaaggcattccctaaaaatgggactgtcccagccaaatcgtctttcatggctaattagtgcgcttaatgtttttgcatttaaggccggaacagcggcgggggggacggcgcatgggacgccgcgggtcaacaccaaaagcaacagcaagcgttgccacgacttgtgatggtcgaagtgaacgggcaccgaatgctgtacccgagccaattcgttgctgtgttggcggacgaattgttgccaatcgtacggcgggaaagggcaccgtcggaacaaacgacgaaagaggaggaggaacaggcggatggggaaacggaagcagcagctggtgggtggcaaaagccaggaaacagaacataatttcgccgacgaaattttaaaaaatttaaaacttagaaatttaaaaaaatcatagataattttttcatataaaatttcaaaaaaaaatcatagaaatttttcaagaacccttcaaattttttataaatttcaaaaacgttagatttttaaattttttccctaggcttacttttgaaaaaaaaattacggcggcgaaattttcgggtgcacctcaaaagccaagcggaaaacggttaaaaaaattggattgaattttaaatttttaggtttttgggctcacaatcagtcccccgaaagcaattgtatgggattgaaaatatacaattttaggcatgtccaattctgcttcaacatctacggattcctgtggccaaaccgtgccgaaaagtggccacaacaatgctttgccatcctcctcctccgtaacgcaacgaccgttgtttctgcaccgaatgcgtcgccgttcggccgcagcgattggccaatgcgcggcacggtgcagctttgaggacgcgcttttacgcgcgaggggcagcggcgtggcgacagctgtgaaaagagagctgcaacagcagcaacaacaacaatttcaaaatgtacaacaacaacaacacattacggggacaacaacagtacggacgctggacgagttcaactacgactacgcgaggcgcgagttttgctactgtcgcatttgtcatggtgggagacggaatggaggaggattgggttggggtgcaccccgaaatttcgccgaggcataatttcgtcgccgaattttttttaaatttttggctgctaaattatgtcctgttccttgttttgtgtcatcgggagcaacaaccaagcaaagcgggatatgaatgaatgctcagtccccgctttttcagccccgtcctcaaccgccactactccattagccaccacaaccgccgttgggttgaattcgccttcgtccaccgcttcgacaaccgttgtagcggccggcggcccgctgacaccaacggcagcaaccactgcaattgcggcgcctgccacagccgctacggtgttacactcgccatgcagctgtgctgctcaccctgcggcaccgttccatcatcggcacggcaacgatggcaattatgacccttattcgtccccagctacgcaacaatatattcaagccgttcatgacgaaccccaacatgcgcataaaacttcgtcctcctcactgaaaaaggctgtgccttcattggccactggaaaaagagcatcctccaaattcaatggcacaacaaaaagcggaactgacgatgccgcacataacacccatcagcagcactcttccagccaacagcagcagcagcagaacagatgggcacgtggttgcgcaacaaacgcggcaacttcgagcagttcaacaacgagtgccaccgaatggccaactgtgccggagtgggacctgctcaagacgggctccgtgttggcaaatcgaagaaaaacgcagcagcaattgcttgccctaagcaagacaaaagaggggggacaacaacatgaaattgctgcaacgacggg

SEQ ID NO: 72928 - DNA, 2071 bp, Heterodera glycines
  Genomic contig location: Contig_ID=SeqID_1343; Location=3065..5135; Strand=-
  SCN-specific regions: Sequence locations=1-226,248-793,815-883,905 -1351,1374-1780,1802-2050
atgtgcagtttgggagtcaaaaggggcagtatcaacggatgttcggagcaaaataagtcggccggagagagcgattccgagaggcatttggaggtgagctgtggagagttagaaaccaacaaccaattgggaagtgtgaaaccaaatggcaacaaaaattacatatagttttggtcaagttggttgaccctgcaaaacctccgagaaatattttcaaacatgaccaacgagggggagggggtgttgtgccgtgccgggcatcccatgttcacatcagtttgattgcgtcttctgctgcttcagttgcctttctctgccaacccttcctcttctgttctgtccaatttctctgctcaaaatccatcgtcctcttatgttccccagcaaatctcttcttggcttggccgtcagaagttcagcggtcgtctgaagaaacatttctcaacttctcagtccaatttggccggtccaatggcaattgaaccattcgcagtcggagaaagtgatcagcagacaaaggacgaactcatcggatcagcttcgaatttttccaaaagttgcaatgatccatccatcaaaagtgagttaatacttaaaatcggttattctttgtccgaattgttcagcgaattcttccgctggtcttctgaagcgctaccaaaaaggcaaagggctgaaacggtcgatgggcgacttgacagcaatcggcaaatcggaactgtacggtattggtggatcatttatcagaactttgaatttttgtaagagcgccaatatcttcgttggatcaaacagaaaaagaactggtgaatgaagctgagcaatgctaatgaatgttattactttctttcagcagaaagtgctcgaccctttggaagtgttcggccctccgccgcccctcccctccaccgaaccgccgccacttaatgacgagttggtcagcgcgttcaatcgcttctcggctgaccatgttggcacatcgtcgacaacaaaagcaaaagagcaacaaccgattcttcagtctgtgtcttttgtatcgatggcgagtgggggaacattgggcgatggacgaccgaatcggcgaagtgcgagcagtagcagcagcacaacttcgggtaggttccggtttattattagcatttaataaattccctccagatgaagaggacatttgcctcgcagcccaacggtcaaagatcagacaaatgcaaattcgcccacttaatgactctcaacaaccaaaattaaacgcatcggtcgatgagttgagaacggcaattggtcagatttctctgcccaaatgcaaaggaagtgaaagtgtaagggtaactattttaaaaagtaagaataataaacatatttttatgttaaaggacccctggggaggtggcccaactcaaagtgtgacgacgcaactcccttccggctttttctcaaatagtcaccaggagggaccaatccgagcggcactgaccggagacgaacatttgcgtcgcaaataccacggtgattctctccataatgcactttttcgaaaatgtttctcttttactgtcagaacttccgctctccgacttcagccaatctgtcgcgtctttgtccggtgcaacaatcgcgcgcgctcggccccgttctcacacgccgttggtttcgaatcccttagggacgcccgcctctttctcaccttttgttggcagtgaaccgaaagaggtggcgaaattcaaatgaaaagatttaatgtttgttaatataagaacgaccgctttttgtcttatatttcacaagtttaagagaaaaaatcaaggccttggcaaaccttaaataagctttttcattttaggcattttcaaaaaaaatttaattgcggttgaaccagctctgaataaatccatcgaatattatattgcaaaggaattggttagaatcggcattcgcacccacacccaagtgggcaccgggactgggcattgaaccaggcagtcaaatgggcgaagtgtcctccatgactgcacattgagcaagtggccacaatacctttaaaaatgcgacattttttaattattcaaataaa

SEQ ID NO: 72929 - DNA, 1217 bp, Heterodera glycines
  Genomic contig location: Contig_ID=SeqID_1344; Location=1..1217; Strand=-
  SCN-specific regions: Sequence locations=1-42,65-186,208-304,326 -351,376-548,573-1217
caaatgaatgcctagggggacaagcacattggatacagcgtgctttatgaaaacatgaagaagggcgaggagtcggttcacgaacttctgacctttctcaaagaacgcgtaaatatggaggacgatttattcaaatcgcttgggaagagtctgcacagagtggcgattaaatatttttgaaacattggattttgatttttaggttaacggatacatttcaaacaagagcggttttgtggacgcgtggaaattggcgaaggaaaccttggaattatggactggtacggctaaatataagcggtgcaattaaataataatttcatttttatgtacccaaataaaagttgaatttagcattgttttataatcatttcttttcagaaatccaatcgtcgacacttcgaaatttaaatgatcttctgaaagaagtcgctcgttatcaagaagaattggctcggatgcgaaaacgtgccaaagacgcggacactttggaaacgatcaatttgatgcaaacaacgaccacctgtctgcaaaaagtgttaaaaaggaaaattaaaatattataattaattgacacaatggcatgtgagaacgtgctcaattaggcctaaggacttcaagataattggggatttgaggacccaaacccttaaggaaattcaaaatcttaaatggaaaataattttgaataatgcttcggcaaattaatactaattgagctttttcttacaatacatttattaacaaaggcaagggacacgttcaaccagcgaagcactgaggtggtcagtctgaaacagagcaacaaagaatggacggctgccagcacaaaagaataccttcgagtgctcacttaacttaagattcatttaaccaaatgttcctcaaagtacttgtaaactaaggcacgcaacaaattgaacaaggctcacgaggagtacaagcagtacatggacaagtacagccaaatacgcgacactttcgaagaacgcgtcaaccaagccgcacgctctttccaagaacatgaccgactccatttgctacaaatgaaaagttggttggaagatgccaactttaattattattttcaattactttttgaaggtttttttacgcaaatggcgaaatgtttggaaaatgcccacggcgcaaatgcacaagtgagcgcaactcttcgccagagagtcgagcagaacattaacgtggagcagatgatg

SEQ ID NO: 72930 - DNA, 1068 bp, Heterodera glycines
  Genomic contig location: Contig_ID=SeqID_1345; Location=483..1550; Strand=-
  SCN-specific regions: Sequence locations=1-23,46-65,87-468,490-1068
  Gene Ontology: Mol. function=methylmalonate-semialdehyde dehydrogenase (acylating) activity; Cellular component =mitochondrion; Biological process=pyrimidine nucleotide metabolism
ttttcgtggatatttccgatgggattttggtcgaattcagggcaaatacatttacgagcacgggtctaagtttgggaaaagagttcagtcgaatatgggcgctaagaatcacggagtcatccttcctgacgcgaaccgagaacacacgttgaatcaggcactttcgtctccgagtttagtcgaactttgcgtgccttctcttctcccattttcaggtcgctgccgcggcattcggtgctgcggggcaacgatgtatggcactctctacggccatttttgtgggtgatgcgcgcggatgggtttctgatttggtggaacgagcccggaaattgcgcgtcggcccgggatgggaggcggggacggacattgggccggtgatttcacaaaaagcgaaggagcgcatttgcgagttggtcgaatcggcgctggaagaaggagccgatgtgccattggatggcaccaatgtgacagtgaaaggcttcgagaagggaaactttgtcggaccgacggtgagattaatgcacaacacttcgccaatttatagctgtttttgtttgggttaaaattgcccttttcaggtgatcactggagtaaagcccgaaatgctctgttataaggtccgtccgatattttttctgaatttaattttcgtttttattgttaggaagaaatctttgggcccgttttgtgtgtgctcgaaacggaaacacttgacgaagcgatggatttgataaacaaaaatccctacggaaatggcactgcccttttcactcggtcgggaattgccgcgcaccgtttcgtctcggagattgatgtgggccaagtgggcataaatgtgccaatccctgtgccacttccgatgttctctttcaccggttcgcgtggaaggtgagtgacacttctctcatgttgtgtttttaatgcgttttaagttttcttggcgatgcaaatttctatggaaaggctggtcttaatttctacacccaaattcgaactgtgacccagttgtggcgttctgaggatgcctcgacagaagccaaaccacaactatcttttccacaattcaaa

SEQ ID NO: 72931 - DNA, 2696 bp, Heterodera glycines
  Genomic contig location: Contig_ID=SeqID_1346; Location=2491..5186; Strand=-
  SCN-specific regions: Sequence locations=1-1098,1120-1420,1442 -1809,1836-2503,2525-2696
  Gene Ontology: Mol. function=transcriptional activator activity; Cellular component=nucleus; Biological process=regulation of transcription, DNA-dependent
atggaaccgccagccgtcacctcgtgcggtgtcggtggacattctgcttcaggcctaaacgatggcaccggtggattgcaaaagtatttcctttaatttaaaaatcattgcctttggctaattttctttacctttaaatttaggcgagatttgtctaccgttgctggttttattcaaatcgacccacaaataagttttaatacgactagtcgacacttcgaggaactgcctgagaatttcctggaaaccataagtcctcaacagggtcacagctctgttggtcatcatcagctaatagctggattgggtggacttcatcatgaaagtggtggaaatgtgtcacatgtaaccactactccacaacttgcatcattgacaacagttagcatggctggtacagctgatgggaacaggttttcgaaagtttcaataaattattgggtcacatcagacgaacatcactcaaagcgtttaaattgactgcgagaatcctaattttcctatgttatcttttaagaagccaaacaaataccaccatatttttacgattcttgtattaactttaataaaacagtggttatgctggtctggtgtcgatgcctagctcctcgcattacatttctgcgctcaaaatggaatcgatggaacaacaccttggccaccatcaacagctccattcaaaccaacttgaaaaaacaaagtacttaacattcataatttcttattgaataattcctcgtgcattgcttattcactcgacgaaatttttttaagttttggtaatggccccgccggattgctttcgccgttgcacttggaagggacgaggagaggagacccagaaggctcactcggacttttgagtagtgtttccgtttcgcatttgcatcgtccaaatggcggaagtcgaacgagcgatttactcaatggtattagacgcagcagcaacaatgttgcgtacattaaagtaagattttgtgcaatggttaaagatatacctttaaattcttgatcaactttacgctttcggatcttattattgaaaattaaggaagaaattaatccatcgaacgaacttggagggtatcactcggcagcatctgtttcccatcatcatgaggcctacggggatgccggaccttataccctccaggggcctactgcccaggaattggaacggatggcaaatgctgagacgccaccagcacttagcaatgtcgagatcacttcatccattcttgcgtcactttcacgcgaatcggtaagctgaaaacatagaatttaatgtgtgattggcatcaattttctttttaagccttcacccaacatacagcagcaaagtcctcaccaaccaacccatttcattgtccaccaaatgtctcgtcaacctcagcaacttgaacatcaaatagttcagcgccacccaatcacatccactccctcaacaacggcacgtcgttcaaaggtgtaatatatataatcagacaaaacatcaatttcaaaattacaggttaagcaacaatctctcagccaaaaccttggtcaaaactcgcagaattcggatcagcaaattattttagcttcgaatggtagtggaacacagtctggatacgggccgatgggacctggagctggttagatctacaaagcttcttggacttaaatacgatttaaaggaattcctcgtaccacttactcaacgacagacacaacagacccattgaatgccgaaattgatgacgaaatttacattgacacaaaggacttgtgcaaacgtgttgcgtatgaactaaaggtcgacccatttagccccctttttatttttaatacaatagcatttaataaaactttcagcaacattccatcccacaagctatttttgctgagcggatcttatgccgtagccaggggacattgtcggacttgttacgtaaccctaagccctggaatcgccttaaatccggccgtgaaacatttcgccggatgttcaattggctgcaacaaccattgcacatccgtttgagcattttggatatgtacaaaggttataataacagctctttccatcttttgaacgtttcttttgcaggtccaatggcttccggtgttattccaccacctacgccagcacaaaattctcgtcatcaccatcgaaatcgtaggaccagtgacacaaatgaggagggaaaccctccacaaaagcggcctcgtcttgttttcactgacatacaaaaacggacgctccaggtttcgagttcttgtgtggtattttaatcaccttaacaaattcaggcgattttcaaagagacccaacggcccagtcgtgagatgcaacaaaccatcgccgaacatcttcgcctagacatgtccaccgtatcaaattttttcatgaatgcccgtcgtcggtcgcgcaacggaaatgggatgggcgatgagccggcgccttatcagcaggtaaattgtgattttatcaaagaaaagctgccaaacaatttgaaggatgaaatcacccaacaatttcctagtatggaaaatggtccaatgcttgacctgacaatgggtggaaataacaacgcttttggttattttccgactaatggagttttcaatcacaatatcaatgaaaacaatgaccagttgttggcatcaatttatgggcagcatgccataaacatggcatcgcaatatgggcaata

SEQ ID NO: 72932 - DNA, 469 bp, Heterodera glycines
  Genomic contig location: Contig_ID=SeqID_1346; Location=37..505; Strand=-
  SCN-specific regions: Sequence locations=1-228,250-469
  Gene Ontology: Mol. function=methylmalonate-semialdehyde dehydrogenase (acylating) activity; Cellular component =mitochondrion; Biological process=pyrimidine nucleotide metabolism
agggccttgattatgcgtttagccatttctccgtccataaagttaaatatagttgggaaaacagtagtacccttctttggctcagttgtccactgtccttcttggagtgtcagatttgtttcgacggtgccgaattggattcatggacaaagggtcgaatccaaaacgaaagaatggattgaactaacaaatccagtgaggaggaggaaggggttgtgtatttcttttgtactgtgttttaaatacatattaaaaaagttatgggtcctaaatcaaaacaggaaagtaccgtcaatttgaagtgggggggggggagaggtgcataaaatcgactaaaattgacgcagtgtttaggctacaaatgaagtggtctgccttgtgcccgagtcgacgttggacgaaatgcaattgtccgtccattcctgcaaaaaggcatttctaacttggcgccattcatctgttgtcactc

SEQ ID NO: 72933 - DNA, 187 bp, Heterodera glycines
  Genomic contig location: Contig_ID=SeqID_9905; Location=390..576; Strand=+
  SCN-specific regions: Sequence locations=1-187
atgcctgcctttttggctcaacagctcgtccgtctctccgaccaaaccatcgcaggtcttcgcctttttccggtagacgaacggcacgtctcagtgaacagcgaggaaagcaacgcgggaacactgcttcgcctgttaccggacaaattccgagaaaatgtgctctcgattcaaccagatgacagtg

SEQ ID NO: 72934 - DNA, 123 bp, Heterodera glycines
  Genomic contig location: Contig_ID=SeqID_9906; Location=228..350; Strand=+
  SCN-specific regions: Sequence locations=1-123
aaaattcttgtggataatgataaaacatatccgccatgcctcatccgcccaaatcgaccaattcaatggtttttggatgaagaagcggtcaaagaaatggcagctgcaatgaacgtggcatga

SEQ ID NO: 72935 - DNA, 816 bp, Heterodera glycines
  Genomic contig location: Contig_ID=SeqID_9906; Location=603..1418; Strand=+
  SCN-specific regions: Sequence locations=1-371,393-560,584-816
  Gene Ontology: Cellular component=integral to membrane; Biological process=erythrocyte differentiation
atgacttttactttcattaagttcttctatgctcgtccgcgacctcactctcaaaccggacgtatcaaaaccacgctgggatcagtcgacttatcaaggccgggcgcgacactttttcggtaatttggtctttaaacttggattctttctttcccacagtattttctgcaaattattctccctttagctgtgttgaatcctcttaatttgtttacctccaatcaaggattggaagaaagtcgcaacattgtcttagattatcggtgttttatcattttgcattctatatccctatactattttagaaaaggcattttttccccagaattaacagttgagcgtctatggaaggccaaacatctgtatggtaatttatttatgtattttctttataggactttaggattactgaagattatcatgcattctttcagaatcagcttatcatccgatgtctgaccaaaaaatgttgccttttggtcgaatgtgcgcccaagtgccatgcaatatggttttgatcggtggcatgctcagtttttataagtaaatctacaaaaaacaaaaaaaaattaaattaatttttcaggtctccgttggccgtcgttttttggcaatggaccaaccaatcattcaacgccgtcgtcaattacaccaatcggtctggtgactctgtgagcactgaccaattgctgaaggcatacgcatgcgcaacgggtaagtctgaattttaaagtggatataaatttaaaatttacctgcttttaaggcggggcattaaccgcggctttgggattgaatgccgcggccaaagtgtga

SEQ ID NO: 72936 - DNA, 1265 bp, Heterodera glycines
  Genomic contig location: Contig_ID=SeqID_9907; Location=70..1334; Strand=-
  SCN-specific regions: Sequence locations=1-165,187-955,985-1265
atggcttatatttctgtggttggtggaggacttttccgctttttctgttcggttcgtaataatttgtgctcgtctcgttcaggctgtgcttttttgactttggtttctcgttcctgtgcccaacaagcgattcgaaaaatgcaccattcgcagattttcgaggtattttcgtcccctcccttttctgttggcctttcaatttttctttgtccgttttctgcactttttcaatttataatttttgcaattatttaagttttgctgggcttgttttagaaatgattcctttgttcaattccttagggctgttccaaaccgttggtcgtcaaattcgccgattcctgtcgagaaaaaaacgcaaaaaaagctccagatgtcaaaaatgaagagggtccgaagccgaacggtgggaaaccgaccagtaataatcaggtgctcgcctggctttgatttcattatgaaggattctaaaacattttgcagaattcgcaattgctcactgcctcaggcaccgaaacattggccaatttggtcactttacttcagcagccaaatgtcatttctctgcttgaggccggtacggaacaaaaaaaaacataatcgcaaaaaagaaaatattttgatttccattttcagcacgtgtcatacaatcggcacagaatgtgacttcgtccgctggtaattctcaattaaatattggtccgtccgtctttttgtcttccattttcttagatttactactcaaaatggaccaaaatcgtcaacagaatcttttcaaaatgcccacgctgctcccaccgaatttgaatcagggcgcactgctcggcctgtcacagggattgctcctccaacagtccgcggtcggaggtaacgaaaatgacatccaaaacttagggggatgagcttcccacacaatgaacccgataaaagggttggccatgtctgatttgggaatgtttttgccaattctttttgtttttcccaagtttcgtttccccccccccctaaaattgtctacggttgggttaattaaattcagcctcaccactcggtcactctgcgctgaatctctctgtgcccagtgcaattcattctgtgctgccaacgactccaccgaatttgccaattatttcgccttcttgctcaattgtttcaaggatgacgccggcaaatccttcatatcccatcgacaaatacaaccggggaccggacgggtgcaatttgttcatctaccatttgccacaagactttgccgacacagattt

SEQ ID NO: 72937 - DNA, 1069 bp, Heterodera glycines
  Genomic contig location: Contig_ID=SeqID_9908; Location=389..1457; Strand=+
  SCN-specific regions: Sequence locations=1-137,159-279,302-443,465 -625,647-736,758-1032,1059-1069
atggcatatctcagctggacgacgacgacgttgaagacaacgacaatgctgctcaacctgacacttttttgccagtgcgttcattcgttggtcatccatccgcgactctgttcaacttcggctgcggttgctgcacgacaaattggagcagggccagaaagaactgctgttgaagacgaacaactgcaacatttgcttgacatcagcaatagccgaaatagtaacaccaaaaggatgcgctggtacggagcagaagccaagcaaatgctcaggtgagggcagcttttaggggaaggcaatgtgccattcatgagggcaccgaatatgccgatattgaggacggagattgtgccgttcattctttggggcagacaagatggccgtgccgtactcacatttggcataataccaaaataaacatttttaaacggccactgaaccaacctccccccgcccttcctcccacttgcttgaacaaagattttattattttttcaatttttttagacaccttgacgagatccggcttcgaacggagacggcacaacagcggaaggcggtggccaaggttggcaaagtgtcgttgctggataaactgttcgcgctgttcacggacaagccggacgacgaggggcccaagcatgactgcttcttctccgccttcaactgtccagtgaatccggcacggaacatcccgggcgttcgccgggtgcgcatcacggcggatgagcgtcagaaactgttggcggcaaaacaacgtgccgctacaatcggcagcagtggtggtggcatcaccgaacggcactggagaaggccacggcatcaccaccaccagtaaggttttgaaacagtgccattgaagccgaacggcacggcataaccatcgattctttgttcactcactcatcaatgctttctctgcttttgcttgccattaattttgttcaaatgtcaaacttttgctgatgacccaaagtctccccaatattttgtacaaaatgaaatgaaattttattgtttgctttgcatttgtatgttattatattatatatttttcgtttctcaaaaa

SEQ ID NO: 72938 - DNA, 1658 bp, Heterodera glycines; identical to SEQ ID NO: 9909
  misc_feature (59)..(59): n is a, c, g, or t
  misc_feature (80)..(80): n is a, c, g, or t
  Genomic contig location: Contig_ID=SeqID_9909; Location=1..1658; Strand=+
  SCN-specific regions: Sequence locations=1-252,277-381,403-455,496 -514,539-911,933-1011,1033-1118,1140-1249,1285-1658

SEQ ID NO: 72939 - DNA, 1391 bp, Heterodera glycines
  misc_feature (25)..(25): n is a, c, g, or t
  misc_feature (28)..(28): n is a, c, g, or t
  Genomic contig location: Contig_ID=SeqID_9912; Location=11..1401; Strand=+
  SCN-specific regions: Sequence locations=1-32,66-144,186-286,315 -317,361-760,790-1103,1126-1143,1165-1279,1301-1391
atgaaaattggagttaaaggaaaanaanttagaaattatcataaatatattctttcaaagtaacactgccaagtgtgcgaatggcctaattgctactctccttgacatttccttcttctttcccctggttcaatccctctacagaaattaaaatattttgaaaattttcttttttttttaaatttccccgctaggtccgggaccaacaagaatagggtcagggtcaaattgttaaccaaatgcatgagtgggttcaattcccacccgaggcttaacattttgcctatttcttattgtatttttagtacagtaaaagcatttttataaaattattttgaaagaaaaaatataaaaatttttcagtaccgggttttaccgggtacccagagccggtttaaaatttggcccgttttcagaacccggcgacaaagggtactgtaggggctaccagaaaaaaaagatgggtgcctattgtaaacattttccactgacgatcaaattcaatggcggggagttggaagctttttgcgccacaactgatcaaagtaaaaatttcatggctgatgcatacgccttagggctcagacgcgtacgctcactcccttaaaacagcttgtgtaacaatttaatcaattaatgtaatatcaaatttcgttttttttgcctcctatgatcatttaaaatagagttgagcgggaccgggacctggacacggacaactgagtaccaaggtcccggttttgaccagttttgaccgggaccgggaaattcccggcttttttcccggttttcctagccaaaaagtcccggtcccgttcttgcccaaatttcccggtcccgctcaactctaattttaaacaattttggtgaggaaataagcaaatcgtacatttaaattagagaccggacgggatcgggatcccgcgggatttcttcgggatcccgcgggatttcttcgggatcccgacctcgggatccgtcccgagcgattttttaaattcatcgggattgattgggatcgggatttcatcgggatcccgaacctggatccctcccgaccattttaccaatcccgcgggatcccgcgggattgaagtcacgataatttttcaaaaaatctccattttttaaattaagatcttgaattttaaattaaaaaatattgtcatttgctaatttttcttaaaaaatcccttaaaaatcccaaaaaattttacaggtctccaaaattccactaaaattttcaaaatttgacgcaaaagttggccattttgtgacttttatttcttcataaaaagaattattttttttaatttctaaaacattagtctaaatcttattaggtagttttatggcacaacgatttctaagaattttgtccaataatcaga

SEQ ID NO: 72940 - DNA, 1058 bp, Heterodera glycines
  Genomic contig location: Contig_ID=SeqID_9912; Location=2030..3087; Strand=+
  SCN-specific regions: Sequence locations=1-408,430-589,611-695,736 -900,922-1058
atgttcgagattgatcgggatcgggattcagtcgggattcagtcgggatccagactcgggatccctccgaccccagttgtccggtctctaatttgccctatgcccaaaaattcattaatcatttttttgagtatcaacaactcattaaagattaggtaagtaccgggtgtaatcacttcctgtcacttatttaatgctgattatgctaaacatgaatttgaaccaatttttggtataggcgcaaatgtctgcacacggaaagatggcatcggacaattaggaaattgtaattatacacgaccattagagttagcagttttttagccttagtcattttttttattcattttcgtatataatctaaaaatttttcttcggtttggtttcttcaaattccacttcgatttaaattttggaatttattttcggcttttcaatttcagcaaatttttgcgcctcttctcgacatttgcactttgtcctcatcatcaaacacaacgacccaacaacaacaattctctgagaatgctttgcgtcgtaagcttcaactttgtgccaattgtcttgccgatttgctgcacacttggcctggctttttcgttgggttttcggtggacaattttcggcacagcacgtgccaaaggtgagaagtgaaagaggaggattttatgaatttttatttgcccaaattttggaattattttagttttttaattaaaaatcttatattttttagtgttattgctttcctcaaaaacccttcttatttggcgcagcagcacgagaagaaattgctgggggttgagctgttcagccgaatgctttgccttccgtacgcaaacaaagaattggccacatgggacgaagcgatgcgattttatggtcgaacgcaatttggaaaattaattgctaatttaattactattttgatagaaagagctcatggccccgaccctttccaaatttcgctcagtgaacattttgttttggccgaactcccattcattcgcccattaataaaagtaaagaactcgtgaaaaacaattaaatctgtataa

SEQ ID NO: 72941 - DNA, 617 bp, Heterodera glycines
  Genomic contig location: Contig_ID=SeqID_9912; Location=3097..3713; Strand=-
  SCN-specific regions: Sequence locations=1-299,321-344,366-370,392-617
atggtaatttttagccttaaaatttataaattgcatatttttggcgcaaaacggtggatgttcacaaatctctaatttttagattaaaattggacctaaaaagctagaaattatttcggattaaaattttttaatctcagttctatttcatatttttgtttttagtttcattaatttttgaattattcctgctcacaccaggacttccgttcaaaattgaccggatttttcgggaatcccggcaatgctcgcggaaaagttttggactcccgtcccggcttgcgcatattttttacgggtctctaattaaagaaaaaattagaaaaaaaaaactttgcctcgggaagacccgaatgaaaaagcgcaaagacatggacagattggcaaatgatgaacaggtccgccttttcggtcttaattgtgaaagtgaaacaattaaaggcatttgtaatatttgtctcttggccgttttcgcctcagcggactccggccaggtttttctgggtcctcaaatccgggttttgagggttttcctgatatttgctgaattccgagtttttcctaattatcccataaatcatgtcgttaaaaacggaaatgaaggttttgtgaaataa

SEQ ID NO: 72942 - DNA, 408 bp, Heterodera glycines
  Genomic contig location: Contig_ID=SeqID_9914; Location=1111..1518; Strand=+
  SCN-specific regions: Sequence locations=1-52,74-408
atggcatatgcaacagaggtgaataggaagaaatggcacgataacattggaaatgagagggataggattggtttgggtgggatgaacggatggataagtttatgacggggtcggatcggggaaagtagggcaatttacattatgcacaaatatgaaatttaacagcggacacagcaacatctctggccattaattaattggtgcttttcagccagtttcggcccgcttcgctgaccatgcagcaatacttggactttggccgcaagggcagtgcgtttacctcctaccactttctgaagacggaactgctggtccgcatggcgaacattatgcaggagttcgacctgctgcccgccaaactgttgcagacgcccagcgcacgccatgtgggctcgtggtacaaacaaa

SEQ ID NO: 72943 - DNA, 1520 bp, Heterodera glycines
  Genomic contig location: Contig_ID=SeqID_9915; Location=85..1604; Strand=+
  SCN-specific regions: Sequence locations=1-270,292-412,457-1107,1129 -1520
  Gene Ontology: Mol. function=pyruvate dehydrogenase (lipoamide) kinase activity; Cellular component=mitochondrion; Biological process=small GTPase mediated signal transduction
atgctcgacttgcgctgcttcaacacccgaattcccgaccagcaaattagcgtcccgctggttccgctccatttgtactacattgtattcgaattgttgaaggtgtgcagtcaatgcctgtactgaaatggcagggatgggaagggaccggcgggtgctgagaccttataaaataccatcatatccataacttttctcaaatccccattaacttttaatttttggtatctttcgatgccctagctgttctctattagtctgcaaaattttaaaaaattccgtcaattttgagcaatttatagccgaaagtacacaagaaacaggttttcaaacttttttgaccataactttttgaaacaacgaaattttttgaattttcaggctaataaaaaagacctagggctgtcaaatgataaatagaaaataaaaaataaaaataatttaataaaataaaatgaatctttttgtttagaattcgatgcgtgccaccattgagcatcaccatcgggtcaaaggctttgatgccgactcttccgatgatttggcagaagtgcgtgcctgcattgtgctcggcgcggaaaacctttcaattaaggcatgtgctttcgattttttggcactttatttttgtccgtttttattttcactctgaccactcacatttctcatctttctcagatcagtgatcgcggtggtggcgtgccgagtgccaagctggccaatctgttccattatctgtattcaactgcgccaaagccgtcacgcgatgactccaacacgccatttgtaggcaccaaccaatgaataaaaactctgatcacgctttcccgtcaataaatatctgatcatttttttttgccataggctggttacgggtacggtctgcccatttcacgcctttactcgcgctattttcttggcgatctgtcactgacttccatggacggttatgggacggatgcggtcatttcattgaaggtagataattcgatcaattagagttgtttaactgggaaattcgctcctctcttcctctcgagaatggcacgggaaattcgagtaaactcactttacaaacgacggcctttagtctcttttcgggatgcgccccaaaaaccttgaagttttcttatgaaaatatctgtttgaaaattttttttaacatacacggcgagattttttcccgtgccttcttttcgtcttttcggcactcatttaccagtgcaacaatcatttttggcacatcttttaaggccgtgccgtcccaggcctgtgagctgttgccggtgtacggcgcttcgtcacgtcgcttcatcacaatggcacgcgaggcgcccgactattgtttccagaagccgaccgcaatcacagcaccggcattggactctacgaccagtgccgacatttcagcagtgccagtgaaagcagtgaagccgaaattggtaccggaaacaacgacgactaagacgaaaagcataagcagcagcagcagtggaaaagccgaacgggtggccatatga

SEQ ID NO: 72944 - DNA, 468 bp, Heterodera glycines
  Genomic contig location: Contig_ID=SeqID_9917; Location=389..856; Strand=+
  SCN-specific regions: Sequence locations=1-95,117-468
atgcgattggcacggttacgccaaagtcagctggcagcaaagcgcgaatttgaacggaacatgcaaatgaaaggtcagtgttgtaaattcgagaccaatgattttaaaaggaatatggttggacttgaggaatatatttttggtttttcttcggctaaatacactgtgtcttgaatttttaaccaattaaaatttttcctattagggttgtgcattgtcggtgattaactggggagggtactggtttcggttaggccttgttcccgaaccccggctctcgtttttggcccaaaaagccgggtttcggttcggttaaacgattttacacaattctattagacaaacatacaaaaatgcccaacattattggtcaatttaatcacgactatgtgtgctaagttaacattttcagcaaataatgccgcccaatcaccggcatcgaattgcttcgacagagctccatggtaa

SEQ ID NO: 72945 - DNA, 1264 bp, Heterodera glycines
  Genomic contig location: Contig_ID=SeqID_9918; Location=266..1529; Strand=+
  SCN-specific regions: Sequence locations=1-121,159-360,382-443,501 -793,817-1078,1118-1157,1180-1243
atgccacaaatctttgagaatttgtgtcattgttgtgtttctattgtgaacaaaacaatcccaagttttgtgtcttattgtccaactttgtccaagaaatatttggcattctttcccccccaaattaacatttaaaacaattaattaataattattttgaagagcatgatccatcgaagtcagcagctaaagcaccgaaatatgagcccaaaattgaccggaataatacgcccgtcgattatgacggaaaggagaaaaagtgtaaagtggaggtgggcaaaaacaaacaaattaaatttattgaattgaaattgtacaggctaaaataaaatttgaaaaattaatgaaactatttttcgatgttcatttaaaaaagaatcaaaagaataaagtgttagtaaaatttaaacaggcaaatttgatcaaattatgacaatttacacattttattcaatattaatttaattttctgtttttttttatattttaaaaatatttttgaatgcttgcaggctaacattgatgttatgtctgaggaattgaagaacatattaaaagagaaaggagcagacaaacgtgacatcaatgccgctgaagatggatgcggactgaaggaatatgcgtacgtttttatttttatggcaccaaattttccaggccaaaaaattgggggatttagcattgaaaaatgataaataaatccaaatttgtcaatggattcaatttgttttaaatcgttgatttgtgagttaagtcttccctaaggcgaaatgtccaatagacgcaatgtccgatttgttttcttaattaatatttgcatttaaattgtgccccattttcagtgaatggtcccgctgcgcgaaggttaaattgcttcttctttatacatatgactttcttgttgatttgatcactttttgttcaggtggcattctacggtcgtggtggctataatgcttccaaaaagtacggcatcgaaaaagcgaagccaaccaaaaacttcaacgacatggacgagttcgacaagtatggcttcatgcacggtgagttttgttggcatttgaaaatagcttttaaatcatgaatttattatagaaaagcataaaatgaaatttttagcacaatgtggaaaaaacggggattgttggccattttcgccaacttttggccattttcagaccaaattttggcaacgttttaagacaatagggacccggcggtgccatgaaaatttagcaaattaaaggtcaattttgttaagaaa

SEQ ID NO: 72946 - DNA, 1814 bp, Heterodera glycines
  Genomic contig location: Contig_ID=SeqID_9919; Location=138..1951; Strand=-
  SCN-specific regions: Sequence locations=1-1,23-520,545-614,639 -660,683-734,760-1013,1044-1094,1116-1128,1151-1394,1434-1623,1662 -1764,1806-1814
atgaaaaaagccaataaaaatgttttttgcggcgtgtttttccaaaaaaactttttgaaacagtttttggattttgagttaattttaagaaaaaagtaagttttgggggctggcggtgccgataggctctgccgggggaaagttggaaattttcatcatttccgacttttatgccggaatttgcggtgcataacgattttgatatttacgccgtttaagtcataaaagggcaaaaagcaaagggttctcccatttagttaaaggcgtacagaaatacggcgcaaatgtcgctaatcttaatgagaaaatggtaatgccgagaaggaaaataattcgatgggattgtcggcaccaatcaaagggagagaagcgcaaaaagttatctaattgcagatatattcacattatttgtgcttttcgaaaactaatcatggccatatcaatgttcggtacattaaaagagaacagtttcgttttgaatgtcacgcaattcaaagtggcattttttctctatcatttgtaaatttttaaaatatttaaaaatgtttgacaaattttcaagcagcagcagtgttttagcgccggaagtaatttttattcacataattagctttttattttaaatgaaatttttgtttaatttgcaggtcaattcactgattttcaaaaatcatttttaaaattggaaaagcaagctgttcttccttttcccatcagatcatttcgtggctccgtgaatattttgttggcattttattccctcagcgaaatgcttaatttgagtggcaatttcatctcggtttacaccgttttttctggccattactttatgccctttcaaatgctttatcgtctgtcacttatcccttttattggcgccagttgcgcaatgattttgatgtttttcacgggggttgagcgactttttattgtgcttttcccgctaaagtaggaacaattagacaaacaataattaatattatagagcaataattaataattaacattgtaaattttaccattttatttatttgaagaaaatttaatcaaaaattgttcttgggaattgcacttacatttaatttaattgctatttttgtgattgcctcctcaacaaaatattttgaccaaaaaacaaattcacttgaagtttttgccaattattacgaaattggcagcttaatttgtaaattggtgcgttttttttcattttcaatcgaatatttttgttttttaggagcaaagtttcattctcagtctctccggtttaatcacagtgataatttctgtgtctgtttacgcactaattgcagtcgcattgcaatgccaaaaaggtatttattcattcaaattcgattttatggcaactgaaaaatgttttataattagttccgtccatctctaactcaacccaattaaccaatcaaagaattttccgatcgctttttacgatcgttgttgtgaatattggcggttatctaattgtatttttaaataatttggtaattgtacctatctttggcaacaatttattggcatggcacgcaactcaaattggtggcattttgatgcacatcagtgcctcatcaaatggccccattctttattggaggaagtaaattgaaaaatatatttaaattttttttattttttgttttttagtttggaatatcgtaaggcatttcacaaagaatttgcatttgtattgaaaatattctgcaaaagaagttctgctgttgttcctcagtaataaaagcgattcattaaatttgcaactattttttgttttattattttggttaaaaattaataaa

SEQ ID NO: 72947 - DNA, 731 bp, Heterodera glycines
  Genomic contig location: Contig_ID=SeqID_9922; Location=145..875; Strand=+
  SCN-specific regions: Sequence locations=1-217,307-324,346-359,381-731
  Gene Ontology: Biological process=positive regulation of body size
gctctgtgggacagatatcgagcaatgtttgcgcttagaaatttgaacaacgaccgagcaacaaaggcattggcggacggtaaatttggcactcaaaaaggggggggggtgaaatattaaagtaatttaggttttacattttcctttcggtaattaccattgaaaattgaattgtgtgcccatgaaaaaacgcattgtattgtaagaaaacttaaagaaaatttttttttgaaaactatattattataaaattttgaaaaatcgcggaaaatttttcaatttttttttgttaaattttattaaaaaggtttctatgcttttttgagaaatttttaattttgtttacaattactcgcctctttcccaaggtttgctttgtgatgacagcagtgcgctgttccgtcatgaggttgcctatgtgcttggccaaattcaatcgcccgtcgccatcccggcattgtccgctcgactgcaaatgcacggagagaatggcatggttaggcacgaatgtgccgaggcactcggctcaattgcaaccgacgaatgccaacggttgctgaggcaattcgttggggatgaagaggtaatttgccgggaaagatggagatgaacaagggattttgattaatgcagtgggtagaattctccataaatttgccttccagagagttgtgcgcgaaagttgtgaggtggcgttggacatcgccgagcttaatcggacggacgaatga

SEQ ID NO: 72948 - DNA, 1037 bp, Heterodera glycines
  Genomic contig location: Contig_ID=SeqID_9923; Location=237..1273; Strand=+
  SCN-specific regions: Sequence locations=1-191,214-1037
tccgaatttacggcggacgatgtcggaaaattgtacaaagtgcccagcaatctgatgaacgtattgaatgtcagaaggaaaatgccggagttcttcgtaagacaattggacacgttgcgcgaatgcgtttggctttaccgtcagcaaacgcaagaagtgagaaaatggacatttgggagaaaatgccattggcattttcaaaaaatatcaaattaaaagtccattcgctagtgtttaggctttccattgtcttcacgaggtcgacttggctcatcggcccgcccttcgcctcgtcctttggggccattttggcaccggaaagacaatcactttgagtcaactgaaccacttggcaattaacaaaggatacatcattttcggcgtaaaagatggtaatcaattatctcatatattaatatttctttttttatggatgggttttcccgtcttttaaaatttcgaataaaattcttttagcgttgcgttggtctcgtgacaattaccgtcctgtacaattgtccacgtataaacccggtcggttggacagtccatggtgggccgtccgtttgctgaccgccttcaaagttgagaatggccacgcgtggaaaaaactcgcggttaaacacaacaaattttccgtttttcactaaaattttttgtaggaattgaaaacaacgaaagattacgaatggacaaaggtggaaaagacgccgaagagaaagcctttgacggacattgtcgaaatggtaaacaaacgaacgacggaattcacttctaaaatttagcgatggattttattttttaattacttaagtaaacttttcaaaaaagcggagttcgcattggttattcgtcgattggtgagaccgtttagcactcgttcatttttgatttgttaactcagaaacattcgcaacaaaaattaagacaatccgctgattgactcgctttttcagggtctgaccgcccccgctttgtccaccgattgtgtgggcgcactttgtcgcgaattgcgcgcgcacgcctccgccggctca

SEQ ID NO: 72949 - DNA, 125 bp, Heterodera glycines
  Genomic contig location: Contig_ID=SeqID_9924; Location=810..934; Strand=+
  SCN-specific regions: Sequence locations=1-125
gattgcacgtaattgccgaaaaaattcgagaccaatttccgaatgttgaccgactaattgcaaaacgaaagccgtctttgtcaaagcgccttaccgagtcaaaaaattggaaatgtatctcatat

SEQ ID NO: 72950 - DNA, 200 bp, Heterodera glycines
  Genomic contig location: Contig_ID=SeqID_1347; Location=80..279; Strand=-
  SCN-specific regions: Sequence locations=1-200
atggagactgaacccatagaatcaacagcggaaaccgctgaaccgaacgtcgttgacactgatcaacatggcaacgcagaacttcgagagcgctttcttcgtttccttcagttgttgccgggcagatcagtggatgtaaaattgtatggcgacattcaagttggtggcaaatttgttgcggcggagccaagcagtttcga

SEQ ID NO: 72951 - DNA, 588 bp, Heterodera glycines
  Genomic contig location: Contig_ID=SeqID_1347; Location=604..1191; Strand=-
  SCN-specific regions: Sequence locations=1-131,155-310,334-401,424 -457,479-588
  Gene Ontology: Biological process=locomotory behavior
tttaggtcgtacatttatttttgttgcttcgatgtcgccaaaatcgtctcatgtcaattacgatcttctgccggaaatttctcacaccttccgcagccctgaaccccgaccatctgttctagtttctgacatgttttctgttttgtgtgcttcgccgcttatcatccttttccttttggtaaatgtttaaatttggatgttttttctacataatttttactttttagtggcttcgtattggcatcaattttggaaaattcaagttttcgctcagtgctcttggtaaataccactttttaaattctctgtcatattattattgttttatatttgtccatttttagggtttcatcttggtctgtgtgctgtttttgggctctacgttttcttctggctcgagttgaacatgttccagacgttgaaatggctggctgttattggcgtgcccactttgttccttggaagtcgtctttccttttaaaaccaatgctttaaagcttaacacaccgttttttgggatatattgtatttcttaatttatatgttggtaaataatattatggttttttaaattccatttataataaa

SEQ ID NO: 72952 - DNA, 3663 bp, Heterodera glycines
  Genomic contig location: Contig_ID=SeqID_1347; Location=1968..5630; Strand=+
  SCN-specific regions: Sequence locations=1-5,28-231,253-757,779 -1042,1074-1326,1363-1534,1565-1679,1702-1738,1760-2070,2116 -2395,2435-3070,3092-3245,3273-3395,3417-3587,3609-3614,3648-3663
  Gene Ontology: Mol. function=protein tyrosine kinase activity; Cellular component=integral to membrane; Biological process=TGFbeta ligand binding to type I receptor
atgacgacgaattgctatgcaaatgcaatcattttgcgacctgcggtaaggtaacaattttttttttgcttgttttatttttattttccttaaatttctttttcttgttgtcaggaaggtgtggcgagttatgttggtgaacagtacatggacgtgtgccggcctggtcgaggcggatactgtagtcgggtagtgtttttgaacgcggatggcacaattcgggaagtcatcacatcgtgagtttctaaaaagtttttcatataggtattttggtgagcgattgaaaatttaacaccaagttttcacagtttattatgacgaaaaatttacagaaaaaggaatcaactccaatttttcgtgggcccaaaacaacttaaatttaattttttattgaaaccaatatagattgactatttttagtgttgcagttgtttgtgattcggttttgcgttttaaatttgaattttcggcactttttgttcgaatttgcaattcgaaagaggccaaaatgaatatgttatagtacaatataatccttaaattgcggccttatacatgcgtaatttttcattcatttttcactttgtttagctgtttgaaacgggaacaactcgtgcccagggaattgccattcgtctgccaaaattcgaccactccgcaatggaacaaattggtgaactgttgcaagtctgaatcattttgcaacgacatccaagtaaataaattaaattcattttttatgttagtttgattaactttgaattttacaaaaaatatatagagcaagcaaattttcagtttcccattgaacttggtcttcgcaatggctttttgcctgaatccttcgatggtttgccatccgtttttctgacccttctcatttcgcttgtccttgtgctgttgtttgcattgagcatttgtgttgccatttcctgttgctgttttcctcgaaaaagggctgttgttgaccgatgcattggttggttggtgcagtgccgttccccaacattgaacaggtttttttgcgattgaaaaaattgtgaaattttaaattttgattttttaaaaatttagttctaaggctgattgtgaaatggacagtgaaagtttatgtggcgcaccgatgggccaattggcggaggcggcaacattctcaaccggatcgggtatatttataggacattcagaaaggttcctctttctcaaaaaaaaatcagaggttattgatagggggtgttcgttcccctccccggatcagttttaagaaaatttcaagaaaaattttggaaaaattttttagcgattttttcaaagattcaaacgctgaatttttttttactaaaattttctttttaaaaaattgaggctgggaaacgactcctaattgatggataaacatacgccctttcgcttttacgatgttttgattttgtgctccgtttcgctatattctggaaatacaatacaattttatttaggtatttaataggatgcccccaaactccccccccccccctccttcccttattatgcctaaataaattaaaaagattaaataaaaattgtttgtttggatcaaggttccggcgttccaatgttggcaccgcgcacaatctcttaccaaatttcgctgcaaacagtgattggtaaaggacgttttggcgaagttacattgggcgaatggcgtggcgaaaaagtggcagtcaaagtgggttggattaattgaatgaataggaccaaattttttgtgtaaaacacattttttttgtgaatttttaagttatttctcggccatgtcgtcccatattaaattcttatttaacgccttttttattacatttttttaaatgcatgagtgcaataattgtgttcattgtcagattttcgagtctcgtgaagtggcttcgtttgatcgcgagacaacaatttaccgggacaatatgctacggcaccaaaatcttcttcgctggatttcaagtgacactgtcggtgggttcatttgataattttcaaatgggggtactacattcccactgtctcgtattgttacccccaccctcccgaaatttcaaaaattaaatttttttttttaaaaaattcaagaaaattttttttctatacgggttgcttcgtgatcatataaaatttggaaaaaatcgccagaaaaaccttacaaaaaatttttctttaaaatattcaatgttaaaactaaaaaaacatttcattgacagatacgggagaaggaataatgcattggttggtcaccgattattgtcccaacggttcactgttggaccatcttgaaaacaacacgctcaacacacaacaatgcctccaattcattcgctcaattgctcacggaattgactatttgcacacttcattgactggcaacaaaaatttttgtaaatttttttaaataaatttttaaaaagtaagagtttcaacatcatcaacaaaaaacaaaaaaaaaattttcagttaaaccgtcaattgctcatcgtgatctcaagccggggaatattctcatcaaaaatgattggacctgttgcattgcggatttggggatgtgcgttcggttgaaaagcgacggaattattgacaggcccgagggtggcgacagagggggaacggcggtgagaatttttggggttttttcgcataattttactacatcaactattgtattattgtaataactaactgtatggtggacctagagcacctgtttgttttttaataatcttttgaaagatttctagcgcttttttcctaaatttaatttccatttttcaaaatttcagcgctatttggcacccgaatttttggacaaatcatacagcaatgactcaattacctcttacattcgcatggacatttacgccctggcactggtcatttgggagatttgtcgcgttggtggaagtgaacaatttggtgggaaaacattgggcggcacattaggggtgaaatttttttttccatttttaaggtttccgcattggactatcaggtgccctaccaagagtatgaattgacgagcactcatccgagtccggacgcaatgaaacaaattgtttgtgtggaaggactgcggccaaccattcccaaagaatggtcgaaaacaaaggtatgtgcttttttttacaatttttttttattcttttaaaatcaaagtatgccatggaaaaatagttcgggtttcggtacgggagaaatgtctgatttcgggcggtaaccccctgtaaaattaaaaatatcttttatagattctcgaaaaatgtatattcttcattcattccctgaaaagttttcaaaaaaaattgaaattggttaaaacattaaaaaatctttttaaatatgaaattcagggttaaaaaataattctaatataaaaatgattgtgaaaattaaaatttttctctcttcggcacatataaaatcattttcagatactcaccgaattcactcgggtcatcaaagagtgttggaatgccatgccgcagtcgcggctcactgctttgagcattcggtgcacaattgacagaatttgcacggaggagaacatcataatcaccaccacataggcacaaatgccaacaaattcctatcccttttttcttttctttttctttcatttcatttctcactcagagagactga

SEQ ID NO: 72953 - DNA, 873 bp, Heterodera glycines
  Genomic contig location: Contig_ID=SeqID_1347; Location=6015..6887; Strand=+
  SCN-specific regions: Sequence locations=1-186,254-477,512-818,840-873
atggtgagtgacatttttatggcgccttggtgatcaaaaaaaaaacaatttcccataaataatggcaccaattttctgtttgccaggtcgaaacggtcatccaacagcagttcgatgatcaggcaaaattggaaaagcgacgggagaagcggcgaagacagcgcaaacggaagcgaatggaacaacaggaaaaggaaggggacgacaaaaaggaaggagaaaaggaggaggagcaaacagaggacgaagcggacccatttgacgatgagaattacaccgtcaaacagtttgaggaggaggtttggctgtcttaatttatcaaacaaaaaaattgggatttacgactcaacggacgcgacatcattttgttttttggggttgaaacatgaaaattcttgtcagatcggcgaaattttagagattttttggtcattcaattaaggagtgcttttgagattcgttttcaaactgtttaactgtatttctttaatttttgttaatttaattaaacgacatcaaaagtatttctgaatctctaagtttcgccgatttgacatttattttttcgtttcaacccaaacaacgagctggaatagaacaaagagttgacactgaatcaaacacgagacgatacaaaaactgcaatgttattcaaaaaattcaggctgaacggatgcgcaaaaagcggatgggaaccgaattagatgaggacgagcgcgaaattaggcatttggaagcaaaactgaggaagaaagggcgcaagaagggcaagaaagagttggaggaggacggagatgaacttgatgagttggagaaggccattttggggggtggggaaaatgattgatcactgatcaccctttttaaaagcca

SEQ ID NO: 72954 - DNA, 444 bp, Heterodera glycines
  Genomic contig location: Contig_ID=SeqID_1347; Location=7023..7466; Strand=+
  SCN-specific regions: Sequence locations=1-444
  Gene Ontology: Mol. function=RNA binding; Biological process =regulation of cell cycle
atgttcaagaaattcgattcggcagatgatgtggtcggttcccagcagctcaaaggatctgtgcaggttagtcaatctgataaaacactgatttttctaccagtgtgatgatgtcgaaaacagcaattggtttttaattatggggcctatccgaattttttttaacgatgcgcgaaataatttgtaggtgtgcccgtgctgaaaaagtgtaaccaaatacatattccccgttacaattactgagttaactcttaatttaattgacagaagtcaatccgggccaagctggttgagcagtatccgagcattgagccgtacatggacgccattctgccgaagaaggagaacttcaagttggtcaagtgcaaggaccacctggagctgatcgcggacgccaacggcactgtccacttcgttaaagtgggcattttcaatttaaaataa

SEQ ID NO: 72955 - DNA, 785 bp, Heterodera glycines
  Genomic contig location: Contig_ID=SeqID_1348; Location=1..785; Strand=+
  SCN-specific regions: Sequence locations=1-269,293-391,436-559,583 -587,610-630,663-785
  Gene Ontology: Mol. function=RNA binding; Biological process =regulation of cell cycle
tgatttggcaaattatttcccaactctgagactgctgcacaaatacccgttcatgcttccacaccaacaggtgaaaaatggtgggggagggattcaatttaaatgtgcatttaatttgactgactctctaatgcaattgaaatttgaaatttctgtcaagggcatagtcaaaccccttggcttcggcttttcttttttttcaatacgttttttcaaaaaaagcattttcgaaatttatttgacctccccccttccccccgcaaaaggtagacaaaggtgccatcaaatttgtgttaaacggttcgcatataatgtgccctgggctgaccagcgcgggcggccgacttttggacgattgcaacgaaggggcattggtcagttttacaataagaattaattatttatcaaaattataataataattattatttttttgcatattattgcataggttgccattatggcggaaggaaagcagcacgcaatgggaattggacaaatgaaggtaaatttggattggttttctcataaaataattgatttgcttacatttaattgtaatataattttcatccttcattcattccggtttaatttaattaattaatggacgaataaattatttcatccattaaaatattcaatttaaaatttaaaaaaatgaagctaaaaaatgccctcttttttagctttcgtcggcgaatgtgcggtcacaaaatgttggcattgccattgacaatgtccacttcatgaacgacgggctgtggcgattaaccactgttcaa

SEQ ID NO: 72956 - DNA, 1808 bp, Heterodera glycines
  Genomic contig location: Contig_ID=SeqID_1351; Location=1417..3224; Strand=-
  SCN-specific regions: Sequence locations=1-14,36-138,160-216,238 -255,278-705,727-1374,1396-1451,1473-1808
atggcaatggttggcacaacaacaacaaattcatcttctgattgttcgtccacagcgacacggccttttgtacacatcaacgtgaatacggtaggtattttaacatgagtacgatagttgttttacggtggttcatcattggttgcaaatatgatacagttgtttcaacatggatatggtaggtttattagtttcgtggcacaattaattgtctaaatatgtctaattgcgatggaaaagtgcttaatcttcgttacattttcaaataattggcactaataatatttttgattaccaaagtttgttttgcccaacttctattgggtccgtcattttccaagaatcagtagtgccaaaactttctaattagtgtttgccaatgccaattaattggtctgatgttcgggcttttacaaaaatccgtgccaattaattggtctgatgatccggcattttaaaaactcgtgccacatgccactttttcacagtgccaactttctcattagcatttgccaatgccaattaattgtcatctttttcaaacaaccgtaaatggataaatgcaatacaataattagtgccgcttaattgcacggcacgtaataaaaactaatccggttgcttcccaacttccctaattgccaaacattggcacggttttcgacatttttgctgcttggatggcattattcaaaaaatgtggcgcctttttcaggtggaatatgccgtgccatcggagtaccaatttgtggactatttgggcggtggtaactacggcaacgtgatgtgagttgagcacatcctcacattccacagcagacaacaccaaaaggcatttaaaaccaacaaattttatttccagcacaatttatttaattagggttttgtcgatcaaattgtttaaaaattcaaatcctggcacgggtttctggattttgatcgtaaatgggtgccattttactggttggtcatcgacccagaaaattcatagcttattgttataaacgtaaaatgaaaaaactccgcggcatttttttgcctttcagtgtgccattggccaaaaaatcggagaaaaaaaattcccaaattaaatccggcattttttggccgttcattgtgccattggccaaaaaatcggagaaaaaaaaacacattcccaaaattgaatttggcagcaaagtgcgagcagcgcaaggcgtcgaattggcggtgaagaaaatgtacgagccattcagcagcgcgatcaaagcgcgccgcgtgttccgcgagttgaaactgttgcagctgatcagccatgagaacatcatccaatttgtggacatgtacacgcctgacatggacgacaaatgcttcaaaaatgtgtaaatataatggaaaatactctcattatttaaaaaatcatcaatatgatttgatgaaaaattattgataactttcctaaaaagcaaccaaatttttaattcttgatatcattcgatagccctaagtgttctctatcattctacaaatttcaaaaaatttcatcaagtttcaaaaaaattatggctagaggaactcaaaaaacctgtacgaattggggacatttttcttttttcaggatgacaattggattggattttttgacatactttttttttcatattatggcacttcgattgggtttttctcggcatttctctttctcattcgatggcatttgtgccacacttttctgttggcagttacattgtgtccggatacgctggcgtcagcctaaagcaggtgttggaccgacaaaaacagttgggccaatcgctgatcaaccatga

SEQ ID NO: 72957 - DNA, 747 bp, Heterodera glycines
  Genomic contig location: Contig_ID=SeqID_9925; Location=32..778; Strand=-
  SCN-specific regions: Sequence locations=1-114,136-747
atgaattttgatgaacacgggcaaatcaacgtaatgagcagcgagcacgcctactttatgctgaaggcggcgcatttcggcgacatggcctcgttccatcacatccgccatgagccaacgccggcggcggcaaaacggcttggccgtcacatcatgccgtttgtcgagcaaaaatggcacgtcgtccgcttcgaattgatgtgccgtgcgctgcgtgccaagttcgccgttgagcccttgcgcagtgcccttcgaacgacgggctacggccaattggtggaggcgtccagagatgagtattgggccgctggacgcgagatgcacgacgtcggtttaacggctacggccaattggctcgggcagaacgctcttggtgaagccctcatgataatccgagaggaggtgcgcacgcacccaccgacaccgaacaacttggtgcggcattatgtcgtcgcgcaagcttcggctgaggattacgtcattgtggcggcagcctttgatcatgagcccttctttgttcgcgttggaaacgacatgctgcaaggcctgggtttgcagcgcaatctcgccgttggagacacgctggttctggttggctactactggagagcagctttcgaacaagtagcgcagattggtcatcctacgttgccaggctggctccatcaaggccaattgtgcgtcaagcggaggcgcagtcggtgcagaatgtcgtcttggtgccatctttcgtcatgccaggagtga

SEQ ID NO: 72958 - DNA, 2898 bp, Heterodera glycines
  Genomic contig location: Contig_ID=SeqID_9925; Location=1287..4184; Strand=-
  SCN-specific regions: Sequence locations=1-1072,1095-1288,1312-2898
  Gene Ontology: Mol. function=ATP dependent helicase activity; Cellular component=polysome; Biological process=mRNA catabolism, nonsense-mediated
cgtccgctcctcccaggtgataaggttttggtcaacgggtacgagtacatctcgggcaaggaattcttggataagtccaaatggatttatgccggtttaatccaatgtcaggcagtcgtgacgaaagtgacaaaagttcgttttgcaaaacaccatgagcaatatggcatcgtcgttgatctcacacgccgtggcagagcgtctgaagcaaccattgggtcaatttcagtcactgcatatggtatggtcagagctatggctctttatgagcgtcagcctctcccggacactcacatggcaagtttgaaaaaggctcagatcattaaattgaatttggcaaaagttcctgaggcctggtacgttggtccgaattatgtcttgccaccaaaaagtccggtaaggtctgggatggaattgtttgcggactttgggactatgattccggctacggccgacctctttgaccgggattggttgcgcatggattccatgggaattcctgtaatttttccctttgtgccggagtacacggacgaagaagtgaaaattgccgaacgtattgtggcagcagccttagtagcagcttctgagtatgaggaaatgctgaaacttgtcactcaattcgttggagttgttcggccgcaatgggaccaaaacgctgacgcggatggaaatgaagaattcccgaaatacttctggctgaagttccagacgaaggacagaaagcttgtcaaacaacttgtcaaacaatggacaacggactcccccgtcacggcaaaaatggaatttgatgctaaggcatttgcatacgggcaagttattctgattaagaagtcgtcggaaaagactgaagaaggcagtgacatattttttgttagtgttaaagttcgccttggacaccatgaaagtgatggtcaaataagcaacttcagaaagatggtgaatggtgaagaaaccatcattcaatcggttggtgcttctgttggtttctcagaccatgctgattgcttcggcacaaatgaaccgtctcgactggccgaagaggattcaccgcgaggagagatcatgaaagcactcctcgccaggcctggaagaagtggactgaaagtgaccactcaaaaactgattgattatggtcttggccaaaagacggcaatgccatcagtagcgcgacttaacgaggaacaacaacaaactttggcactcattgcatgtgaccttcctttggttgtgttgcagcaagccccgccaggcacaggtaagacactaacattggctacggccatcgaccttcttttgtcggagaaaaatgaggaaacggtcattgtggcgacagctacgtctaacctttctgtcaccaaaatggtggaagaaactcgggcagttggagtttcggaggaacacttggcactcttcagtggaacggccagagtgcgctacggcgagcaaattcaaccgttggaaagaagtctgctacggccaagactcacgcagacattcttggaagaagtcaaagacaaaaaggacgtaaagcaatttgaggactacaaaaagcacgtgtttaacacacctctgcgggtccgagaagcgaaagtggctgaaagttatctgaaatacgacaaaaggaaagtcattttcctcacgactcacatggctggtcgcgtcaagggtacgataaattgtgcaacccatcttcttttggatgaagcaacgcaggcaagtttcaccaccgtagtgagtttggcatgcggggcaccgaatctcaagaaaatgatggtcaccggggacgtccgtcagcttggcgtccacttaagtgaactgcaagaagtactctggtcaggcttcggcctcgaatcgatcacggatcaactgctgaaatcgccacgaatggaggaaactgtactgaaaagatgctacagatcacacggaagtttggttgaatgcgtctccttcgcatcatacgtgccacacggagaagttctgttgccagtggaagcagtgaccaaagcgaggacatcactcacaacttcggcaatcaatttgccaatggctggaattccccttgtgctaattcattccgaaggtcggattcagatggatgaaacctccttttcgctctcaaatgttgagcacagaaggattgcgcaggaagtcgttatgattttggatgcaaatttgccaaaatcgaacacaatcgtcatcatctgcctttatctctatgagaaggaacaattggcttcggccatgagggaagcacgtgaaaagaagatgctttcacggaccatcgaagtccacactgtggattcgtatcaggcgaaagaagctgatttggtgatcgttgtgacgacgaaaacggcggctacggccgatcaaaacccgtttggctcttcaagaatttcaggattctttcaagacagccatagagctacagtcgcgctttcacgtgcaagagaaggcatgttcttgattgcggactttaacacactgatggggtgcaaagtttggggccgttttgttgagaaagccaaggaaatggtgccaattttcaatgaagaatatttgcgaatgatggaaagcaccaaaattaagcgcgtggatggaattttggctaatttaaatggttattccccaattccctccagcggcaaatttacgaatccaacagacgctcgtaacccggctgggggaccggtcagagggcgctcggttggctggcgtgcatttgctccatcacagatacgagcatcacactctgaaaggccacggccgtcaaatcgcggtcaaaacagttttgaccaaggcatcttcagtaggcaaggaacccaaaacattaccaggggagcctgcttcaactgtaagaaaagtggtcattggtcccgtgaatgcccgtcaaaatga

SEQ ID NO: 72959 - DNA, 1678 bp, Heterodera glycines
  Genomic contig location: Contig_ID=SeqID_9926; Location=3113..4790; Strand=+
  SCN-specific regions: Sequence locations=1-442,473-1587,1618 -1621,1643-1678
atgcaaacacccgcagacacaacaaccacaatcgtacttcgcgaaatgttggttgatcaacaacagtccgacgacaactcctccgctccatggccgtccattgtcaccaccactgaccatgcccacccgtctttgttggtgttcccaatgggtgtcctcactgtgctggcacttttggccaacactgcgctgaccgtttacattgtgtggcgccgtctctaccacaactatgtgtcctcccaattcattttgcacttgtgtttgactaacattgtcgggctcagtgtgctcgtcccactgttttgtgtcaacctgtggtcgggcaacaacctttgggagaacaaccatttgatgtgccgaatgcaggtggtggaggatttgatttcgatgcaaaaaaacagggcacaaattacatggcattctttctggatgggcaaaaagtgccaacaacaacaccaccaccacaacacttggcattatttgccttttagacatttatgatgtgctcagtgtggaccgtaatccacttcatgacactgtgcatcgccggcgttcatctgttgacttttgcgcgcattcactacgcccaactgtttggacttccgccagggtcattttaaaaaaaatgatttgaaaatggatttaaagtggaggtttctcgctggtctaaagaatcgagagtctcgaaaacgtcactgtattcgcgcaacaactcaacattcagatcgctgtgcgcactggcgtggatcgccgcgttcgcggtcgcactgcccagcctgaccaactcgcacatcgttgtctacgacccggcactgcgccactgcgtgtggggcagcaccgactacagctacaagttcttggcctacatgctgatcctgtgcgtgctcatcccctccattctgtcctacttctgctacatcaaagtgttgaaaattctctaccactctccaatcgtgttccagtccatcggactgtacaagagtcgctttttggtctacgcctttctgatggggtaaggcactaatccgtcacattccatagatttgattagaattctctaaattttccctgcttatcggcacaatcgagccatcaacttcttaaaaatttgatccgaaatcctttgcttaattttttagaccaatttttttaaaaacggctaaaatccaattccgtcgatggcatccccagactcacaatcatcatagaaaatgacataaaaaaattcaaattatgcattttaatcaaatcgccgataaaatcccaaaaattggtccttcactacgcatcgcaatgatcagaaaatcagattttctcatcgatcaatccaattgcttggcactcatttgtcagtcacagtcaccaattgttcaggccgctctaccaggcgcccttctacataatcacaatgagcggcacgtggcgctttggccacggctcggtgatgcccgttttggccatgttcctcggctacgcgccatcaatggtggccccgtttgtgtacggcctgtcactgttccaaatgaaggaggaggacatggcaatgaccgcaagggcacacaaaacaatgaacacggccacttatcaccaccaacatcagcacaaccaacaacaacagttgaacaactgcagcaacaaccgcggggcaacacaggaggcaagggcacaacttttgtag

SEQ ID NO: 72960 - DNA, 897 bp, Heterodera glycines
  Genomic contig location: Contig_ID=SeqID_9927; Location=149..1045; Strand=-
  SCN-specific regions: Sequence locations=1-69,278-486,509-897
atgtcaccggttcacctctatttgcttggtgttctgagcaaaatgcaatcatccaacagacttggtgagaaaaaatagtttttaaaatttattctattatatatttattagaaattttataattcaataagataattattgtcatattttaaatataaaaattccataaaaaagaatatattaatatgaatattttagtaaaaaacaatatgtatttataatttttcattatttgaaaaaattaatataaaaaaattaaataaaaatataaaaaattcagcctctgtcggcgaaccaacattgcatctaccgcctgatagtgaagagcgtcgcaaactgattggcacccgtgtgggggaccaccggaatgaacaattgaaaaaacggggccccgaaattgggagcattgcatatatcgtacaatgagtaaaattaggcaatacatcacagagggtggttagacacattcttaggaatacttttggaaaattcttagattgtaatttttccacagggaaattggtgtgttctttaatgacaaagacatcctttgaaatatagccaaaaaataatgtaatgtatagatatgtcaacaaaaagctcgattttatttaaataggatttcgataaatttttatagacgacatttactgatcgactttttcatataatttttaaaaaaagagaaatatgcatcggattccggacaaatgagcgcatagggaccctaagtggtgatacagaccgaatctcggtcccaatcaatcccagatgaatgtaaaaaaatattcgggacagatcccaggtggggatcccgagtttaatcccgatagactcagagaaaaaccaagggacgcccggtcccgtgcggtctctcatatgaaagcagacaataaa

SEQ ID NO: 72961 - DNA, 936 bp, Heterodera glycines
  Genomic contig location: Contig_ID=SeqID_9928; Location=47..982; Strand=-
  SCN-specific regions: Sequence locations=1-178,373-398,430-503,538 -620,692-750,772-936
atgtttcaatcgttggcatttttcatttgcctcaatgaactcacaaacattggttcttcattggccctcaaaattttgtttgcccatccggcatttccgcctttcaatagtcactttgcgtttggtctctcattggccaaatcattagcaaatgatggtcacgatgttgtaagttttgataaaaagataataataatattcattattaaaattattaattttttttttcatctagaaaagctaaatattaaagatgaaaaagtttttatttaaatgaatgttttttaattatctttaataactttaatacatgcatatttgtattaaatttaaaatgaatttaaaaaattatcataaaatttattaatttttgtttatcattaacaaaattgtaagagaattttgtttttattaaaagtttctttttaattatctttcattgcttaaatgcatgtacattagcaaggaataattataattacttgactttattcatttctttgaataaataattaattttttaattaatttaaaattgtttatcatcaacacttttttattggctgtttgtgctgtcctgaaatattcgtaaatccatcaccactggcagatttatgaacattaatttagttttaaaaaatgaattttttaatttaaaaaaaaagattgaattataaaaaaaaatatttttctcgcaattaacttttttgtgattgaaaagaattcctagcaataattctgattgaaactgtgaattaattttagcacatgttagcaacaattagagcggaaggccaaaagctcagcaatgaaagtgctgataaattgacaatgcattataaaatgacgaaatcgaaaccattagaaatgggcagtggaaaattggagaatgacaccacaaatattggtaaaataaagttaaaaatcggaaattag

SEQ ID NO: 72962 - DNA, 1394 bp, Heterodera glycines
  Genomic contig location: Contig_ID=SeqID_9928; Location=1394..2787; Strand=-
  SCN-specific regions: Sequence locations=1-14,36-39,63-152,203 -477,499-500,522-666,712-810,834-838,865-932,1124-1258,1290-1394
atgcaaaccatcagagaactggagaatcaaaggcagaagattactgccatgatcacagacagtagtgatttgaaaatgggattagtgatttcaattttggattgggtgggacgattgttgctgttgctgcgatcagttctgatcactgagccataaaaattaattattatttttttctaattgattaaaattttaatttttaccaatcagcataaattcccatgattatattagaagcaaccaaaactaattcgtcttgaattatcatcaggcccaccataaacaattcttttaatttgaaaatttttaattaattcgacaattaaataattcattaattacttttctggatgtttagagcaaatataaatgacagataaataatataaaaaacgattgacaaggaaaagacatttgcaattatcacatattttccagcgaaccttgagatgttgcgaaagcttaattaaaataagtagattaaattttttgagtttttaagaatttaaaaaattacaaaacggggaatgccattgccacaaatgatcaacgcttatccaaaacagattgataaaagaattaatatttccagtgactgcaaagaattgggcataaccacaagtcaaatgaggaatccggacgcggagaaaaacaaggaataaaagcaattaaaaattgattaaaaaaatgcaataaattttattatttttactggtagctaatggagtggccaattgcgtcactcagcgaacatatggccaaccgaaagctgaaattcactaattctttcttaaatcgcttaaaaatttctaaaattttcatttattttccttcatgcatttaaataaaaaaattttttttaaagtcaatcaattggcaatatttaagtgctggcaaattcgtcaataaaaatgacttatacaagccatatcaattaaaatttatataaatatgcatgcatatgaatgaaaatattaatattattatagtttccaataaaatattttcagaaatatatacattttatattttttgcttatactttttacattaaaagaattgcttaattttatacaatcaaaaatattttattaaattcttttttttcattatttaatatatagggattttctaatacataataagattaaattttgtttaaaaaaaacaaaaagccttcacttaacgccaaaaaacgaatgttggcataccgttgccttgcttcaaattatgttgtaattaaagcggagaattgtcgatttttatagtttttttaaaattttttattagttctcattatgcacctattccttcactaattctttagtaaatctcttaaacattttcgtaaaaatttcattttttctttaatgcattttttatattataataaa

SEQ ID NO: 72963 - DNA, 68 bp, Heterodera glycines
  Genomic contig location: Contig_ID=SeqID_9928; Location=4178..4245; Strand=+
  SCN-specific regions: Sequence locations=1-68
atgatggtctatcccccatccgaactgatcgacatccttctggccaacagccgaggcggattggaacg

SEQ ID NO: 72964 - DNA, 752 bp, Heterodera glycines
  Genomic contig location: Contig_ID=SeqID_9929; Location=1776..2527; Strand=-
  SCN-specific regions: Sequence locations=1-247,272-399,435-449,488 -609,634-752
atgaaaatggagcaaaaggaacaaaaggagcaaaatgataattcagcagcagttgatcaaatgggtgaagaaatgggaaatgacccaaatgatcaacgaaaaagagaaatcataaaaaaatttgatgcaattaaagaaaaattgagagaaaaaggaaaatatcaattgaaaaatgacacaaaaattgagcagaaaattggaaaattattagggacaaatcgcagtaaaatatacaaatggaaaaacgaattaaatttaaataaaattaaaaggatggaaaagagtttttatgaacaaaaaaagaaagaattcattggacgatttgctgaatttaaaagtttatatggccaacgcaaacagaaagaatttgtgaaggaattgggcatttctgaatttacattttggaaatggaaaaaggaattggtgccaaaatacaataaaagtaacagatttttataattatatcatttataaattttcattttaagcaccatattccaatgaggagaaatttaaaaagatgaaacaatatttcaaattaaaaaaaagaaatccaaaaattatcgacaaaaaaattgcaaaaaaattggaaattggctatgaaacgctaagaaagtggaaaaagaaatttgcatcaatttctgagatgtgattttgagggtattaatcggctcaaaaatttttttaaaaaacctaaaaaaagttttaatgcgttgattaaaattccctaaagaattctttcacccaataaa

SEQ ID NO: 72965 - DNA, 2423 bp, Heterodera glycines
  Genomic contig location: Contig_ID=SeqID_9930; Location=1898..4320; Strand=+
  SCN-specific regions: Sequence locations=1-79,106-404,434-535,559 -1084,1106-2088,2112-2148,2170-2423
atggcagctgctgcagccaaacaaagtgcagcacaaatggaacagaatgccacaacaaaatcggacaatgccaaaacggagcagcagcaacagcagcagcagcagaaactgatcggagaggaggcggaaatgatcaaacagttgaaattggccgacttgaagtttgaggatttgaaggtgcatactgttagggcgacattttaaaataaactttgaactgatcagaatccccaatcggcgctgatgaaactgatcagaggcgaacggcgccaaattcaggcacatttggcaatttgcatggatttttagctttggtgtatttttaaaggatgaattggaaaatcgggttctatcggacatttcggaggaaagttcgattcggtccacgatggccaatgaacaccggcaagaagaagaagaggagggggagaaggacagtgacggatcaacgccaaagggaattggaggaaaacaggcaaaaacaaaagcaaacaaaaaccaattagggagattataatgctaattagctaattcgagagattgacctgctgggcttgggttttcctgtggatttatatcaatgctcttttaaaaagttaaacggtttagtaaagccttaaaaattgattttctaaatttttaaattgaaatttgaccctttggcaaacaaacactgccagtgcttttctttgacttccaattgaattttttattgacactgaacatttcacaaaatacagcgcccctgcaaattggaagcgctcggcgcctcgcgcgaggaggaaatgagcacgacgacaaccgctgaacacgagggcccctcctccagcaccgcgactccgctcgcctcgccggcattcactgccgaatcgccacaacagaaacagccggggcaacaccaacagcacttcttcggcgatcacgaagagagtgctgaccaatcggagagatcgaaaaagcgctgggggagggcatttgggacaaaaatcttgaaaattgagcccaatcaaagctgaccattcttagtttaagcgaagaaaactgtggttgagaaatgcattgatcacttaaaagccgatcagtgtaattaaattttatttaaaatgcttttcctatttaaatgagttttttaggctttgcctcctgaagtgttggatgagagtgagcatcagttcagcagtgaaaatttgccgctgaatgtgtccgcttttcgcgaagtgccgccctttgccaacggcgccgcgttggacccgcccgaagtggcaaaagccgcgcttggcctcaagtcgggcaaatgctcaccgtgcgaagaacacacaatcagcgtgaagatcagcggcgggcgagtgccgtcgctgcagcgacaggaggaactgacggagagcgcagagccccctaaaacggtggatggcactgatcagcaacagtgggcacattgactgatcaacacattgatttttaaacttgcccacctttcagtgagccaactacgccgattgctgacgaacagcagccaatcgcagcggccaatggtctgatgaacccgctggagccgccgaacggagtgccgctgccgaagacggccgaggagcgcaagcagtacaagccgatgccggacacggagtttgaactgttgatggacgcggtggagcgaatcaaacgcgacaatttggccaagcagcaaaaggtgcgcgtgggatcgaattgactgcgcattcaaatgatttacagaagagcccgcacctgggtgaagagttggacgaattggagaagtaccggccgcaggacagcgcctgccgcgagttcgagctggaggtgcagcgtcagaagccgctgtacgacgcggacttcgcgtgggagtctcgctaccaaattgggcccgacactctgctgatcccaacgcgtggggcgcgcttcaatgcgcgtgtgcgcgactaccggcgtgagttgtggggcgacagcgcgccgttcgtctcgttcggcgtgctcggcgcgcgcaaccaggagatcacggtgcgcgagcgacgtcgctacaccgacctgatcagaggtgaccgatcagcaagcagaacataaaaggataatgtgtttttttaattaattttatattacagtgtatcagggttcggtttcgtccttgaatggcaaggacatcttggaaattaggccgtctcatttgtgaatttgaaaatatccttgaattcaagacggcttgaaaatgaaaatattgataaaatttattctggcgaaaaatataaaccatttggataaaatttaatcatttttcatcgcatatgataaaatttttaagtgtccttgaatttaatggaatttccccttatgtccttggaaaccggtatacccgtccttggaaagggaagtttattcgatccgaaccctgcagtatctgatcaaaagatcaa

SEQ ID NO: 72966 - DNA, 1011 bp, Heterodera glycines
  Genomic contig location: Contig_ID=SeqID_9932; Location=1014..2024; Strand=+
  SCN-specific regions: Sequence locations=1-419,441-870,903-1011
atgcatttattggcactttgcagggacgacccctccaaacggtggatgctttgcctccaattgttgccaagtgcgacgataaaatggcaaacagtcagccaacaacaacagagcccggccaaaggtgggtgaaaaatatgaaacccaggcaaaaggggaagttaacagcgacatttctgggaaaataaaccgatgtatttttgaacctattactttctcccccccccccccaatcgtaaagtgttgattttataggtttgaatggatatcattttgtttcagttgaatttcccgaagtcagttataagcaaagtgcgtcgactagaatttattggacggatcagcacggcattcagtcggatgtgcagagattgcaacgattacttaaaaggaccgacagatcggaacagttcaggcaggtaattccaacagtttatttcaatgacattcgcaaaatcccaggaattgagaagaattgcgacttatgcaaccgcgttgggttaccataattttgcgagtgtttttgcggaagtgatcgaacgaagggtcggaggtatccccgaagagaaccgagtgacgctgcagacggcggccaaagtgctcaggtggggcggggaggagatgctttggtggtcggttacatggcttggtacttatttggtttagggggacttttaacacacatttttaaattgcctataaattcaatcatggaaattttaactaatattcatgacttatttattcttctgcaaaatcctgacggtgaatttgaagaaattttttttgttaaaaatgtatgttctaagtaccccctaaactaaataagtacccatggcttttgtggcccgaacttttttgcctaattgtaagccaaattgtttttaaaaaataatttttcagtcccatatatggcataaaaaccattaaagccgagaatgaaaaatttgaacaatgctattgggttgaaacattaattgggactggttttggacatcataaatgtgcaag

SEQ ID NO: 72967 - DNA, 1120 bp, Heterodera glycines
  Genomic contig location: Contig_ID=SeqID_9933; Location=645..1764; Strand=-
  SCN-specific regions: Sequence locations=1-734,762-917,942-990,1012 -1120
  Gene Ontology: Mol. function=cell adhesion receptor activity; Cellular component=integral to plasma membrane; Biological process =cell adhesion
gttttgtccattttctgttttcaattgccctttgccaccgctgttcgtaataaagaaatcgacgatgagtatcaacgactgattcccctacggaatattccccaggggtgcgaccacgccaaaggcgtacttccggggacgggggacccggcaaaaggttcaacccgagaaacacgtttggttggctttgacatttctcgatttatagaatacggttttgttggcggtgggcttgagaaatgccaagtttggcttgagggcgacgagcaaagtgccagtgaagaggaaagccattacgagcgatacaaatgcaaacacctcaagggttggtcgggagatggtctgattataatacccaaaggctttttgaagtacatggacatttcaacgaggaaaagggcaaatgcgagtgtaaagagcattggaaggggccgatttgcaacggtgggcagacaaaggcgcgcagagatcagcgattgtcctttcagattacatcggctgtccagccaaccattccttttatatgggcgtgtgagtccctccccccccccccctcccgtgccgaacaattgcccctttcccatcagttgcacccccaacaattgccaacacgagggagaattggcactcggctccaaacatatcgaatgcatttgcaaggcgccatgggacggtcgcttctgcgaacgattggcatgttggagaatggcagagagaggcgagtgattaaatccattgaaacaaaacaaaacaaacattctctcccccgtccctctcttttgcctaattttggactcattcgcagagaatgaaagacggtggcgcaattcgggggagcactgtcgctgtgctgacaattacgagggcaccaactgcgagacggtggtgtcctgccaaaatggagaattggtggggggaaggtcagaggaagggacagatctgattggtcagaccgatcgaaaggaacgctctttcagatgccaatgtgcggagggatggaaaggcgaggtgtgcgaccggaaatgcattccgaaccaaacgtaaggggcgaacatttttgaattgataacgaatcattcgattaaaagacaaagaaattatagtaatactcttctcactt

SEQ ID NO: 72968 - DNA, 614 bp, Heterodera glycines
  Genomic contig location: Contig_ID=SeqID_9934; Location=291..904; Strand=-
  SCN-specific regions: Sequence locations=1-123,145-185,207-380,402-614
atgaacaaaatttactttcactatttcaaattaacagttcgtaaattagtccgttcggttttacacattttaaacttgaagtgccaattttgaccaattgtaacatgggggtcaaaaaatgtgcttttccccactttggcacctatatttaacaacaatgtctttgttaaaaaaagacaaatattttttctgaaacaaaatgcattcgatagaagaaagaaagggctaaaaattgatataaatgaacccaataattgtcgtattttagagaaataatcccggagtactcatttttatcaatttggaggtccatattcaaaaatcaatagctgcacgaaatcccgatttccaacatcagattcccgtaatttttgtgccatggaatttcggttttcctttccgaaaatttttggggtctcgaaatgctatccaattgatcacgagagcaagagttatctatggttcttcccctactatttgggaaaaaaagtcggggaactggtatcaaattccccgagaattatctataaggctaaaaaaattttaaatgttggggggggggggggtcaaaaacttggtcgtcaaatagaaaaaaatatttttctaaaaataaa

SEQ ID NO: 72969 - DNA, 303 bp, Heterodera glycines
  Genomic contig location: Contig_ID=SeqID_9934; Location=1887..2189; Strand=+
  SCN-specific regions: Sequence locations=1-146,179-303
atgataaacaaaatatggagaacctcagtgccaacattgtcagcagttccgataacgtataaaattttcttaagaattcgcgaaacttcgaatttttttcagagttccgaaagcgattatgaaacagcaaatgaaagcggttttgcaatttatttaattatatttattatatttttttgtttatagattcgaatgaatcagtagaggtcgatgaatcccaatcagcacaagatgagtattcattgaatattggaggtagtcatggggttacacgggtccctgggggagaacaaccgggtccgg

SEQ ID NO: 72970 - DNA, 1281 bp, Heterodera glycines
  Genomic contig location: Contig_ID=SeqID_9935; Location=78..1358; Strand=+
  SCN-specific regions: Sequence locations=1-364,386-629,651-947,969 -1023,1045-1246
atgggaaaaagtcgcggtcagtgagaattttgtgtaaatagaaatcaaaatatgaattcattagttgcttctatatgaattagcttttttttttgcaaaaaaattccttgatttacaaaaaatgccacaataaaattataatacaaaaaaaggatgaaatatgtctcatttttatgacacatttattcagtgaaaacaacaacttaaattggatagatattttttgaaatcgaaaaattaaacttcgtacacttcattatttaattggttttcagatgtgcttatgcacttagcactgaagccttcatttttacttttgaacaacacttcagtttttaatcatactagttcaaacttgaaagagattaaaattattttattaaaagcttatatgcgctttaaccaacaacataaaactgcagaagctggacataacagtgatggtgatgaagaaattttgaacaattttgcaaatagagaaaattgtgagaaagtgatgaaattggctgaggaatacaaaaaaagcaaaacattaaaggggtattttttttaatttcataattattaggaatgggtcgcgacattgacaaatccggaatttttttttaccgagactaattcaggttcccggtttatacataaaaatttggcattttttccccaaaataattaccatatctttgctaaaaatcacaaaaacttatattcttagtatcattcgatagctacaaaatttctcaattagtgtctagtccagactttatatcgggacatgtcccggatttctaatgggtttcccaattttttcgatttgtttgccgattttctggtcaaaagtgagatccaggttccagcttggccaaaattttgtctcaacctgcttttaatttattatacttttgctcttaaggaaaggaaaaaaatggcgtaaagctttgaaagaaattcaaaatttgatggaaaacaatggagattattgtacatcatgtgaaattcctacaattgatcaaattcagaagagtaaaaggcagattttcatgaacattccttcgtcaattgttgatgaaacgaaaaaaatgaaacaaaaaattgttaaaaaactcggtagaaataattcaatttttttttcaaaaaagttgatcattttctcataaatagcatatatagattggtatgaattaggttttacgaattaatttataaagcttataaattaagatgagaagattcacaaaactcgaaaaggtataaaaaatatatttgaaaaaaattaaatttaaa

SEQ ID NO: 72971 - DNA, 70 bp, Heterodera glycines
  Genomic contig location: Contig_ID=SeqID_9936; Location=2885..2954; Strand=+
  SCN-specific regions: Sequence locations=1-70
atgtcatcgaatggagaaagtgacgtgactctaccgtcgaagggagcgttttgtcacgtgatggaaaaag

SEQ ID NO: 72972 - DNA, 947 bp, Heterodera glycines
  Genomic contig location: Contig_ID=SeqID_9936; Location=1..947; Strand=+
  SCN-specific regions: Sequence locations=24-752,775-947
  Gene Ontology: Mol. function=Rho GTPase activator activity; Cellular component=actin cytoskeleton; Biological process=Rho protein signal transduction
aatttaagagaaaaataaataaaatatgtccattgtaagatacgaccgctctttgcattccgcaacttccaacgctgtgtttgaccacaatccagctgcttttcaaagtcaacctccgcgaccaactcaacagtttaatgtttcgtagaaatagtaagtaaaattttcaaaaaaaagttagcgtaagattgtgcctaaagcattcttgaccatcatccaaattcggatttgccgcccatgttgttggaactgatctcttttttgcgcgttcatggacttaaaactgaaggtatttttcggcgttatgctcccgtgaccaatatcaaagaattgcagcatcgtataaatatgggtcagtggcatagaaatctatttgttttttagctttttatttgagttttcttaggtgagtcaattgacttttccaacgatttaatgttccacggagacatccaaagcagcgttacccatgctgccgttctttttaaaacattccttcgttcactcggcgagccattaatcacaaacaaattgtacccggaactcacattgttgaacggtgggcacaatttagccagaaacaactgaatttagtctaaacaatttaatatttcttatctaattaggaatcgaaaaaatcaaccgcactgatgaaattcgtcgttttgtgcataaattgccaccagaaaattatttactactgttaaaagttatcgaatttctcgtggaagtggcgcagcacagtcaccaaaatttaatggatgccaataatttgagtgtcgtttttggtccaaatttgacatggccgactgatcaacaggttaaaagagaatggttcaaatagtgatacattatttttttacatttaggttccgatggtccaattgaacaatttgaacagcttctgttattcgttaataaaagattttgacgagatttttgtagat

SEQ ID NO: 72973 - DNA, 235 bp, Heterodera glycines
  Genomic contig location: Contig_ID=SeqID_9937; Location=3624..3858; Strand=-
  SCN-specific regions: Sequence locations=1-154,178-235
cttaattttgtcagtttcggcaaacgatcgcttggtccgtcaacggatgccattggccttccgtcgtcggattccttttcgaactcggcggaccctaacaatttgatgtccggacatttcaattggaactgatgaccgaacgaacagaccgatctcatcatcatcatcaatcacatccatttattaagcattcttccaacgataaacttcgagaaaattatttatttcaacaaaa

SEQ ID NO: 72974 - DNA, 1612 bp, Heterodera glycines
  Genomic contig location: Contig_ID=SeqID_9937; Location=1807..3418; Strand=+
  SCN-specific regions: Sequence locations=1-34,56-223,245-1612
  Gene Ontology: Mol. function=biotin-[propionyl-CoA-carboxylase (ATP -hydrolyzing)] ligase activity; Cellular component=cytoplasm; Biological process=protein modification
atgcagaatttgggccaacgtgccagtgccctcttctccgacgccaccaccgaacaattgctgagtgccggcgacggggctttggtccgcgacgcccttcaccgccttggccttaaagacattccacaaaaagcattgccatcggacgaaattgggctgcctctactttcgtccggttatttggttgctgcaagagacttgaccattttggacattccggtgggaaattttaaagtatttttatccaaatttcgagaaaaacttcgacgatttttctcccttcgaaatcgcttattttgtctgtcatttcagtgtcgcgcctttactcgttgacaatttttcagggaatgacttacggcaaagtgttgggttatgcagggccatcactcatttttcatcgatctgatcaccaaccatcgcttaaccaagacaacaacaatgacgatcaaaatgtcccttctgaccaattgctaccggtcgaagtgcgccgaagacgggacggactcccggagacaacgcaacagcatcggttcgaagttgaaccgttcttccaacagttggccacaaaaagacttggccaagtgttgctttatgtgcccgtttgtggtacaacgatggaagtggcaaaaaggttctaattttgttggttctattttgaattaactctttaattaacgggtcctagcctttcgcatgcttttccactctttgacggcattttggttgttgcgggcattcaattggctggtaaaggtgagtgtttttacttttttatcgaaagcctgcttcaattatatttttaaggacgtgctgggaatgactggattagccccgcgggctgtgcttcgttctccttcaactttaacatcccttgcgactcgaatttgggccgttccatttgttttttgcagcatatcaccgccgtttccgtggccagcgctgtttcaaaattattaaaggatgaaattccggttaattatcattagaatgattgaattggttcaccgaatcacaacttttaggattttcctatccgattgaaatggcccaacgacatttactacgaacgttcgtacaaattgggcggtttggttgtgcaagtgtctcactgtggccccaattattgctgcaccgtcggtgtcggactgaacgtggcgaatgcgaagccgaccatttgcatcaacgacatgttgccgatgcactcaaatcgacagctaacggtggaagaagtgttggcagggacaatgaacgaattcgaatgtgagagattcacaaaccaatccccttgcaattgttttttttatttgcagattttgtcaatgttttcgagaaaaaagggagggccgagtttttgaagtcgtactaccgattttggatgcattcgcacgaggaggtgcaggttttgcacactgaaaacggcggacgccgtgaaaaggtcgttatccgagggttggacgagtacggctatttggaagtgcggagcaaagagacaggccaaataatgaacgtgatggacgatggtaatggaaatccgtgaaacttcaacaccaaaatttgccctttttcaggaaacactttcgatttattccacgggctaatagtgccaaagtga

SEQ ID NO: 72975 - DNA, 473 bp, Heterodera glycines
  Genomic contig location: Contig_ID=SeqID_9938; Location=334..806; Strand=+
  SCN-specific regions: Sequence locations=1-160,182-402,424-473
atggtcaatttggcactgctgatgcttctgtttcggcaaagatcgcttagcattccttccgggggttacggcgcatcggcggcattctcttgtcaggacacggcatggaattgttgtgagctgccccttttttatatgtccttggtttataaaaggtttaaagccgtttttgcgcctccccctttaaatttggccattcttttttctcttaacctcccctttttccagttcagttcgcccccatgtgcgcctattctttgcgtatggtttacttatgcccccgcacttgcggcttatgcccatcgctcggcttcggcacggcaatgttcggcaacggaatgcaaacgcaaattgcactagcaaatgcattgggaagcagcgcaattggaaagaaatgatcagagaaaaggaaggaaaagccaaagccaaacacaacgccaaaaagcacccattagccgatgaaataatttaaa

SEQ ID NO: 72976 - DNA, 512 bp, Heterodera glycines
  Genomic contig location: Contig_ID=SeqID_9938; Location=1438..1949; Strand=+
  SCN-specific regions: Sequence locations=1-422,447-458,480-512
cttcctctctcttttctcctcctcccttctccctctttctgtggcacttccctttgcccctccggccaatttcgtttcggccgtatgtttttttttcattttttaattactcattctctccttcgcctttttcagcttgcatcggtgaccaatgtcctccgacttgtcccggcgtttgcacatgcgtcggcagaagggactgctgcacagatcgaaacgccggcggaggcggcgatggcattgccgtcgacttaatatccggcggagggtttgagtttgtttttggcactcttttttccctttggcattttccctttggcattctcttttttgcatttaattttggcacttatttatttttggcattcttttttccagcgcctctctgccccgtcttctgttggcacttctgctcggcaccggtcggcccggccttccctccctccaattggctttgtgccgtgacaatgccctcaactgtccgttgtttttgtcctactgccaacttccgc

SEQ ID NO: 72977 - DNA, 216 bp, Heterodera glycines
  Genomic contig location: Contig_ID=SeqID_9938; Location=1544..1759; Strand=-
  SCN-specific regions: Sequence locations=1-216
atgccaaagggaaaatgccaaagggaaaaaagagtgccaaaaacaaactcaaaccctccgccggatattaagtcgacggcaatgccatcgccgcctccgccggcgtttcgatctgtgcagcagtcccttctgccgacgcatgtgcaaacgccgggacaagtcggaggacattggtcaccgatgcaagctgaaaaaggcgaaggagagaatgagtaa

SEQ ID NO: 72978 - DNA, 444 bp, Heterodera glycines
  Genomic contig location: Contig_ID=SeqID_9938; Location=4436..4879; Strand=-
  SCN-specific regions: Sequence locations=1-71,95-444
atgccatcctcccactttgtacattttgctcagagtgttgtgccgtccaatgtcgaaaagtccaagcggcggctgcagcagcaggcggagcagcagttcggcactttctataatgtcatttgcggcaccggcttcttcagttatattgcgcacactgacgaattttggtgagttttaatttgcgctgactctgccaattttggtcatcttttgtgccaaaatttggccataattttcagtctgatggctgtccatgacatgaattgctatgtgttttcgcccgtctgcgcctcggggcaaatgccaacggaggaaaaagaaaaaaggaaaagcgcgagggtattcaacgctaacagcagcagaaggaggagacggagaaggagcacatgaacagcgaaacgaagctcaaaatgaagacgcaatttatgaatattattaaataaa

SEQ ID NO: 72979 - DNA, 1452 bp, Heterodera glycines
  Genomic contig location: Contig_ID=SeqID_9941; Location=30..1481; Strand=+
  SCN-specific regions: Sequence locations=1-9,32-53,86-147,171-192,237- 282,311-374,419-468,491-512,557-606,629-650,693-740,785-830,875 -924,947-968,1013-1062,1085-1106,1149-1200,1223-1244,1289-1338,1361 -1382,1425-1452
  Gene Ontology: Mol. function=myosin light chain kinase activity; Cellular component=extracellular space; Biological process=cell proliferation
gcatcggaggaagaggcgcagaagaagaccacgacgactacatccgattcgacgaaaggaaagaaggaagagaagcccaccagaacatccgagacggacacggcagcgcagaagaagccaactgtgacgtcatcaaaggcatcggaggaagaggcgcagaaagaagaccacgacgactacatccgatccgacgaaaggaaagaaggaagagaagccggccaaaacatccgagacggacaaggcagcgcagaagaagaccacgacgactacatccgatgcgatgaaaggaaagaaggaagagaagccggccaaaacatccgaaagaaggacaaggcagcgcagaagaagaccacgacgactacatccgatccgacgaaaggaaagaaggaagagaagccggccaaaacatccgagacggacaaggcagcgcagaagaagccaactgtgacgtcaacaaaggcatcggaggaagaggcgcagaagaagaccacgacgactacatccgatccgacgaaaggaaagaaggaagagaagccggccaaaacatccgagacggacaaggcagcgcagaagaagccaactgtgacgtcaacaaaggcatcggaggaagaggcgcagaagaagaccacgacgactacatccgaagcgacgaaaggaaagaaggaagagaagcccgccaaaacatccgagacggacaaggcagcgcagaagaagaccacgacgactacatccgatccgacgaaaggaaagaaggaagagaagccggccaaaacatccgagacggacaaggcagcgcagaagaagaccacgacgactacatccgatccgacgaaaggaaagaaggaagagaagccggccaaaacatccgagacggacaaggcagcgcagaagaagccaactgtgacgtcaacaaaggcatcggaggaagaggcgcagaagaagaccacgacgactacatccgatccgacgaaaggaaagaaggaagagaagccggccaaaacatccgagacggacgcggcagcgcagaagaagccaactgtgacgtcaacaaaggcatcggaggaagaggcgcagaagaagaccacgacgactacatccgatccgacgaaaggaaagaaggaagagaagcccgccaaaacatccgagacggacgcggcagcgcagaagaagccaactgtgacgtcaacaaaggcatcggaggaagaggcgcagaagaagaccacgacgactacatccgatccgacgaaaggaaagaaggaagagaagccggccaaaacatccgagacggacaaggcagcgcagaagaagccaactgtgacgtcaacaaaggcatcggaggaagaggcgcagaagaagaccacgacgactacatccgatccgacgaaaggaaagaaggaagagaagcccgccaaaacatccgagacggacgaggcagcgcagaagaagacaact

SEQ ID NO: 72980 - DNA, 1513 bp, Heterodera glycines
  Genomic contig location: Contig_ID=SeqID_9942; Location=248..1760; Strand=+
  SCN-specific regions: Sequence locations=1-182,227-272,317-362,407 -456,479-500,543-617,797-827,849-885,914-936,976-1014,1036-1079,1101 -1513
  Gene Ontology: Cellular component=integral to membrane; Biological process=muscle contraction
atggtggctttcaccattattcctcatctgctgctcttcactgtcttcatgtccatcatcctggtgatcctctctcaatgttgcggctgtacgccttcaaagaagaagcaaactgcgacgtcaacgaaggcagcgaaggacgaagcgcataagaagaccacgacgactacatccgaagcgatgaaaggaaagaaggaagagaagccggccaaaacatccgagacggacaaggcagcgcagaagaagaccacgacgactacatccgaagcgatgaaaggaaagaaggaagagaagccggccaaaacatccgagacggacaaggcagcgcagaagaagaccacgacgactacatccgaagcgatgaaaggaaagaaggaagagaagccggccaaaacatccgagacggacaaggcagcgcagaagaagccaactgtgacgtcaacaaaggcatcggaggaagaggcgcagaagaagaccacgacgactacatccgatccgacgaaaggaaagaaggaagagaagcccgccaaaacatccgagacggacgcggcagtggagacggacgaacggagcaaatactttaagaagatgtgataaacccaccgtatatgtgatccgtattgtatatatattgtgttgtattgtacataattccaccgtaatgtgatcccatgtatattgtattataccaagataatcccatcggtatgtgatcagtattgtatatatattgtgttgtattgtacagaattccatcgtaatgtgatcccttgtatatgtgttgtattgtacagtaaacaaattaaaccaaatctgtttttcatttcttagggttgtatttttctgaggtttgtaagcttaaaaaaataagcactaaaatattcttaaaattagaaaaataagtaataattaaggctcgaaattatacggactaaaaaacatcaaatatggacaaaaaactttttggaaaattttgcctttcggttggctcgtccagcaaatgttgagttgagctaaacacacaaacaacaaattgaaaacatatttatttatctcaattaattaattaaaattgagagatttcgcactttaactttttgtaccatttgaaagctcttgacgagatttttgtatgaagtcgaaccgcgccatctaaaaaccgacaggcataaaccggtttttaaccgattcaaatcttatagtaccaattcagtaccaaacgtaattcctgatttttagattaagctcgtcaagagctttcaattggtaccaaatttgtctggactcagtcgtttaaaaaacagttcgagtgcgaaatctcttatttcgagtgccgataggcgccgccgggaaaatttttgaaaataagcactaaaatattcttaaaattggaaataagtaataattaaggctcgaaattatatagactaaaaaacatcattaggccccgccaattggtatttttgacagattttttacataacagatttcactcaaaaatcataattttaaa

SEQ ID NO: 72981 - DNA, 1153 bp, Heterodera glycines
  Genomic contig location: Contig_ID=SeqID_9943; Location=1620..2772; Strand=+
  SCN-specific regions: Sequence locations=1-1153
atggacgaaaaaataaacaaaatatacaccgacccggccaatcccggtgggtttgcgggtgcgagtgcactctatgcagcggtcaagaagaagcacccaaaactgaagaggaccgactttgatgactttttgcagcggaacaccacctacacgctgtttaagccaaagagggagaagttccgacgccttcgcacagtccccggagggttcatgaccggtgagtttgtccacgttattttcacgtgatcggctcagacgttcaggcggacttggcagacttccaagccctttcgcgaaagaacagcggctatcggtacctgctgttggcggtggatgtgttgtcgcggcgtatgttcggctcacccgtaaagagtaagaggccggcggacgttaaaagggcatttgaggaggtgtttggccaaatgccaaaacttccggaaacactgtacacggaccgtgggctggagtttgtggccaaacccatgcaggagttcttcgctgaaaatggcattaagaaatacgagaccagctcaaagaagaaggcagccgtcgcagagagagccattcgtacgctgaagacccggctgtacaaatatttctctgccaaaaacacctctgcgtgggtggatgtgttgcccaagtttctgtctgcgataaacaattctgtgtgccgcgcaacgggacttaggccaaacgaaatcagtgacgtcaatgcgagagaggtgtggaagagggtctatggcgaaggacttgtaccagcggacaagagcccaaagatcaaagcgggggagactgtcagaatccccgagcccaagcacatattcgagaagggtaaagttactcctccattttttctgtattttttttttgtgtttaaggctatattcccaactattctgaccatgtgtacaccgttgatgcggctcgcgcaaccaaaccccagcactatttgctcaaggactattatggcacaaaaatgaatagaaagttttatttgccagagctaacaaaagtacaagtggacgaaaacacaatgtataggatcgagaaaaaatacaaagaacgaatgagggatggaaaaaaggaaatattggtgaaatttatcggatttccggaaaaatattgggtcacagatgaggattttgaaaaataa

SEQ ID NO: 72982 - DNA, 1608 bp, Heterodera glycines
  Genomic contig location: Contig_ID=SeqID_9943; Location=2791..4398; Strand=-
  SCN-specific regions: Sequence locations=1-506,541-1030,1058 -1199,1221-1470,1492-1608
atgttcaccaactaccccgtcggtcatccaaaggtcatccaaatggacaaggacgtcaactggactgcgaaggaacacattgtggacgacgacggcgtgaaaatggagggcatcatcaagtgcttcgttgtcccgcctcggcactgcctctacgacattccggtcatcccaatgcggcgtaacaacaggaccctcttcccactctgccggaaatgcgcggagatgtacccaaagggtctggtcgaccctgggtacaactgccctcactttgaggacgctgagaggggtaaccaatggctttattttccaatgattttatttttccttcgcaggattctcaacgaccatcccacacatcgagctcgaggcggcgctgcgatccggctacagagttacccatgtctaccgggcgtacgtctggccgctgtattgtgactggagtaacggcctcttcctctcctacctcaacaaattcctgcgcataaaatttgagggtagttttatcagcaatcaaaattaaattaatcaataatcatttagccaacggtttccctgctgactgtgccgcagatgacattgacgaggaggagagggagcgcagaaagcagcaatacatcaacaacccatggaagggctgtacggtgcggctcgacgccaacaacatcaagccaaatcccggcatgcggtacctttcgaagctgtgcctcaactcgctgtggggccgctttgcgttgcggaatcggctgacgaagacggaaatcatcgactgccacgccgaccttgcgaagcttctgaacgacgtcaaaatcgacatcagcagcatcgaccaactgacggagaaattctggatggtgtgctacaaggcgaaagatgagcacgtggtggagcacgacaccagcaacgtcgccattgccctatggactacggcagcggcccgtgtgcacttgctcaactcactgcaattggtctacaggcaggaaaatctggttcagcgctacgacacgcgcattttatacatggtaagagtgtgcaattaaaatgttcataataaaatattcgtttttcaggacaccgacagtatcttctatgacttcaagactgcactgggagacccgctgaagggtggcaaccagcttggggagctcgcggacgagtaccccaaccataccatcgtcgagttcatctgtggtaaggactttgtccaaaataatttgaataaatttctaatcgttttcagctggacccaaggcctacgccctttggcttcggaacaacgcaaccggcgaggacgagtacaagctgaagctgcgaggcatcacgctggactcgaacgcctgcacccgcatcaactttgagaagatgaaagaaatggtgctggagaagtggggcacgcccggcaaccatgtgcggttcgactaccctacgaagaacttccgcatcacgaagcagggcgacattctaactgtgccaatcaccaagcagttcaaccccaccgtgaataagggggtgctccgggaccgtggacttaaggttgtcccctttgggtatagctcatgggattactgtaaggcccataacccctacgattgtctctgtaagcgcgaataa

SEQ ID NO: 72983 - DNA, 543 bp, Heterodera glycines
  Genomic contig location: Contig_ID=SeqID_1352; Location=4968..5510; Strand=-
  SCN-specific regions: Sequence locations=1-153,175-199,221-349,371 -501,523-543
atgaacaggttagtgttaagccacagattcactgacgacggctcaggaacaaagccactgaaagcccgccaacagccacagagatcaaacggatggtaacatcgcgtttgtcaaccatggagagccaacggatggtaacatcgcgattgtccatttctttggtcacagggaattcggagtacactggaaaaaaaaaatatttcatttttgttgtgtttgatgagactacacctttgtccgaagagatgttggcaaatcctccgccggagctgtccaaagatgctgctgatgactcgctgctgctggacgaagggcctgcaattatgaaaaaatcattttttgaattactttttaatttattctgttaattaggtaatttttttctaatatttaggcattttgcagtacgatcggaggcagaaatgtcctcgttgggagttgaggtgcgcactggcgtaccgcagtctgccattaataatgatttgattagttttagttagctatattataattaaaatataagaccaaataagagggaataaa

SEQ ID NO: 72984 - DNA, 697 bp, Heterodera glycines
  misc_feature (665)..(665): n is a, c, g, or t
  Genomic contig location: Contig_ID=SeqID_1352; Location=7298..7994; Strand=+
  SCN-specific regions: Sequence locations=1-697
atgccggtttccggaccggtttggcattttcaaaatgaccgttttccgggcccggcctctgaaaaaccggtcaaaccggaattttccctaaaaccgccggaccggtttccgggcccggtaaaaatcggtaccggatccggtccggctcggtctctacttttaaccataatttgaagctcaattgaaaatctagagaaaaatagcctattttgaacaattttggacattttcgtccattttattagcacaccgatgtgaattacgcagtaaaacgagtataaaaagcggtgaaaaagtgaaaaccgtccatttccatttcttctcctgtactgtgcagcgcagaacactgttcttgttccttcattcacactatgaggaaattctattatttcaagctgttccaagcggtcttggcatttgtcattgtttggcaaatcctttcgattgagaagctttgcgggaaatttgctgagccaaaggtgcacacattcatcatcagaccatcgcgaaccttacatttaattttgtactgatttactctccatgctttcagtgtttctatccaacggaagcttgcgacaacttcactatcttcaaacaaaacgcagaaaccactgaactcaacgcggacaatgaaacaaaatggatccagctgaacgacctcncgaccggcgagggctgtctcccatcaatgtga

SEQ ID NO: 72985 - DNA, 471 bp, Heterodera glycines
  Genomic contig location: Contig_ID=SeqID_1352; Location=1714..2184; Strand=+
  SCN-specific regions: Sequence locations=1-61,83-209,232-471
atggaagaagagataggtggtcctcagcgcagttcgactccaaaccaaaacagtgacggtgccatattaaaaaataataaaacagcataatgatgctttaacaatttcagacgcgccgtccctttctctcaatgacgacacaactccgagcttgaatggttcggggtcgttcctggatattacggccgacgaaagtaattagccagaatgaacttttacaaaaataaggaatttgccctttcagacttcaatcgcttgatcccggcgagcagccaattggagaagagagacattgccatcggcgttttgagcagccaattggacgttttgaacagccaactggagaaaaaagacatcgccatcggcgttttgaacagccaactggagaaaaaagacatcgccatcggcgttttgtcaattgctgtcgtcgggatgggcgctacaatcatttatctgttgaaccgtcgctga

SEQ ID NO: 72986 - DNA, 1812 bp, Heterodera glycines
  Genomic contig location: Contig_ID=SeqID_1353; Location=254..2065; Strand=+
  SCN-specific regions: Sequence locations=1-346,388-738,773-849,905 -926,948-1184,1206-1264,1288-1673,1695-1812
atggaaatgcagcagttgcgaagccctccctcggcatttgtcagtggtggacaattcgagcacattcaccacgttcagtcatcctcttcaacctcttacgacttgtactatgatgatcaaggtttgatttgttgttgtgtatagccataaattaattagaatcgatgttagtggatacatttggcatttatagtgccgtaaatttgcgttttttgggctgtttgtgaggagccccgacttttgcgcctatgtccaaaatcgaattcaaatttgaattttttgaagccctgatagcctaaacagcattaaaattaagaaaatactgtcttctagttttttaggaacatcaattttgttgtttgaaaattttattatttttcaaaaattcattacatatcaaagatcggctacaatcacttttaatcccttttttatgctgtttaagtgatcatggactgaaaaaaactcaatttgaacccgattttggacaaaggtgcaaatgtcgggccgcataattggggggaccgcaaatgtcgggacacggtttgggatagagggaatacaaattaaaaacacaaatatccgaaactccaaaaatcgattttttgaatttattttttgcaaagaaatcaagtccgcccatttacagcagcaactcaacaatattcgatggtttctcggccaatgcattcgtcggcaatgaatttgggcggtgatggccaacccattcagcaacaactggaccaccaccaacaacaacaacaaatgtaccatcaacatggacacgcatcagccgaaacgcgaggatttgttagacgagtgacggcaccgacggcgaaaaccccatttgaagaagaggaggaggaggaggaagatgaggacgaagaggaggaggaaaaggaggtgcaaatgggaggaaatgaaaccaaagaggagatgggaggaggaggcggaagcattggacgacgcgcatccgcgggcagtgggagcggccgtgggagacggacaattctgctggacgacagtgcaccgcttcccctcccgccaacgatgacaaaagggggcaaaattgtgccggacaacaaacatccgcttcagcaggtttattattgtcaatgtcaaaggatatatgttgggagtggtcaaaatcggggaacattttgatgaattttcgttttttaaaatcctgagttaggtggtgcattataaaattgtttatccattttcaccaaaaaattactatttttggcatcttggtctccatttttaaaaatatgataaaatgggagtccggagatgccattaagcgccggcgtgaaatttttgagaattttaatgcaattttaagataattgcttaaaatttcaaaaactctacgcccttgtgttaaaagaagttcgactttgaaaaatttccagtcgcattacttctttcaatttttgttatttcaagtcgtcgaatcgtggtgccgcccttgacgaggagaacaagcagaaggtccgacgtcgtaagcaggaatttgaaaaatcgacaacagccaacaaaccaatcgttggcgaatcgccttcaaaaaccagcactgccacagcggtctttggaagtgccggaggagtgaaagtggaagtgaaatatgacgacggaacgactggcaacaaaaagggcacaaaaacgaaacagcagcagcaccaaagtgatgggacagcgccagtgattgaggagacatcgccaacaaccaaaaatttgatgcacgagcaattaattaatttaacaatccataattattcatttttgcatggcacattaaaggcttga

SEQ ID NO: 72987 - DNA, 306 bp, Heterodera glycines
  Genomic contig location: Contig_ID=SeqID_1353; Location=2135..2440; Strand=-
  SCN-specific regions: Sequence locations=1-160,182-306
atgcctcacattcgaaagctgggtgagaagttgtttcagcttggtcatgtcagactgtttcatggcacttttaagccacccattcatccgacgccatccctcaatggtgccaaggcgttgtgccgtttgagccacaatgaggcctttatcactgaaaagtgtgggcattattattattattgttcgatcatcagtcgaaaatttttgtttacagggaattttaacaaaagtgtgacggatctaaacaaatttttcgtcaatgtaatgccaaattttgactcggatataataataacatttttttga

SEQ ID NO: 72988 - DNA, 1114 bp, Heterodera glycines
  Genomic contig location: Contig_ID=SeqID_1355; Location=423..1536; Strand=+
  SCN-specific regions: Sequence locations=1-179,215-1114
atgcctcccggacacatgcagcggccgacgccacaaattccgctgcatcagcagcaaagtcagtaccgcggtggaatgatgggctcttccggcggtgcacaaatgggcaaattcggtagaggaatggaaaaccttttccgagtaagctaacggaaaaaataattgcataaatatggcttaattaatgttttaaaaaattttgagtggaaattggtgcccgttgacgacgtcatcactttggttgtttcgggcagcaaaagtcagtcgaagaacgtcgaagcgacgcgcattcgcggagtgatggaggccatttgtctgccagaaatgtgagttttgggtgaaacagtgattttatgccgaacatttgtgggaaaaccgtcgcagagaaaagcattggctgaattagtttttttatgtatttcgatgagctttacggggctttaaacttagaaatttttcaagaaaaaaacttcgaaagttttttcataggaaaattctatgaaaaaactttttcgaaaaatttaatggttaattactgttttttcaaaaaaaaatttccataaaatcgctcaaaatttcccgaaaaaacaataagaagaaaatgtctaagattttttcttgaaaaacttctatttgtaaatttaaaaaaaaattttcgacgggaaacgatgcggggaaatgaaccatacaaccgcggacaattatttatttgaaccaaaaaatagaatattgaaactaaaagttgaggaatttactctttttttattttctgtaaagacaaacgaaaactttttgaaatttcagcagtttaccaatatcggacattgacgagaatgactacaagcagcaccaaaatgagacgactgatcacatgccgaaaatcatcccccacgaaatgatcactggtcagtcgatttccactttgtttttgctgggaaaacagcccgttttcgccgacgcactttttagacatcggactctgaaattataagttgggtcccgagtgtccaaattggtgattttgtgaatttttggaaaatttttagtgcgagaactcttggacacggcgagtcaattttgggctccaagtataaatttcaattttttaaagcaa

SEQ ID NO: 72989 - DNA, 931 bp, Heterodera glycines
  Genomic contig location: Contig_ID=SeqID_1355; Location=446..1376; Strand=-
  SCN-specific regions: Sequence locations=1-740,776-931
gcgaaaacgggctgttttcccagcaaaaacaaagtggaaatcgactgaccagtgatcatttcgtgggggatgattttcggcatgtgatcagtcgtctcattttggtgctgcttgtagtcattctcgtcaatgtccgatattggtaaactgctgaaatttcaaaaagttttcgtttgtctttacagaaaataaaaaaagagtaaattcctcaacttttagtttcaatattctattttttggttcaaataaataattgtccgcggttgtatggttcatttccccgcatcgtttcccgtcgaaaatttttttttaaatttacaaatagaagtttttcaagaaaaaatcttagacattttcttcttattgttttttcgggaaattttgagcgattttatggaaatttttttttgaaaaaacagtaattaaccattaaatttttcgaaaaagttttttcatagaattttcctatgaaaaaactttcgaagtttttttcttgaaaaatttctaagtttaaagccccgtaaagctcatcgaaatacataaaaaaactaattcagccaatgcttttctctgcgacggttttcccacaaatgttcggcataaaatcactgtttcacccaaaactcacatttctggcagacaaatggcctccatcactccgcgaatgcgcgtcgcttcgacgttcttcgactgacttttgctgcccgaaacaaccaaagtgatgacgtcgtcaacgggcaccaatttccactcaaaattttttaaaacattaattaagccatatttatgcaattattttttccgttagcttactcggaaaaggttttccattcctctaccgaatttgcccatttgtgcaccgccggaagagcccatcattccaccgcggtactgactttgctgctgatgcagcggaatttgtggcgtcggc

SEQ ID NO: 72990 - DNA, 1381 bp, Heterodera glycines
  Genomic contig location: Contig_ID=SeqID_9944; Location=601..1981; Strand=-
  SCN-specific regions: Sequence locations=1-196,218-219,241-531,568 -619,641-662,684-1162,1199-1343,1373-1381
atgtcgagcagtttggtggatcggatgaagctgatgttgagcacgggcgaaggggcggacgttcactttttggttgggaaagaaaaggaggtgagttgaacccacaaaagttgattaatccagggttccgttctaaaattttcagcgcacggaggaaaagcagggattgtattcgtttttgccaaaaaaaaaccaaattttttgccattttctggtcaaattttagtaaaatgagtagggagtccaattatatggaaatccatatttttttcctggactgtgggaggcctgaaacgcacgaaaaacatgtttttagcttggtttgaagcttctaggaaggatttctatatcaatattttccatatttcgcgatttatgtccatattttggcattttggtccatattttggcatttttaaaaaaaaacctctattagaacggcccccagcagctaaattagcctttttgagcccaaaacccgaaaaatttttcaaaaaatcattttttcgccaaaatttctcgagaatatagaataaatttaaattttcttaaaaattaataaattatgtcaaaaataagcaaaaaagcgaaaatttcgcttttgttattgattttgcgctaaaaaaattaataaattttagcttttatgttttttttcttttaaaatgattgcacgtaattgccgaaaaaattcgagaccaatttccgaacgaaagccgtctttgtcaaagcgtcttaccgagtcaaaaaatttggaaatgtatctcatatgcaatttcaaccaataaatttgaagaaattttacattcaattttgaaaaatttatgtccatatttcgcgatttttgccattttatgtccatattttgcgatttttggtccatattttatggccatatttcgcgattttatatccatatttttggactccctaaaaatgagggtcagacggtgcttcgccgccagggaaatgtttataatttaattgaatctttatcctcattttttttttatttttgaactagttccatttctattccgagtttttttagctttttaaagcacacaaatgcgtgatgatgttcgcttctgctgtgtttgggtcgatgttccgttttgatgacaaaaactcaaagactaaaagtaaacaaaaaaaaataccgaaaatatttctaaaaataatttttcattattttttagcctctgccgactgtcctcacgtaattgaagtgaccgatgttgaagcagaagcgttcaaagtgatgttgagcttcatttatgcggaagatttaagcgaattgaacggacaaaatgccatggcagtgctttacgccggtgaaaatgtttaaaaaatattaatttttatttattaagcaaataaa

SEQ ID NO: 72991 - DNA, 2363 bp, Heterodera glycines
  Genomic contig location: Contig_ID=SeqID_9945; Location=115..2477; Strand=+
  SCN-specific regions: Sequence locations=1-283,309-421,464-620,675 -846,868-950,977-1031,1068-1484,1514-1875,1911-2021,2043-2363
  Gene Ontology: Mol. function=protein binding; Cellular component =nucleus; Biological process=pathogenesis
atgttgagcacagctgaggacgcggatgtgtactttttggtgggagaggaaaaggaggcgagttttgaaatttaaaacatttaattttcaaaaacctcaaaataaatcagggatatcggcctaataatgcgtaaatttgttatttttgatgcaaaatacaaatcgtataaattaaaaaaaatttcccatcgaccgctattatctttcaacaccatcgaccaaatcacctcctaaaattctcaaaaaaatattattctctgcttaccgcctgaggcttcaaacaaatttaattttaattgtttctctttttaagcttttgcctgcccataaacggattttggcagtgcgcttccgacgtatttgaggcaatgttccgttttgactcccaaaacggaaaagcggaaaatggtatgaaaaacggataataaaataataaataattatttttatttaatcttttaaacattagcctctgccgttagtcccattgttgtccctgatattgaagaagcagtgttccgagtgatgttcaacttcatttatgcgcaagactcaagcggactaaacggacacaacgcaatggcattgctttacgctggtgggataattaatttttttaatgggattattaatttcctttttgtgattaaattaaataaaatttcatgcattttttgtttagccaaaaagtacaacatttctggtctgatcaaagcttgcttggattatccaattggtcaattgtccaatgttttccttgccattgaccatgctcgttttctcagcgaacatgtaaagtttggcactgattttgaagaatttttttttgtaaatgaatttaatcccaatttaatttttttttaaattgccttttaaggattttgctcttcgctgcttggatttcattgaccgaaacgcgaaaattttattgcaatcggaggaatttgcacaaattgatcagaatttattgtgtgaaatactcgaaagtgatcagttgagaatcagcgatgagctcacaatttggaataatgtaataattaatgtttaaaaatagaataaaaattattgttcaaatcatttgactcatttaaggcactccgttgggccgacgaaaagtgccgtcaaaatgccatcgaatgttccgctgagaatcgccgttctgcgcttgggccggcacttttcaaaattcgtttccctctcatcacatatgaggaatttacacaaaatattggtaaatatggaagaatttaatttaatattatcgataattcatccaaaccttggtcaaaaaggccgctttaataagggggcgttttaaaatatttttttgttgttggaaaatgcccaaataagcaccaaaacgcacataaatcgcgaaatatgcatatggaaaacgtcctagaatcttcctaacaagctacgtttcatatgcctttcacagttcatgaagaaaatgcctgtgcatataattgaacgctctattcataatttaaaaaagtttttaattttttttggcagttccttctggcgttttaacatcagaggaatctgtcggcatttgtcagttccatttgcctgggcttttatctccggtggcatttccaaaccatgcacggatttccacgtggaataatacccccaagggaaacgcagggactctcgcgttggaaattacgaaattttctcgatttgcgcgaagggacgagggaaagtgccgacttagcaatggcaaagtgcacataaaggcacttccgtggaaaatatgtgccaaaataaatacgacgaaaaacgaaaatggcaccaccgaaaagtgtttgggctttttccttcagtgcaccgcgccaagggcaggtgggataatgataattaatggtgttttaattctaattaattattttttattttattaagacccgaaatggagttgcaaatgttcagcgacatttcgaatcatttctcaaaagcgcggcacggagcatttaattggaaaacgcaatgatcacatttttaacaacaaaatgaacattttgggtttctcaaattttattactttttctgtaagaaacaattaagagatgtctttttttataattgaccataattaaggaattgatggacccgagcagaggattttatgacaaagacggggacaaagtgacattggccatcgatgtcattgtgaaggaagaaaaagcggataaattggattattcaaatccaaacaaaacaaacgggaaaattgtgatggaaattggcaaattgactgagttttcgcgagagatttgtttgagtgaacggagcagcgaaatcaaacaaataaagggactttcgtggaagattggcactgataattaatcagaata

SEQ ID NO: 72992 - DNA, 730 bp, Heterodera glycines
  Genomic contig location: Contig_ID=SeqID_9946; Location=7..736; Strand=+
  SCN-specific regions: Sequence locations=1-163,185-264,287-298,321 -389,421-653,675-692,717-730
atgctcaccgattgcccagcccttcgccatgttcatttctgtggcactttgttgcccgaatttccgcccgacgacagtgccaatgcgtcggatggccaagtggtgaccaaatggctgttcacgcctcatttcgacaatttgccgaaggcatttaacattgtgaagttaactgtggaccaatggacgacaattgtggaacaaatcaaagcggtgatttttgtccaattaattcgctttttaaatgttttgtcttttttaggccttttcttctgcttcttctcctgttaatttcggcatttctgttctgtttccgccgtcctcttcactttctgtcgttgtgccatttgaattgatcaacgaatttactcaagagaaattgacactgtccaaagaagacgaagatgaagaagaagcagaagatccaaaatatttttatctcatccgttctccaattgtgccggaagatcagaaaaagcagaagatcaatgaaatggggggccaatggaacaaaattgacatagtagccacagacgacgaattcatcaatcgatgaacaattgcatttaaatgttgttgtatttgatttttgcttacaaattcataaaagatgttaggctttaccacgcttagtaaattttaaaaaacgtacaggaaattgtttatttaattttttccttatcaagtcatacatatttttatgtttttgtgtgttttgatacctaaagactca

SEQ ID NO: 72993 - DNA, 228 bp, Heterodera glycines
  Genomic contig location: Contig_ID=SeqID_9947; Location=348..575; Strand=+
  SCN-specific regions: Sequence locations=1-228
atgtcttccgcctcctctttttcgccgacaaattccgctagtgaaaatagcacaattcgctttgccttgcccatcaatcaggcgaaacaactgctgcattgccttgaacagctccaaattgatggtggcagcgacggaggctgtgccggcaattcggatccattgaatgtgcatcagcaaagattgtccggcccattgttcggcttcaaaaagagcgcattttatttg

SEQ ID NO: 72994 - DNA, 3822 bp, Heterodera glycines
  misc_feature (42)..(42): n is a, c, g, or t
  misc_feature (69)..(69): n is a, c, g, or t
  Genomic contig location: Contig_ID=SeqID_9949; Location=1..3822; Strand=+
  SCN-specific regions: Sequence locations=1-271,297-836,858-1256,1278 -1657,1679-2586,2609-2653,2675-3628,3652-3822
  Gene Ontology: Mol. function=sodium-dependent phosphate transporter activity; Cellular component=integral to membrane; Biological process=phosphate transport
acgcgtttcggtcgcgttccgacacttgggtaaacagaaganatatatatttaaccctgcggcgtttgnagaacatttcaaaaagtcccaaaatcaaaaccgataattgggaattggttagtctgaattcaaagaccgatcgctgactgaaattattggccaagactcttgggctcgggtaaaacattttggagaaacgtttctggggaacaatcatcaatcgatcggcgcccgggggaatgcgatttgttagaattttccgatgcgaattttaaaatttcattttcttttttaaacttaaggtggcactcgtccaaattgctcaggtctctctttctcctctccactcgcttttctcggccatttcctttcttttttctttgccttagggtctcgtccaagggttggcctatccggcaatgcatggtaataatatgttatcacttatcactaaatgtttttctcattttcttttgaggagtttggtgccattgggcgcctccgttggaacgctcaaagttggccaccacggctttcaccgggtacgaagtgaaactgaccgaaattcgaaatccccccacgggcttttcaggtcgtacgccggggctgtgtttgggctgccgttgagtgccttgttggtttcctacgtgcattggtaaggcattttttggcattcccaatcattgctaacaatatgcacttttttatttgccgttcccgcaggtcaatgcccttttacatttacggagttgccggcgtcatttggtccgttttttggttctcgatgactttcgaaaagccggcctttcacccaacgatcacagtgcaggaaaagcaatacattgaagcacaaattgggcccgtcaatcagtcacatccgacggtacattcacattcattttttaggtgggggggggaatggccaaaacgaagccgaaaggaccaccctcaagcacagattgaaaaaaagtagagagataccggacaagagagttggttgatattgtcaaaatgaccgagtgtgccaatctctaataattaaccaatcaaaagtgccaataatttggggtcagtgcggcacccacccgctgttcgactcgtctctgataaccgttcattttccgactttcccatgtcccccgacttgtccccgcttctgtttgccgctcccctaaaaatgcttctgacgtccctctcgccccgttcagttcggcaccataccatggcgtgccattctcacttccaagcccgtctgggccattatcgtggccaacttcgcgcgcagttggaacttctatttgttgctgcagaatcagctcacttacatgcgcgacgtgcttggcctgcgaatttcggacgtaaacaattacggattttaaggcttactgtacaggaattacgatttttgggtctcataatgacgattgtgatttgggttttttactcttgctaccatactcaccaagttgatactgtacttacttctcctttacaccattctaattttgcttggtttaaaaatgaatttctgttgatttttctgaagttgtcttcctcattttgtacttttcagagcggtctcatcgctgcgctgccccacgccgtgatggtctgttataaaaagaccaaaatcatcattaattgctattaaccaaattgattatgcattatgtaaccgtacttttctccctaattgtccacatttcccctcaagggctgtgtggttttaattggcggccgattggcggattatttgcgttccaacaaaatcctttccacaaccgccgtccgcaagctgttcaattgtgggggtaagcaaaaacatcttctgccgtggattctctacatagaattttggcttaggtttcggctgtgaagcgttgtttttgctgttcgtcgcttacaccaaaagtgagaggacagcgatgatcggtaagtgattgattggccagggtcaatcaacaacaaatttgcgtgaatatcttctgttttctcgctttcagcgatgatcatcgcggttggatgcaggtaaaaaatatgccgattgatcagggccaccggtccaattaggtatccggtccattcttataactaaaacctgatcaaacaaagtaaaatccgatctccgatttggccagtacaatttatcaatcgattgattgaagtggcaaatctgatttgaacatttcgagtaaacccaatcgactgattgtgcagacccatcggcctaaccaaatgattgtttaaagtcgattcgattgatcattgcccttgccattttgtgtgatcggtagcccctcggaattgggcaaattaattgcattcattttccatttcattttcagtggtttcgccatctccggtcggttgccgttctcgcttctgcatttatctttgtttgtccacaaaaactaaaaaatttctatgataggtttcaatgtcaatcatttggacattgcgccgcgttatgccgccattttaatgggcttttcgaacggaattggcactttggccggcctcacctgcccatttgtggtcgaatcactcacttccaaagggaatgccaacggatgggtcggttatcactaattaattacccaattaacgccatttgtttctctaaaattggcactttcatttcttcgtctatttacttctcccccctctttttaaaggtgactgtatttttgctggcctcactaatccacttcactggcatcactttttacgcggtgtacgcctcgggggaattgcaggtgggcgaaggggcggcgagggcaaatcgaatcgaagaacccggcaaaaggggaaatgctaatttgtccgggttttaccgttattgtttctggaaaagcacatttgtcactctccaaccaaaagtcaaacattggggcgtcgaggaaaacaattacaattaattagggcaaaaataggccgaaactgtccagacactttcgactacgtccaacattgagttaaatttaagttttcaatttttcttaattttaaagctatttaggccatcaaggcttgaaaaatttaaggtttgaacccaattttggactttggcacaaatgtcgagtaaccgcagtttttttgctagcgcattatttgctattttttataattaattagtcattttatcaattaggaatgggcggaaccaaagccaaatgaggaggaacaaacgctgcaatgggacgcgcaaaaggcggccgaagcgcgcgcattggaagcggcggcaaaacggggcgacacttacggcacaaacgaagcgacggcatttgcgccattgccccatctgacgacggggcaacaaccaccaatgaacagtgagtttcaagcaaaaggcactcactcactgatcagatcagcgaatgccatccaaaacataggacaaaacgtatgatcaacgaaggccggaattttgagaaattcggcgcgatcagactttctaaatcgggccgggacgaaatgccgtacattcacaattagaagcgttgagaaaatgaaattttagcaaaattctctgccgagttcatccccagtctctcccggcagaattccatttgttggtattgtgccaatgccaaagtccgaaaaggatagacaaaattcttgctttttgcctcctccacagattttcatcaatcgacggcacaaaaccaaaatggcggcaccgctgcaaccaatcccttcatgaccaattggggcgacgactttcaccacgctgggtgcagcagcggcaacaaaagtttcggcactgcttacggaggccagccgcagcagcacgcggtggacgacgactattaccagcagcaa

SEQ ID NO: 72995 - DNA, 1211 bp, Heterodera glycines
  Genomic contig location: Contig_ID=SeqID_9952; Location=308..1518; Strand=-
  SCN-specific regions: Sequence locations=1-35,57-622,644-655,677 -707,729-803,835-896,960-1090,1112-1128,1171-1211
atgccaagcataattctctctttttgtggcattccgcaattcttcttcccttttgcaacttatccaatcaaggtcaaaggtgtggtggtgctgcgttttcggcaagtgcttccgtcgtccgctaggcactaaattatatttaataaagcagcgcttttgaggcctggaaaattcattaggtaattaaaatagcgaaatttcgaaacttaaggtattttttagttggcttaagaaagctaattactcgttaagaaaattattaatttttttctacctttcccttcgttgaaattttctgcttttcttttgatcaatcctctaaaaatgggcttaaaattactaaaaaaaattcgcttaaaacccaaaatttcgccattttaggcaaaacatctttctattaacaaattgaaacaaaatttaccaatttaatagtccaatggatgtatatgttctgggttcgccaatttggcactattatgacaaatcagcaccttctgctgatcattagttttgcccgaggcaaacgcggaccaatgaccaatcgatcgatcgatgcgtgcgatttgtgggcggagccaacagacgcccgcccccaaaaagcacagcagcagcgaaaagcacgagcacagaacagagcagagatacactaattgatgattagtgagtgagtgtgttagcaaaggagagagagagagaaagcacaacgaatgctaattgctaatgctaatgatgattgtccaatttgtccccatccttccctaatttactatcatcaatctatcagctcctctgagttttttgtctttaattatgaaaaatttaatttttttttatgaacttatcccttttctttaattatgtaaaacaacaattgtacgttttttttattggtcgacttttaaaataacttctaaattaattgattaaacaaatatattaaatttgtatttttaaaatttcttttccatagatattaattttttgcccatttttaatgcatttctttattcctttgttaatgattttttattttatgattcaatatcaaaacagcaaaactattaaaaaaaagaagaaagcccttttttcaaaagtgtagaattgttgatttgaattcctaaaattgccaaaattaattaattaatttttttttgaaaaaaaacaaatatacttccatgaatataatttcaaaaattatcaactataataaa

SEQ ID NO: 72996 - DNA, 853 bp, Heterodera glycines
  Genomic contig location: Contig_ID=SeqID_9953; Location=1839..2691; Strand=+
  SCN-specific regions: Sequence locations=1-557,583-853
atgacgggtgaaagcgcatatgaacttgttttgttggttaaaccagaagtatttatttacaaaattcctccactaacgggcaacaagggctacaagtttgtttgtttatttgtttttttccagtttaattttttgtagggcagccgattggaaattggacagtcccgactgggtgggaaggctcaggctaatttcaatcggcgacaagctcgagattcgacttgaggacaaaacttcaggtttttatcgatactgacaatgagcatcttttatgacccctggtataaggcattttatttgttaaggtgaactgtttgcgaaagcgccgattggtcagctgaactctgtcgactatgaatcggtatccgactcatcccgctattttgttgtccgactgcgcaacgacaacgcccagaccgcatttgttggcatcggcttcgctgaccgagctgactcatttgacttgaatgtggcgatccaagatcatttcaaagcggtgaaaaagtgcgacgattcggcggaggataacgcagaaactgtgcccaagttggacttgagcttcaaagagggacagaccatcacggtcaacattggggtcagttgaagtcggacaacgcatttaaatcttgcaaaattttgggattcgttttatcttaaaaaaaataatttaagaaatatgtaggtattccgaattggtttttcaccacaatcccctcaatttaagaagaaaacgatcacttccaacaacaacagtagcagtgctgtgcccaaccttcggacatcgctcggcggtagcagtgccgtgccgcttttgccaccaccgcctgcctctgggaataaaattcgaaaatga

SEQ ID NO: 72997 - DNA, 1420 bp, Heterodera glycines
  misc_feature (6)..(6): n is a, c, g, or t
  Genomic contig location: Contig_ID=SeqID_9954; Location=34..1453; Strand=+
  SCN-specific regions: Sequence locations=1-984,1007-1030,1052 -1098,1120-1420
  Gene Ontology: Mol. function=ubiquitin conjugating enzyme activity; Cellular component=endoplasmic reticulum membrane; Biological process=protein monoubiquitination
gatttntattgttctctgtggcaatgggcggagcaactgtcaccgcggtgacgaggctgaagaaggactaccaaaagctggtcagggacccagtcccttacgcaattgcagcaccgcttccgtccaacattttggagtggtacgtggcggacgtgaagtttaaaatgcaataatttgaacgagttttaggcattatgtcgtcaccggtgctcccgacacgccttacgaaggtaggcgcgaaaagacctgataaagaggtcgcggaatgtgtttctaaaatagaatttcaggtggttactaccatggcaagcttattttcccgcaggactttccctttcgcccgccggcaatttgtcagtttcggattttcgttattgtcatttgatgattcatttcatcatttttagacatgatcaccccgagcggtcgcttccaaactaacaccagactgtgcctttccatctcagactttcacccggtgagttcagcaggcgtgaaattaattgggtagaaaagcgacagggaattttgaaaatttaatagttttatatcccgtttataatattgcattaaagtaaccaccatcaccctgtcgtaaagtaggacatcttttgttataggacacgtggaatccgtcctggtccgtttccaccattattatgggtctgatctcattcatgaacgagaactcaccaacacttggcgcattggtcagcactgacgaggagaagcgcgtttttgccttgtaagactttcacaaaataattcttcaattgtcgtgtcaaataaatattaaaacattttctggcgttcccgtgagctcaaccttaaaaatgcccagttttgcgagctgttcgtcggcctggccgaccaaattcgggccgaattggaggcggaaagggccgccgcatcggacaacgccgaggggcaaactgcttccggagagtcgacgaccaaaaagtgaaataatcagtaaaaatgtagtttcttcttcattctcaaaaaagggaagagaccttcggtgatccccttacaaatgaatttttatctcgtttttaccagattttggccaacaaatttcatggtgacaatgaggatgtttgggcccaaattttaaaattttcaacgatcattagtgatctttcagtgcataacccagaagatttttagcgtaaattctaaaaaatgcattccgagggaaagttaaactgcaatattaccaaataaacatttaattgaaaaaaggttaaaacggaatttcaggaactctcgacacgactcttcctcactgactgccaatttgttaatggtacgttcgattcaatttataatttcgctcattttcattgttaaggtcgcgggtgttgtcatccttttcttcgccgttcgctacgttattctcaacgcgacgactgtatga

SEQ ID NO: 72998 - DNA, 1209 bp, Heterodera glycines
  Genomic contig location: Contig_ID=SeqID_9956; Location=136..1344; Strand=-
  SCN-specific regions: Sequence locations=1-107,129-181,206-308,340 -347,370-376,402-500,524-758,901-913,985-1177
atggagcaatgccagagggactttcatgacgaaggtaaggaattctacgaaataacgtcacttcggctgtacgacatctgtagctgtattagatgcgaaaaacagtgccatttttggaaaattgggttccaaggggaatccgagtatttattggaacggatgtactcgagcatgtaattttattaatcttattttgaaaaaattgacataacattaaggctggcgagtcacttcttttactcctcgaagaaataaacaagcgcaccagaaatgaaggacacatagacatcactctggcacgaaaaatgtaatttttaaagttataaattattaaaatttctttcttaacattgggttataaatatataaatccttgttttaatgaaaaaataattaattatagtatgcttcgaaatacaaatggagctctaaaaatacatggttttgatgagaccacaaattgccgtgtcaacattgtaaggacatatatgtcttaaccctttttgtaacttgttttttattttaggatgacatttttccttagcgcctattgcaaaacgcaaaaagacaatggcattcgcgcaaaatgaacaatttggtctacaaacggccgagacattgcgacaaacggacgcccaactcttgacaacaaaacacgcattcagccccacagaaacttctgcagattcgctttttaaatctgtcgttgctgctgtaactgcgcaagcaccatcacatcaaccgtcaacctcgtcatcacagcaccaacaacatcaatcgcaactaccaacacaacaaaatttggcatctgcatcaataccacaaccaccgcaacaacaacagtcaatatcgataatacatccccaacaacaacttcaatcacaactactaacacaacaaagtttggtatctacatcaccgccatcaccaccaccacaacagccatcacatcagcatcatcaatgtcgcaacagcaaccatcacaaatacgccaacatcaaccgcggcaatttatcgatagtgaaggaaggctaacagcccatgtattcatagatgaggacgaagagacggaaacacagcaacaccaaaaccaacaatattcgcctatatctgacagtccattagagggtgtgccaccacccgacaacgataaccaaatcacaggcctaatgacttctattttaaatgtgttttttaaaaatcaataaa

SEQ ID NO: 72999 - DNA, 1725 bp, Heterodera glycines
  Genomic contig location: Contig_ID=SeqID_9958; Location=14..1738; Strand=+
  SCN-specific regions: Sequence locations=1-3,26-69,132-186,305 -529,621-838,860-1050,1074-1230,1254-1725
  Gene Ontology: Mol. function=actin binding; Cellular component=actin cytoskeleton; Biological process=endocytosis
atgccaaaaaagcagatggccattcgctccggtggtccgccaaagcaccgtagggttaaaaacgcacagaatttaaattaatttcattttaaaattattttcataaagttaaaaataaaatttatatttaagccttatttccaccaccagtagcagcagctgtgcaattggaagttggattggaaacaccacctccaccaccagcagcagcagcagcatcaacttttacaccgccgacaccaccaccatttcctactccatttcacaaacacttctcatttttaacaccgtcaccaccaccacctgcaacagttgatttggatcagattccacttcccccaacaccaccagcaacattttcattggatttttggctaccacccgcaccaccaccaccaccagcagcaacagttcatttggatatgaatcccacatcatcatcaaaggcggcagcagcagacgaaattgaacgtgaaaataggaaaaagcggcgaggcaatcggtggaacagcacacaggtcagattgggaatttattttttaaatttcaattcgattaaatttacttttttttatttttaactttgtattaggaattataaatttgtttttttttaaattgtaatgaaattatagaagcgccagactgtgcgcgtaaagaagggtggtgtgccggcaaaggtagtgccgcgccaccctgagccggacctctcggacgacgagtacgtcgtcaaggctattttggcctactgcgaggtcaaaagccgaggggtcaccagtaaatgctactacatagactgggccggtgagtcttccccccccccactgccctccaactgttttgattaaaaatttttaaagaccagcgtggtcaggagagctggattctgtccacatgcaacgacgcattagaaattaccggcgaacatctcgaggattcggctgtggatgccgcatacgacgcggtgtacggcgagccggtcgctgaccatctagcgagaaaaatcgtaatgagacccaaataccacgatcgtgagttttttttctcgacaaatttttaaaataatttaaattgtgaaattcagtccggcgtcgaatggtcggagtcaatgctgcaccgatttgccgtcagcactttgctttccacacttgtgtcacaaaggaccaatttgataaggtgggttgggggtctgctgctgtttgcctttgtctctctcgctctttcttatatttttctgggcattggttagcaggcatctcttggtatttgcccccttaccaatgctcttttctgtaaagtggagagcataaggcaggcatctcctggtatttgccccccttttgtttttcatttttcatcatttctctctctctctcatttttctgtgtattggtgtgcaggcatctcttggtatttgccccctcatcaatgctcgtttctggaaggtggagagcataaggcaggcatctcctggtatttgcccccttttgtttttcatcttttatttagtttttttgtctcgaaagtctgttgttttcaaagaaaatcattctaaaacttttataaaattaaggcggagcgcctttacaaagaattacttgtcagggaggggctcatcgaggatcccccctcccacggagctcaataaattggaggaaaggcgccttggaagcaacgtgcccacagtggccataattattaattattttcacctttacaatttta

SEQ ID NO: 73000 - DNA, 1498 bp, Heterodera glycines
  Genomic contig location: Contig_ID=SeqID_9959; Location=246..1743; Strand=-
  SCN-specific regions: Sequence locations=1-350,372-395,419-612,671 -682,727-967,992-1050,1073-1116,1138-1184,1206-1315,1337-1498
atgctgaaagtgaaaccaacaattgtcagtctctgggacgacttggtcagtgtcgagcgcaaattgctcagtgtgttggaggtggcatttgtggagcggcaggaacgcatccgctcactgtgcacttcggcctccgatttgacgcctgggaatccgaacggcgtgcagcagcagcaattgtgggcaacgttggcatcacaacagacaatgggacaagggcaaatgccgaacaacggcagcaaccaccagcagcagggagcagggggaggcactcacttcgcttctcctctcctttccgtcgatgacagtggcattgacatggagagactgaggtgagacgagagcaggggtccatcatctgttctgagaatatctgatgaccgaacgataggcgaagagagagagagagagagagagaagcatagaacggaaaataggacccagacaagagaatggagacaaagggagagattattccccctccccgaaatttttcagaaaaaaaacctgatatatggggaggaggtggggaacagatatgggggggtaaaaaacccagtaaataaccgtttaccggtcgacttatgttaccgcctatttccggttttccggtaaaattttttaatgatttttgtaacaattttttattttagtattttcatttaaatttcatcacacacacttattttttctttattttaaaattttctacaaaaattattatttcataactttttgtatccaaatttataattcaatttacggatgtacatctttctcattaagtgatgatgatgaacccttacgtgaatggcttttgcgcatcggttgtgacgattattcgattgagctcttggagagagagcggtacacaaaaagggacattttggagtttgtcaccagagaggagctgatgaagttgggcattcggtaggtgactgtccgctaaacattctaatcgtttcaaaaacccaaatttgaatccctttgtcagtggtggcatcgcttgccgaatttggcgccacattctcagggctcggctggagagctcacaaaaggtgtgcaaattgaagttgtgttttgagaggatccaacgaattttcagttcaacggggacacagcgaacagaaaacagccgcgacaaaattacagcacgaattttgattggaagaacgactgatcagtttttgcattgtattcacacaaatccatttgtaattggtccccccaaatccatttgtaattggtccccccaaatccatttgtaagccggtgatctccgccccattcttttcattcattccatttccatttgttaatgtgatttattgggtttcaccactcactgatcttccctgttcaatcattccgttattctgtgattcgtcagtcaatttactcccatttttgtccatatcattttatcattcattattattctaagggatgtaaattataagtgagacatgtgtgtaaagcccacaaatatgtaaataaa

SEQ ID NO: 73001 - DNA, 2730 bp, Heterodera glycines
  Genomic contig location: Contig_ID=SeqID_9960; Location=1..2730; Strand=-
  SCN-specific regions: Sequence locations=1-39,62-377,402-530,552 -740,762-769,791-1379,1401-1458,1480-1506,1528-2547,2569-2730
  Gene Ontology: Mol. function=MAP kinase kinase kinase activity; Cellular component=intracellular; Biological process=activation of JUNK
aggtgggcaggcagaggaggggagggggacactcggatgcaatggccaacaaagaaattcagttcgaatacgaagtcgacagcaacagggaacgcattgtgttgggccgtggcacttacggcaccgtaattactcatgatttgaatataaattagagactaatcgggtccaatactcgcaaatcagtcttgaaaaggaactccccaacaattacatacaataatgttccggcttttctcggttttcttccatgccgctgactcggcctccttttatgccattcaaatttggttactttggcattgtgccttttcaggtgtattcggcccgggacatcaccacacagcggtcgattgtggtgaaggaagtcgaagtgaagaatgaggaggaggttcagccgctgatggaggagattcagctgcactcgacgctctcccacgacaacatcgtcaaatacctcggctcgaaggtggagaaacgcgaggcgggctctttcttcctcattttcatggagcatgtgccggggggtgagaaaagcaaaatgccaaaatcaaaggcatttggactgaattggaacaaaatgacaggcagtttgagttcgctgatccgttccaaatggggtccgttggacaatgagcagacgatggcattttacgctcgtcaaattctggagggtctcaaatatttggtgggccattgcgcccgtccctttccatttgccacttttagcattctcaaaagattgttcaccgggacattaaaggggaaaatgttctggtcaaccaatactcggggctgtgcaaaatatccgactttggcacttgcaaacggcttgccggccttaacccggtcaccgacacgttcaaaggtcaattgaaaaagggtcagccattggacggaattactaccattttaattaattcaggcactctccaatacatggcaccggaagtgatcaccggcgggcaaagggtgcagcgaatttgatttgaccctttaccattttcacccaatttcagggatatggcccaccagctgacatttggagctttggtgctaattacaaaagtgacaatacttaattgattatcatttaggcgccactttgatcgaaatggtcacgggaaagccgccttttatcgaggtaattaattgctcattaatgaccaaagcactcgtttatcaacagcttggtcttccagaagcggctgtgtttaaaggtcagtcacttttgggtcatttcgccactctgaaattttaaatggttcatacggttgtccaccgttcagtcggaatgcaccgtattcacccgccaattccgacccatctcagtgagtcggcttccaatttcatcaaaaggtcattcctctgtctgtcttttttgtccaatcagttctttcttcagctgcttcaaccccgatcccgctgatcgttcgagtgctgccgaattgctgggcgaccctttcatccaacagtactacagtaatgcgtaagtcactccctttacagtatgcccagcccacaccttttgcatttcagcagccgaaatgcaaacacgaagaagagaattgaaagctcaacgacgggaggaggcggaaaacacacgagcagtgagtgcatgagagagtcaaaaggccaaatgggacggaggagggaccaccgatttggacattttgaaattccaatatttgctggcattcgaatgtgtgggattggtcctacccccccccccctccctatggcaatttgtctgatcaatgcgacttttgccttttccgatgccattgtcatgcccaagtgctgtttttctgttctctctttcgtgactgcgcgtttctttcagagttttttcgttctgcttctcatatgagtggcatgactgtctcttccgccttggccatcccttcggcgtgttcgtcttcttccatggccatcggtgagtgctccacggcacttctcttctcccattcattgtccattcagtggatttgccaaattcttctctggccactccgtccctctcctccgtccctcagcaaatacacgtcactccttccgtgtcaatgcgaaatcgaccgcccatggaacggtcggaccgtcggatgggcaatgagcgtaatttgaagttgcgcattgaaccttgtttgtcgatgccgtcctattgctgtcagtcgatggcatcggccgctgcgcgtaagtgaattcgctatttatttaagttcacaaatccctttcagtgattaatcccactgccacgtcctttgccccctcccccccgtgcccccaggggccgttctccgcttccccaaaagtccccacggttggctcctccattttgggctttgcttctgaccaaaatgtcggcgttgtgcatcagtgtgccaccgcacatcagctgagagccccgaaaccgtcaagtccactggcaatccctgtgcaattttcacaaccgaacaggtcgagcgaatggaaaagctaataatcatgtatttacacgataattacgtcactttttaactgtgtcatttccgcctcgttttctctaatttttatttccattttcaaatgccttaagtcccattcgcgaccaccaaacgccccacactgccagcccttccttcggctccgacaacgccccttttctcggcgtttccccctccacggctttgagcattcccgaagagaattcattctccaactttttcttcactctacagaaggagggcgagc

SEQ ID NO: 73002 - DNA, 965 bp, Heterodera glycines
  Genomic contig location: Contig_ID=SeqID_9961; Location=1..965; Strand=+
  SCN-specific regions: Sequence locations=1-362,385-643,665-690,728 -764,817-934
  Gene Ontology: Mol. function=receptor activity; Cellular component =integral to plasma membrane; Biological process=cGMP biosynthesis
aaacacgacgcatacaaagtggagacggtgagcaaagaatgtaataattaataaatgcccttttgttagccaatgatggataatcaaggaaaactctcggttcgactcttgaattgataaaccgaaacttttggattcgatttgcgtttctcgaggccattctcggccctgtaaattcattgaaatgtaaccgataccataacagatcggcgatgcttacatgatcgtcagcggagtgccgcgcgagaatggcaatgcgcacgtgcaacacattgccgaaattgcactcaaaatgcgaatggcaagtgatagtaaagcaaaaacattaggaaaagcatgctttatttaatacagaagcaaatcattatttaactcagtttgtgaccaatttcaaacttgcgcacaaaccggaagagattatgatggttcgcatcggttttcacagcggaccggtggccgcgggagtcgtaagagcattttcactggattttaaatgaccaacggcggcattttgacattaaaaacggaaaattccgtcggactttatttatttttaagcaagggacatattaacttcctaaaatttggcatgaataattgtcccatttcaaaggtcggtttggctgcgcctcgctactgtctgttcggtgacactgtaaatatggcgtcgagaatggtttttctccccacaaaaaaataaatttaaattataactaaaattatttttcttaggaatcgacgggaatggcaaataaaatacaggcatttttattttaaattttatacatttatttattatttgttttacattttatagatcagcgaaaattcgtacaatttgctcaagtgtttctacatccaattcgttgtggtcgaaaggggaaaagttgaaataaaagtgggtgagaagagaagacgagcgaaatgcgacgatggcattttaaaagcatttaattaaattaatt

SEQ ID NO: 73003 - DNA, 1286 bp, Heterodera glycines
  Genomic contig location: Contig_ID=SeqID_9962; Location=153..1438; Strand=-
  SCN-specific regions: Sequence locations=1-203,226-770,793-967,989 -1022,1045-1054,1076-1224,1246-1286
atgaatcgcgcctttgggccgcttttccttctctttccgattcttttcacttcatttcccatttgcaattgtatgaatcgcgaaaatacacaaacagcagcaaaatcaaagaatatgaatgcaggcggaacgggttccgaacaatcggcacaaaaagagcttttgcgactgttaatgacaagcactgattacctccaattaacgcccggccaacaattttcaactttcaaatggcttacggacgacatcgcttcccggggtggcggcattacggaccaaaaacagttgtgtgctatgcttcatttgttacgacaatatgagcaaaacattcgatgggatgccgagcgagtagcattgttggaacggatgttagccgagccagaatattcggaactgtcacaggaagcacaatggcacatatacaaatcgctaaaggatggggcaccggcagtgccaaaccgtgccgaaaatggaggccaatctcaacagaggcagcagccatcactcagtggccaacccacaggttatggcaatggcattactaagtgattaattggaaagactaacaaaaggcaaattcagaaatcacaccgatggcaacaagtggagctgaatggttggcgcaaaatcaaaagacgaagaaacgggcaaagacatcgcaaccgaatttcgctagccaaaaacactcatctgacaaaggttggacaaacaattcaatcaatcaatacttacgatatgatcaattacaaagtaattagaatcagcagcagcaaatggtcctcaaaatgaaacggcaaacgatggaaagagaatcgaattaatgggacagctcatggctaacagggagttcttgcgcatgtcgccagacgagcagtggaccatttacagacagatgatagagaatagcaaaacggcagctgagggatggcattgaattaaatagggttcgagccccgtgggcgggggtggcttttcgcgggggcgggggtcagagtcgcgggggtgagaaatttctcgcccccggggacgggggtgggggtttgtttttaattagctccaaaaaacatcacaaaaaaatttttttttttttgaatgatgtgtttggctccacattcctttattcgatgtatcgcctcgattcaattcctttttggtataattgcacagatattgtctaaaaatgaccaaatttaaggattataaattatgccagaatagtcaatttttatgggtgtttttgtctaaatccagggtttctatttcaaaattttcaaaataagaataaa

SEQ ID NO: 73004 - DNA, 682 bp, Heterodera glycines
  Genomic contig location: Contig_ID=SeqID_9963; Location=187..868; Strand=-
  SCN-specific regions: Sequence locations=1-214,236-607,640-682
atgggcccttcgccgcctctccgatttgtgcgacggtccttctttacactgctcgttgtcctggtgctccttcagttgtttgtgttcgccgattgggttgacgatgtgatcgaagtaagtgcccgggagcttttctcgggtataaactcgagaccaatgagactttcaaaagtgttggcacttttctccattttaatcaccaaaaatccaatcccttgggatgtaaaaatctctgtttcgagaccaagactctcgagctgcagaagtgggccgatcttgtcaagtcttgctgtgtttctttagattgtaaaccaaaaaatggccccatggcacgccctgttagagaaatatgagcgcgcattggccacaatggaatccgaggaacgcgaactgagccgaattaagcaggcaaatggaggggggaagtaaagcttacaatgatgaaggcattcacaggtctgaggcctatgtgagcccaatatggcatttccactcaaacacaaaaatttatccctaaaaaaaaagttttggccaaatgaccccggagcatttaattgtaatgcaattggatttaaagttgcagataattgagaagaaaattgagatgcatcaaaagaagttgaagaagctgatgctgaaggtggtcggaaacgcaacttttgtgagcaaaaagcgcaattag

SEQ ID NO: 73005 - DNA, 2402 bp, Heterodera glycines
  Genomic contig location: Contig_ID=SeqID_9964; Location=87..2488; Strand=-
  SCN-specific regions: Sequence locations=1-184,206-233,255-358,380 -597,620-1367,1389-1424,1446-1599,1622-2402
atgagacaatggaatgtcgaacatattgagggtcaatcaaatccggcagacgttgcctctcgtggcacaagtccggaagatttacaaaccaatgaattatggtggaaaggaccgccgtttataagtctaaaaaatacacagtggccacaaacaatcagagaatttgatccaaatgtatgggcagatcaaaatcaagaggtcactgtttgtgaactggcgaatccggcaagggaaagaaaccaaaggaaattgggttcctttctcacagtttatgtgaaccacttctcaaagtggaagaggattagaaatacagtggcgtatattaggcgaatttacaaggggcctcttcaatttgtacaacaaattgagccaattcaggaacgcaaattgctcaaggcaagaagtgaaactataaaaagaattaagcctctcacggcgattgaattaagagaggctgaggaagtaattatcaaagagatgcaagagaattttcctccagatgaaaataccaggaggaatttacaaatgttcacagacgataatggtatattgaggtgtaaaggaagaattgaagaaggagggtttgattatgatacagtaaatcctatttatctgtctcatcagataccgattcttgatttgcttatttctgacgcacatttggaaacagaacatggtcgaaaatctcagactctcaattatctgaggaagaaattctggattccaaaatgcagaagaatgattacgatggtcattaagaaaaatccatatacaaaatgtgggatttgtgcaaaattagaagccaaggctttcagttatccaaatcctccccccttaccaattcatcgagttaaagggtcaagtgcctttgaaacaattggcttagactattttggtccaataacaataaaggtcaatgaagaaacgcaaaaggtttggggagcaatatttgtgtgtacagtcacacgtgccatacatttagagatagtgacagattgtacggcacaaaaattcttattggctttagagagattcatgaggcgtagaagagtaccaaaaatgataatttctgacaatgctagccaatttgttctttctcataagatattggctaaaattactgaagcacattggagaaaaaataaggtttggggtcaaattcagaccagacaaagggaattagaagaaaagagaaatggtcaatgatcatgaacgaaagagaggtacaagaacttacagcaaataagggtatcacatggcaatttgcctctccattagcgccttggcgctcgggattttttgagcgactaatcggtctagtcaaacaccatttatacagagggttaggtaaaaaattattggattatgaagaattattgacttatcttatccaagtagaaaggatagtcaatgagagaccaattacatacattgagaatgatgaaattatggagcccttgtgcccaatacatattctcaatgcatcagaaggagaaccatttgagtatcagagtgacactaatgaaacagagaatacagacgatttagattcacaaattaaccaaacaaaaagggatgaactcctcgaagttcacaagaaaacaatgtataagagtaccaaattttgggaagtctttagggatgactatttattggcattaagggaacaagaaaaggccaaaaatgtggatgaacaaaggtttccaaaaataggacaagtggtactaatcaatgaccaaaaaccgtgtccccggaataaatggaaattagataaaatagaaagtataatcaataaccgaactgccaaattaaaaatgcccgacggaaaaataatggaaaggtcaacgattttattatacccactggaaatagagaccctcgagtctgaccctaatcccattaatgaaatttcagcgttaacaatggaagacacggttagcctagccagcatggaggaagagtggtacgaaattgatgaagtacaaccgaccgaacaacccagttcaacaacgacaccaacggcactgtttgaggacgacatttaccatgacgacgaaccggcggtgaaggtcatcaaagccccaattttgatattggggcaaggggaagaggacggtggtgtgctccgtaattgtctcatcaacgcggatgcacggcaattttgtcattttcccgaagaatgggacgcacaccttttctcgaaagaattgcaaattgaaagcgtgcagtcgatcattgtgtggcgaaagggagcaactttggatgatttgggattcttgcaaacccttctcactgcccaacagctgtacaacgacagattgttgttttggattttggatgctaaagtttcaactcaaaggggatctctcaagatccaagttggagttggaaacagggatgca

SEQ ID NO: 73006 - DNA, 1324 bp, Heterodera glycines
  Genomic contig location: Contig_ID=SeqID_9965; Location=165..1488; Strand=-
  SCN-specific regions: Sequence locations=1-198,225-289,311-312,334 -363,385-690,713-750,772-1127,1156-1324
atgaaaattgcaccttataaaaatattcgttgcgaacaaactggcaatggagcgaacgaagaactcgaaaattttatggacacaatttcggatatcgttgttggtgagaacatcacaatcgattcggtaagtcaactaccagtttttgtgaaagtgcaattcgttttttggcaaactcaacaagggaaaattctacagtaatattaaaatattatttaaaaattggccttcaaaaaaggcgaattcttcaattttagcaaaattttatagaaaattagattttgggatggaaaaaatataatttgttaatagattgtcactaaaaatagttaaaaatttttgtgatttttaagtcaggcggtgatttttaattatttaaaaaatcatcttttgcgaagcattttttcacaaatctttatgaacagtgttgtgccgccgcgagaaaaactttaattctttacattaaactccatttttaggcaaataccaacggagaacaccaggaaagtgaaatggaccatgcctggagaccaaaccaaaacatcgttctgcacgacgaattccaaaatgctttggcattaaacatggacgtggaaaacaataaccttgaggaagaaaattcggaaaggtaacctcagttaaattaaaatatctggcgaatgattttttatttgggtctggattcaaaaatttttcaaatccaaaaattagattttgtggtcaaaaatttaacattttttgcgattttttctttgatcaaaaaatgatcaattgttattttttttttcacatgcaaaagtaatagtaattcttatttacacgccgccattttttacttaaaaatgatattaatcaccaattttagcatgggtgatcatcactcattcgctaattctgtccaaaatggtcagcaaggtgcatttcgattgccaccaattgaaatatttattgacggatcacttccggaaaaaacggtaaagatgcgcgaaaacatttcaagtcttggggcttaagtttttgcttttcggatgaaaataagggttattttaatcaaagtgccgtttttaagccgcgcattggcagcattcaaggcatcaataatccggccattcgcagtttggatcattgtgggggcgtcaagcgcatttccggcctgatctacgaagagaatcgcacagtgccaattgtcagggagaatgagccgacatttaatgaagaaatagggccacaagatggcaatgtgtccgagttatccgtatgtgcgacggacaaaagcagccacgggagggcacctcggttagaactgattggttctgacgtttaa

SEQ ID NO: 73007 - DNA, 626 bp, Heterodera glycines
  Genomic contig location: Contig_ID=SeqID_9966; Location=77..702; Strand=+
  SCN-specific regions: Sequence locations=1-38,64-559,581-599,621-626
atgtggaagctgccaaacgcgaaagaaaacaaatcggaattgcaaaaattttttgggggtgggcataacggaccaacagtgaggaaacgatgcacggcaatggcatgaattcaatgcatttttcgtggcacattcgatgacagagtcggcactttgatgctcagcgatggcattggtgctgccaaacacgaccacatcaacgcttaactgaccagaaatggtggcatttgcgcgaagacatgcttttacctgaaattgaccgaaatttacaacttttatcaacttctaatcagcaaactgtttttgcaccaaaattcttcaaaatttccaaaaacaaagcatcaaatattcgaaaataaaacttccgatcttgctgtaatgatttaagttcaatcattccagtctgtccaatgtgctgtcgtcttggctccatggtccggccgtttccatttgacattttatgaggacatggacgatcgggagtagagaatcaagcgacgtgactcttttaaaattcggagatgaattatttttgataaaattccatttcataggggtgtatttttctgaaaatttttggatcgattcttaggagtgtatttttcgtttttattacatttttgtta

SEQ ID NO: 73008 - DNA, 1275 bp, Heterodera glycines
  Genomic contig location: Contig_ID=SeqID_9967; Location=21..1295; Strand=+
  SCN-specific regions: Sequence locations=1-217,316-494,533-581,603 -716,738-770,849-974,1006-1161,1224-1275
  Gene Ontology: Mol. function=alpha,alpha-trehalase activity; Cellular component=extrinsic to plasma membrane, GPI-anchored; Biological process=trehalose catabolism
atggtcaaccgatttggttttgtgcccgccggcggacgcatttattacaacaaacggtcgcagccgccattcctcaccccgtagggcaaatttgaatgaaatttggttgaaatttccaactttcagtttggtctatgaatactttggtgcaactggtgacattgaatttcttaaggaaataatgccaacgcttgaaaaggtgttcccattcattagcataatttatcaattaattaactgataattaataaataattttaaaaaacaaaaaaatgttttctttatcaataaactaaaaataaataaattattaaagaagttataagtaatgaaataaattagagacaattatcagggtttcgaggtttttatattttatgcgttatgcaaaaccgaccgaaataataaaaaattgcctacctttgttcaaaagcaaccaaatttttaattcttcatatctttcggtagtccaaaatgttttctattagcctaccaaattttaaaataaaattcattatgtttcaaaacttatggccaataatgttcgaaaaaattgtttttgagttctattgactttttttggaaaactaaagtaaattttttgaaatttttcaggctaatagaaacacttagagagagctattgtatgacatcaagaattaaaaatatgattacttttgggcaaacttatgaataatttgaatatttttttcaaaaattttatttggtagttttttgagtaatggaccaagcgcccaagataacttaccattaattaattaactaattcattaaaccacctaaagcaattaattataattaattagttcattaaaaaaaattaattacgtataattttaaggaattattattttggcaaacaaagcgatcggttaaagtaaaagtgaagggaacgatgaaaatgttctatcagtacagagcggacacaaaagtttgtagcgtaaacaaaaatgaaatttttaaaatttttacaataaatttaaagttaccacgccctgaggcattttgccaagacgtgggcctcgtgaaaaacatttctgatccgatggaaaaggcgaagatttggcacgaaattgcgtcggcatccgaatcgggatgggatttcagttgtgagaaggaaaagaggggcaaaatgaatacaatttatttattattttaaaacccgttttaatagtaagaaattaatttaaataatttttattcgttttttaaaaagcgatttttatcttttacgaaaattatcaaaaatttaaa

SEQ ID NO: 73009 - DNA, 691 bp, Heterodera glycines
  Genomic contig location: Contig_ID=SeqID_1357; Location=283..973; Strand=-
  SCN-specific regions: Sequence locations=1-224,248-271,307-317,379-636
atgttcccgggcgaacatttcccaccgtttttgtacggtggctgctatttgacaactccaagcaccatcaaagccgtcttggaacaagctcacaaaaccaacagcttttatttggaggacgtgctgtacacgggcattttggccgagttggccaatgtcaccgtatcggaccaattgagccatttttatgggaatggattgcaggtaattaataatcattgggcataataaacaattaataaaaattcttgaaatgttgatagccccttggtttttcaaaatttaaaaatgtttgtcatatattgaatatccatttcttaattattaaatttaaaaaatataactaaattgtaaaatttaaagttatttatataataagtagggttcaaagttgtatgccctaaaaaaagcaaaatatgcgcataaaatatgcgctaaaaatcccccaaatatgccctaaaaacccgaaaaatgcccaaatatgcactaaaatatgccttaaaaaactgcaaaaaatggcttttaaccttaaaaaacgccaaaaattgtgtataattaagaattgatttttaaaacaccaaaacaagggataaggagcattttattttacttacaattgcaaaaatgtgaatttacaaatttataaatttttatatattctaaaacaaatttacatttctatataaataaa

SEQ ID NO: 73010 - DNA, 708 bp, Heterodera glycines
  Genomic contig location: Contig_ID=SeqID_1358; Location=1091..1798; Strand=-
  SCN-specific regions: Sequence locations=1-623,647-708
atggtccgcttcattcgattggagctgaacctgacagaacttgtccgacgaatgaatctgatcggctatggacgggacgaaattatgctgatcactctgcactcggctgatcagcttaacgcgccggacggatacacgcagacatgcttcaaccaaaaaaaggcagtgcccacaaaacatttgacgaggttcgcattctcatttggatccctcacagtctcgaaaaaaatgcttaacatgaccccattaccaagctttcaggcagactttgtgggctccggatacttcctgtccctctgcccattttcggcatggcatttgcatttttggcgtcgaagatttggcccgactcgccgcattccctcattttttcttcaacagattttggcccgcattcgattttggcgctttgttgtgtgtgtacgaacggttgttcaacatgacccatttgcacacctgcggggaacaattggccaaaatggcactggtggtgaacaaatcgtttgttcaacaactgcccaatgtccgttaattggcaaaatattaaaggaaactcaaaaaggataatttcataattttttagcttttttttaaatccacaaaattaaaattgttgttgtccttttttaattaagtaatttatttaaccaatccgttgaactttttaaggttcgatttcaaagttttaagaggaaaatactgaataaa

SEQ ID NO: 73011 - DNA, 240 bp, Heterodera glycines
  Genomic contig location: Contig_ID=SeqID_1358; Location=1..240; Strand=-
  SCN-specific regions: Sequence locations=1-30,52-240
atttgccaatacttagagcatggtcatctcttgcatttggcaaatgtttgccctgctcattccaatggcacacatcgtcaacagtggacaaattagctacaacttccaaattcatttccggcactttggcctggatgcatgggctcagtttgaaaagccttgcgctaatggcaccaagttgctcatattgacaatgtcgcgccgggaaggcttcgacagcagaaagggcatccgaaactt

SEQ ID NO: 73012 - DNA, 1346 bp, Heterodera glycines
  Genomic contig location: Contig_ID=SeqID_1359; Location=1088..2433; Strand=+
  SCN-specific regions: Sequence locations=1-224,249-531,553-595,629 -862,919-925,947-958,987-1241,1263-1263,1321-1346
atgccggcactgacaacgccaatgaatggcactgctaaaggacaacaacgaaacttttggcttcctaatgagctcatctatgagctgctcctatgggtccggcccagctatttttggcgcgttcggcaaatgcttacaaccagtctcattctgtgtcgtttgcttacgggtggcaaacatgcaattacttggcatgagccttacgatgtttgggtaatgcgtgaaagtgtttttaaaaatatataatggaaaatgtccatttacttttgtgcaattgagatcttatttttctttttgaactaaatttggttgagaaaatcgtagatcaaacaattgaaataggctttcttcaagtttaaacttctttttttcaaaaataagttagcttatcttgcttagatctctgatgattgtatttctccttattctctgtcttatcattcatttgcttattgcctagcgcacgcattatgcgctgttaaatgcgggacaaagcgttctcttcacatggctttagctttattaattaccttttttaatattaaaattaaactatcattttcaacttaaatttggtaaaattgctccaaaattgatataaaaatataaatattaataaataatttatggtttttccatccagcatttggagtccacattctcagaccgtaaatttggaccaacaaaagtctgtgcgtatttgtgccgtaatcattcattgctgttgccgcgcaatttcctcaattatttacattgttcggaggactatgtcacgctttatgttctcattgttttggatagttccaagttttcgtcgcttgctcaactcgctctcgcggtgggtaaagtttaaaataaaaggaatattattaatttatgtatttagtttattatacaaatatacaaaaaatataaattgctttaaatggcacaatttattttttatatcagctaaataatttgcatttttgtttttcagcgccagggttttgacggtcgtggaccatgccgcgacactggactttgtgagagcgggtcttttgtttactgcccggacgaagtacgttaattttacaattcttaatttaattggtattaaatttgtttaaattctcttaaactagtttaaattctcgcgagtaaagctttctgcattttttaaatgacctcctaaacgtggttggcgccacctcacaaaaagtgcaaatttcggcgcttcacaaaaatgtgcaaatatcctatttttcctatgattttttatcgattttttattttaatttaaatttaattaaactatttaaattagtacttaaattttttcttctatatgttatgttgtatttcga

SEQ ID NO: 73013 - DNA, 280 bp, Heterodera glycines
  Genomic contig location: Contig_ID=SeqID_1359; Location=3075..3354; Strand=-
  SCN-specific regions: Sequence locations=1-196,257-280
atggatgagcaaaaataccgaaaaaaagtgaagaaaatggtgaccatgatgatgatgaccgcgaagcaattcaatatctgccaactttggcaaactgtatgtttttaccagggacggtttagtgcctattttgcgatttttttatgccttattaggtgcctatttcgcgattttttgtgcctaaaaaaggaacccctaataattataaataaacaaaaaaaaatgtaaaatttgaataatttaaaaataataatttcagatagcaagtttgtgaaataaa

SEQ ID NO: 73014 - DNA, 2379 bp, Heterodera glycines
  Genomic contig location: Contig_ID=SeqID_1359; Location=3925..6303; Strand=-
  SCN-specific regions: Sequence locations=1-610,632-783,805-1006,1028 -1208,1230-2379
atggacatcttagatgtcggcccaagccaatcgaacaaaaaatatatttgtgtgatcgttgatcatttcacaaaatatttggtcgcagaaccaattcctgataagtcggcagaatcagtggcaaaagtttttgtcgaaaaattcattttggtttatggcaccccacaaaagatccattcggacagaggaaaggaatttttgaatgcgacaatggaagaaatttcaaaagttttggacataaaaaggtccttcacagcggggtatgaccctcaggccaatggattggccgaaagaataaacagaattatcatcggaattctgaaaaagtcgaccgcgagcaattggacttgggatgagagattggcgtatggcgtttttgcctataacattacaccgtcaaatgttacggggtactcaccctttttgttaatgtttggccggaatgcaaaatttccgctcgataaacacgtaccatttccggttaatcctgtttacacgatagattccggaaaatacattcaattgttccgggaaaatttgctaaacatgttggaagaagcccagaaaaattcggaagaagcgagggaacagtcgaaaatttggtatgattcccgaccaaaagtcacggccaacaagttccaaaaaggagagaaagttatggtcgtctttcctggtcaaaatcgtcgttcgcctcacaaaaagttactttggtcacattttggaccatatttgatcacagaaattggtgattcatcggcaaatttggtaccaatagacaaaaaggaggtcaccccaataaaagtgccgattgaacgattggttaaggtcccaaaaggcgtcccagacatttcgacactgcctaaagggaaaaatccgtttaaaaacgacctaaaattgttgtcaatgtacgcaggaattcgttcagaaatttgcgaaatgactggaaataagtgccgcgaaattgggggaaaaagcgaatcgcaattggggacaattgcttcagattgtttggggggaaattggaaaagcgactccttttcagagccaatggatgtcggaagtgtcagtgccggatttggatggacttcggagtgcagtggaggcggctcggggcacgagctgtgcgagaaaatcacgctgggaagtatcgacccggtcctgaacatgtcgaatctgggatcggcggtagtcaaaacaccgcttcaagcccttctcagcatctttctgctccgaacgggcgtggcttcttcgctcacggcagcccaaactttggtccagacaattgttggagcagaaccgaagctggagttgtgtatgtacacagggaaaaggggggaccaaatcagcaccggcaaatacccaacggaggaggaccaacggcaggctttggagaagtgggtcggatcgtgctttgtggctcgacaggctttaaccgagtcgggatataagcccttgtcgatgcaaatgccagagggagtcaattcgctgcccgattctgagaaaaacaaatggcacgaggtcttcaaagacagttcatgggcactcgaacgtgtgcgggccacgattgtgcataaagcgagccgctttttggcacatgaccgtgttctgctcggagactcatcggccgaaatgctcgccaaacacatcaacagctcctactgcatcggaggagagagttccatggccgacttaatccgccaatttcagccgatcgttttgtcaagccgtgtcaaggcactgctcattttggctggacgtgattctctgatgcagggcgaaaccgaaaaatcgatcgcggcccaattcgaaatgatcgtcagcctgtgccagcgcttcccgcacgtgcagatattttggtgccctccaccgtatgtgcacgccaaggcaacggaatgcgaggagctgatcacgaaaatgcacgccatcatcaccaaatcgccgatcactccaattttcaccaccgacaaaggccgatcagttttggaaattttccgattcggggaaaatttcaacaaacacactgtttccgaagaggggaaaatgtgtaataatggctgcaaaatgcttaaggcctggattttctcccagacgaaattcccgggcgatcaggatttgaaaattcggaccgtcaattctgcagttgtctctacgagtaatcgagccgattctcgtatgaacccgacggttgttgtggccccgaatgttaccgcaagagatcgagtcgatccttgtcggattggaccgttcccgccccaaaatcgccgtggcacttcgactcgccatcatccgtatgctggacaatggcgcaacaccaatcgctatggaccgccgatgaatcgtcgttccgatccgtccgactctcgcccttttcgccgttga

SEQ ID NO: 73015 - DNA, 2596 bp, Heterodera glycines
  Genomic contig location: Contig_ID=SeqID_9969; Location=1710..4305; Strand=+
  SCN-specific regions: Sequence locations=1-86,108-1518,1540-1550,1572- 1669,1691-1721,1743-2596
atgggccaaaaagtgcgactgaattcggttggcgaggaaatttgctacgacgaattggtgggcaacgcatctgatgttagcaacttttttgtgtaaatataatttttgtcttttagggctcatttactttcaacccaattcaatcggttttcgaaaatgaaaccgaaatggaattcactccgacgcagaattatgacttaggtaagaaggtcaaaaaaagactgttcaccaccaactttgtcatgtcagattatctccgttcccttccctcgatggtggtcaatggcctcttcccccttctgcactttgccaagcggttgctgaagtccaagcaaccggaagtgatcgaaggcatcacgcggcctcgccatttggtcaaggagtttcaggtgagcagcagcggagggacgagacgcatttgtgtactgtgacatcgctttccttccaaatttacgcttaacaaataccaaaattatttaaaaacgatcaaatgatggtaaggtgtgcttgcctttggcattttaaaaatccaaaaattgattttttttttttcctgatggaaaactaaaaaaatgccgggactcaattttatttgtgtttttggaattgttacaattatttgatccaatttttcggtaaaaacttcatccctttaggcgctcctaggcaaaatcaacgaggttggcctcgtgtgcgtgcagctcgaggtgcaatttgcgccgaagtttcgctgtgaaagtgccgaattcactgtgccggcgccgatggagccgcccgttactttggtaacaaaattgcattaaaagcatttaattaagtattatacaccagggatggcacggaattccgatttccgacgtttttggggtcggaattccgatttccgaaaatttttggacccccggaattccgaaaattttttaggcctcggaatgccatccctgttatacacactcattttaaatttagtcagtgaaacagccaccgaaggatgacaaaagaaaaagtttgcgtttattttaacaattttgttttaatttgtttgtttccagtgaaaagacacggagcggttgaggaaacagtgcagaaaaagacactcaaaagtttgttgttacattttttagaaaaattatatattttcccaaaatattaccattttggaggttttttttgatatcatggtttcgaaaaacttcaaaacttgggacgggcacacttgaagaaccaaccaaatatcgctttttctacgacaattcccgcatttccagagaagaatgccggcactccgttgacgcccgcgaatggccctattttggtcgggggtttgccattgtccacgcatttgcacacgccctcgtcgtccggcagcttcaacccaatgggcgaaattgtgaagctcggacagaagccgatgcagtcggcgtggcgaaaggcctcaaatgtaagacggggaaaatgggggggggggggcgggggcaccccaatttaacttgatcgttttcggaaagaaattcaatgatatgaattttgttttttacaaaattcagtatgagttggttcggctcccccaatttgtttaaaaatgcactaataatttaacttaattagatggcaaaaccgccacccccgacgcacattcatcagctgaaaaagcgctttgattattcttcaacaaccaccaacaacaacaccatggatggtggtggacatcacaacgaagcggacaatgcgtttgacgaattcgcaacacaacaaaaggggacggaggagggcggcgccggacagcaaaacgcgaccgttgctgacgacgcggcgttcacgacacagtccacgtcatccttcgggacgttttgcaaagagcgcaaaatgggcagccaaagtgatgggggaaatgggacatttgcattcactaattgtcatgcatttgggttaaggaccccaccgaaagtcaataccgaaggtggcgcacaacaaactcatcgaaatccatgacgattcgcccgaattttcgcatcgatcgccactccaacgcctccgtggccaagaaacaaagacggccgcccacaatcagtttggcacaaattcatttcatcaaaggccggtgtcacacgcgtttacaccgtcgaacaacaacaggagcaacaaccaatggaataacggcaactttggagggaatagccactggaacaatggcaaatctgccaatggaacagcagcaaatttggcggagacgaccaatggaacaacggcaaatttgggggggacgacccatggaacagcggcaacaatcagtggggcagcggaggtttcggtggccaacaaccgtaccaaccgccaccgtcggaacccaccagcagcaccttcagcgaattcaagggcacatcacgaaacgacacgtttggggggaacaacaaccaatggaacaccagcaacaatcagtggggcagccgagggttcggtgaccaaccaccacccagccgaggagggttcagtaaccaaccagcaccgtaccagcagccacagcaacccatcagcagcaccgtcaacgaattgcatcacatttctcaaatgtttgttggctaccaataagatttga

SEQ ID NO: 73016 - DNA, 1407 bp, Heterodera glycines
  Genomic contig location: Contig_ID=SeqID_9970; Location=707..2113; Strand=-
  SCN-specific regions: Sequence locations=1-27,49-373,395-821,844 -918,946-1062,1093-1123,1145-1342,1366-1385
atgaaaatttcttcgctggctacaaacttttccattgaaaatttgctgtccaagccgcacacatcaccaaccccaccaccaaatgcttctgacactgctccccccattgtgccaatgccaatgttcctcccattccctgcggccatgccaacaccagaaacagtgcctgcggcaacaatttttccgccgccatcttcaatgttgtggccagtgcatggctggcagtttttcacgcctattgccactgcgcctggcacaaaggtgtggtttaattattagttttagctaacatttaattcttacaaatttgcaattcattttgaatatattgaggcaaaagatcatcattaagactaattaggatggacttaattagagaggggtgggggcagcataaatgggctcgccctattcaaacacaacggtacttttttatggaggaatacggtatttcatgggcaaatctttaaaattatactgaatatgtctgaattgatatgattagagaagttttattggtttgattagattatagagcagaaacagtccgtttatattttgtttttaatcgaaaaacagattaagaagttttcagtttttcagcattttaatccgaataaatcccttgcccgtctctagatcatataaatttaaacaggagattaaggaactcaaaatgactttcttttcaaataaaaaatcaaatttttaagcaaaatgtcaaaacgatgacgactccgccaagttcaagcagtacaacaacgggcacagcaccaactgccagcaatgacaataaccaccatcaacagcagcaaaaattgacagcagcagcaacagcttcagaaatggacagaaaaactgggaatgagcaaatgccaaagctggcaccgaaaatgccaacaaatccaaacaatgcacatggtgatgatgatcatcatgatgataaagaggaccatcatcatcatcttggaaaaataccgtccaacaacagcgcattttcaagcctaaagaaagcttgctcggctactgtagcgactcaattttacggtaattctaaaatgctattttaattttcttatattaaatttttaactctgtttaaaactattgaataacgaacggtttttaaaaatgatttaagaagattactataattgacccgtatttttaaattggatcggttactgtgttttttcgtttttgtaattcaattttttcgaaattcaatttaaatttaaaattttctatccaccaaatgataaaatttcaaaaaaattctccgaccgtaatgctttccacaacatccaggagaaattttcaaaaaaaaaagaaacgtcaatttgggttcggcaaaatcaattttttccatttccgtcatcccatcgaattactgtgttttgtaataaa

SEQ ID NO: 73017 - DNA, 438 bp, Heterodera glycines
  Genomic contig location: Contig_ID=SeqID_9974; Location=1271..1708; Strand=+
  SCN-specific regions: Sequence locations=1-391,413-438
atgatcggagagattggaaagtgccacagaaaaatgcctttcttttgtcaggtgagcccgaaattgagtgcggaccgggcattgtgcgctttaatgtgaggactcgcaaaggcaacgcgtcggcggtttacgtgcggggccaaagtcagaacgaggactgcactttccacaacacgcgcaacatcaccatcgaattggccaagtgcaacgtgcgacggaagcgggaggtgaacccgaacccgggcattgcctaccaaatgaccgtcgtcgtccaattgcacccggttagcctaattgtttggaattggaaaataaatcactcaaaaagtgttgcccaatttgcagctatttgtgaccagagtggacagagcttacaatgtgaattgcttctaccgagaacagagacaagacgtcagtgtggactttggagtgaagtga

SEQ ID NO: 73018 - DNA, 165 bp, Heterodera glycines
  Genomic contig location: Contig_ID=SeqID_9975; Location=422..586; Strand=-
  SCN-specific regions: Sequence locations=1-165
  Gene Ontology: Biological process=morphogenesis of an epithelium
atgcagtcgacgcagaatagttgtccgctggagatgcacaaaatcccggtggagcgctgtgacccggtgtttgacaaggcatgcgaaggcagaacggagataccattcacacgggccaaatacgacaaaaccacggggcatgggctgaactcaccgcgcgagcag

SEQ ID NO: 73019 - DNA, 892 bp, Heterodera glycines
  Genomic contig location: Contig_ID=SeqID_9976; Location=1852..2743; Strand=-
  SCN-specific regions: Sequence locations=1-695,765-892
atgctttccatctggcataaaaacagctcctggcatgttccagtcgataatggacctcatgttggcagattctggcttcgcggcagcctgcctagtaggcatcatcatcgtcaccaaggaccaaaaaaacattctgttcattggaaaaagatgttctcgcgatatcaagaatggggaattggtgtcatacgtgaaaaatgttcgtatttccaagatgaaattagaatatctcggacaaattatcggcaaaaacgggcgcagacccgaccccagcaaaatctccgccatcaatgagatgcccgcactgtcggacgtctcttcacttcggtcatattcgggaatggtcaaccattaccaacaattcattaaaaccatgcgcctcgtcagtaagccgcttgatgttttgctaaaaaggacacagaatggaattggagcgtacaaatgcaaaaaggcattcgtcagactcaaagaactttggtcatccaaattgctgctcacgcgttagggggggggggggggagagccgctggcgggcgaatggcggcggaatgaatcttcgcattctaatgaatgtgaatgaatgccttcttcatcatttcgctgcccctccgatcgatctgtgctattatttccctttgatcactttcaatttcttttctctcgtcgcgatggacaccaaaaaattcactaattactttttaataataatttttattaatttctatttatttagtaatcaattaaatttgtttttttgaattttagatgttttttcctttcaaaaatatgttaaaacaattgaaacaaaggcgaataccaacaacgaattggataattttattaacacttattgcaatttacaacacacaaatccatggtaaatgcaaataaa

SEQ ID NO: 73020 - DNA, 388 bp, Heterodera glycines
  Genomic contig location: Contig_ID=SeqID_9978; Location=3872..4259; Strand=-
  SCN-specific regions: Sequence locations=1-83,127-213,237-388
atgcttcaaatctttttgacaatttcatttctgttgataattggaagtgcaattagcaatggaactgacgaagtgaaaagaggtaaaatttataaatataaaatgtaaatttaatttaatttatttgcaaattaacccaggattttgtccaaatttatacaaaaccatgcttatttattggcaaaaaaatgcattgttttttcattcgattacaaaaaaataattaattaaaaaaagggaaaagatttctaaaagaaaaattttcacaacatttattgtttagtggaaataagtctacgggctttggtggatgatgccatcaattgggcccaccacattggcatggcatggcgagcggacaaaaaatttccacggtgatttaaataaa

SEQ ID NO: 73021 - DNA, 354 bp, Heterodera glycines
  Genomic contig location: Contig_ID=SeqID_9979; Location=2118..2471; Strand=+
  SCN-specific regions: Sequence locations=1-3,25-47,69-156,178-329,352- 354
atgcccttttttcttatcttcctcctcattccattctctcattcattcttcctgtattttctgttcattatgttgctgcaaatgtcaacagaaattttgtgtacgtttattattcccttattttccgcatttattttgctagacatttaagcttgtaaccaattttaacaatttcaacacgaatttttaaactgtagatttttggaacttcaaacttcacttttggattccctcgctttggtgcttttcccacttctttcagtcagttggtctgccttgtttcttcattggtcgattacttttgctgcaactttttgttcgtggattcaatttgatcaaatgtgatgatcagaa

SEQ ID NO: 73022 - DNA, 695 bp, Heterodera glycines
  Genomic contig location: Contig_ID=SeqID_9979; Location=4589..5283; Strand=+
  SCN-specific regions: Sequence locations=1-19,46-104,239-458,481 -645,667-695
atgaaattatttccgctacttttattaattattttatttttaattgacaaaattggatcagaaaagaaaaaattgcaacaaaagtcatttggcgaaatatttggagaaaaatgggaagagaaagaagaagaaaaacgaaatgaactcaaaaaaagagaaataattggaaaattttataaaataaaagagaaaataaagcaaaaaggaagaaaatattcaaaaaaagaatggggaaaaattaatttgaaaatagcaaaaaaattgggaacaaatcgcaaatatatttatgaatggatcaaagaatttggtcttcaaaaacaaatgcataaaaattacaaatcaaaaactgatgaagaaaaattagaaatcgtgcaaaaattcattgaaataacaaatgaatataagcaaaaaagaaaaaaatatgccgaaatttgcaagaaaattggagttagtgaattcactattatgaaatggaagaaacaatttggcattcgcggtaaaataacggatgaagaaaaaatgggaaaaatgaaaatttattgggaaataaaaaaagaaaatccaaaaatgagtgacaatcaaattgctaaaacattgagaattagtctaaatagcattataagatggaaaaaacagttttgagaagaaacttcgtcgaaaaaagaatgatcctggctatttaacgcgataaagaa

SEQ ID NO: 73023 - DNA, 1973 bp, Heterodera glycines
  Genomic contig location: Contig_ID=SeqID_9980; Location=693..2665; Strand=-
  SCN-specific regions: Sequence locations=1-175,200-257,280-311,375 -388,418-868,896-1107,1130-1353,1379-1694,1733-1842,1864-1889,1911 -1973
  Gene Ontology: Mol. function=calcium channel activity; Cellular component=integral to plasma membrane; Biological process=transport
atggccaaattcttttggcagtacggcgaagagccaatggcaaaagcattggtggccattcgattgtacaaatgcatgagccgcgaagcagcgcacgactacacggaagtggaagtcagcaaccaactcagagagtgtgccaacgcggtcagtggtcggacaaagcgacaaacttttgggaaatgggcgggcaatggggttaatttcagggacaaattggggatggcttttgtaagaatgcaggggggtgaggatggtagattttgaaaatgaaaaatgcaaaggggcggatggtatttgtcgcattcgcttttcctttgcttttcctttgcttttcctttgcttttcctttgcttttcctttgcttttcctttgcgtcgtgccaatgcgctgcttcttcttcttcttcctcctacttcttcagttccgcgattggtccctggagttgctccacaactgtcatcagcaggactctcagctgaccatgcgccttctgacggccgaactgcccaattggggccatcgcacttgcctttcgctggcggtcatcgccaacaacaaacgcttcttggcccacccgtgctgccaaattcttttggccgaactttggcacggcggacttcgcttcagaaggtgcgcgttgcaattgcgtgtaaaagcaccaatcgcaatttgttcagtcaatcgaacttcaaagttgtgcttggcattctgttcccaccgaggtaattaataatgaattgtctcatttcgcctaatcactcgtctaatgactgtctgttcattggcactttcatttgctgcagcattctcttacttgacttcaaaacaaattcttttgataacttccattcaaatgccgacacttcacttgaagaagaggaagaagtttatgaagaggaggaaagcaatagtgacgaggaaaaagaggagggcacagagtgcggaggagggaaacagcgggggacagagacgacgacggcaaaacggacaaaatgccattttagcaaaatgtcagaaatgagcgaagagcgggaggaggagcagctgatggaggaacggaggaggagggcaggggagcggcagcaacaattcgtgcggtgtcaatgtttgggaaatcgtaaagaaatgcaattgccaatggcgcatgtacgggaaaaggacggggataatggggacagactgaaaaaggacagacaaatggggacgggacggcacgagacccatccctggcacgtcgtaccctatgtacacgccccgccgccccgccccctctccctgggtatgtccatggtgtatgtaatgcaataaaaacgagacaatcgacgttagtttgattttgcgatcaagtaccgctcccccgcccctcccctctccggttggtgccgttcattttcatgccgatgctccgtctcccctccgtccaccactttcagtgccaacggcgggtactctgtcggccgacctttcccatctgccgccttttgtccaaatttgtgcttttctattgcgccccgatcacttccttctggacttggtccatctcttacgccactttcatgctcgccctgattttcgtcctgctgatcgaattccccagcgaagtgtcccccgtcgaatggtttctgttcgtttacgtcctttccttcgccatggaacacttccgcaaggtttcgtctgtccctttcccttttccaaaatgtttcttctaactctttcagcttttcgtgctcgagtcgtcctctctgattgagaagctcagtgtgttctacagtagatactggaacattctgaccactgttgccgtcctctcttttttcgtcggctttctcttccgtctcaatccgtccaccgtccacactctctcgcgcactgtccttgcctctaactctgtgctttggcacatgaaactgtttgattttctcagtgttcacccgcgcatcggaccttacattacaatggctggcaaaatg

SEQ ID NO: 73024 - DNA, 1491 bp, Heterodera glycines
  Genomic contig location: Contig_ID=SeqID_9981; Location=1..1491; Strand=-
  SCN-specific regions: Sequence locations=1-250,312-578,600-1491
  Gene Ontology: Mol. function=calcium channel activity; Cellular component=integral to plasma membrane; Biological process =gametogenesis
cggcgagcggcgggggagagacattcgtagtgcgaagaaaagtcgccgggggttagtcgcgaggggcgggacgacttgagagagacaaacgccgttaagtaccgcgaccttttccaacgccgggtccgtcagccgccttcctacgcttggattgaaagagtgtttcagcgtagggattgcatcaaattcattcccgtcggcgatcactccgatcggtctgtgccgtccttccgctggccgttcccttgggctttcctttcctttagcttttcctttcccttggcttttgcttttcccttgcttttcctttctcttgtagcatttcattgccttcagttgccattgcggacgtgtcagtgcttcccattcgcaattggcactttcgcgctttaccacttcaattgtcgttcgtcgcggcactgacggggaccgctcagcggagaaaggcccaaacgaagaaagggcccgttggactattggcggatgcaccgcaccaaacccaacggatgcgtacggagtcattcaatttcaggtgattgggcaaagttgttttttgctttttgaagggccattcgaacgaatgccaaatgaatgaatgagcaaatcaaatgccgtggaaagaatgcctttggcaagtgaacggtcccttctccgattagggcggtcctcacgtgcacaaagcgcgttatgtgcgcttgtcctttgactctgagcctgccgatgtgttccgtcttttggtgcgcgaatggggactgagtatgccgcggttggtcatcacagtccacggagggatggccgacttcgagtgggactttgccggccaattgcttttcgggacttttaaaattgtcagagtacccgagagagttggcaaagtgttccgcgaaggattgctcaaagcggcagaaacaacgggcgcgtgggtgctcaccgctggggtttttgggtttgtccgtccaaatggacaggccttttcaggtggactcgggcgtagtcaaacatattgggcgtgccctcgacgaggcgggcatttcggcgaggttcgctcccattgaacggtcgcttcagacaaagttcgcattcgttcagaatgcgttcgcggattgtcaccgttggcattgccccatggggacttcttcagcaccgcgagcgcctcctcggccgaaatgtccaagtgccctacgacagacattcgtccggcagtccgtcctcctccgctctgcccggcgtggttcgtccggcggccttgtacttaacgaccgccactcgtactttctgttggcggacaatggcaccgtcggccgttacggggcggacatcgttttacgcagacggcttgaggaatttttggccagcagagcggcgaaggaagcgcacgacgggcgaggaggcacggacagaggcggcagaagcaatcgaattccgatcgttagcgttgttttggaaggcggactttgcacgctgaatttgatccatcgtcacctcacgggg

SEQ ID NO: 73025 - DNA, 514 bp, Heterodera glycines
  Genomic contig location: Contig_ID=SeqID_9983; Location=1060..1573; Strand=+
  SCN-specific regions: Sequence locations=1-32,67-87,110-514
atgatatatcgtagaagtcccaccgaagaagaagtgccatttctccacaaggcaatgcacaaattgatgtccatggtattttggtgggttcattctttgtgtagagaaaacatttagcaactttttcgatgggctctcaaattgggaccgatttattccatgtcagtggtaaaaaagaaaaaagcgaattcaattggaggcacttttgaattaagtaatgcttagtatgttaatgctaacagattttataaatgctattgttagtctgcttcaaaatttaagcatatggaaatgtgagcttttttattggcacggaatggcagcaacaattatttaattgctgaccaaatcgctcaatatttacctcaaaaattcgtattttacgcatccccccagcgttgcttcttccagttactaattgttcaggtattgggttttctacacaatctattggcatcatcaagagcagtttacggtgagagcagggacggtttctacaaataaattttcttga

SEQ ID NO: 73026 - DNA, 188 bp, Heterodera glycines
  Genomic contig location: Contig_ID=SeqID_9984; Location=330..517; Strand=+
  SCN-specific regions: Sequence locations=1-30,52-188
ggtgaatggtacttcccgtaccattacgaatggacggacgaggagctcggcgttccgcccgacgacgcgcctgacccggaggaacgccaattctggggccatccgggcgaactgatcggcacttaccgcgcatagaaagagccgtttacattaggagtcttcattaatgacgagttgatcgaaagcaa

SEQ ID NO: 73027 - DNA, 641 bp, Heterodera glycines
  Genomic contig location: Contig_ID=SeqID_9985; Location=138..778; Strand=+
  SCN-specific regions: Sequence locations=1-234,256-383,418-548,574-641
atgcgcacctccgcccgcgcatttgaccgcgtggatcgcggtgtgcacagcgctggtggcgcttttggtggttgcggaggtctgttaatttgagcatttaatcaatattccgttaaactcctatttctcaattaagcttgtgcgcgccgggttcaagttgcgccaatttttgaaggaccgcgccttcaaaaaagggattatgcgccgccatcgccagcgtgagtttctcactattaaatttttagcaaattaaatacaggaatgagcgccgcaaggcgcaaccgtcaaccggtgagcgcgccgactccgcttattttgccggcaatgttggccggagtttcgcttcgcccgacgggcgtcaatttgacggtggaccgggtaggaaattttaattaaaatctttatatattttaatttctcactcattaaaattacaatttaaatttaaaggcagaggggcagcgccgcgcggatggtacggacgaagagcccgtgtacgatgaggtgccgcttgacaccgtggaacaaaggcgtgatgaagaaaatggggaggaggatgaggaagaagatgacagtgatttttagtgaatcggcaagcgatcactcaccatttaaccaatcgatcgatttttcactttaaa

SEQ ID NO: 73028 - DNA, 851 bp, Heterodera glycines
  Genomic contig location: Contig_ID=SeqID_9985; Location=986..1836; Strand=+
  SCN-specific regions: Sequence locations=1-311,333-567,594-600,625 -785,808-851
atgtcggataaaaaagcactgttcaagcgcgttatcgctgaggttgacctcactataagcacgggaggcataactttgagtgggccccgtctgtctgttccccgtttcattccgtttgaggaaaatgggcgttgccgcgcatgtaaaggaactgaggctgaggtggacacaatggtcaccaaggagggaatcaccttatggtgtacacggattgaaaaggcccagtttgtcccttttgacattgtctacgagcttcccggccattgtttctttcgcgtgaagaataaggcaagggtgttcagtgttccatacagcgaactgccgtcctcagacaagtgcgcccagtctctaccaccaccagtaaaacatcaacggacaccggacgacgaggaggagaagaatttgagacgtaaggcaaaggtggcgcttgacttagtggaagctggtctagcggcagacgcaatgatgcaggatgggacgcgttggaagaaagccaaaaccgcgatcaatgtgctggccaatttgcttttggcggaatcattaacagatgtctcaccaacttttgatcaacaacaacaacaacaacaacaacagctatcgtcaaaagaggaggagaaggaggaatgcataaacaacagcagtgctggagcagcaaccgaatctgctcccgatggtgatgtaatggacgatttcgtcaatagtattcaagcggcgacaagcaatatgcaatagcaaaaaagcgcaaaactcgctctgacctatatataaaagctgattgaccaattttattctccataaatattttcaagctctaactttataaaaaatgttaaattctcaaccgttcagta

SEQ ID NO: 73029 - DNA, 955 bp, Heterodera glycines
  Genomic contig location: Contig_ID=SeqID_9985; Location=2473..3427; Strand=+
  SCN-specific regions: Sequence locations=1-13,40-253,276-743,766-955
atggagcggtataaacggcaacaacaacaacaacaacaagctaaagttagtcaactaataaaagaaaatgccaactggctttgcgcactgtcgaaagcaaaatgtgtgaaacgatgcgggagactgatcagaaaggcgaacactgatcagctgctgtcactggtggaagtgtgcttgaacattgttgcttcccgattccgactgacaactcggcagaagaaacgactaatgccctacgtggacacggtgcgccgcgtgagcagagcgaggagcgagaggggcgctaagcgagcgcttgtcatccagaaaggagaggggtttggcggactatttgcagccctcttaacacccgtcttaattgaattggcaaatcggttgtgacccgaaacacataaataccctcgtaaaattgtctcacacgcattcattcattaataaaaatggcaaaaaattcattctcgtaccacaagaaatttatcggggtctcacctctgtctcgcagacgggagacctcaatttggacgcggttcgccacgacctggaccgggccaggggtggacggacaacaacaaatccttcggcgaaaaatgtcaattataaccagcagctccggcgttatttacagatgagaaaggaacatgcggacagaccaactaaagttgagctgaccaagggaataagggtactgatgaatagaggtggcgaagaaggcgaggttgttgataccccacgccgtcttctcgctcctccagcacctcctccgccgcctggaagacctcctcgtcgtccaccgcccagtcctccgggtcccgggggtccttcgccaccaacaagtcccccacctcgtccacaacgctcctcgagaccgagcaggacttctcggagaagtggtcgtatggagcaatggaggaaaaggcgatacgatatacaacagcaacggcagccgccgccgctg

SEQ ID NO: 73030 - DNA, 162 bp, Heterodera glycines
  Genomic contig location: Contig_ID=SeqID_9987; Location=171..332; Strand=-
  SCN-specific regions: Sequence locations=1-162
  Gene Ontology: Mol. function=monooxygenase activity; Biological process=oxygen and reactive oxygen species metabolism
atgaaaattctgatcattggtgctggcgcttcgggccttccggcgctgaaaacggcgttggaatacggcttggacgcggtgtgcatggaaaagtcgttggatattggagggctgtggcgctacaaggaaaatccgggacaaggagaagggacagtgatgaaa

SEQ ID NO: 73031 - DNA, 1898 bp, Heterodera glycines
  Genomic contig location: Contig_ID=SeqID_9987; Location=2083..3980; Strand=+
  SCN-specific regions: Sequence locations=1-454,476-1216,1239 -1683,1706-1898
  Gene Ontology: Mol. function=carboxypeptidase C activity; Cellular component=endoplasmic reticulum; Biological process=vacuolar protein catabolism
ttcagtttttcgaattcggtggaatacgaagaagcgaatgaatcggacgaaatcaccgaccctttgcccgggctcagcttcgaactgaacttcaagcacttttctggccagtctttggcaccgttttccaataattggccctcttaaggctttctgcaagtgtcccccacccatttcctccattattggttcgtcacctcccaaaaagactcatccaaagacccattggtgatgaacagaagcaaatgaagccgtaatttggttggagctgtccttttgaaggtgttttggttcaacggtgggcccggctgttcttcgctggacggactcgtcaacgaaatgggcccttatttggtgaacccggatggacaaacgctgcgagagaatcccttctcctggaacaaatttgcatcggcgagtgctttgaactgttggaactgatcaccgtgccattctgtctctgtgttggttcagatggtttacatcgaagcgccagcgggggtcggcttttcctacgccaccgacggaaacacaacaacaaacgacgacttggtcgggttgaaggggtcggcagaccaatcaaataaacacatcatctgaagtcgggaggggagggaatccacgaagtcgagaaatgagtgactgctccgactccctttggttggccaatgctatgccaatcattctttcttggcacaatttgtcataaaatttgcctattaggccaatcgactgattctctgatcattttatccctttttaatcagacttcgctcgaaaattacgaggccatcaaacagttcttcgccaaacacccgtctttccgtaatcactccgtttttatcaccggcgaatcgtacggcggcgtttatgtgccgacgctaaccgcgcgaattgtggacggacaagcggaattccccataaatttgaaggtcgatccttttattaattgagcaatgcgttggcatttcctttagggaatggccatcggaaatgggtatatgaacgcgaatttgaacattgacacttccgctcggtttgcttatggccacggaataattggtaattggagagacggacaattggaacaaaatgccaaattggaaaacagatgagaaaatatggaacgaattggagcagcggtgctgtagaggatgcattggtgggcaatttggccaattaatggggagggaggggagagagtggcccatttgtgataattaaaatggaatggaattctctaattccccaccccccaaaaaaaaagatggctgtgatttgacggcgttgaaagactcttgcgaacggatggtcgggtcttttcctaaaaaggcattctttcgtttttcttttaggtggacgacattttcgaattcctttggcacggcggattgaatccctacgatttgttcgtccattaattgcccaattagcccggcccggcggcttttcctttggctctcctctccctttgaaggtaccgcgattgcgacccgagcccgggccgaaattccatccgcatggaagtgctcaaaaatgggctcgtccctccgaaaatgcttcgccgtttcttttccaatgtgacacgaaacttccgccggcgtctgcaagtattcgtgtcgattacaaccatttcaatacgtaccattcacttgaaaggataccgtacaaggagcacaaaacgttggcacaccgtccgtgccatgtttaaacggtaaaacgattgaaaaaagaattaaaatggtatttgaatgccttttagatacggatttgaccacatatatgaatcttcccgaaggttccgcacaataaaccaacaataataccaaatttattaagtgcgaaaggcactaaacattccggacagtgtgggacatgggacatttgcaggttggcat

SEQ ID NO: 73032 - DNA, 975 bp, Heterodera glycines
  Genomic contig location: Contig_ID=SeqID_9987; Location=1291..2265; Strand=-
  SCN-specific regions: Sequence locations=1-313,337-348,377-975
atggaggaaatgggtgggggacacttgcagaaagccttaagagggccaattattggaaaacggtgccaaagactggccagaaaagtgcttgaagttcagttcgaagctgagcccgggcaaagggtcggtgatttcgtccgattcattcgcttcttcgtattccaccgaattcgaaaaactgaaggaatcgccatggtcgaattgaggacggaccaggacgaacagcagatgaaccagcagcaaacggagaaacatattcaaagggacggaggagagaaaaggccaaaggaacggaaaatggccaatttaaaggaagagaaaacaaataaatatacaattgcctgacagaagcaaagcaaagtaaagcaaagctaagactgtgcccactttcttttatttgtgtcccgttattttcagagacattttgccaccgttttcgcccttattcaaccaacagcagctgtcgtgtgttctttttttgtcatttggccgaagaaaatattttgcttttgcccgaggggccaatccccgccgaagatttgcccggggcgataaatcaaagggctaacgaatattcactggtcaaaggaggccaagaattaattgaaccatctaatcgttgatcaaaaaatgccaaatgaagtgatgcgaaagggaatcaatggaatatgacatcccaaaggtcattttggcataattaatccccccttgagaagtgtcttttgtcttttccgctcactttttcatttcgtttttaccatctcaacaattagccgtcattaaatgaaaaggcgcaaatcgaagaactgtgtaatatttttacatttgatgggcaaagtgtttgttgtcactgtgcgacttcggtggaaactttgctcaattttctcaatttctgtggcgaatcggtcgaagataaagcgatgagcggcgacggatgaaagggggggggggcaaagattaaagggattaaataaa

SEQ ID NO: 73033 - DNA, 1538 bp, Heterodera glycines
  Genomic contig location: Contig_ID=SeqID_1361; Location=2541..4078; Strand=+
  SCN-specific regions: Sequence locations=1-552,574-756,778-1189,1230 -1503,1525-1538
atgaaacggtgagcaaaatttttggaaattcgattgggaatttgatgttctacaatttcagttggattcgcaacgacatttggatggacattttccctcattttgaccgtccacaactcggcctcaaattggcacttctttcgccacgtttcgatgagctggtggacaaacacttcgatggcaaaacagaattgacaatttggcgcccgtttaaaattgaaaaaattggaactgaagcaaaaattgctgttgagacgaagcgaaaagccaaaattgtgcattttccgttgcccgaccgtccgatgcacaacaaaattcgctttaaccgccttcagattgagtaattcaaagaatgaattattaactgataaaagctacccttttcaggtacatcgatcattccgtcgtcacatttctccgtaccaaccagcaaatgtttgacaaaggcaccaatttggatttgtatatcgaggccaaggatgtcaagccgatttgggatgtttttgtccgtcaaatttggcccatttttgcgccaaacattcgccacttgggctttgtcagggataatcattttgactatttgcgtcgtctcatttcgccgtcaattctcaccgacctcacccatttggattcaatcgatgccgcttatttgttgccaacggtgatcgctgatgatgggccaaatgcaactgatcgccaagcgctgtccaaatggttgaacattccgacaaaagacgggaagccgaagcaattgatttgttgtgctactactactacgtcaggaaccattgaattgatcaacaatttcaaagaggtggggccacattttcgtaaaacattttggattaattgccattttattttcgtttccaattgctttaggcatttctccatgccaccactcctgctgccaactacataattcaacttcaactttttgaaccaacgccaattgagccatttgaattgacgaacgaacagaccaatgaaaagttgacagtgaagaaagaagacggtgatgaaaacatggagaaagaagacgaagatgactatatcgtggtggtgaagcgatgccaaattggggcgacggttcggtgggaggacaaaaagacgaataatttcagcaatatcaatttctggcctcttaatggcaaatactgtattgggtgagtctgatgagagaaacagtttttgctttaaaaatcaaatttaaacattttatttcatttaggcgaatgtctccaccaaagtcgggccaaaagaacacaaaaaatcgtctgaaaatgaatcccgggcccagcggacagcaacagaagaaagagtgaatgaattgttgggaaatgagaaattctgatcgatcattgtgaattttaattgagctgataatcgctcgtcgcgtttatttgttgcttcttttagttaaatgaaatcatttaccataaaaagaaacgaactttgaggaaaattgtgagcaaaatttttttattgtattaaatagggatcatttatttatgtaagaaaaatcgcgaaatatgtaa

SEQ ID NO: 73034 - DNA, 770 bp, Heterodera glycines
  Genomic contig location: Contig_ID=SeqID_1361; Location=3553..4322; Strand=-
  SCN-specific regions: Sequence locations=1-553,594-770
ccctaaaaaatcgatttttttcaaaaaatgatatatcaaaaattaatttgtaaaatattcaaatgtgattctaagcctattttggtcatttttatggcattttgtgcctatttcactttttacgaagaattttttttccaaaaaacagcatttaaaaaattatatttacatattttcctacatatttgaggatttttgtacatatttcataaacatatttcagtgttttttatacatattttatttacatatttcgcgatttttcttacataaataaatgatccctatttaatacaataaaaaaattttgctcacaattttcctcaaagttcgtttctttttatggtaaatgatttcatttaactaaaagaagcaacaaataaacgcgacgagcgattatcagctcaattaaaattcacaatgatcgatcagaatttctcatttcccaacaattcattcactctttcttctgttgctgtccgctgggcccgggattcattttcagacgattttttgtgttcttttggcccgactttggtggagacattcgcctaaatgaaataaaatgtttaaatttgatttttaaagcaaaaactgtttctctcatcagactcacccaatacagtatttgccattaagaggccagaaattgatattgctgaaattattcgtctttttgtcctcccaccgaaccgtcgccccaatttggcatcgcttcaccaccacgatatagtcatcttcgtcttctttctccatgttttcatcaccgt

SEQ ID NO: 73035 - DNA, 2271 bp, Heterodera glycines
  Genomic contig location: Contig_ID=SeqID_1362; Location=416..2686; Strand=-
  SCN-specific regions: Sequence locations=1-1310,1332-1417,1439 -1735,1758-1883,1905-2271
atgccgagcaaattctgtatttttaggaaccaaagcccgtcatcttacgcactgaaaagacttcacaactacgatggggttgatgacaactgtcccaactgtcacaggcgcattgcttcgccattgtctgttgacgcggccactgcacctgccaaagacgatcgctctgattcatctgaacattctgatgtaaatattcaagaaaaaatatagacaagggattactgactttaggaaccaattgagccagaaaaccagcagctatctgaagcagttgatcatgctttgaacatcaacgaggagatttatacgccgatcaaagctgagtatgacaacaccagcattgcttacttcgcagtttataatgcaatgattcgtgcgaagaacaactgctacagaaacaggccgacaccaccgcctgagatgctggctgaattgagggtgtgctccgaaaaggagaaaagccttttctgggacttcaatgcgtcaacaaagcggcatcaatatgcaatggagcagatgcttaagatgaaggactacctgaaggctactgcgcaagccaaacatcggcaatgtgtgaaggagcaactttgcgactctttgaaagaggctacaaacaacaaggctccaataatacgggagcagcattgtttgctcatccaagcgcttgaagaacagctttacgacatcatcaagcagtttctcttgctctggcactcattgcagcagatctgtcccagcacggcgacgttggattcaatgcaggattggcttcaaagtgctgaggtcaatggcatggaactggcgcgtttggccgacagttgggtcgaacacctggccctcatcaacgaaaacatcaaaagttgtgtgaagaagtgcaataaggcgaagatgacgaagagctttatgtccgttggccaacttacaggcctcctccaagcaaagctaaagtagagatattaatgtgttacaaaaaaatttatttaactattaaggcttgtgcgtaagaggtcaaaaaagaaggctgtaagggttgaacggcatcccctgctcgaccatgtttttgaagacctgcgtcaaaaacatttccagctggaagcagccatacgaaagcaggaagaagctcaaaacacaacagacgaagaacaaagaccgcgggccaattccatcggcaaaaaacgacgaaatgaggacaaatcggcgacgtgtgagacaagcgtgaagcgacgggctaaggccgctcaggcagcagaacaacgaatgcaacgcccgattctgatgacggctgaacaagcaaaggcgttggaggcggagcgaatcgaggcccagaagcgcatggctgcagaccgccgagtgcaagagagattgcgccaggctgaccaattcctcaagcaacatcttgctcagcagaagcggcttaagcagcggaatctggtctggggcaggcaagccgcatacgagcgatacatcaatgagcggttggagaagctcaaggctgaggtcaacgctctacggaaatctgcacgcgagtcgatgaacttcacagaaattgacatatgtcagctgaaaataattattttatcaaatagcgtcaaatatttagttctgccaactcgccaagctgttgaagcatattgcgctgacatcattcgctatgccaatcatcatgctgaggaggatgttcaaaaggcaataaaggaacatcagcagattctcgagcgacgagagcgggccttggatgaggagcggcagcgacaaaaattgcttagcacatggcggggttaacaaattaagtggaattgcttttaaaaacaactttagacgaagacagacaatgggcatatcgagaagacccagtgcttgctgccgagctcgagaagataagacagcagaaggagcaaattgatgttgagtatgcggaagagcaggccaggcttcgtaacatcagaagagccgaggaagatgcacggtcgcgagcccgcaatgagttgcttggcctctacgattcaccagaatctggtaaaagcaaaatttgtagtttcgttcgagaccaaaatttcagagggttggtcggatgaagacctgttctacaatgtccgtcaagccgacagaatgcccatcatgcaagaagtgggagtggcgcagatgccgccggaggcaattcgcgcaagagaggtcatagatcggcgcttgaacttccaagaggccgactatgttggtgagatgacgccagctaacaaaggcgacgacaacagaggtagccgggagtaa

SEQ ID NO: 73036 - DNA, 1056 bp, Heterodera glycines
  Genomic contig location: Contig_ID=SeqID_1363; Location=220..1275; Strand=-
  SCN-specific regions: Sequence locations=1-92,114-141,163-354,376-1056
atgatcaactgcgcaattttacggcaacgcaaaatcgtggcgaccagcgacaagttgttgatcccatcatcatttggtacaacggcacggatcatttccaaacccttttgctggtcagtaaactaacaatagtgtttatcgttttttactttaacaatttaagccggacacgacgcctgcttctcgctttgcggtcgaaatcgtcacttcgccgcgagtttcctccttcgattcaccttttcggtgaagaagttgaagctatggaaattgcagcgcctgccgctgccccttctgcgccaattccatcgacgtccagtggaattgaggagaagcgttcgaccaccgtcacagctccatcaatagtgactgaagaagaagatgtgttcctggaagaatcgttgccgaagatggagtcctgcaaatgctgtaatagcgctgttgtgccaccggcattagaagacgccaatgtccatctaaaacaacagtttgcctattacggctacattagcactccctgttgtggcgacttccatctaagatgcttcgaaaaatggtcgcatttgtttttcaagtctgtgcaaattacttctatctttaggaaccaaagtccgccctcttatgcgctgaagcgccttcacaactacgatggtgttgatgacaactgtccaaattgtcacaggcgtattgtttcgacattgtctgatgacgtggccactgaacatgccaaagaggagcgcgcagattcatctgagcattctgatgtgaataattaaaacaaaaaaaatagctaagggattactgattttaggaaccgactgagccagaaagccagcagctaactgaagcagttgatcttgctctaaacatcaacgaggagctttatacgccgatcaaagttgagtatgacaacaccagcattgcttacttcgcagtttacaatgcaatgatccgtgcgaagaacaactgctacagaaacaggccgacaccaccgcctgagatgctggctggatttgagggcgtgctccgaaaaggagaaaagcctttactgggacttca

SEQ ID NO: 73037 - DNA, 653 bp, Heterodera glycines
  Genomic contig location: Contig_ID=SeqID_9988; Location=278..930; Strand=+
  SCN-specific regions: Sequence locations=1-192,214-653
atgccaatcagtaaaacgttgccttgtggaaattataatcatgaacaatttgcaaaattaaaaaatgaaattgtcaatgaaattaaagaaaaatttgtaaaaaattctcaatttgaagaaagcgaaaggaaatgtttcgaagaattaaaatcaaaacttaaagtgttagcaggtaaataaacaacaattaacgaaaaatgatagaattaaatcacttaaattcacagattattcattttatgcaaaaattgagggggaatatttaattgggaattggacggacgaaaaggaaaaggaaaaggaaaaggaagggccaaaaaaggtggacaaattccggcaaattctcgcctatttggaattgtgggcaaaaagtaatgaattcattaataattaattgagtattagagaaaaggtattatttaaatacatatttagacaaccaaattttggacgatttgatgggatttttgaacacgaaaatgcttttgacaatgctaaccaaaatattccttttgtacccaaatgggtcaatgccttttttggtcgagaaattcttcttgacttattccacctggtgagcaattattgttaattggcatcattagcgtttattactttcaaggaattggcctttgcccgtccaattagccgaa

SEQ ID NO: 73038 - DNA, 566 bp, Heterodera glycines
  Genomic contig location: Contig_ID=SeqID_9989; Location=799..1364; Strand=+
  SCN-specific regions: Sequence locations=1-62,84-490,512-566
atggtcgatcgtgcggctggcttagaatggatggcccaagatgaagcacttgtggagatcattgtgccacaaatgctcacagatgaacggcttaaagcgcagcttgaagccgtcaagagtaaatacagtatgaaggtgtacgaaaacttctggagacgatattttgacgcgttcaacggaggaaaagaaaaagagcaatttgtgaaggattttttgaaggaggtgaacacagaaattgacgcattttgaccattcactatttgtctgttctcaggaaacggaatcgaatttgacggatgaagagcgatggaccgatttcagtgagtcgcttcgcaaagtgataaatggcacaatggaagtggtactaacggagaaggtgaacggaaaaccgaacagttccaatcagacgggaaacagtcaagcgaaggtaaacggacagaaagaaaggcataattaacagccaaaaaatgcttaaggcattttgcctatcaaaaagttttgctttctttttctcttaattaaaaagtcagccgaaaaatcaaaaattaatatgcgcaaatccgtta

SEQ ID NO: 73039 - DNA, 235 bp, Heterodera glycines
  Genomic contig location: Contig_ID=SeqID_9990; Location=668..902; Strand=+
  SCN-specific regions: Sequence locations=1-235
cccgacgctgcccttttcggcattttgacccaattcttcgagacgccattgaacgtctttaaagggttttctaaaaaagaaggtccactttatgaattcactaaagaggtcaaaaaaactctgggttttgctgataacagcaaatgggaggcgctcacgaaaaggccgtggcaactgaacttcgacactgaatttatttttggattcaccggtgatgactcatcaaaatacaacg

SEQ ID NO: 73040 - DNA, 546 bp, Heterodera glycines
  Genomic contig location: Contig_ID=SeqID_9991; Location=117..662; Strand=+
  SCN-specific regions: Sequence locations=1-22,46-332,354-441,463-546
gccgatcatcgattgagtgctcttagattctgtctttcctttcctaagttttcctttgcttgtttttttccatttcattagatagtctttcttttcattcaaactgcgtccattgtgaatgttttccaatggataaaagggtggatctgtcattgatgagcttatgtgtcaattgcttaattatagtaatttataatatgaaaccctttcttaacagggccaatgctttttagtttataattgcctcggccttaattatgttcgcggtttgtctccctatgcacgaaaagtgtgccgcagtggaggcagtccgccaattggtttgcctctcctcagtgccaaattcaattggccattcggctcttggccaaactcagtctcttcctccttttggcattccgcggctccattgttttggccgatgcctttcctttggctgtttttcagctccatcttctgctgttcctctcttcgatcatctgttcgactttgagccgtggacggcggcgtgtgactcatttcagtgatcaccgattgattgctagg

SEQ ID NO: 73041 - DNA, 751 bp, Heterodera glycines
  misc_feature (570)..(571): n is a, c, g, or t
  misc_feature (577)..(577): n is a, c, g, or t
  Genomic contig location: Contig_ID=SeqID_9992; Location=88..838; Strand=-
  SCN-specific regions: Sequence locations=1-751
atgcttgccgtacgtccaccaactgccgcagcttcagctttggcacagcctttggcacccaattacggcattaattatggccaatacgctttcggccatccttctggtacttttatcacttgctcttatcagtgataaatgaagtgctaatgcaggccttcattttgcagcacgtccaccaacttctacagcctttgctccagcccagcctttggcacccaattacggcactaattatggccaacaaccctttggtcttcattttggcgcagctccttcggttaccgtcgcttctgttccggcacagcaattggcagctaatcccaataacggccttaattatggccaacatcaattcggccgtcttcctggtactttatcactttatcttatccgtgataaatctattacaaattgtaggcactaattttgccgcacgtccaccgacttccgtgcatctgctttggcaccaaattatggccagcaacccttgggcaatcctggtacttttgtcacttgtcattgataaacttaatacaaatttaggttccgcacgagcagtttctgatnnggcgcnccctttggcaaatagtaactttcctccgctgctttaattgcttgtagttaattagacagggaaacacggggacagtcttttaattaggtcggaagaatagggacaattaatatttaagactttgaccaatggttatttgtcgccaaatatccaactccgtcaattaatattaaa

SEQ ID NO: 73042 - DNA, 112 bp, Heterodera glycines
  Genomic contig location: Contig_ID=SeqID_9992; Location=2107..2218; Strand=-
  SCN-specific regions: Sequence locations=1-112
ataaaaagtcaacgtaggagcctcaaaccaagtggaaaatgcgttatttatgcttaatatatcgaaacaagtgcgcagaaaaaaaggcatatgcctcaaaagtcggtctcta

SEQ ID NO: 73043 - DNA, 1333 bp, Heterodera glycines
  Genomic contig location: Contig_ID=SeqID_9994; Location=27..1359; Strand=-
  SCN-specific regions: Sequence locations=1-42,81-210,234-248,271 -369,410-434,460-480,507-937,999-1213,1255-1311
atggcgccatcatttcatgaggcaattggtatttgttagaacataaaaatatttttagcaatttaatttttttttttaatgtgtaggtaaagaatggaaacaagcattgttcggcagaggtggcttattgacagaaattttcaattttgtcaacgataaacgcaaggaggatttggccaagaaacaagccgctccaaatttgaacggtgggcatataagaaaaaatttaaaatgtgaaaattaattcataaactaaataaactgaatttgaaatagggtgcggatttttagttaggggaaataccaaaatatacctaaacgcaattggctttttccatataatttttgtaagtcgattctgatagttttattacaataatattaagaaatttgtcaaaataacaaaaaagtgacgacaattatttctttgggggattttaattaattaaataaatttttgaggtagcaggattaagttgctaataaaaaaaattttaaaaatttatgaaagacagcttaggtaattgaattaaattctgtaattcttcagtttatttggccataacttttcttacttgaaccacccatacattcttggtatcaacgtaaactaagagaatttttatatacaaaaaattatgtgccaaaagcaacagacaatttcttggatatacccgaaaaaaaaagtggccatagaaactgaaattgtataaaatttgaaatccattagcagataaggccagcagggaattcagccaaattttggatgcattattgcgcaaggcgaaaagtggcaattttgacgaggaaccgttgccagaaataccattcattggcatttgcaaccgacttagctgtgccgacatttacaaagcattagaccaattccggaaaagtgaatttttctcaaattttcaggtaaattttttcaaaatgcaatttaatttatttgtaaatgaatattttcgttttttttaattcttttttaaattatttaacaagcattttgaactcagactgcaattgctctactacaagacccaaaaggcctggacatgatcggagaattattagccaatcctgatttaattgaaaatttttcgggacccgaaagtcttggcgaaatgtttggcagcaaaatggcacaaaaaagtggcacaagtcgtgtcgaaattggcgaaaatgtggtaaaaaaatctataaattacattgcaaaataataattaaaaaacctaataattaattatttataaaggatggtgaaaatattggcattgatttttcatcccaaattgatggtttgtttgaaagaaattcaaaaatttaaaataaa

SEQ ID NO: 73044 - DNA, 890 bp, Heterodera glycines
  Genomic contig location: Contig_ID=SeqID_9995; Location=1893..2782; Strand=+
  SCN-specific regions: Sequence locations=1-195,238-377,399-496,518 -599,622-707,757-890
atgccaaatctgacgaaaatggcactattaaatgagcatacagtagttagtatttttcaatgcttagctttccttacattcattgttggtgggttgggttgattgcaatttttgttgataattgaattctgtccgctgttgcttggcgctgctgtagctttcggccactattggcgctgccatttggccatgaataattgccataaaaatgattaaatgataataataaaaaatggacatttcgccagcctaaaaagcattcgtttttaaataaatatcgatacatgaaaatgctttccgtttggttgtgaattgttttcctcatgaattatgacaaatgtgtgtgtgcgcgtgaggattttcgggaccttgacctcattttgggacagaatttaagagccacgtttttttaatgatattattttaccgacccataaaatcaggggctcccaaatgtgaggctctaaagtttttaatttccaaaatcttcgaaaactgtcaagtttccaaatccattaataaatcgcatttaaaattcagaaaattttccccggctgcgcttattggcaccgcccctcgaacctccatttttttaaggttttccaaaaaataaactaaaaagtctcagtaatattttttttctccctgttgtcattttgaatcttttctatttatctaacacagaaacatacaactattttccccccttaatttatttattttttgcaatttaattcattaaaaattttaaattatgtaaattgggtggcaaaaaaaatttttttgttgtagccagtaaaattggtaatgatcaaaagggaaccgcccacttcggcgccggccttttcggcgccgttgctaacaacttttttcctgttcaaccaaattaa

SEQ ID NO: 73045 - DNA, 234 bp, Heterodera glycines
  Genomic contig location: Contig_ID=SeqID_9996; Location=140..373; Strand=-
  SCN-specific regions: Sequence locations=1-42,69-88,112-234
agtgtccaagccacgaaatgtccaaaagagtaaaaacccacgaaatgtccaaaatttttcaaaatttataaaaacaaaatgagtctaatttaggatttttagggttttcggggtcgctgaatacgaatataccctttatattaccccttgcctaaccttaggcccatctgaataataaaaaactcaaattcgagacttggaaatttcgtgggctggacattttgtgggtcagcg

SEQ ID NO: 73046 - DNA, 816 bp, Heterodera glycines
  Genomic contig location: Contig_ID=SeqID_9997; Location=395..1210; Strand=+
  SCN-specific regions: Sequence locations=1-161,183-816
atgaatgaaaaaaacacaattaacaccaacaacagtttaaaagccaaaggtggcactctcgatgagaaattacagccaacagccaacggagagacagaagtgttcattcagacgaaaccatccaggttctatttacgacattatttatgttcctagctgattttttgggactgaagctgggcacaccatattttgaaaaaattaaaaaaaaatgaaatttcgaccttttgttcgagttcgatttagctcaaatcaatgcactttttccctgcccagcgaccacccaaaataccttttttatcggcttaaattttttttcaaaaatcttttctacaaatggtggcaacctcttgcttcagttattgcctggtttttttttccatttttcgcggattttattcggtcattttcctgatattttggatttccctccatttttatagggccaaaaccgcatgttcccgtgtggacgatgtgtccctgctgtccttcatctcattttcttggatgttcccgtggatgtggcgggccttccgcggccaactgagtcccgtcgagtcgtctgcccaatggacatgctccattttcgactcggccaatgtcaacatgacaaggttttgttgttcatcagttaggtatatgaaaaaaaatgagtcgctatattttacgcaacagcgcctgatacaaaaattccggcgctaattaaaaagtgacagattttgaaaattttttcacttttttttggtcaattttttttttgttgtttgttttgatatagaatgatgaacacattaagcattgagcataatttggcga

SEQ ID NO: 73047 - DNA, 915 bp, Heterodera glycines; identical to SEQ ID NO: 9998
  misc_feature (884)..(884): n is a, c, g, or t
  Genomic contig location: Contig_ID=SeqID_9998; Location=1..915; Strand=+
  SCN-specific regions: Sequence locations=1-209,243-467,503-579,601-915
  Gene Ontology: Mol. function=potassium ion transporter activity; Cellular component=mitochondrion; Biological process=potassium ion transport

SEQ ID NO: 73048 - DNA, 75 bp, Heterodera glycines; identical to SEQ ID NO: 58933
  Genomic contig location: Contig_ID=SeqID_10000; Location=3122..3196; Strand=+
  SCN-specific regions: Sequence locations=1-75

SEQ ID NO: 73049 - DNA, 3517 bp, Heterodera glycines
  misc_feature (3369)..(3369): n is a, c, g, or t
  misc_feature (3467)..(3467): n is a, c, g, or t
  misc_feature (3500)..(3500): n is a, c, g, or t
  Genomic contig location: Contig_ID=SeqID_10000; Location=1..3517; Strand=-
  SCN-specific regions: Sequence locations=1-26,50-67,90-120,142 -264,293-443,465-888,911-1086,1108-1450,1480-1497,1520-1974,2003 -2372,2394-2618,2643-2724,2746-2829,2851-3414,3438-3469,3491-3517
ctttacaaaaattttctttcccataactaaacaaaacatttatatttttcggtcttactttctcacgttttatttggttaatttttgttataatcactttgtctccgtcgtttaaccttaattcatttcctttaaattttcttgattatttattcttttgtgcttttatttaatttaatcgataaattcatttttgcgctcgatttgacccaattatcgatttgaaatgtttcagtggtactgtagcttcgaagatgtgctgtagattatattttacccaaaaaatttttaataacttgctagcgggggaatgttcgtgctacacaccgtccgaaaaaacgagatgtgtaccaataaatagagagtgccagagaaaaacattatcttttttctctaattttttgtctccttttggcgtactatctaatatttttattattaggaaaaacaacatttacttcgggaaccgcccggttcgccgcggccacttcgccgcggccatttcgccgcgggtttttcgccgcggggttttttcgccgccggctttttcgccgcggactttttcgccgcggccagttcgccgcccgaagaaaaatgtccatttcgccgccataattaaaaaaaaatttgttatacttctcgtgtaccataatttattaaatctatattgtctatctttatatcttaagcaatatttggttacttattaataatgtctgaagttgaaacaaatcgtcacaaggataaattaattaacgatggattcctttacattttcgacaaatttaatgttgatattagtttgaaattctggcgatgcgaacgaaggaacgaatgtcgaggcgaattcacaccgacatgaacaacaattttgtcaaaatggtcaccgaacacacacacgaagcaaacattgccaatgtgaaagcaaaaaaaattgtcacggggatcaagaggcgtgcggcggaatgcatggaattgccttcacaactccgtgcaaatgcaatggtcaacgtttcaacaccggtgcttgctcagttgccaagtgccaatggaattaagaaggtaacgaaaagcagacacatactattattttttgctttgtttttagattgtcaaacgtgtacgccatgaaattgtagctgcaccagcggctccaaattctattcacgacctccaaattggccaagcatatcaggtgtacaagcgcggtgaaggagttgaggaggagcaatacctactatctgactctggcgttttttcacttaatgccgacaattcccaacatcggtattaattaatgtgacatattttaaaattccgcttatattcaggattctgatttttgccaagaactcttacgcaaatggacgcatgcaatggtcgaagtgttcgcagatggaactttttccatcgcaccacatccattttcacaagtttacgtcctcctttcaaagtttgttttgtttggtttttgaatttcttccagaaaaatttcagaaaaggaaaatggactttcccaatcgccacatgtcttctgacaggaaagttgcgatggtctacgaaaaaatgttcagaatgatcattgacgcatggccagccttctctccaacgtccatcacaatggacttcgaacaagcggcgatggacgctgcggccgcagtgtttccgggcgctcagcttcgagggtgcctttttcatttagtgcacaacatgcacaagcgcctgatttccgaaggacttcaaaatgtaagtttcagttcccaaaaaaaaagaaattgtctcccgtttagcgctatcgaagtgaacggactgtcaacgaagagcagcgaacaaacgacatcgcggaagcagcgcaccgtcgactccaaacaatcttcagctgtcgctacccgtcaatttggcgattcatcgatgtccttcgaatggatcagcgtgcgcgcgacgctgactatgtgagctgcgtgaacggcgaagaacctccaaagaagaaaaagaagtttcggaaggctgacaagcgcattttgaacattattgaaaattttgatgcccaaaatattgttgagtttctcaggggaatttcaaataatagtgttatggacccgtgattttgttgttcatttgttaaacttatataataatgcggtatacatgtttgcacaatgaaaggcaaattaaaacttttttgaaaatttttttggatttttaaacactggcgccgaaaaagccattttatatagggcgccgaagtggccgcgccgaaagagcccgcgccgaaaaagctcgcgccgaaaaaacctcgcgccgaaatacccgcgccgaagtggccgcgccgaagtgaccccgaccccaaaaattcaatgtcaatccctttgaaatacctaatctaatttatgaaaataaatgctatcataacagtgctgagaaatctgaattatttgccaccttatttgccaattcatttaataatagtgaaaccgacccaagcaatccatgcttgggtaatattatagaaattgatcaatgctttatatcggatataaattttaacatcatcgagacccaaaatcttctgaaaaaacttccgaataaaaatggcacttctcccgataatattagctataaaattttaaaaatttgccattcgtccctgtcaactgttattactgacttgtttaggatctcattagacatttgttcacttccagacatctggaaagaatcaattgtttttccgctttttaaaaagggtgacaaaaataatcccgaaaactataggccaatttcattaacctgctcactctgcagggtaatggaaagaattttaagcaaaaatatttacaattttctattaaaaaacaaaaaaatttcggaatttcaatttggttttgttagaaataggtctacaacgagtcaactaataacagttgtggaagattggtacgaggcaataataaatggaaaaaatgttgacagtatttatattgattttcaaaaagcatttgactcagtgccccatgaattacttttatacaaattgaaaaaaataggtctaaggggcaaacttttgatgtggataaaggactttttgagtaataggacttttcgtgttaaaattggggatgatttatcctccagtaaaaaagttggctctggcgtcccccagggctctgtccttggacctttattatttttgatttatattaacgatcttcctgatgctttgccatcaggagtaagaattaaattatatgctgatgatgttaaattgtatatttgttataaagcaagaaccgaaacagaaattatgcataaagcattgcataatttatcagaatgggcaaataaatggcagatcagaatctcaattanaaaaacttttgtacttcatttggggaataaaaaccccaaagaaatatataaaattggtggaaatataataaatgttgtggatacaattagggatttgngcataaatattgataaataatttgcattttccnatcatgtcacacaaata

SEQ ID NO: 73050 - DNA, 171 bp, Heterodera glycines
  Genomic contig location: Contig_ID=SeqID_10001; Location=114..284; Strand=-
  SCN-specific regions: Sequence locations=1-171
acggctataaaagccagctacagcaccaccacctgcaaaacagtttcctccgtcgccgtctccaccaccagcacagacgcgtccgacggagcggccagcaaagcgcgacggccgccttttcactggacaacggtgcgacggcacccgcggcgagcccattgcgatttgacg

SEQ ID NO: 73051 - DNA, 1104 bp, Heterodera glycines
  Genomic contig location: Contig_ID=SeqID_10001; Location=725..1828; Strand=-
  SCN-specific regions: Sequence locations=1-478,501-787,809-1104
ttgtgagcaatttgtgtggcaaggcgaggcgggcaatgaaaatcgattcggcaccagcgaagaatgtgaagcgatgtgcaaatgtaagcagcggaaaagcaatgccaaagtcgacgatgctttcctttccctgagaacagttgcacaagtgccgggaattcttcggcccaaaaatgttgtggtgacaaacgcacggggaacatcaaaggcaccgacagtgccactctcggccgaccggcaaaagagtgaagaagttggagcagtgcacggagaacatccgcaaaatggcaacgaaaggcacagcatcggtggtgaggaagcgcaacaggaacagctgggccacgaaaatgaccttccgctcgcgaaagccgcttccatcgcgcagacggaagacgcggaaggggcggtgggaatgccgggaccagcgcaagcgatgtgcggagggatagccacgggagagactttagccacgggagagactaagttcatttgttgctctttagtgccgaaatgccacccgcagcattccccggctccgctgccgcgccctccgccccaccgcaggcgccgccacctttgccgccggcaatggccggtagcgccggttacgcgctgtcctccgcgtacggtgcccaaccgttgccaaaattcccgcaaaaagtgcccgacaatttgccgccaatgctcggcccgtcgccgcccgcagtgatcgattatcaaacgggcaaacgatgtaagccgaaagagaaggataatccaattacgaagtccattccgactcagttgaccagcccaaagaggcagaagcatcagcagcggtggttgctgcttctccaacggttgctgtccaaggactgccaaatcacgtgccatcgagcaaagagcaaagcattggggggactgaccaaaaaagtgaccggaaaggcacaatggcatttgaaatgcatttttaaggcttcggcgacggcattttggagtcattctccaaagatatgttggctaacggtcaaaatcaagcggaacaatcgccacactcaattccgatgtgtccgaacggactcagtgccatgcgatacaaagacggtgattcattctcgaatttga

SEQ ID NO: 73052 - DNA, 294 bp, Heterodera glycines
  Genomic contig location: Contig_ID=SeqID_10002; Location=35..328; Strand=-
  SCN-specific regions: Sequence locations=1-294
atggtcagcgctcagttgggcgtttgttttgccctaggcaaaacaaatttttttcccttgggcaggttcttcaatgctcagtccggcctttgcgagcagttttcattcggcggatgccatggcaatcagaacaattttgcggaccaagacaagtgcgaggcgaagtgcagtcgagcgacgacttcggtggcgaacagtcaccaaatgttgccggagcggtgcgccttggagaaggaggagggcaccggcggaggataccatgtccaatggtacttcaacgtcgaaaaatttacg

SEQ ID NO: 73053 - DNA, 1806 bp, Heterodera glycines
  Genomic contig location: Contig_ID=SeqID_10002; Location=812..2617; Strand=-
  SCN-specific regions: Sequence locations=1-98,120-149,171-227,258 -269,294-410,518-644,666-764,786-964,986-1499,1521-1546,1568-1806
  Gene Ontology: Mol. function=transcription factor activity; Cellular component=nucleus; Biological process=ubiquitin-dependent protein catabolism
atggagcagcaacagcacgtgcagatacctgtccaagtcggaggagtacaaattgaaaaggcgacagaggtaggcagaaagagtgcgggacagacggagagtgacagacacagagaggagcaaaagacaacagtgaacaaggagagcgaaaagaaccgagagggacagatggaagaaggtgtggaatatgacggtgatatgatctttttggagacccaaagcaatggcagagaggaaaagagaaagggaaagcaaaggaaaggggacacggaagagacggacagacagacaaagttggaagagacactgaccgagttggagccagacgaaaaagagggctggaaagagagtggggaggagacagagccagagcaagtctacatttcaccagcggaagagagaccggcagcagagaaggaaggagcgagaaacaacagagaaagagagggacagacggaaggaaagagtgaaggcagagaggaaaaggaaaaagagaggcagcagaacagagaaaaagtgcaacatcagcagcaacaagttcaagaagtactgggagaacaaccgcagcaaattcagccggtacaagccaaaaagggggccgaaaatataggacaaatggaaaatggacaaaacacacaaccgaaacaagcacatcaaggccaagcagtacagggagaacaaccgcagaaaattcaaccggtccaagtccaaaaagggttcctaaatatagggcaaatggaaaatggacaaaacacacaaccgaaacaagcacatcaaggccaagcagtacagggagaacaaccgcagcaaatccaatggatggaagagaaacaaaggcaaaacgtaaacgggggaaaacaacagagacagcagaaaaaacaggaaaagataacagttcatcagcacgaagtacctgctcaaaagcttgctatggaagaaggaaaacagcaacagaatgtggaagaacaacagcaacaacagaaactgaataaaaatgagtcattatcatctgatcaggatataatacgcccatcgaatccgatcattgaacaacaacggcaacatgttgaagagggtcagcaaccacagcaatctgaacaaagtaaagctcacaatcagcagaagcagcttgttccaacagcaacaactgctgaggctgatcacttctcacctcattccgctgatcaatcagttgttgccgctgttccgtccgtctcagtgccgaattcgccgcccactgtctcattggagggcagtggcaacggcggcgcacctccaaccgccccatccgccgcgtcttccgcctctccgccctccgcttcggccggagctccggaaggctcactgtccgacctgtttaccatgcaccatttgcaacagctacggtcaggcgggagcagcgatgttgggagtggacgggaagaggtggcacgcaaaatggtgccggtttggggcggactgatcgacgacagttcgcaactgcagccgatcagtacgacgctggaggaggaggagcagcaacatatgcagcagaacggcaccacggaaaagcagcagagagaggaggtcggtggtgaaatgccgacggaaggcgacgacaaagagacaggcggcaccgccgcgggggcggagacaaacccaccgaagcaacgacagccgaatggagaagcggcacaggccatgccggaacagcaggagaagacggtggtggtgagcaacaacggatcgggtgagaaaaaagaaacgggggaaggctttgatgatcaattatcagccagggagggagggaaacggacacgcgagtga

SEQ ID NO: 73054 - DNA, 930 bp, Heterodera glycines
  Genomic contig location: Contig_ID=SeqID_10003; Location=79..1008; Strand=-
  SCN-specific regions: Sequence locations=1-76,98-341,366-683,705-930
  Gene Ontology: Mol. function=ATP binding; Cellular component=integral to endoplasmic reticulum membrane; Biological process=regulation of protein activity, epigenetic
atggttggacaaaatcagaaacaccaaatagtacaaggagaagaaatgcaaactgaacaagagaaaaaaattgttcaaactaatccaggacagcaacaaattagacaaggtcatcgacaccaaactgaacaaagtaaaactatacaaggacaacaagttgaacagtcaactgaagaagacccacacgaaggaccacaagcagtacaagatgtacagccaactgaaggacagcaaaaccaagctgtacaaggaaagcagcaaggaaagcaaacagttcaagggcaacaaatgaatcagcaaattcaagtgctgcaaaaccaagctgtacaagggcaacaaacaaatcagcaaattcaagggcagcaaaaccaagctgtacaaggacagcaacaaggaaagcaaacagttcaagggcaacaaatgaatcagcaaattcaagtgctgcaaaaccaagctgtacaagggcaacaaacaaataggccaattcaaggacatcaaaaccaagcagtacaaggacaacaaacaggacaacataaccaagcagtccaagggcaacaaacaattcaaagacatcaaaaccaagctgtacaagggcaacaaacgaatcaggcaattcaagaacatcaaaaccaagcagtacaaggacaacaaacaggacaacataaccaagcagtccaagggcaacaaacaattcaaggacatcaaaaccaagctgtacaaggacagcagcaaggaaagcaaacagttcaagggcaacaaatgaatcagcaaattcaattgctgcaaaaccaagctgtacaagggcaacaaacaaataggccaattcaaggacatcaaaaccaagcagtacaaggacaacaaacaaatcggccgattcaaggacagcaagcagtccaagagcaaaaaccaaatgagccacaagaacagcaa

SEQ ID NO: 73055 - DNA, 656 bp, Heterodera glycines
  Genomic contig location: Contig_ID=SeqID_10005; Location=362..1017; Strand=+
  SCN-specific regions: Sequence locations=1-7,80-312,375-656
atggttaccgctcctaccgctgctgcggacgtcgccgcgtctgtcgccgcgtctgtcgcctcggccgccggcggcggcggttcatgcaccgcgtgctcgtcttctgttaacctggccgtgttgaccagggaagaagtggcggcggccaactcgataagaaacgcacgacttgcagaggaaccggtcaaccaaattagcacgtcgggtggatgtacaacactgacgcccacctgtcccccgggtgaatctgtaagttttttttctttgagattttttctagtaagaatatttttcacttgtttcaccactttcaatttaattaaaaatctactaaaataaaaaaatctttattttttgaatgttaaaaaaattttcacggctttgaacagtatccttgttgatacggtgttatggcattagtcaaaaaccatcaaaaaaagtcacttccttctaatattttcttagaaaatattaacattttttaaatcaaaaattttgacaagaaaaaaaattgagggatgaattttttgcgaaaattttccaatttttaggggtgcatttttttaattttagctcggtcttaggggtgcatttttttgaaaatttttaggtcgattcttaggggtgtatttttcatttgtattgcattcttgtta

SEQ ID NO: 73056 - DNA, 424 bp, Heterodera glycines
  Genomic contig location: Contig_ID=SeqID_10007; Location=562..985; Strand=-
  SCN-specific regions: Sequence locations=1-424
gtcattcccattgtccggattgtctgagtggaattgaaaatattgcgataagaaacgctgtggagaatcgagtcggactgaaccaagtcagaagcaatgaatatttggtggacaaagtaaataaagttcagatttccatcgaatgtccgctttgtcgtgcgcgttgccttttgaaccgtcaacgagtcaaaaactacgcaattgaggccataatcgcatcgatgggcacagttaacaatgagcaggacccaaacaacgaaataattgcggcaaaaaatattctggtcaattttttcaattgtttttcttttgcgtttgtccttaattttgtcatttcagatcaaacaattggaaaagaatgagcgtgagatgaaaaggcgcttttctgagcaggaagtccgaatcgaaagagcatttttcttcg

SEQ ID NO: 73057 - DNA, 854 bp, Heterodera glycines
  Genomic contig location: Contig_ID=SeqID_10008; Location=170..1023; Strand=+
  SCN-specific regions: Sequence locations=1-15,37-479,501-501,533 -588,610-854
atggctgacttttggcttctctttttggcctgtcttctcgcctttttcgtcggtgtttctcttttgattgccttttgctgtttttcgtgctacgcttgtttttgcggttcttccgattgttgctccgccgattcaaaataaaatgtgtttttttaccatctttgtttttttttgttcattctctccaaattctatggcctttcttcacattttctgtttaattaattttgtctaattattgtgtaaatgtgacattttctcatgtgcataatgtaaattgttaattgttggattatcttaataataaccgaaatattttattctttgcatttcatggaaatgaatttgccacagtttaaagtttgagagattttagatttttatttgtaaatttcttgtcattgttttattttttcttaaacaagactttcatcattttccgccttcttttcgccctcaacaattcctcgtcaattctctgtttttcttaaatttattaaattatttgcatttttcattttgctttgcctctgaatatgcggaacatctcatgggtttgcttttggcattgcatcgatcttagtgccaactttttctcctccaatctcacgcgtctcgccagtcccgaagtgccaattcgattttggcaactgccgggaacaaatattcatttgtcagttcttcaaacggacctttcaaggctttcacaacatcgccccaattttgtgcagtgccggtgcaaaagggcaatgcgttcggagcactgcaaatggccgttcattttcggcgaggtcaaaacggacaattcctttggacacgaccccttcaatttcaatttgagttggctattgtga

SEQ ID NO: 73058 - DNA, 873 bp, Heterodera glycines
  Genomic contig location: Contig_ID=SeqID_10008; Location=1136..2008; Strand=-
  SCN-specific regions: Sequence locations=1-873
atggaggcggagcagggaaagttggcagaagagttagcgggcagcaaagtgagtggggaaaacgttatgcagaatttccatccatttgaatgggcccttttggcgtttcgtcactaattagcaaaaaaaaaaacgattcacttataaatatccagcagcagtttcaattctgcaaaactctcagagtgttggtcggccgtcccttcacagttcgtcctctgttcgcagttccctcggctatcgtggcaaagttctttttatggcccaccaaatgaaacttcgctcggactctcttcccaaattgggggtcacttcattcgttcgtttttagtacattttgcactgatttaccttttgtcagaagaagtctcttctgccgtcgtcaatccgtcgttcgccaatcaaaggaatggccaaaatccgacctttgtccccccttaagcgcccgccaccccaacttgtcacacttttcccaaggtctttcttcgttgtactacggtacattcgctacggtagccaaaagtatttttagtgataaaaaagagatggaaagaattcgcgagcttttggtgcgtcagttggagaagcagcagagacgggtcgacccctcccccctcccttcggtcatttcgcctttcgctttcccaccaatttttttttcacagtctccgccttcgtccaaccactgtcaactgttcatctcctgcatgtttctcctgcgcagtgttcagtccgatctgtgccgtccttcgcctgctgagacgggtcgtcccgtgccgggtccgccgcggcgacgcttcggccgatgcaacgcgcgtcttttgccattgttcgaggtgaaaatgctctactcttttcgacttaacaaataaa

SEQ ID NO: 73059 - DNA, 950 bp, Heterodera glycines
  Genomic contig location: Contig_ID=SeqID_10010; Location=325..1274; Strand=-
  SCN-specific regions: Sequence locations=1-74,96-950
atgaaaaatccaatttccaaaaataacccaacactagaaaaagggcaaatcttagtaataagttcacttggcacggtttttctttacaatttgttggagtgcattcactgcaaaatgctgttcatccaacaacagaatgagttacatcattggcccattcctttggccggatttgacgtaattatgtgccaacaaaaagtcgacggggatacaatgctcgtggcagcgcagaagaattggccatttgttgagaggcatcactttttgacaggcgaattgcaattcttgtcgctaaatccggaccattaaattccgtaattgcttcccacttaattaccattatgttgtacggacgaaaccaattaggcgcaattttggcattggtcagcagacgaaggaaaagcgagtggcacttcagcagacgactcgctcgccaaattgagctcggcacgaacaaaagcaattcagtgacaagttcggcggggagccaacggtagtgctctttctgatgagcagcagcagcgacgcaaatttgtgaagattgcatcgcgaaaaatggggaaatgcgcagagagaaaaggcgacggaatggcaaatgtaaacgaaagcagaggaaatgaatggcacaatttgggggacggatgaaaaggttggcggaggatggcatggcatgggaaaggcaagccaagcctcgctgggcggagagcgacattcgcatgtgaagtgacccgcgatgggcgtggttggtcaattcaaaatgcactaaaattcaaaaatgtacccaaattattggtaaacggcgtcattctcgcgcgaccttgaggggaataagcttgcattttaaatagacaaatcgtaaataggcttaaacttagtctaagctttaggtctaggcttcggcttacttgagcctagggatgtgtgtgctcattttgtgtgtttttaataaa

SEQ ID NO: 73060 - DNA, 2251 bp, Heterodera glycines
  Genomic contig location: Contig_ID=SeqID_10010; Location=1731..3981; Strand=-
  SCN-specific regions: Sequence locations=1-54,77-223,246-366,429 -1035,1057-1155,1177-1337,1359-1478,1500-1562,1584-1769,1791 -1794,1825-1864,1888-1908,1930-1942,1982-2230
atgctttactggtcttcacaacaaaaaatagattattcaataagatgtttgaataagaataaaatttatataatgtaagattattttggcggatttgtaaacgcttaattctgccgattcatttggtcgagcaaaacattgtccatgaaattgcgaacgtcgctaattactttggagaggctcattaagtaatattcatcacaagtcgggcaaaacttcacagcaaaatgacataaggctgcaaaaattggaaacattaagtgaaaaatgagccaatttatggacaaagggcttctgttggggttttagaatatttcacatttaacaaatttaaaacgaaaaggctaatttaggaacaggtggcagatttaattttaataatttattttttcattatttcgaaataattcttttgttaatattttaatgaaaaactgacagctgtgtcgagcggcacaaattccacttgcaatactttggacatgagcacagagtttacaacggtgctaggtcgtttcttaaaaaccgccacattgggcgtttcttaaaaccgccactttgggcgtttcttaaaaccgccactttgggcgtttcttaaaaccgccactttgggcgtttcttaaaaccgccagggcgtttcttaaaaccgccaggtgggcgtttcttaaaaccgccactttgggcgtttcttaaaaccgccagggcgtttcttaaaaccgccacattgggcgtttcttaaaaccgccacattgggcgtttcttaaaaccgccagggcgtttcttaaaaccgccactttgggcgtttcttaaaaccgccacattgggcgtttcttaaaaaccgccacattgggcgtttcttaaaaccgccactttgggcgtttcttaaaaccgccactttgggcgtttcttaaaaccgccagggcgtttcttaaaaccgccaggtgggcgtttcttaaaaccgccactttgggcgtttcttaaaaccgccagggcgtttcttaaaaccgccacattgggcgtttcttaaaaccgccactttggtcgtttcttaaaaccgccagggcgtttcttaaaaccgccaggtgggcgtttcttaaaaccgccactttgggcgtttcttaaaaccgccacattgggcgtttcttaaaaccgccactttggtcgtttcttaaaaccgccagggcgtttcttaaaaccgccactttgggcgtttcttaaaaccgccagggcgtttcttaaaaccgtcagggcgtttcttaaaaccgccaactcatatgattatgtatgtatatccgttaaattaaatatacaataataatcggttagactctttgattatacaaattcatattaaaaatttagcttacgaatctgagtcaaaaagaaacaacagcatcagtatttttgtattataatgatggacattttgaactgattaaacagccaacaaagataaattaattattttgttttatttctgtgataatctttataaaaattcattcccttttgaaagttgcaaagaaattctgtgggacttattgtggcacctctctattagactcttgtctaatagctcctgtaatctggttttgcaactttcaaaaaagtaacaaattacgaattagcaattttatattcgaaaattttgcagttgataattgttgctataaccacgatgtgtgctacataaataaatatcagaaacgttacgattgtgatattaaattttgcaattgccttaatgaatatcctaattgctttctaacaaaagtctgttctccaactcatatcttaaatattttattttttagaatatattatgctggtcagttcatatttttggagaacgttttaaagaaggataaaaataattattttattttaccgtcactagatatgcatatgtattttaaattttttattgttatgtaaacttctaatatatatatatatatatatatatatatttatatacataatcatatgagttggcggttttaagaaacgcccaatgtggcggtttttaagaaacgtcccagcaccgtttacaactatgcaaaagtgaggcattctctcgcgaaattgttgacgctaatttaaaacgaaaattatttaatcgggttaatcggtatttgaaaatccatattgttttcctggactttcgcgatttatgtccatgttttcatagttaccatattttgacataatatcctcccctttggtgccgtaaagaattcatcaaaataaa

SEQ ID NO: 73061 - DNA, 1902 bp, Heterodera glycines
  Genomic contig location: Contig_ID=SeqID_10011; Location=49..1950; Strand=-
  SCN-specific regions: Sequence locations=1-1390,1412-1522,1544 -1800,1822-1902
  Gene Ontology: Mol. function=helicase activity; Cellular component =chromatin; Biological process=chromatin assembly/disassembly
atgtcctgctctttctatacctttgctgttttgcagttggtcccacctccacaacacatgggaatccgaggcgagtttaaaggccgcgaatgtgaagggcttcaagaaggtcttacttcaacagttttgtcttcatataataaacaatttaggtggagaattacagcaaacgcgaagcggaggtggacgtatggtttgtttgtggcattagttaaacggactaatgaaacccaaatataggcgccaaagggccgacaaagaatacatcgaactgtacaactgcgaactcggcatgaacgatgagttgattgaggtaaacaacactgtgctctttgtttcctgggagtaattggctcctccttccagcaatataagcaagtggagcgtattatcggagagcaggcgtcccttgacaaaatcagcgataacggcgaggcggcgactgagtatctgatcaaatggaatggattgccctattcggagtgcacttgggaggacgaagggctgattcgacgcgaattcgaccacaaaatagctgaatttgaagtgcgcgaacaatcggatacacagccaaagaaatcgtacccggtttggaaccgtcggtttttgttatttgaaatggaaagctttgactttaggcctataaaagacggcccaaatttcaaaaacttgagtctatgcctgacttccttaggccagttgactctgaaatggaattgcgtgactatcagctggaggggctgaattggctgctttacgcttggtccaagtgagctgactgaagttgacattcattttatgtaaatttatttagaagcaacagcagcattctggcggatgaaatgggcctgggcaaaacgattcagacaattagtttcatttcgtcgcttttccatctgcatgatatgcatggcccctttctcgtcgttgtgccgttatccactttaccatcgtggcagaacgagttcaccttgtggggaagccgattgaacacagtcatttatatgggcgacgtcaattccagggaacaggtgggtaaatggtgatatgggtataacaaaaacaaacggcttttccattaaattccattcttacaattaactgaattgtcagatttttagattcgcatccatgagttagatgttgatgaacatgcaaagttatgcaaggccaatgttgtgataacaacatatgaaatctgccttaaggataaggtaatcttccataaacataagataaaaccttgaatttttagctttatctcggcaaattcacatggacttgtctcgtagttgacgaagctcatcggctcaaaaacgacgactcgcttctgtatcaaactctgtacagttttcacaccaatcatcgtttgcttgtcacgggtactccattgcagaactcactcagagaactgtgggctcttttgagcttcattatgccagaaaagtgggtgatgaactttcatttactagtactttaataaaaagttgcatttttacatagatttgaatggaatatattcaaaactaattttcaggtttaacgattggtgtgaattcgaacgggcacaccaagaccgtgaccacaaaggaatttcgtcattgcacagaaaattggagccttttttgttgcgacgagtgaaaaaggatgtcgagaaatctctgccggccaaagttgagcaaattcttcgcgtggacatgaccgctcaacagaaacaatattataaattggtgctgaccaggaactacgaggagctcagcaaaggcgtgaaaggcagcattaatggcaagcaaagaattgcaattttttaaaaagttgtttagatttatgacttttgttttaattatagggttcatcaacataatgatggagctgaagaagagttgcaaccattgttgcttg

SEQ ID NO: 73062 - DNA, 831 bp, Heterodera glycines
  Genomic contig location: Contig_ID=SeqID_10012; Location=315..1145; Strand=-
  SCN-specific regions: Sequence locations=1-252,279-620,643-791,824-831
  Gene Ontology: Mol. function=phospholipase C activity; Cellular component=mitochondrion; Biological process=protein-nucleus import
atggccgatgaggacgttgtcatcgctaaatttgatgcgactgcaagtgaatactcaatccatttgctattattctttaatttacaattcacctttttagatgatgtgcctccacaattcgaagttcgcgggtgattgcttttttttaaatttcctatctatgctttggcatttaatatttgtttttagatttccgaccattttctggctgccaaagaaggacaaggccaacccggttccttatcaaggaggccgtgaagtgaaggacttcatcaagttcatcgccgaacaatccaccgaccctctgaagggctatgggcgtgacgggaaaaagaagaagaaggcaaaggctgaggaactctgatgggtcaaaatatttgcatggtttgaacaaccagtgattttttccctcctcccctaatgtgtgccgattaaaaaatttggtcggtgtgcattttatacgtgttaaaacatcgttggggcttagtaatgggttctcgttttaatgttaatcaatgctgcagctcgtacaccaaaattgttttaatttatttgactttctggctcttttcttttattacttaaacattatgcgcatgaagagatgcttctttttggttttagaaatagtaaaacagcattcgcagttttaaaatctgaattccgaattgctttctcttcatggcatgatgggattgtgaatccgatccgttgttgtgccttataaagctcccaactcccaattgagggctattgtcatgctgtcccctgacttattttccgccgtttcaattgtaattttattttcaatttgtttgtaaaggaaataaa

SEQ ID NO: 73063 - DNA, 1750 bp, Heterodera glycines
  Genomic contig location: Contig_ID=SeqID_1368; Location=1302..3051; Strand=-
  SCN-specific regions: Sequence locations=1-210,232-587,610-744,767 -842,864-1184,1211-1750
atgtcctttacgccgtcaaatgcggcatttattcccccgccgcctggcaaaggaaagcccagcagaaatgtgccgctggtgtccggcccttcccccgccgccgctgcgtttcgaactcgtccgagcggtggcgccgctgccggagacaatgcaacgcaaaaaaattgtaattgttggagagtctcgaaaatgccaagccaaagatccgggacagagactcaaaaaacaataatatgttaagaaatttcactcgaaaatataaaccggtctttcgaatagccccctattggtatggtttaacaccttgttctgaacaaaaaagattgcattttggtggattttggcgggtgtctccgccaatttacattccaaaatgttcggtttggcttttcgttcgtccatccctttgccttttacatattactctcgctgcgttcagttgttgaccaatctctgtctgcgatgttcgcaaatcgccagctgctccagtcggtgtgcaacaatccgatggtgcaaagtttgggcaaacaggcggtggtgtcaatggtccggcagcagggcaaagagttcgtcggccgaacgtcgacggcgtttggcggcggaggcgccgctgcgaccaatcaaaaaacaatgccacaacggacagtgatgagcagcagcaacaatagcaatggtggtcgtactgcttcagcacaaccgacagcgaaccgtacgttgtgagagaaccgattttgggatgaaaagggccccggaatttggaaaaattcattgggaaagggaattattaaaacttgaacgaaagatcctggttgtttggtttggattgtgttccttaacttggccatgtgagagggtaaaatccgaaattggcaaatttcgaattttaatggtcgccaaaagcggcatcactttttagagtgtcattcattttttaaatgttttctaataaatctatggctttttgtcgacgaatgtccgtcattttgaaggccaattgagcagcagccaatgcttggccgagaaggaattggaggacattttcggcccattatcccttggcccgtcgtccaacaaaatgccgtcgtcgtcgtccaccgccgcccatcctccgcctcaatgggcggtgccctgcgccgggggcagtgccgcatttgccgacggtttttttaccggtgaattccttcggcatttttaattcaaatttttcttcaatgcttagctcaatcggcaccccttcgtccgtttgattcggccgcctctttccctgcccattccgccaacgccccgctttaccccgttttggaccgctattcgcctccctctccgctcatcgaattgaaaacgccggcctctgttcctttggatggccaatgtcgggctgtggcattgtacgactacgacagcggagtgcccggggatttgaaggtgtccaatgtttttttgtcccaattcctccctttcaattttgtcccaaatccatcgtgtttcttttgtaccgtctccccttacccgttcattacagttctctgcaaacgattgggttatggtcatttcgcgtgtgaatgccgattggttgcgcggtgaattgccaaacagtggtggcaattgtctgcgtggcattttcccggttaattatgtgcaaattgggcccaaggaattgagccgtttgccgtgggaggacgaggacagcggaatggacagcacaaagcaaccgaaacagcaatttctgagggcgttgtacgactttaaa

SEQ ID NO: 73064 - DNA, 478 bp, Heterodera glycines
  Genomic contig location: Contig_ID=SeqID_1368; Location=7016..7493; Strand=+
  SCN-specific regions: Sequence locations=1-27,52-148,170-478
atgaatttttctccgatcactctgtttctgctctcttcactcgccattttctctgcagcggatgcattccgccaacaaacggtcgccgttcgcggccgtttaatgtgtggggataagccattgacggacacgaaagtgaagctgtggaataaaaacaaaattggtagaaaatcataattttaaattcctatcaatatatttattgatcaaaaataggccgtgatgatcagctggcggacgtgaaaacggacgcgcagggaaatttcgcattggacggcggcgtcgggtccattttcggcatgaatgtgcacctgaaaagttgggcactccatttttgtaaatgcgaaattcgagcgaatccctaacattttttgccagtttatcacgactgtgaccgtggcatccttccgtgccaacgcaaagttaacctcggcattccgggcgagtacgtcacgcggaccagcaccgttcagcgatg

SEQ ID NO: 73065 - DNA, 825 bp, Heterodera glycines
  Genomic contig location: Contig_ID=SeqID_10013; Location=143..967; Strand=+
  SCN-specific regions: Sequence locations=1-250,273-340,362-402,424 -528,615-798,820-825
atgtcatttttgaccaattcaataaattatggagatgctttcacacaagcagcagcaaaaggaggtcaaaaaagatgagaaaagtggaggaaaataagaaaaatataaaacccaaatttttagaagtgaatggcgatgcaattaatttggataattatggacaattatttgacggaaaaaacagtgaatcgatcactgatcaacgacagcttaaggtgggcgaaagaaaaacaaacaaaaaaacagacagaaacaattgggaaaatatttttagtattatgtgcaacccaaaagagattttgctaatttaaattcaggaatttcgtgaaaagtttgccagaatggaaatggaattggaaatggccaaattggaactcgaaactgtgagttttgctataaaaatattttattttctgttttccctatttgtcttaagaagacacttgaacaaaagttaaagcagcagcaggaactgattggattgaaggaaaaattggccaaaattgaacaggaaaaggagaaaaatggtaaaaataataaataaaggaattaataaaattattttatggaaatatttatttaaatattcgataaaattaatgaatttaaatttacagatgccaaatatttgactgttcatcatagggaaaaggaaaggggtaaaaagttacaaattattagggttgtaaattatatggattaatatcttttttctgcgcatatgctatggagaaaggggctcaaaaatagcatttctgcattaaaattttttgatttgtgaaggtttttagtccatataaatccatattttgggggttttcgaga

SEQ ID NO: 73066 - DNA, 54 bp, Heterodera glycines
  Genomic contig location: Contig_ID=SeqID_10014; Location=1638..1691; Strand=+
  SCN-specific regions: Sequence locations=1-54
atgctgtaccgttggggaattgaacccaagagaacagtaaagaaagggagaagg

SEQ ID NO: 73067 - DNA, 835 bp, Heterodera glycines
  Genomic contig location: Contig_ID=SeqID_10015; Location=1315..2149; Strand=+
  SCN-specific regions: Sequence locations=1-13,40-41,66-220,242 -345,409-835
atgaaaaggtaagataaataatatttttaattttatataccaaatttaacagagaaatattaaaagtgaatgattattaataaaattgttatattcctttatttatactttttcagtttaattaccttcggattcgctgttaaacagcagaacaaattcgatggaataattcttagccacaagggcacttacgcatattataatcgtggcgatatttggattaacggaaaaggaaagggaagaaatggcaaatattcctacggtgttggcgataccgtaggaattggtgtcaattcggccactcgacagatcattttcactaaaaatggacttcgtttgggttggtaaataaataatgaatttaagaatcttaaatataattttttatttatttgattttatataaatcttttccttaactttttcacagattcctctgaatttttcgttgctcaatcttttgctgatgattcatttcatccatttgtttctatttggcattatggtggccaagatcaaattgaggcaaattttgggcccaatttcaaattcgatttggcaactctctgagggtgaaatattcaccaaagctgatcaatctgttctttttactgatcaatttgttcgtttaatcttttttttaagagtattcttggaatcagggaatataaatatcggtatgtacatgtgtatgaggtagagaattgatgactttgaaatagggttcggtccggtgggaaaaatattggaaatttcaattgaatagtaaataagttagaatcaaaaattttactcatttaaaaaaaattttcatttcgacgcgtcgtggttatta

SEQ ID NO: 73068 - DNA, 481 bp, Heterodera glycines
  Genomic contig location: Contig_ID=SeqID_10016; Location=1173..1653; Strand=-
  SCN-specific regions: Sequence locations=1-481
  Gene Ontology: Mol. function=glucosidase activity; Cellular component= cell wall (sensu Fungi); Biological process=cell wall organization and biogenesis
atgatttatcatcagtcacggaacagtcgtcaacatttgatgatttatcatcagtcacggaacagtcgtcaacatttgatgatttatcatcagtcacggaacagtcgtcaacatttgatgatttatcatcagtcacggaagaatcgtcaacatctgaggccttatcatcagtcacggaagaatcgtcaacatttgatgatttatcatcagtcacggaagagtcgtcaacatctgaagatttatcatcagtcacggaagaatcgtcaacatttgatgatttatcatcagtcacggaagagtcgtcaacatttgatgatttatcatcagtcacggaagaatcgtcaacatctgaaggtttatcatcagtcactgaagagtcgtcaacaatttccgagtcttgtgcgtcggtgtgcagtggatttggatggacaaattataatggcaattgttacaaagttatcgaaggactgatgaatcagac

SEQ ID NO: 73069 - DNA, 88 bp, Heterodera glycines
  Genomic contig location: Contig_ID=SeqID_10016; Location=275..362; Strand=-
  SCN-specific regions: Sequence locations=1-33,56-88
agaatatgtggccaattaatcaatttgtgttgtatattattaattttaagcatttttaaaacaagcataaatatttgtggagaagaaa

SEQ ID NO: 73070 - DNA, 890 bp, Heterodera glycines
  Genomic contig location: Contig_ID=SeqID_10017; Location=122..1011; Strand=+
  SCN-specific regions: Sequence locations=1-844,867-890
  Gene Ontology: Mol. function=chaperone activity; Cellular component =nucleolus; Biological process=nucleocytoplasmic transport
atgttgacgactcttcagtgactgatgataaatcatcaaatgttgacgactcttccgtgactgatgataaatcatcaaatgttgacgactgttcagtgactgatgataaatcttcagatgttgacgactcttccgtgactgatgataaatcatcaaatgttgacgactgttccgtgactgatgataaatcatcaaatgttgacgattcttccgtgactgatgataaatcttcagatgttgacgactcttccgtgactgatgataaatcatcaaatgttgacgactcttccgtgactgatgataaatcatcaaatgttgacgactgttcagtgactgatgataaatcttcagatgttgacgactcttccgtgactgatgataaatcatcaaatgttgacgactcttccgtgactgatgataaatcatcaaatgttgacgattcttccgtgactgatgataaatcttcagatgttgacgactcttcagtgactgatgataaatcatcaaatgttgacgactcttccgtgactgatgataaatcatcaaatgttgacgactgttcagtgactgatgataaatcttcagatgttgacgactcttccgtgactgatgataaatcatcaaatgttgacgactcttccgtgactgatgataaatcttcagatgttgacgactcttcagtgactgatgataaatcttcagatgttgacgattcttccgagactgatgataaggcctcagatgttgacgattttttagggaccgatgttgaaacttcacataatgaaagatcttccgactgtgaatctttagatgatttggaatcatccgatgatgaatcttttgatgatgattcagatgatgaagaatgctccgatgaagaatgctga

SEQ ID NO: 73071 - DNA, 944 bp, Heterodera glycines
  Genomic contig location: Contig_ID=SeqID_10017; Location=75..1018; Strand=-
  SCN-specific regions: Sequence locations=1-31,54-944
  Gene Ontology: Cellular component=extracellular space
tacctattcagcattcttcatcggagcattcttcatcatctgaatcatcatcaaaagattcatcatcggatgattccaaatcatctaaagattcacagtcggaagatctttcattatgtgaagtttcaacatcggtccctaaaaaatcgtcaacatctgaggccttatcatcagtctcggaagaatcgtcaacatctgaagatttatcatcagtcactgaagagtcgtcaacatctgaagatttatcatcagtcacggaagagtcgtcaacatttgatgatttatcatcagtcacggaagagtcgtcaacatctgaagatttatcatcagtcactgaacagtcgtcaacatttgatgatttatcatcagtcacggaagagtcgtcaacatttgatgatttatcatcagtcactgaagagtcgtcaacatctgaagatttatcatcagtcacggaagaatcgtcaacatttgatgatttatcatcagtcacggaagagtcgtcaacatttgatgatttatcatcagtcacggaagagtcgtcaacatctgaagatttatcatcagtcactgaacagtcgtcaacatttgatgatttatcatcagtcacggaagagtcgtcaacatttgatgatttatcatcagtcacggaagagtcgtcaacatctgaagatttatcatcagtcacggaagaatcgtcaacatttgatgatttatcatcagtcacggaacagtcgtcaacatttgatgatttatcatcagtcacggaagagtcgtcaacatctgaagatttatcatcagtcactgaacagtcgtcaacatttgatgatttatcatcagtcacggaagagtcgtcaacatttgatgatttatcatcagtcactgaagagtcgtcaacatctgaagatttatcatcagtcacggaagaatcgtcaacatttgatgat

SEQ ID NO: 73072 - DNA, 2323 bp, Heterodera glycines
  Genomic contig location: Contig_ID=SeqID_10018; Location=584..2906; Strand=-
  SCN-specific regions: Sequence locations=1-1948,1972-2067,2089 -2151,2174-2182,2315-2323
atgataatggctcgaaccatcaagagtctcgacattttttcctactcaatgattcttcaccaattgccagagttgaaaggaaacgcaggagctgatcaagttaatgcgttcttccgacaatttgacgcggtcagcgaagattggccaaacgaaaggcgtttaagggcacttaaatcgaaatgttcgggtagggcagagcgggcctacaattctgcagttgccaacaacccgtttcggtatgaaaacatccgaagggctatgaaacaacaacttgactcgacggatgccaaatcaacgtgtgcatttgatgagctaatgaccggggtatgcagaatgaacggcgaaagcattgacgacttagccgaccgcgtttcatcactggtgagaagggcctatcccggacatggcgaacatttgtacgacgattattcaattcggcatctgatccggtcgctaaaaaatccgaacttggcactcactttggaaatggcacggaagcctgacatgatttttgacgaattcgtggccatggcagcgcgcgcggagatcacccaaaatgcagcaaaagcagccgaacaaagagacacgaatttttgccaaaattttgaacaccgccgacaatttaatttccgatcatcgaatcaacctgagaattttgtccggtctttcaaatgctacaattgcggccaggaagggcatgtttcccgtaattgttggtacccacgacgcgatcagtcaaattatgccccaccacaatataatgcatcggctacgggagcggacaggattccctataccaatgaaagccaaaaatcacaacaaaattttccgaatcatacccaacaaccgagaaattttcttcgacaaaattatttggtcgaacaaacagaaaaatcgccggcgtgtcactcaaatgttttgattggaggaataagtgctgtaagtgaaaaggtggaaaaattatttgaagacgtgaaagcaaaagatgcgcagagtgctaaagagaaaagggaaatagtcggtaaaattttgttagcaaatgtttcaattcttgggcagcatgccaacgcaatgttagacggaggagcacagatttcgttgatttctgctgcatttttgaacaaaattttgaacatttcaacgtcgagcaaagaatttttgaacccaagccgtcagaccttgcgcgtcatcgacataaatggggaggaagtcaaatgctacggaattgtttcgttgccggtgagaagaatgggaaggaccgtgtcagttcgtctccacgtggcccaaacatcgttcggctacgatttgctcttcggaacaaattcactttcggacctgggttttaaactttttgacgaattgtccgacacaattgtcgatttcaaaccggcatcgaacaatgacaataaggcagtaaacatcatttatggtttgactttgattcaaaattccacgccatgtttgctagggaaagaacgaacagaaaaggctcggaaaaatgatgtagccatcagccaagaacaaaaagtcgcagatgataatgttgccaaaattccgaaaagtcagcaaaagtcgtcacaacaaaagaatcgatcgaagtggcaagcaaaaaacgggaaaaattcggcacagaaaggaggaaaattggagaaaaaatttggggaaaaagggagtgaaaagagtaggaaagatgtagaatgcaaaacagaaaagtcgattttagaggttcaaaaaaatggaaaagtctgccgaaatgttagaggacggagttctcaattggggacaattgaatttttggagggcgggaaggaattggacccgaaaaagtcgaccactggtaaaaagaatggcaaaacgaacccgatcttcagaaattttggtggatcgtacaaggaattaggaaaagctgggcatcgaatttcggcaaattttcgacaaattggcaatgtaaacgaaaatcgagagaaaggaggcggatggaagagaaaaaccatctattatgcgactccatcggggccaatccctaaatttgttggatcgtcgacggcggacggcaatgtgtcagctgagaacccttcctttcgggccgaatcaaggaaattttgacggcagagacgccttttttgttgggggcgggatgtgataatgacgaatatttattttagttttaaatttattggcgttttgttcttattattgtttgtgaattgttttagttctttttcagactttatgtttttgaattcatgaagatatttttatgtttattatcgtctctcctcctgaattttattgtggtgtttgattttattttggaaataaa

SEQ ID NO: 73073 - DNA, 465 bp, Heterodera glycines
  Genomic contig location: Contig_ID=SeqID_10019; Location=70..534; Strand=-
  SCN-specific regions: Sequence locations=1-465
atggttatcccacgctcgccgcaccaaactcgccagcgaacgcgacagcaaggcgtcatattggacagcgacggaatgcaaattttgcgagagccgaatgaggaaccaccgaattttgttgtttcggaggcaatccgtcccgcaaatgaaattttagagagcgggagcattctcggcggcgagcaatttcgacaacgacatttggaagtgaatgttcatgaatttgaaccggcagcaaacgaagaaaggatgagtgagcacttagcgttggtggcaccaatggttaatgcaggttcggggcatctcgaaaattttggaagaaatatgggagaacggaatgctgtcgaaataagaaatttgccaccgaatggccatctttttggagacaatggaaactttgaggatggttgggcccgatcaccgaactcaccgttattcgaatcaagtcgccatgcttatctgaat

SEQ ID NO: 73074 - DNA, 438 bp, Heterodera glycines
  Genomic contig location: Contig_ID=SeqID_10023; Location=208..645; Strand=-
  SCN-specific regions: Sequence locations=1-30,62-83,106-158,180-438
atgggcataaatattccgaattatatcggtttagaagaaaaaacaaacaaaacaattaatgtaagatttattattttttcgtgaaaaaagaccaaaaaacagaaatataactctttttttttgactatttatgaagaaatctagggttggtcgggaccgggaattttgggaaaaaccgggaccgggacttttttggttgaaaaaccgggactttttggctgggaaaaccgggaaaaaacgggaatttcccggtcccggtcaaaactggtcaaaaccgggagctaggtactcagttgtccgtgtccaggtcccggtcccgtacaactctaaagaaatctatcgatttttaagaaagatgaaattcaggccgtccatagtccaggaaacaaatatggttccgtataatttccagccctaatcatattttgaacaaataaa

SEQ ID NO: 73075 - DNA, 214 bp, Heterodera glycines; identical to SEQ ID NO: 72307
  Genomic contig location: Contig_ID=SeqID_10024; Location=2066..2279; Strand=-
  SCN-specific regions: Sequence locations=1-91,115-214

SEQ ID NO: 73076 - DNA, 334 bp, Heterodera glycines
  Genomic contig location: Contig_ID=SeqID_10025; Location=331..664; Strand=-
  SCN-specific regions: Sequence locations=1-35,64-179,201-334
atggtgcttatcaacaacccaaacccaatttgtacaaaaataatatgtttaattattatttttgtaacaatttttgatacaaatccaattctttgcgccaatctaattgatgacacaatgtcagaagtgttcaaacatatgaaaatacatggtgagaagctataaaacaattaacgaataattaatattaattaccaaaaattgatttaaaaaaatgtaggaacgatttgcagggtaaaaatgttgactccaaagccattagatttaattaagcccagcatacaagtaaagtaatcatttggtatcattatttttagggttatccattatttaa

SEQ ID NO: 73077 - DNA, 1031 bp, Heterodera glycines
  Genomic contig location: Contig_ID=SeqID_10025; Location=753..1783; Strand=-
  SCN-specific regions: Sequence locations=1-272,294-464,487-770,794 -1031
atgattttctgcggaattggcggttcgctggatccaacggaatgggcaaactttgtgaagattattaaatggaaaagtgcaacaacaaaaaatttcgccatcgcatttcgaaatttgccgcctattaatttggtaaaaaaagtgatgtgattgattaggaaatatggtcaaattttgaaacaaacgcaaacacttggccaagttttgggattaggctgtgattttggattttgagattcatcgccgcccccccccccctcgggcaattgtttgcattgctgtgtgcattcatgttaatgcaaacaaataaatccatttttgactcttaaaaatgaaattagtttaaattaagccacccaccgatgatagcccatagactgaggctttaaaattgaaaaaaattgataaagctctctccaaccggggcgccaatcaaaaaatggccaccaaagcacaaggctgcctaaatttaaaaacaaaaagtcatattcactggattttaaacacttgaagcataaatttctcgaaaatattttgttgtccctatttagatttggtgtcgaaatttcagaaaaatccaacccgagttccttccgttcaatatttttaggatttttacatttgatcagaaattttggaaagaacggaatcgggatttccgggacaaaaaaaaatttggttttgccgccgaaactcgtggggtttctcgaaaacactcgggattgaccgggagtctaggcggcaagaccatatccggtccggtctctctaatttttaggcccttcttcaagggtacattattaattattcaatttaatttagagctggtcgggaccgggatttttgacaaaaaccgggaccgggaattttcggattgaaaaatcgggactttttggctgggaaaaccgggaaaaacccgggactagtcccggtcaaaactggtcaaaaccgggactgggtactcagttgtacccgttttttcagtaccagtcccggtcccgaccagctctaatttaatttaaacaattaaa

SEQ ID NO: 73078 - DNA, 177 bp, Heterodera glycines
  Genomic contig location: Contig_ID=SeqID_10028; Location=397..573; Strand=-
  SCN-specific regions: Sequence locations=1-177
atgccgccaatgatttttttccgtaaactgtctccacatatattcgtcacaataactgggcaacaattcgcggctagtccccgacatcgccttgaacttcattttcaagttcttccaaaagcactcgacatggcttgtatgggcgccggtgatcggatccacaaagttcgaatccgg

SEQ ID NO: 73079 - DNA, 450 bp, Heterodera glycines
  Genomic contig location: Contig_ID=SeqID_10028; Location=847..1296; Strand=+
  SCN-specific regions: Sequence locations=1-450
atggtgccatttgaattggtgaacgaatggacgaaggaaaagctgacattggccaaggcaaacgaaaatgaattggacaattggataatgaaacgatgcaaaattattggggagaaagaggaaaattgggacaacaattgcaacaatgtgttcttttggcttgttggtggcattgattgcattgggtgagcaattaaaaaaaggcatttgattttgtttaaataattcaaattgcgcttaattaaggccattgtctccgccaccggcagaagaaacgggacaaagcatcacaaaagtggcgtcttctgctgacgatgaatgagtgacggacaaaagaacgaaacaatggtgattagtggaagaagaaatgattatttaagaatggccaaccgatcataattcatcagtgatcaaatgcaatttatgatgaaaacctctcaatttcggtaa

SEQ ID NO: 73080 - DNA, 554 bp, Heterodera glycines
  Genomic contig location: Contig_ID=SeqID_10028; Location=1944..2497; Strand=-
  SCN-specific regions: Sequence locations=1-196,218-306,328-379,401-554
atgacattttacgcgtcccaacaacactttacgcgtcccatgacattttacgcgtcccatgacattttgtgtccatggcagggatggcattccgaggccccaaaaattttcggaaatcgaaattccgtgccatccctggtctcatggtattatagttgtcttaataactaagagaaaaacttttttttgttaggtattcaataaagtttttaactataaatttcgttgttaaacctaaggttatcatgacaactcatacacaggcaactcgaacaatggcttattgttagactaggcctaagtttaggcttttgtaaattttcttttcttatattagttgaacttctgttgacatcaataagtgtgcttagagttgcttttgcacttctcttttatatgcaaccacgcgaaaacgtcctggcccgccaaaaacttacagaaaaatattttttcgtaaatatttctggcttttttatcaaaatatttgtcccagccctagtgattagtagggcttccaaaaatatggatataaaatctctgaatatggcaataaa

SEQ ID NO: 73081 - DNA, 428 bp, Heterodera glycines
  Genomic contig location: Contig_ID=SeqID_10029; Location=706..1133; Strand=+
  SCN-specific regions: Sequence locations=1-312,334-392
atgtaaaaattaacagaaattcacgggttcataaggtaatttggacaataaaacaaaaaatcacgggttcattcgatagttgcgagaaattccccggagaaacacaaataatgtgaaattgattttttgaactcgcatctccaaaattttgtcatcccatcagaactcattttagcgaacgtgtaaaagtggccttcgtaagacaattttactttttgttttttggttgcaattgggttagccatttctgaaaaatgtccaaatcagaatgtacatcaaattggttaactattaaaaaataataggatttggaataagtaaaattgtaaaaaatgagcgaatgttaattaaacctaacttatgccaagtggcgagggatccctcaggcttagtttttagaatcttaatttttaaaaaagcacattttt

SEQ ID NO: 73082 - DNA, 636 bp, Heterodera glycines
  Genomic contig location: Contig_ID=SeqID_10030; Location=811..1446; Strand=-
  SCN-specific regions: Sequence locations=1-259,290-559,582-636
cgacgatgcaaagcatgtggattaaccctaattaagccaatgtctggccattcaaaaaacgacactttttaaaattccgcattttagggggcaatcaaaaattccacattcttttacatgacaatccaagaatccgttgaaggaaaattcaactggtcaaatggcgccaaatgctcaatttattagtaaattatacaccgaactaagtcaaaccagccaaaagattgtcgaacttaataccacataaattgactttcactgaaagcattttaaatgttaaaaaatatatcaagttcatccaattcgacaatccatggcatgagaattgggacaagaatgattgccaaatgatgaggaacaacaaaaagcatcattttcaaatttcatgcatattaagcggtgcgatggtggtcaggtgattgattttattcattcacattttgtagggatgacaagtgtttattcccgtgtttgtttgtccgtcaattgtatgtgtgatggatgtgtcaagaaactaataaacgaagacaaaataaatatccgtgttcaatgggagagcgagcgagaggaagagagaacaataatgatgataaagcatttttttttgaattttatcatttgaatcaatcaattaat

SEQ ID NO: 73083 - DNA, 492 bp, Heterodera glycines
  Genomic contig location: Contig_ID=SeqID_10031; Location=138..629; Strand=+
  SCN-specific regions: Sequence locations=1-41,63-116,138-285,307-492
atgatcagatcactttccactgggggagctttatttttcaaccctaattttttcaaaaacccaacaaaatcggtttacctcagttgggccggcacgattgggccccagaacttgtttggctattttttctttgtcaaccaaattcaacattgttagtatcattcgaaagcttaatatgtttagaagctttttctaagctattgcttcaccattagacaattaccaaaaaagttatacatgaaaattgcgaaaaagtcgaaattttgaagttttttcttaataaaattttttccagtcttgaaaattgtaaggctaatagagcatgtgaagagctttcgaatagtaccaacaattttggattacaaagaaaaaagctatagtgaaaaagcatgctgggacccaacggtgccggcccaactgagcgagtccgaacaaaatggcgatttttcgtaaactttttgccaaaaataacaaatttttccaatgctttta

SEQ ID NO: 73084 - DNA, 891 bp, Heterodera glycines
  Genomic contig location: Contig_ID=SeqID_10032; Location=2492..3382; Strand=+
  SCN-specific regions: Sequence locations=1-891
atgagcggaattattctgacgtgtaccagaataagcggaattattctgatgtaccagaataagcggaatgattctgacgcgtgcaagaataagcggaattattctgacgcgtgcaagaataagcggaattattctgatgtacctgaataagcggaattattctgatgtaccagaataagcggaattattctgacgcgtgcaagaataagtggaattatactgagaataagcggaattattctgacgtgtaccagaataagcggaattattctgacgcgtgcaagaataagcggaattattctgacgtgtaccagaataagcggaattattctgatgtaccagaataagcggaattattctgacgcttgcaagaataagtggaattatactgagaataagcggaattattctgacgtgtaccagaataagcggaattattctgacgcgtgcaagaataagcggaattattctgacgtgtaccagaataagcggaattattctgacgcgtgcaagaataagcggaattattctgattaccagaataagcggaattattctgatgtaccagaatagcggttctgacgcgtgcaagaataagcggaattattctgatgtaccagaataagcggaattattctgacgtgtaccagaataagcggaattattctgacgtgtaccagaatgagcggaattattctgacgtgtaccagaataagcggaattattctgatgtaccagaataagcggaatgattctgacgcgtgcaagaataagcggaattattctgacgcgtgcaagaataagcggaattattctgacgcgtgcaagaataagcggaattattctgacgtgtaccagaataagcggaattattctgatgtaccagaataa

SEQ ID NO: 73085 - DNA, 354 bp, Heterodera glycines
  Genomic contig location: Contig_ID=SeqID_10032; Location=2884..3237; Strand=-
  SCN-specific regions: Sequence locations=1-354
cgcttattctggtacatcagaataattccgcttattctggtacacgtcagaataattccgctcattctggtacacgtcagaataattccgcttattctggtacacgtcagaataattccgcttattctggtacatcagaataattccgcttattcttgcacgcgtcagaaccgctattctggtacatcagaataattccgcttattctggtaatcagaataattccgcttattcttgcacgcgtcagaataattccgcttattctggtacacgtcagaataattccgcttattcttgcacgcgtcagaataattccgcttattctggtacacgtcagaataattccgcttattc

SEQ ID NO: 73086 - DNA, 3634 bp, Heterodera glycines
  misc_feature (3484)..(3484): n is a, c, g, or t
  misc_feature (3600)..(3600): n is a, c, g, or t
  misc_feature (3605)..(3606): n is a, c, g, or t
  Genomic contig location: Contig_ID=SeqID_10034; Location=471..4104; Strand=+
  SCN-specific regions: Sequence locations=1-43,65-139,166-1081,1103 -1223,1245-1398,1421-2223,2246-2667,2690-2998,3021-3274,3300 -3429,3467-3634
atgaagccactgtggaagtccaaagacatcgtgtataaacaggagctctgtgtgcttttcactgaaggtgatgcggggcaagcaggccactacgacccaatcaaatcaacaggcagattatttggtgccaagacaagctattgttttggggtaatatatgtgtgtaaattgagtataatgcaaatatttagtgcgaaatgccatacacacaccagacccgtcacaacggaaattgcaaatggaaatgtcgcaattgtcaacgagtaggcaaaacctttcgtgggacctgcagggatagtgacttttgtttgtcttgcctcggctgtggaaaggtatccgcataatttaattaaataaacaaacccttgtgcagacctttgagagccgtgaatgctttgaacaccatgcaaaggttatcaaagcaacaatcaagaagggggacaaagaagtgaaaatagagaaatcaatgtgcaaaagctccagaaaatgcgtgaaatgcggcgttatttaccgcgcaatggtctcttccttatctttcgttttaattatgtcagttttcagcaccaggacaaagagagaggtcacgtctgcggtcataagttctgccgcgtgtgtctcggattccatgcacctcgtgactgctacattccgtaccgcccaaagaagaagacagagaagcgaatcatattcttcgactttgagtgcacgacggatttccagccagatcctgaaattgcccgtttcaaacatcaggtaaaaaaattcccatatttcagtaacatagacaagttttaggtgaatttctgctatgcacacgtgacttgcacgagttgcatcgagaagggaatctggaaccagtcgctggagcagaaatgcggaatctgtggcgactaccggacgtacgcgtgggcaccattcgacttctacaacaccgaagttgagcgccgcttccgtgttgacgacccactggcatcattcaccaaatggcttttgaacttcgagactgagacgctgggactcgatcacaacgagcgtggaaagaaacgcaagcgcaccgttaaacagaataacaacaacaatggacaggcctgtttctttgacaacgaagccgaagatgatgaagacagcgacggcaatgatgttgagaacaactacatgctcggatacgatgaaggcggagaaaaaccaagatccgtgaagacctacgcctacgcacatgctggtatttacgaattaaataatcaataaacaataattcaggctcgcggtatgaccatgtgctcatctttggcgagatgctacgcatgggtgttcgccctgatcttgtccgtcaaggaaaccatctgctggagatgaaggcacataagaagggtgccatcacgacaactatcttccgggacaggtaaaaattatggaaaaatggcattatttattatattgacaaatttcagctacaaactcattccactgaagttggcctctttcgtaaagacgtttggcttgaacatcgatggagtggaaaataaaaaatattttccgcataagtttaataaggtgaaaaaatgaaaaaaaatatatatatatcaaaatccaataaaattttaggccgtcaattatggaaacgtcttggaaactcttccaccgcttgaggattactcaccaggcagccacttcccagaggagcggatcaaattggagaaatggcacgctgacaacattaacacacgctttgacttgcgagagatcatcgcagactactgcaaaactggtaaaattatgatacatttcaaagtattctgcgaaacttcagatgttcaaatcctggtacatggtgttttgaaaatgcgagagctcttcatggccgagacaatgcatgatttaacagattcaatcaccatcccggtagctgagaaacgtgattttttccaataattttaaatttcagtctgcctgcatgaaatactttgtagcactgtcgtaccaggataatgaacgcattgccattgtcccccatcttggttatgaaaagaggggaaagcagagcacaattgctcgcaagtacctcaaatggcgtgcgggggaagagatgcgaaacaacggctggacactccgcttcattgaaagccccgggggcgagtacaaatatggcaactatagcctagacggaatgatggagcgccctggaatggcgaaaaacctcgcgatcgaagtgcaagggtacgtattttatttaataaaaataccatcaatgtccgattatttaagctgctattggcatgcttgccccaactgttttcctgatgaggaggcgattgttggcggtggagagacagcaggtgcgatccgtgcgagggatgccaagcgtatcaaacaaatcgccagggactttgaagtagagatcatttgggagtgccacctgatgcgtatgctggaggaagatcctgcaatgaaggccttcttcgataacacgccggactcaggccctattgaattccgggacgccttctttggcggtaaaattcggctagttttttgtaaaacattccaaaatttaggtcgaactggacccgattggttggccatgggcatgatgaagccaaacggagagaagctgaaccgcagcatcaagatcaaagacttcaatagtctgtatccatcacggtgagctttataaaaaaattaaaattatgtcaattcaaaggaacatgttcaccaaatacccgattggccaccccaccctgctcaaaatggacaaaaacgtggaatggaccaagccggagcatatgattgataatgatggaataccgattgaggggatcatcaagtgttttgtggtgccaccccgccactgcttgttagacatcccggtaatcccgttccgaatgaacaacagaactctcttcatgctctgtcggaggtgctctgaaatgtatccaaaaggccttgtggaccctgattacaactgtcctcattttgaggaccatgaacgaggtaattctgtgtaaataattaaaatataatgcctatttaggtttttcaaccaccattacacacattgaattggaagctgctctgagagcagggtaccgagtcacgcgggtcttcagtgcgtacgtgtggcgacgtgcatgtgattggagcgacacattgtttcactcgtacctcttcaaatttttgaagataaaagaagaaggttggttgtttgtaacataaaattattataaaatgcttaagcatccgggtaccctgccaaatgtttggtggatgggatctcggaggaggagagggaagaaagacaacagcagcacattgacagctgctacgcaaagagcaaagtgcgtcttgaggcagccagaattaagccaaatccggggctccgctatattgcaaagctatgtctcaattccctatggggacgcttcgcactaaggtaaataactcaacaaaaaacataaaaactactgcacaggaatcggctgaccanaaccgaaattgtcgacagcaacgcagacctcggaaagctgctcaacgatgataagattgactcagtagcctcgacaactgacccgatcgggtctggatggtctgctataagacaanggatnngacatgtgtcgagcatgacacaagcaac

SEQ ID NO: 73087 - DNA, 1289 bp, Heterodera glycines
  Genomic contig location: Contig_ID=SeqID_1369; Location=23..1311; Strand=-
  SCN-specific regions: Sequence locations=1-269,294-603,625-697,719 -1023,1045-1251,1273-1289
  Gene Ontology: Mol. function=guanyl-nucleotide exchange factor activity; Cellular component=membrane; Biological process=locomotory behavior
catcggcctgcaatcctccgacgaacctcaaatttggggccgttgtctgcacggcttttccgccggcattcgcgtcgcttgcctctttcggttggccattcagcggaaagcatttgtgcagacgctgaccaaattcactctgctcaccgcgaacagttcactgtccgaaattcggccaaagaatgtggagtcgataaagctactcatccaaattggggttgaaaatggcagccatttggacgtaattgactggcaaattggctaatttcaaatttttaaattttatttttttagcaaagctggtacgacgtgttgaaatgcatcagtcagcttgaactggttcattccatcggcacgggaaaccacggtaattaggatggatttgcgtgtttttactcatgacaacggattcagctgatgctaaaccccactggatgatggttccccaaatcccattccttaaagacaatctgaagagcatgttcaacatccgtgacaagtccttctccaccgtgcagggatatttggctgaaacatcctcccaagacttagtggtggccatagacaggtgacagcaattattctgatggggtttagacttttaccttgtttttgcaggatattccaagactcgagtaaactgtccggcgaagcggttatcgaatttgtgcgagcattgtgccaagtactgctcgaagagttgtgcagtcctggtgggccgagcatgtacatgttgcagaagatcgtcgagatttccttctacaatatgaaccgaattcgtatagagtaagtgcgaagagatgttgctgtttcttcaataatttgtggtttgccattctcagatggtcaatgatttggtccgtcctcggcgaacacttcaacttggccggctgcagttccaaccaggacatttctcactttgcgttggatgctcttcgacagctttcgatgaagtttttggaaaaaggcgaactgccgaacttccgtttccaaaaggaatttctgcacccatttgaaggtgcacaattttctcatcctttcatttttactcgaaatatccctccacaattcaagtgataatgagtcgcaacaagtcgctgtcctgtcgtgaaatgatcgtctcctgcgtcactcacatggtccattcgcatgccgacaaaatccgctcgggttggaagaacattttctcactgttcacactggcggccggcgaaaaggacgagcgaattgtggaggcggcattcaccacgacatccgaaattataagaaaagattgctatttccattag

SEQ ID NO: 73088 - DNA, 4043 bp, Heterodera glycines
  Genomic contig location: Contig_ID=SeqID_1370; Location=3780..7822; Strand=+
  SCN-specific regions: Sequence locations=1-1,30-310,336-895,928 -1162,1184-1482,1507-1529,1572-1715,1738-2053,2076-2168,2214 -2680,2702-2957,2979-3385,3407-3564,3586-3792,3814-4043
ttatttcttttaaaaataacaattttttgtgcatgacaatttatattttattaggtggcggaatttaagaaacgcgcagcacgcatttgagtggcattttgggtaggaactcaatttgacagtaattaaagtgtaaaattctctagatcaattgtccgtctttttgatcattcgtccgttccctttaatctctctgttgttgcgttttcgttttttgtttcatttcctttggccatcgtctttttgtttggcgttatttgctctgcaacaacagaagtggcaccaatgtgggaaagtcgcgcgtgtgtgcttaaaaaattaaatgtaatttaacaatttcctaaattcgttttacaaattttccacggcgtgccaatcgccacaccttttacatttattggcaccggcacttatcaatcaatcgtcaattggttgatctgaccagtaaaaaaacgcaccgaagtccacgcactgtgaacgcccggtagccgcactcggcacaaacgacgggcagtgagtgctgctgtttctggtggtggcccagcagtgcgttggtcgccgtttggaacggacaatgcggacattggaccaacggcggagaggcggacgggggcgaggaagaagacgaatttgcgatggatttgaggccaagcgaagggtgtgcaacttctgctaattggccattgggcgctgttctgttggctccgggcgaggaattcgaagtgtcgtcgggtcgaagccgattccgactgaaggagaaaaggaagcgggtaaaaaatgccaaaatcgatgcccccggcaaatgtaccaataatatttcttatggccaattagcgtctccatggccaaaaatgatacatcaccgcacataaaaaatgaaccgaacgacggtttgaaaaagttaactttattttaataatttgcttccaaatttattatttttttttgtttatggtttttaattttcttatacattaattgttttttgatttattttgcaatgaattccgtatttcaaaatgtcggtttatattcattttaacccgttaagtattcaggggtcgctgatcacaaaaccagtatttcgatcaactttgaccccggaccagaattctgataaaagtcgaaaaaaaatttttcttcaacaaatagatattggtttgtgaacagtgatttagaaatatgaaaaaaaattgtggcggttaaactatatagaagcaaaaatttctaatttgtacaaatccttatattttttaaatgttatctaattctttaagatattaatggtacgaacaaagcaatcttttccttccgaggctcagtgttcctaatcgtctttacaaaagattgatttgcctacttcaacaggaaatcaaacgggttataagctaccggtcaaaaaagcagtcaaaccggttcaaagctccggtgaaaaaaaagcggtcaaaaattttgaattattatgaaacagaacatttgaacaagaaaaggaaaatgaaagaattattttctgaagataatgaaatttctaaaaattttttgaaaaacataagaaaataaatataataattcgttcgcttgcgcttctttggcctgtaataaatttagttttacatcgccaggcccaagttgttttaaaatatcaggacaagtttatcataaatataatccaatagcacaaccgacagaccataattcattgccaacaaatggacagttgtattttctcgatagttgcgaagcacaaaatgtaattacattctcataatttagatatatttttgacagaaaaaatagaaataattcttagaaaaaatttccctttgctaaagcttatgaaatgatgagaaatgtagtagacgaacaaaaacaattaacaacaacaaataaaaacaatgaaacacaggaagttaaaatgttgttgagtttacggaaaggttttgatccaaatcaatacaatctccagcacacaaatgaagtagctgcgattattgtatgcaatgcaaatgaagaaataccagcggcaaatataattgttgttgaaaagggtagcaaaaaaattaaaaaaaatttatcctttgttatacccaatgggaacaaaaggatggagctttgacataaaaatcaaaacggaaaaaagatttcattttgtgattttattaaattcaagctattttacagacattcttattttttgcctcatcatttttctaatcaactttttcaacaatggatttttgaccaagcggcccgtgttgaatgggatagactgaactatattagaactcaccaagaattaagagcgtgtagttataagggattagaagattatctttttaacaaagctgaacaaacgggagtaattattggaaaacaagtgattttaccttcgtttttttaggagggccaagaaacaaatatcaacattttatcgattctatggctattgtgggagaaaatggaaaacgggatttatttttgacatatacaataaatcctgaggatccggacataaaaaaatgtttaataaaaaatcaaactgaagataggccggatatcgtagcaaagattttcaaattaaaagctgatacgaaatttttggtaaagttatagcttattgttgggttgtagaatcccaaaaaagaggcttaccacccttacattttctaatcactttacatccaaaagataaatttaaaaatgcaaatgacattgacaaatttattcgtgctaatcttcctgataaagaaaaagaaccttttttacgctcttttttagagaagagacccaaataggagaagatggatatgctttatataaacgtcctaacaatggtgattttgaatttgtaaaaggacatcgcttaacaaatcaaaatgtcgcaccttataatccatatttattaatgcgattccaatcacacatcaatgtagaattttgttcagaaataaacgctgttaaatatatttacaaatatatctataatggatatgatgcagcaacagttgaatgtgtaaaagaggagccgaatggtgaaaaaattatgttaaaatacgatgaagttagccaatatcttgaggcgcgttatttgagccctgtcgaacatgttatcgattgtttaaatttgagatatagggtaaatcacattcaatcggacgattataggtacatttagaaaaacgaacagaccatttatattgataaaaattccgaaagtgataatttaaaagaagctatgcaaaaagctagcaaattaacggcatactttaatttttttaaagaatatccgaacgcaccggaatttaaatatatagaaatgccaatttattgcacttttgaccattggaaatggccactaaaaagaaccgataaagttattgggagaatatacacaataaccccaaaaatagagaattatattatctccgttatttattgctcaataagcacgctaaaagttttgacgatttaaaaattgttaatggtgttaaatcaacatatatgccgaagcgtgtttggcgttaggattaacacgagatgattcagaatggaacaaatgcttagataaaacaagccaattcaaatttcataaaggtcttcgttcactttttgcaaatattttaattaattgtgaaccaaaatacccacttactttgggaaaaatataaagataacttaagttaggatcttaaaaaatcgtatactgatcagattgcttatcaaatagctttatcattaattgaacaaaaccttctaaaccatcaaaaatgtttggacgattttaaagatatgccaaaaataaatcaaaatattcagaatatttcagatgatcagataatgaatccacaagatgaattaaacattgctttaaaaaaaatattctttaatgaactgaacaaaaagtaatttttgagcatataaaaacaatttttgaatgctctaatgaaagctcatcaattgcttttacattgatggaccagggtggacaggaaatcgtttgttcagaccgctatttatcatatagccagaggttttttaaaaaa

SEQ ID NO: 73089 - DNA, 265 bp, Heterodera glycines
  Genomic contig location: Contig_ID=SeqID_1371; Location=421..685; Strand=-
  SCN-specific regions: Sequence locations=1-265
atgtcttcaatgaacgataatgtaccgttgcaagctgaaagaaatggaattcaaacggatagcgaagctgtgaatactgacaaggtccaacccaaaccaaacacccgcagcatgatcaaaaaaagtcgctggggcaataattgtgcaaaacctgtgcaaaaggatgctgaagaagcgccagctgtcaaaaagaggaaagtcgaagacaacgagctgtgggtactcgtgaagggaaagtatctattgggcttctacctgtgtgcgg

SEQ ID NO: 73090 - DNA, 866 bp, Heterodera glycines
  Genomic contig location: Contig_ID=SeqID_1371; Location=845..1710; Strand=+
  SCN-specific regions: Sequence locations=1-371,393-866
atggccattaacatgagcgacaaaaagggattagtcaaacaaatcctgggcgaagccgatcttaccattaccacctctggtattacagttagcgggccgaggctgtcaacgccacgttttattccctttgacgagagcggcaaatgccggtcatgtaaggcaaccgaggtggaggtcgacacgatggtgacaaaagagggcatcactatttggtgtacgcgcgtcgacaaagcgcagtttgtaccgtttgatgtgatctacgatctgccgggacattgcttttttcgagtgaagaacaagtcaagagtgttcaatgttccctacagtgagctaccctccgacacgtgtgcagacctaggggtttcaattgaagagaaggacttgaagagaaaagcaaaagtggctcttgatttggttgaggcaggaatggtgtcggacgcaatgcaggggggagcacgttggaagaaagcaaagactgcgatcgatgtgttaggtgatcttttgcttactgaaccactgagcgaacatcaaaagaacactccagattcatacctaatgagcctcaaagccgacaatcatcacaagtgaaagaagaaacaacttcagtttccgcttctgcagctgggagccctcaaacccacactgttgaagagatgaaggaacaaaatcaagaagatgttgaaaaaaagatgccgcctgcactcccggatcctccaactatgagtggcgaaaagaaggtggaccctaaaaaagaggatctcggagacattgataaaactcttgatgaattttttgagagtattaaggcagcaaccaccaatatgtaatgatatttaagtctttgcttttgtattcttttaaccaca

SEQ ID NO: 73091 - DNA, 1070 bp, Heterodera glycines
  Genomic contig location: Contig_ID=SeqID_1371; Location=3163..4232; Strand=+
  SCN-specific regions: Sequence locations=1-376,407-611,663-737,759 -779,863-1070
atggctgtttgtaaatgcaaagtgtgcgacgagtgccgtcgaaagcaacggctgcatgaaattagcgagcggaaaaaaattattgaaagctgcggtggggatcaccactatataaaaatgattgaattacggatgcgcgacttagagctatataaacgagcttataggcgaataaaatctgtgatcgaccaagtgctggaaggttggtaatataaggagggtgaaatttttaaaaaaatttagggccattccatgtaaaatgcacttcaaagtgccaagaagaatttacatattatttgattaaatgggaatgttgcactgaggattatggacggggagtgggctgcacatattcagaaattagtgatatagtaagaaaaaaaataataattaaaataatatttaactgttagagccaaaatgagttgttggcatattacgatcgggaacgggtggtcggcgagatcgatccgccgttggctgataacaatgcaccgttggcaatggctggaattatagccgagttgcgcggtggaaagttaccgcagggaaatttggctcaagatgatttgacccaaaatgaggacctaattgcggcgggggaggaggtgattataaaagaaatttttaaaaaataataaagttaaatagtaaattttaatggataaaaaaatcgaaatgttgtgttaattgtaggccgcagggcaagatgctccagttaaatagcgggcgcgacgcaaaaacaaaaagaggggcggtaagaaggtaaaaaatgggatagaagaggaggaggaagaagaagaagcagaagatgagggggaggaggaagaagaggcagaagaggagggggaggaggaagaagcaaatgacagtgtgcagggtagcagtatatggtccgggtcaattgactcggccattactgccttctccacaatgtcggccacgcagcgaaaaaaagtgctagggaggagccgacaatggtggcaagagcgcaaagagcgcaaaaaggctgaaaagggaagatgcgctaaaacagtaggagcagtggaaaatgataaattgaattttga

SEQ ID NO: 73092 - DNA, 933 bp, Heterodera glycines
  Genomic contig location: Contig_ID=SeqID_10035; Location=56..988; Strand=+
  SCN-specific regions: Sequence locations=1-106,131-232,254-310,482 -489,521-611,643-765,787-933
atgaaaaatttgctgcccgaacgggcagagagtgcgtgcccctcattaattagcgagttaagtagggctgttaatgagctgcagcgacactgggaagtgcatggaaccacttattttttaattaattaatgccagtggcatttttttggcatttttatttttttgcaaaaatttgtttttacgtaatttttaaaacaagttgagcacatttcagtgtcttgaagaagaattgtacacaaaatggacggacgaagaaattggcgaattcatttattcattgtgtatttaaaaatgggctaattagcgagtgatatttattttatattttattttaattagtattaaatgatatggattttgaaatttaatttattaaacataaattaatttaaacatattaacttatttaaatgttaactaaattaagaaatgattaaaatgtttgcattattgaataatataaaatctaaatattaataatcgcataaatggaaccaattaaattatttaaatctttactaaaagctattttaaaatgattgattattaacagggctgcaaaaaatattcaaatgaatattttttcctggcttctccatgctctaaatagtaagaaaaacactttcttttttgtgtttgcgtataaaagtcggaacttttatttgcatatttttgcatattttaagtttttatgcatatttaatgcatattttgccattttttgtacatattttcagattttttgcatattttgccatttttcgtcaaatattttcagatttgaatatctcttaggaaaaatttttgaaaatacctaaaattaaatcaaaatctgaattgatgcgcgagtggttaacagtgagtttcactgccgaaaacccttgagaaattttgatttgaaattgcaaaaacaagcgatataatttatgagga

SEQ ID NO: 73093 - DNA, 217 bp, Heterodera glycines
  Genomic contig location: Contig_ID=SeqID_10035; Location=1211..1427; Strand=+
  SCN-specific regions: Sequence locations=1-13,37-217
atggtgcgtctaacgccaacaatagtttttgttttggcattgtgttgtgcctggcttttaaccgatgcccaaaactacggagcgatgattgcaaaatcgcaaaacaagcgggagacggaccaggaggagacgagtgcaacaacagaagcaacgacgaaggaaacagaagtgacagttggcgagcagcaggacgaagtcattaattaatatatgctaa

SEQ ID NO: 73094 - DNA, 1874 bp, Heterodera glycines
  Genomic contig location: Contig_ID=SeqID_10036; Location=338..2211; Strand=+
  SCN-specific regions: Sequence locations=1-89,111-164,186-299,330 -466,497-642,678-1027,1079-1197,1243-1289,1311-1368,1391-1594,1616 -1712,1757-1775,1798-1835,1857-1874
atgacacaaaattgtccatttttggctaatccattattcaatcaatcgtaaagccatcatccaaaggacattttgttgagaattttgtgctctttcatgagggtttaaataatttttacgaaaattttttccaacccccataagaattttattttctgaaattttcccggtttcaagtaattttctggttttcaaatcaccatgaaggaatgatctgaccaaattagtaaaagaatttttttttgattagcttccaaaaaataggctcacttgaattatctcagatttttggggcggctttttctccaatcttgtggttttttgaaagtgaacatatcattttaaatcttattcttttggcattctgcttggcttgcacaatttcaaacaaaatttgtccggtagaactgtttaatgcccaaattcaagggtgaacggtatcattttgtgtcatactgtacctttgaattatttatataattaaaaaaaataatttccatttaagcatgccgcgttgaaagccttgaaggcgagcaaacagtacgacacactcgcgatcatccacaaaaatgtggacgggtcgggcgccgcacattcggggcccgcctttttgccgtggcacagggaatatttgaaaaggtgaaaattaaaaaatataatgtatttaattaaaattagaatcacaaataattatttccccgaagaaacatggctgagaaatttcgtaaatccgccaaaatcgctttttttagcaaattgtcatataccttttcttagatttactaaatcacaaccttcatggaattatttgatagacctaacttttctcaatagtccgaaattttcaaaaactgaccaaaaacttaaaaaaatgatttttctttttccttaggtaattaattagattgtgtttttattttaaatatttttgtggacaaattacctaacttgtttacaagaaaatattgtgttcaactgatttaatagaaaatataattacaaactattaaatgtagcaattaaatccaattaaattaatattagcaataaaaaattaatattaaaaaaaaaattaaaaggtacgaaatcgcactgcgacaaattgacccaaccgtcgcattgccttattgggactcgtcgctggaaggccatttgccgacgccggcggattccattctgttcactgaaaatgtaaagaatttaattagaaatttaaaatttaatagtatttaaatttaattacagccgaaaaaagtcaataaaatataaatgttttaagtttgctggtgaaaacaacaaaaaaggcgaaattgtgagcggcgactttgtcaactggagaacctttgacgtaattaacccctagtgaatttaattaattaatcaattaatgcattaactttttttaaaagtaccaattttacaaattttccgagaaaaactgatcataacatctcttagacacaacaaaattaaataatcttggcttcatacgatagttagtgggttgctctattaactaaaaattttcaggaaattttattcaatttttaaaaaaaccatggcaattttttcaatcttttcgctaacaacattctggaaactgtctgaaattttctggaatttatttggctaatagagcaaaccaagagctaattttccaagaaaaatctgaagaaaattggcacttttacgaaacgaccgagcaccactttttaattaattaattaattaattaattaattaattaattaattaagatttatcacatttcagggaacccgaaacctgaagcgatttgtgggtgaaatgggcactttgcccaccgacgaagggtaattaaggggcaattaatttttaacctttcttgtattcaa

SEQ ID NO: 73095 - DNA, 3435 bp, Heterodera glycines
  Genomic contig location: Contig_ID=SeqID_10037; Location=1..3435; Strand=+
  SCN-specific regions: Sequence locations=1-270,359-468,648-760,797 -966,1011-1107,1154-1161,1183-1221,1244-1360,1382-1501,1525-1890,1954- 2078,2164-2282,2318-2401,2521-2558,2580-2690,2761-3073,3194-3267,3298- 3302,3345-3389
gtcgaatttactcactgtcgaaatggtccagtgtcgaaaatgctggaaaacagtgagagtttttgaaatagttcagtgtcgaaatttctctatgtcgaaaacgtagtgtcgaaattacttagtgtcgaaaatactcagtgtcgaattagcgatgggtttgaggaaaacgggtgttacataaataaataaattaacccaattttttctttttattcagcaatgcgcaagtccccagcatttctctgccggaccaatgcatccgttccaggcattttttatatttaattttttatagaaaaaacgattattatttattttaaaattttaatcataaaactttaattaaaatattttttttcaatttagccttggcagaacattgacggattggtgaacaaatacacggacaacatgtacgaatttgcgccccgtccgagctgctcaatgggcccggactgtggatcgaagtaaaaatatttgaaaacataaaaatttattaaattaacaaatattattaaaattttgataaataataattttaatatttaaataaaataacaaatttaatatttaattaacaactatttttaaaatttgatagaataataaaatgaatatttaaattaacaaatattattaaaaattttcactatttttaggtatttgttctgcgaccgttcccatggcaagccccgatgtgcggccaaagtccgaccgaatggcaattgtgccggattcactaatggcacgaaaaatttgcatttaaaattttatttataatttaaattataaaaatgatgtttaattcaggtgaagatgtttgtctgaatggcgaatgccaatatgggaaatgtgtgaaaaaggtagcaaaaattaatcagacaaagtcacagcggtgaataagggctctgaaaattgcggcatttttgatggaaaaatcgcgaaaatctcctgaattttaatcgcaaaaattttagttttgtttttaaattttataaaaaatatttattcaattcttagggttgcgacaaacttcgtattgtgtaaaaatttcttttttttcaatccaaagcaaaacaaattatcgaaaatttcccctacacacgcaaaaaaattaaatcaaagaaaaatgttttaaaaaaaaaatttttttggaaaaactccctggtttgggttcttaattttagaattttttgagcctaaaaaccggcccggcaccggcaaaaccaaaacaacaaaaaccgacaataattaaattattttcagtccccaccgccaaccacgccaaaaccaccgccaattgtgacagtgtcacccattgaggtaggtggtcaaaaaaaaacccagagttattatgaagaatatatattccatacatagtctggcttttatttaaccaaccactaattacggaaaatccctaattatctccataattacaaccataatccgtcattatcatagcaccaagatgtgtacagcaaaaaatttgctggcggagatatatttttttaattttttaatccgtcccttccaaaatagaaaaatcccagaagaaattacacacatgtgtgctttgattttttggttttattttacagtaatacaattttcattttttgttaattttttaaacttttaattccctaattatttaatacgctaattaagtcgccctgctttaatgagcacgaatgttgcgcgaaatgggcagccgacggacagtgcgaatcgaacagcgaatacatgagccaattttgcaaagccagctgcaaaaaagtaaataaatgttgttcaattagtttttaattgatttttaattatgcttaattaaatgtaaattttaacattaattctttagtgccaatattcgtacaacatgcaagagggtaaaaattcaataatgataaacaatattaattttatttattattttatattgaaaaatttaaacccatcatttttatgcttaatttgatatgccagcagttcatattgttcagaatgtgctgatcgtcataaaaattgcaaagctttgtcctaccaaatgaaatgcgattcaagctggatggtatccgttttaatcaatttaaattttatgaatttttatttaatttataaactaattattaaaaaaatataaataatttttataaaattattccgtgtaattgcattttaaggctgaaaactgtcgaaaatattgcaacaaatgcatgtaaaacgtatgcaaacatgcgctggcggttccccggggggagaaaaacgtaaaaaaaattcggaaattaattttattaatttttattaaaatatattagccacgctttcatatggcggcaacaatggtggctgtaaatcaaaccaatgctacaacgaaaatatttgttgtcaggtgaaaaagaaaaataaaatttctaaaaataaaattttttgatttttttaaatttagaacttttaaatacaaaaaataataattggttattgtacttatcaaaaaatatttaattacaaatttataatcctttatttttatgggtggaattaattgtgcaattaattggggtaattaataataaaattattgtacagcactgggcaatgaacggtggatgtaagaagaattcggaatggatgaactgcaactgtaaagtgagctgtggccaatgcatcccacgaaactacaaatacggaagtaagtaattaatatatgaattaattataattacctagttcattaattatttattatttatttaattatgcataataattaaatgtgtatgtgcacggttaacttttcatcacttattcattaattatacatatatattcgaatccacaaattaattatgtaattcggttaattaagcgaatcctcaaatatgaaattttcagaattattaactaattgactaattagcaattattggcaatttgtttttagcgtgctccgactatcacccgaaatgcttcaaatgggcaaagcatggtcaatgcaaatccaacggatgggtgttggcgaactgtcgccgcagttgcaactcatgcgcaagcatttggcacatcaaaaaggtatttaaatatattttttaaaattttaattgattaaaagtttatattctggcagaaattcagtttttttaataatttaatataaatttaattatctttattaatgtttaataaatttaaagatgtgtgccgatgggagggggaagcgcagtgttgatgaccatcacttatgggcagacgcaatggaagagacggtaattaattaattaattaattacttaattaggccgaataaaaatgaaaattatgattctaaaatatttaaaaaatttcttttccattctcattagccaatttctctgttgcgcatggcgcgcgaggcggagaaggagcagaaggaagagaaaaaggaggaaaagaaag

SEQ ID NO: 73096 - DNA, 1125 bp, Heterodera glycines
  Genomic contig location: Contig_ID=SeqID_10038; Location=57..1181; Strand=-
  SCN-specific regions: Sequence locations=1-121,170-595,624-633,655 -1125
atggccgcaactccaagtcgaaaaggcgagcctgagcatatgcaaagaaaacattgcgcagttttgaaatggaaacttgtaaataaagagcgacaaggttagggatattgtactttttggctaattaaaaattaaataatattttacatatttaatttacaaaataattcatcggcgtaaagcactgccagtattgtcttcgttcaattcactcaaatcatctacgtaatgaagctcaacatcaccttgaatgctgctgcttcaacatcggggatgttgtaaattaatttttttgaatgattactagagcacgactaaaaaggcaacaaaacaccaaaaatctcgaaaaaggcactataatagggaccaaaaaattgaaaaaagtaaaggcacgaaaatcccgaaaaagaaataaaaattagtttttagtttctaaaaaacccccaaaatagttgctaataactcgaaaagtagtttaacaacagccgaaaaaacacgtttttcgtgtgtttcaggccacgtggagcacaggaaaaaaatagtgaaaaacctataaatcgtatccctagtcataacaaatcaaaaactgatgaacaaaaaatttaaattgttaaataatttatggcaatgaaaaaataatataaacaaaatgaggaaaatattcgaaaaaagaatagcaacaaaatttatacagaatttaaattatgcagaaatttgcaagaaaattggagtatgccaatgagtaatttacaatggaagaagcattcaacgggtgaccaaatccggaagtaccggtaaatcaactcggggcggtaattggtaagtcatttactatatggatgtgtcggcatgccgatttaaagtgactgatgtttttggccacaaaaatcttaaattgtgaatattattcactcccgtagtcattttgccgttcaaaaagcatcagtcataataactgtggatgccctgccgcaaaaacatgttcatgacgatgcccaggatgaacaaaaaattgaaattgttcaaaaatttaatgcaatgaaaaatgaatataagcaaaaaggaagaaaatattcgacaaaagaatggagtcaaaattatgaagaaatttgtaagaaaattgga

SEQ ID NO: 73097 - DNA, 687 bp, Heterodera glycines
  Genomic contig location: Contig_ID=SeqID_10038; Location=3212..3898; Strand=-
  SCN-specific regions: Sequence locations=1-6,44-109,248-687
atgaaattattcctatttttctttttaattgtatttttaatttgtcaaattgaaattgcagcggaaaagaaaaaattggagcaaaaaacatttgaagaaatatttggagaaaaatgggaagaaaaagaaaaagaaaatgaacagaaaaaaagagaaattgttcaaaaatactatcagattaaagaaaggatcaaacaaaaaggaagaaaatattcaacaaaagaatggaataaaattgaatggaaaatagcgaaaaaattgggcacaaatcgaaagaaaatttaccaatggatcaaagaattgggattatacaaataccaaagcaaattgaaaacggatgaacaaaaaattgaaattgtgcaaaaatttaatgcaatgaaaaatgaatataaacaaaaaggaagaaaatattcgaaaaaagaatggaagagaaattatgccgtaattgggaagaaaattggagttggccatgatttaattaaaaaatggaagaaacaatttggaatgaatgaaagaataaatgagaaagaaaaaatggagaaaatgaaaatgtattggcaaatgaaaggagaaaacccaaaaatgagtgacgagaaaattgcaaaaatattgaaaattaatcgacggaccattgacaaatggaagaaacgctttggggaagaataaatgaggattggatacattaaa

SEQ ID NO: 73098 - DNA, 454 bp, Heterodera glycines
  Genomic contig location: Contig_ID=SeqID_10039; Location=411..864; Strand=-
  SCN-specific regions: Sequence locations=1-154,177-427
atgtggaattgctccggtaaaccggtaccgggtcgggtacccggtaaaaccgggtattaaaaaaacccaaaatcttttttaattttttttgcatgaaaataaaagtttaatcttttaaaaaagcataaaaaatataatatttcacaaataaacgctttattaattgcccaatttttattgttatttaagccacttttttttgcggtgcgctttttccaaaaaacttttcgagagcaggggcgatccggtggtgccgataggcgccgcctggaaaaaaattttgagaatttacttctgatttgttgacatattttattcaaaatgaccaaattttttgattttagctaatatgtttacagaatttgaaccaaaaatgttatcaagaaatacatggttaaattcttctaaatttcttacggggctattgtaaaaatataatattttttaaaataaa

SEQ ID NO: 73099 - DNA, 1423 bp, Heterodera glycines
  Genomic contig location: Contig_ID=SeqID_10040; Location=620..2042; Strand=+
  SCN-specific regions: Sequence locations=1-53,75-243,325-408,467 -654,676-685,707-1098,1136-1223,1247-1387,1409-1423
atgaaatttggtgggtggatagagcacccatgggttcttaagaaaagtgtttttattttctgctaaatgagcatgagtgccgagttatgacgtgccaaagtttttggatttttccaattaaataaaagaaataattgtttctctccgttaaaagtgtataatgatgtaaaggtagtgcgttagtcaaaattttttgggtcccaggttcgaatcctctacatgcaaatccattttagacttttatttttgttattttatgcaaaatcaattataaaaagaatttttaatgaaacaaaaactttaattttatttaattttaaaattcattaaagataatggtgcaataaatagcctttcagttaaaaataaattaatttttgtcaaaactttatgagtaacttatttgtcaaaattaataaaaaaaaaaaagaattttatgtcatattttatgataataataataattgattttggcataaaaagcaaaactaaaaatttaaaaatgaatttgcgtgtaggggatacgaacctggggttcagggaacgctgtctagagcactaccgctgcgccgctggacattgtaaagccatgcaaggaattatttattttgtttattcattaaaaaaactttggcacgtcataactcggcactcatgctcatttagcagaaaataaaaacacttttcttaagaacccatgggtgttctatccacccaccaaatttcattcggaaatcccacggacacccttaaggccacatttttgtaagtttcctagataagattctcgaatcgcgtgggaaagtcctgttaactaaagccgggtgtatttaaacaattagataaatttggtggctttacaataacgccctttttgtaaattagccaaaagcggtattgggaggggagtgcccctcctgtgaccgaagatggcactccctaatgatgtttgagagctttggtcaagcatttttgggtctcaaaaaatactaaaatcccacatttttcttgaacttttcagccttttcactgccgtcggtgacattttgctccacttttttgcggcgcttttattgcagaatgacaaacaaatttagcaaattaaaaaaaaattatttttctttctaaaaattaagcatttttagtcactataattgctatcgccaaagaatggcactttccaagcgcattaaggaagagaaaaataatttatgcgtcgatggacaaccaaaacaccaaaaccaacgaaaatgaacgagtgaatggagtcgataaaaagagacgcgcaaatggacaaatggaggaattgtggagaaaaaggcacaaaaaaaagatagtaaaagatggcactgaatggatgacacaaccgaaacatgatgggattgtttgtcaaaaatgaagacaaaagttgaaattgaaagaa

SEQ ID NO: 73100 - DNA, 526 bp, Heterodera glycines
  Genomic contig location: Contig_ID=SeqID_10040; Location=3642..4167; Strand=+
  SCN-specific regions: Sequence locations=1-317,339-526
atggctaaaagaactttattacggaagcgacagaccaaaaatgcacgccatacgcgtgagaacaagcgggaggagagaaaagcgcagacgcagagggcgagacaaggccgatgggccaagaaaagtgagttttttcatcaattttatctcaaaaaaatcatttttttgtattccagccgctacacaaccaaatcccaatgccgaaatagcactgcaggacgaagcagggccgtcaacatctgctgcatcaacagaagaagcgatggagcctccgccaccaactccaggaccagtgccaacgccggagatggacgaggaaattttggaatttggcttttcgctgccatcgacatctgtcacaccaatcggcgatttggtgccgttttcgacaacaccaactgcgccaatggacaccggagagacgaccccgccaccgctggccattgacgagcgatcagagcgcatcgaacaactggagaagcagctcaaggaccgggacgacaccatcaaatttctccgcgagcag

SEQ ID NO: 73101 - DNA, 504 bp, Heterodera glycines
  Genomic contig location: Contig_ID=SeqID_10041; Location=497..1000; Strand=+
  SCN-specific regions: Sequence locations=1-150,189-504
atgttcacctcgtttatcgactcaaaaattctgtcagcccaaaatccgcgcacaaaaacaataaatgtacaaatatttgatgagaaaattgccgctttgtcgtcaacagaaagccaaaaagaaaaaacaatggaagccaaaaattgtcagaaaaattgttttaaaaatttataaattttacaaattttcagccctaaggctggcaaaattggagtttccgaggccaaggcctggcagttcgtcggttcagccacgaaaatatggtggctttcttccaattccggcacaatctgtgctcgagccaccggccccagctgttgtgccaaacaacagaaatttcttggcaaataatgccggcacaaaaaatgaacaacagagacagggcgatgaggaaatggtggaggaaccatttaatgacgaggcatggccaaccaaaccacctgttaatgaatgataaacagattaaatgattatttaaaatttaaggaaaatctgaaatctgaa

SEQ ID NO: 73102 - DNA, 2063 bp, Heterodera glycines
  Genomic contig location: Contig_ID=SeqID_10042; Location=154..2216; Strand=+
  SCN-specific regions: Sequence locations=1-69,151-328,374-382,404 -783,807-807,830-1078,1100-2031,2053-2063
atgggcaatgaagcagtgcatttgggacatgggcacctccacctgggcatttcgggtgttgaagaagtgaatttttaaaaattttcataatattttattattactttagtaattaccttaatatattaataattatataattattatattccgattaattcattgtcagaatacattggtggcttcattttgtgatctgttggagcgaatttggtctcatggattgaagaaaaagcaggtcatcctaatttttttaaatctgccaatcaaacaaaaaaaaatcttttttcgaattcgaaaattatttggttcttttcgagagttcctgtttaaaaaacaaataattcaaaataatattatttcatatattaaacagttgtttaatgaacaaatttttatatttgtcagaagcacaaaagcttgaaaaatttaagcaatttcagagggctaaaaatccaaaaaatttccaaatttcagggaaaatcggccctgtggaattacattatcgcctaccatgaatgggagaagaaaagtaacagggaagcgagccgtaaagccagctttacagctggtgggacgaacggtgaatcacagtcaggtacagtaattgggcagccatctttaccactatcatactctaattaccgtaataaaatttaatctttggtaaaataccaaatggtctaattttaattaagaatctgtcctttggattgtttttcggagacgtataaaacgtaagggaaaatttggaatataccttcaagcaaatgcttttgtcgcatgagaaattccatttatttaaaatgcatttcagtcccgctttttcagtattattcttgtgaaattacagtatcttaaaccttgactcgtgtactggatggagtactgtattattttttccctagtcaaatgcctgaaaatttttcgagagaactcttttctgcttttttttaagtggtggtttattaatttgtgttttggcattatactgtaaatatatattatacaattttgtaattgttttcgttggtggtttgtccattttttgttgcaatttgtcacactgtacacaggtgaggaggaggatgaggacaaagtgtcgacaaccgttggaacagaatcggacgacaatggcacgcccaaggcggcattggtcgatctgataagttccatcagacggatggcgtccgcgggaggtgcagatgatggcgacgaagcgtcattgtcatcggcggcgagttctggtacagtcgcggcgacgacgccaacagtgccggactggtctcagtcgctgttaagagcggctaatgtgatttgcgagcgcatatccggtgccggaggatccgctagcagttccggcggcgacattggcggtgctagcgatagcataggcgactacagtaaaaagtcggcgacacttccgccacgcccgccaccgcctcggccaagcggcagcagcaggtcacgtcaggcggcgacagaagcggaaccgcatcctcaactgcaacagcagcagagaaggagcagaacgccaacgccaaattcaaaaaagaatgcgcaagtgccggcaaaagcgagcgcaaccgcgaccgggacggcagcgattgtggtggaaaagagtgcgcaaaaagaggagacgcgggaaaagaacacagagacaagcggcggcggcgacggaacgccatcaacctatcgaaaattcatttacaagggcccgccgttgaaggagatgaacaacaacaacaatggccggagatcagtgagcagtcagcggagaacggcagcgacttctgcacatggtggcggccttttgacaaatctgatcaccggtactgtgtgtctcttatcccgattagttaaaggaattattgtatggatcagacagtggtgctatatatatgtcgtacagtatgccgttctgactttgatcaatttaagagcattataatctgataactggtataatactcgtcactaattagttgaggccttatgtatttattttgtacagtatgctattagtgtaaaattttagtgtactatataataatttatgagga

SEQ ID NO: 73103 - DNA, 1274 bp, Heterodera glycines
  Genomic contig location: Contig_ID=SeqID_10043; Location=1969..3242; Strand=+
  SCN-specific regions: Sequence locations=1-224,246-275,301-317,340 -514,536-617,664-1031,1053-1274
atggcgaaatgccatgcatttgtcacatccgtcattcaatccaatccatttgatgacctgggagtaagcctatataacaacaaacaataagcagcatagtcgaggattaaatttttgacgaagtaacgattttttgcttttgttttttggtggattcattcggtgatcagagagagagagaacaacgcatattcacagagttagcagagaaacaaaaaaaaaggaggaaagagtgtgaggaaaagggagaatggtagagaacaagagaaattctgtttaattaaaattattaaaaaaaaacaaacacaaattttacagaaattaacaaacaaacaacgagtcagtggaaggacaagcgtattaacaagtggtaaagcccggggaacggacatagaacagaagcagcaattccttccttgtgggacaccgtgccaattaggcacgagaggaggcggtaattgtgctgttcatatgtgaattggttggacaaatttacactgggcacaagagagggaccaatgggagaaagggataacaaacggtggcaaaacaaaatgtgatcgaattcggccgaaatatcgcgctagccttatcaagcggttcaagttaataatgtcaacaaaaacaaacaaaaaagaaaaaacaaaaaggagtaaaaacaaatggttgaacattcgcaaaacaaaagacgacggccgacgctctgtgcccattcctagtcgattctgatcagaactacccgatttgctggtatttgtacagatacagacggtaatccttgctgcaggggagggaatgtcggacaataaaatgcttaaattgggacgacaaaagaacggaccttgccaacacaaccgaatcgtcgatcaacgccacgtcgtaacattgcgcgtgcttcaccttcgactcaaaggcactcagcagagtgccgtcctggcggggaaagggaacggttaatcaattggttgttgctttcgagggactacctgactgaagacggtcaagttgaaattgttatgattatccgcctgaatttaaaagagcaaataaaatcgaactgctgcccgtggtgtacagaccaccacaatctcgccaagttggttgatgccgaccccaatcggataattagtcaccccctcgccaccgatctgacgcaaaaattggccctcgtaattgaacaccttaacaaatacatcaacaattatattcatccattgaagcgccaacaaaagtgcactgactttgatggaatgtgcccggttgtcactgattag

SEQ ID NO: 73104 - DNA, 383 bp, Heterodera glycines
  Genomic contig location: Contig_ID=SeqID_10043; Location=1052..1434; Strand=+
  SCN-specific regions: Sequence locations=1-269,312-321,350-358,381-383
cttttgagtttggatacagtatcaacaattgaatgttaagaatttgctgttttttagatttccaaattccgaggaattaaatgtccagtccgagcgattcaaagttcgcctgctcaaccaataaaagttcgtttgggattcctcccgccgccgttcgttcctttctgtttgcttctgtactccgccccttcgcttccatccttatatactgttaccatttgccctccccattctattaccgtgtccccacacatatccaccgtatcccttttttgtgcctttctcccatttctttcatccattttctcaaaagttatttagtattactattatttttattgtcctttatccagtaaatttcaacaaaatttcattcttagttc

SEQ ID NO: 73105 - DNA, 1422 bp, Heterodera glycines
  Genomic contig location: Contig_ID=SeqID_10043; Location=2667..4088; Strand=-
  SCN-specific regions: Sequence locations=1-1068,1090-1422
  Gene Ontology: Biological process=oogenesis
gcggaagtgatggattggctgcttcgattccgatgctccccccgccgcggtcccaaataaaggtcactctcactcgttctttcatttcaccggaatagaattggcactttcagcgccaaaagatgacttaccattgtaaattcggtgaatttggggtcatcgaaggccaattcaccgaacccagcggagtggcggtgaatgcgcagtgcgacattattgtcgcggacacgaacaaccaccgaattcaggtgaaaactgtgcaattttccgttttaggttgtttattaaaggtgttcgatcgcgagggccgcttcaaattccaattcggcgaatgtggcaaacgcggtaaattaatgggaaattgtgtcaaaatccgaacattgtttctctttcagatggccaactcctctacccaaaccgcgtttctgtcaatcgcgtcaccggcgattttgtcgtcactgagcgctccccgacgcaccaaattcaaatttagtcagtccttcacaaaatgccatgatgctctttctcatttttggttttatccaaccgtttaactttttctcttccaacagcaaccaatacggccaattcattcgcaaattcggcgcttccatcctgcaacacccgcgcggcgtctgtgtggacagtcagggccgaattgtggtggtggagtgcaaagtgatgcgcgtgctcatcttcgacatgttcggcaacattctgcacaaattcagctgttcacgtacttttacaattagcaatcgcaaataccccatttaatttgcttttcgtcgtttaggctatttggagtttcccaacggcgtttgcaccaccgacaaagaagaaattctaatcagtgacaaccgggcacattccatcaaagtcagtgcacttttgttggcgcttcaatggatgaatataattgttgatgtatttgttaaggtgttcaattacgagggccaatttttgcgtcagatcggtggcgagggggtgactaattatccgattggggtcggcatcaaccaacttggcgagattgtggtggtctgtacaccacgggcagcagttcgattttatttgctcttttaaattcaggcggataatcataacaatttcaacttgaccgtcttcagtcaggtagtccctcgaaagcaacaaccaattgattaaccgttccctttccccgccaggacggcactctgctgagtgcctttgagtcgaaggtgaagcacgcgcaatgttacgacgtggcgttgatcgacgattcggttgtgttggcaaggtccgttcttttgtcgtcccaatttaagcattttattgtccgacattccctcccctgcagcaaggattaccgtctgtatctgtacaaataccagcaaatcgggtagttctgatcagaatcgactaggaatgggcacagagcgt

SEQ ID NO: 73106 - DNA, 59 bp, Heterodera glycines
  Genomic contig location: Contig_ID=SeqID_10044; Location=425..483; Strand=-
  SCN-specific regions: Sequence locations=1-11,40-59
cacttcttcaaccaccgcctccaccaccgccgccgatgccttcgttgtcgtcagtgcag

SEQ ID NO: 73107 - DNA, 1327 bp, Heterodera glycines
  Genomic contig location: Contig_ID=SeqID_10045; Location=866..2192; Strand=-
  SCN-specific regions: Sequence locations=1-68,122-493,517-726,749 -896,919-1327
atggcatcatttgtcatcaatcccggtggtcccggcggttatgtcattccaaagcgtcgaaatgcaacggaggaggaaaagaagaaagaaagacatggggcggcggcggcgacggcggaagatgacgccaaatgtgagtgcgcattaatttttgaatttatgctcaccggatttcattgctggtgttatgtttttgcattactgtagtatactgtaccatttatcccaacaaactaaagagacaaccttatagaaagttgcattgctaagtgtaattatgcagttagagagtcgattattttttatgtgttatgctgttctttatagaaatgcattttagaatttactaaattttaccgtttagtattgcttattaagcgattaaaatagcggtgaatgaaacaaaatttatttgattgggttcatcattatgagttttgcctcccaaagtttgcccatatggaaatgattccaatttcatccaagcctaattacatattgtcaattgttaatgtatgcgattgccctctctaggagtaaggattaattttatgattgtggaaattgagacaatgttgatgttgagttttggattagatacccactacatattttggttggtctcagtcatagtcaaaaaaggaagatttatatcttaagattagctaattttctgaaaaataaactgcaaaagcgaagctcataggttcgaacatttggggaaatttcaagggaatctaaaaaatttttctacgagtttacagaaatgtagtgcttaatttcatatatatgtacaatttggaaaatcttgataatttggtgtcatttaatcgaatttaatttctccgttttgcttctcaaatccccccaccctaaccattcccaatgtaattacctaattattttattttcatttatcaacaattatgctcattcaatgctttagtgtaaagttttttgaattatatcatttccattcctatatcctcacgcttaatagggtttcttaattgttgctcttttttggttacatagcattaagttggtatcttaagctgcttcctcatctcgtgctgttgttgacaacaaaaaggattcgaccgcaagcagaggcaccgccgttcctcccatccgtaatccgctcaacgtgtggaccggctcgcttagatttgaagaccaaactgttgaaagtgttgatctgtactcgccgttccgtgacagtgccaaaccaaatggattgtatgttttttgcattgaatttttctttttttgttggcaaagtgccttctggcgtaatataaaaaatagaattggctactttaaatag

SEQ ID NO: 73108 - DNA, 2333 bp, Heterodera glycines
  misc_feature (2152)..(2152): n is a, c, g, or t
  misc_feature (2304)..(2304): n is a, c, g, or t
  Genomic contig location: Contig_ID=SeqID_10046; Location=74..2406; Strand=-
  SCN-specific regions: Sequence locations=1-35,57-255,278-430,456 -615,638-757,781-1195,1226-1291,1313-1405,1448-1593,1615-2333
atgtccgaaacacacccattttcggaccaattaactcaacatttcccaaaccaggagaagttggacgacaaagccaatctcaacttggcggagggaagcgatcggcgaattggggagaagttggacaacgaagccaatctcaacttggcggagcgaagcgagcgacgaatttggcacaaggcagtcaacgagggccacacggttggacgagttgagcgagtgcaaacgagaacgaaagaagaatggcgaaaatggagggagaagaaagtgaggaggacatgaggaggaagttgcgaatggggaggacttgccaatctgacaaatttttttatcacttaattcgatgatcagggacattcatttttttttctgcccaaattctcattttctttgcattaattatgctttaattttaaatgctttcaatcatttaaattgttaaattctatttctcatttcctctcctattatctccgacacatatctcttgcaaattgacggcggctcatccgccatatttaagccattcattctttcccatctcctcctctcacatcattcacttaaaaaattgtttttaatcgacaattccgccttttgcaattctcatcacatttttaaaattaaatttcttcattggaattttattgaaatttgtgttttgcaaccagcaaaccggaggttttctgagcaagttttccgccacacaaaactaaactgcttaatttcaaattgtggcggaaaaccggttccagcctaaattattttttaattaattttgtctaatcaaaatttcataattgttttcccctttttacaagtgaaaagtatctgacattggacaaattggaaattggacgcgttgaacaaattggaaattggaagcactaacaaattggaaattggacgagctgaacaaattggacattggacgcagtgaacaatttggacattggacgcactgaacatttggacatttgacgcaccgaattggacattggacgcatcggacaattgacgaatcgagaaccaattgagtgcactgtcttggtgcacgtctcagcgcgcaggccatccccatttactaagacgtgcctgccccagacaactggcgacctgttgtgcacaggcgggttcaatttttttcccaaggggaggtctgattaatctggtctcatccagaattaatcagttctttaatttctgttccttcctcctcctaaaaaaggcaatcaagttcatttcggactgaaaatttcgaagtctcatcttcgaaaagtcaaacatttaaattgcccaatttaaatttgtcaaaaaattatcggcatttcatttccaattcactttttttttgtccaatcccatttagtccaaattttcggaatctcatttccgagggtctaaatcttttttattttttgttgttttgtttttttgttttttgtttgtaacccaaattgtccaaaccatccgcacttggtaaaatcagagtcttttggttattgattaaattggagtttcagttccaaatttttaaattgttcggtcacagttcggttattgattattaaattggagtctcatctccgaactttcgaatttggtcattgatttgagcaatgacagcccccatccaggcattaattagggggtgtgccagcaaattgggagcattattgggtaccgaaattccacctgacctgggaataaatgccctaccgaatcaatgccaaagaaggctgtacaaattcagaaactttctgaatgacttagaaagggtggtacaaaagattgaagataatttgggtttggctaatgagtatattggcaaactgagtcgagacaatgcaatccgtaaagaaacggaaatgcaggaattaatgcaggagttacaaattaatgagaaacaaagggcagctgacgttctcattccaattttgagggacaaaattgaggcattagaagagaggttagacataactcacaacacggatggtgacactacctccggcattgtacccctctcaaggagcgtgccaatgcgtaaaaatttgccaaaaactgagcttaagagatttgatggtagtccatctcagtggataccattttgggattactttcgtacaataattcatgaggactctcatgtccncaaaattgataagttcagttatttagactcatgcattgaaggcaaagccagtgcaatcattcagggtattccaattagtgagagtgggtatgatgatgcaatagatttacttttaaagacctacggggagaccaaacgtctaattcgaacgnttaaccgggatttatgtcgctcccaatta

SEQ ID NO: 73109 - DNA, 822 bp, Heterodera glycines
  Genomic contig location: Contig_ID=SeqID_10046; Location=937..1758; Strand=+
  SCN-specific regions: Sequence locations=1-23,66-158,180-245,276 -690,714-822
atggtttggacaatttgggttacaaacaaaaaacaaaaaaacaaaacaacaaaaaataaaaaagatttagaccctcggaaatgagattccgaaaatttggactaaatgggattggacaaaaaaaaagtgaattggaaatgaaatgccgataattttttgacaaatttaaattgggcaatttaaatgtttgacttttcgaagatgagacttcgaaattttcagtccgaaatgaacttgattgccttttttaggaggaggaaggaacagaaattaaagaactgattaattctggatgagaccagattaatcagacctccccttgggaaaaaaattgaacccgcctgtgcacaacaggtcgccagttgtctggggcaggcacgtcttagtaaatggggatggcctgcgcgctgagacgtgcaccaagacagtgcactcaattggttctcgattcgtcaattgtccgatgcgtccaatgtccaattcggtgcgtcaaatgtccaaatgttcagtgcgtccaatgtccaaattgttcactgcgtccaatgtccaatttgttcagctcgtccaatttccaatttgttagtgcttccaatttccaatttgttcaacgcgtccaatttccaatttgtccaatgtcagatacttttcacttgtaaaaaggggaaaacaattatgaaattttgattagacaaaattaattaaaaaataatttaggctggaaccggttttccgccacaatttgaaattaagcagtttagttttgtgtggcggaaaacttgctcagaaaacctccggtttgctggttgcaaaacacaaatttca

SEQ ID NO: 73110 - DNA, 1644 bp, Heterodera glycines
  Genomic contig location: Contig_ID=SeqID_10046; Location=5062..6705; Strand=-
  SCN-specific regions: Sequence locations=1-55,83-142,200-583,615 -695,717-722,807-1181,1204-1527,1581-1644
atgcatggagaaacagttgatcagaaccaatatgatcaacaatttgatcatttggaagtgaaagaagagcagagtgaagaaatatccagaaattgtgatgaattgggcggccaattgccaatgccaacaaataatggacaaatttatgataatttttcaaaagcaattaataaaaagaaaagagaaattgttgaaaaatttcataaaattaaggagaaagttaagcaaatgggaaagaaatattcaaagaaagaatggcaaaaaattgaaagaaaaattgccacaaaattaggtgcaaataaaatgaaaatttacaaatggaagagcgaacttggaatgatgacgaacaaaaattattcagttgaagaaaaaagaataatgttaaagcaatttgatcaaatatatggcaaattaaaaatgaaattaaatggaaaattggaaggaaaaggaagaaaatgccaaaaaataatagcaaaacatttgggcacaaatatcagcagtattcaaagatggaagaaagaaataaaagttggaaaaatggtgaaaaatcaaaaaactgatgatgaaaaaagagaaattgttgaaaaatatttaaaagtaaaaattaaatttatgcaaaatggaaaacattcccagaaggaatggaaggcatttaatgcaaaaattaaacaaatgtttggtgtgagttattggacgattgaaaaattggccaagaaattaggaattaaacaaaataatttaaaaggtaaattcaattaaacttttatttttaaatttaaaataaatttttcaatttaaatatattacagagcgaaaaaggttcacaattgtcgaaaaaatggaaataatgaagcaatattaccttatgaaaaaggaaactccaaaattttccgatgtgaaaatcgccgaattgttgaacattgagctaatgtccttaataaaatacaaatccgaatttaaggaaaaagtggaaatgttttgaatacgacagaaggccaataaaaccaccacaatttttcgagatgaaatgaattgtttaattaaaattcaactctattttagaagaaaatgtgttttaattttatttctcaaaacataaataaatgccaaaattcaaagcgcaaaatggtatacagtataacattagataaatcgggatatacaataaaccatttgggtagttaaatttaaaataattaaaatggaaaatactgatttatttggtagtcagtttgagggtcgtgaaaaataaactttttgtagatggaattaaaattatcaatattggcatctaattaaggtttaaactcttaagttctcaattcttccttagtcattttgagagtttagcttgcttaccctaatgaattaaataatttttgagtaatttttcttctacaaattatgactaatttttatcgaaacatttgtagcaatttgtcgtgttcgtcgaaattgccaaaaaaaatacaactcttttttatcaattcccacatcctataagttcaatcctctattttaatatggattttttttattattattagttcttttaatttttaatttaattaataaaatttgcagaatccaaattttaatccggtggcgcctgtcggcagctcagaaagacctcatgattcttga

SEQ ID NO: 73111 - DNA, 1951 bp, Heterodera glycines
  Genomic contig location: Contig_ID=SeqID_10046; Location=2530..4480; Strand=-
  SCN-specific regions: Sequence locations=1-3,32-245,267-562,584 -835,857-940,1004-1144,1173-1230,1263-1569,1603-1740,1763-1951
atgaaaatattattaatatttttattattatgcgcattaatattcaaaaaagcaattaaccaaattgaggctggcaaaataatccaagaaaaaagttttgctgaaatatttggccaaagatgggacgacggagcagaagaaaacatctgtcaaaatgatcaaataatgcatggagaaattgctgatcagaataaccaatttggacaaaatgttcgacaatttgatcagatttttgatgaaaatgtggaagtgaaagaagaggagagtgaagaaatgtccacagattatgatgaattgggcgaccaattgccaatgccaacaaataatggacaaagttgtgataaattttcaaatgaaactaataaaaataaaagagaaactgtggaacaatttcataaaattaaggagaaagttaagcaaatgggaaagaaatattcaaagaaagaatgggtgaaaattgaaagaaaaattgcaaaaaaattgggaacaaatcaaacgaaaatttacaaatggaaaagagaatttggaatgatgaagaacaaaaattattcagttgaagaaaaaaggataatgttaaagcaatttgatcaaatatatgcaaaattaaaaatgaaattaaatggaaaattggagggaaaaagagaaaaatgcaaaaaaataatagcaaaacatttggacacaaatatcagaacaattttttattggaagaaacaattaaaaagtggaaaaatggtgaaaaagcaaaaaactgatgatgaaaaaagagaaattgttgaaaaatattttaaaataaagaaagaatttatgcaaattggaaaacattcacgcaaagaatggaaagaatttagagcaaaaattaaacaaaagtttggtgtgatttttcagacaattgaaaaatgggacaagaaaattggcttaaatcaaattctttcaaagggtgaaatttttaaacaaattgttatttattaattaaatttaaaaatttttattatttaatatattacagggcagaagcattatacatttgcggaaaaaacggaaaaaataaaacttatcaattgaaaaaccaaaacccaaagctcaacgatcgccaaattgcggaaattttaaatattacaaaaagatctttagaaagatataaatctgaattcaagagaaaaagtgaaggtgtcgcggattgactgagaatatttttaagctttcagggccattcattgttaggttttgatgaatttaaatttcttaaaaatttatatattattcggcatttcattcattttccaatttgttgcttatgtaagagttaaaagtattatgcataatgtttgaaggttgttttttttgttctattttttgttgtaattgccagggaatggatttatatgtgccaaaaaagctccaaaatatgtgctaaaaagctcaaaaaaggccaacatatgtgccaaaaattgaaaaaaaaactgtcaaaaaataagtgaatttatcaaaaaaatcacattttttatccatttcgctagtacaattctaatcaaaaacatttcaattctttgtgacgtaaatatttttctcgcttcaaatatttatttatttttctgttttcattgataaaatttaaattttgccttaaaaatgaaaaaagtcattaaaacggtcaaaaagtgcaaaaagagaaaaaactaaaatttttgaaaatttttgtacattttgacaagaatttgagtgcaaaaaaagctacttttgtaaaaaaaattaaaaaaaaaatccccagaatatgtgctaaaaactactgaaaaccaaaatatggtttcattttaatgaatatgcttgatgccattttcaaaaaagccgaaagacagccatattaatttataaattgaaacccactcgtaataattaagttaattttaaacaaaaaaatgaaaactgaaaattttcaaacaaaaaaaataaa

SEQ ID NO: 73112 - DNA, 329 bp, Heterodera glycines
  Genomic contig location: Contig_ID=SeqID_10047; Location=370..698; Strand=-
  SCN-specific regions: Sequence locations=1-65,88-265,291-329
atgtcgaaattggacggaaacccatttgctgacccttttaaggtacgatcatttaaatacctttctgttagtggttattttatttttctgtttttacaaatcatttttccctcaggacccggctgttcagcgtgtggtttcgccggctgcatcagtcggaaacaattcaacgagtcaatcggtcatcgaggagtacaacccattcgcaccaagtgcttccgctggccaagttagtgcatgtttttaaaccgccgtgtttaattccattttaatttttatttataaattaaccgagaatttgtggcttttattaaacacttaaaaataaa

SEQ ID NO: 73113 - DNA, 255 bp, Heterodera glycines
  Genomic contig location: Contig_ID=SeqID_10050; Location=1027..1281; Strand=-
  SCN-specific regions: Sequence locations=1-255
atgagcgaaaaaagtccgaacggaagcggcgaattgcgattagaggacaacattttgagaccggatgaaaagaatgtgttcactgaagcattgcgaatttacgaaagtgttggagagcaattgaaagagaaagggcagcggaggaagggattggtcgaattcgaagcggacaaatgttatgtgatcgaatgggagtaccgaattgagaggacaggtcttacaaattggggtggtaaaagaccgtcaatggtttag

SEQ ID NO: 73114 - DNA, 620 bp, Heterodera glycines
  Genomic contig location: Contig_ID=SeqID_10050; Location=349..968; Strand=-
  SCN-specific regions: Sequence locations=1-620
atgctttttctattggctgggcccgcgttcgacccccgcggagcaaagccgttgtgcgttggcactgcgcgagaaggacaccgaactgtgcgagcacattcgagtggaagcgggcaaagaagcgccgatgcttttgcacattttggacggattgatcgtttggggttagccatcgctcggccaaagaccgtccaatcacgcggaaaatcggcgcaatttgtttaggcaccggctcaaacgtcctttgcgtgatcggaagctccggcaactgctacttggcacaggaaatgcgcttccctgtcaaattccgttctcagggcatttacgtgcgaatttgcgatgggtccattgaatgtttgaggggcgaacaatgccccgacgcacttttggaaagttcgaaagcattggccaagaaaatagccgaggcggagggactgaaatggaccggagaagtggcacatttgggggaagacattgcgaagccgagggaatggacaaaggcaccgaaaatgtttcgtttccgggacaatgaattttgggagatgaacactgctcatccgcaggccaatttcaccttcacccaaaaggatttgaggtacagttggccaattcaccattaa

SEQ ID NO: 73115 - DNA, 1256 bp, Heterodera glycines; identical to SEQ ID NO: 10052
  Genomic contig location: Contig_ID=SeqID_10052; Location=1..1256; Strand=+
  SCN-specific regions: Sequence locations=1-52,75-245,277-392,414 -845,868-1178,1202-1223,1251-1256
  Gene Ontology: Mol. function=protein binding; Cellular component =spectrin; Biological process=common-partner SMAD protein phosphorylation

SEQ ID NO: 73116 - DNA, 763 bp, Heterodera glycines
  Genomic contig location: Contig_ID=SeqID_1372; Location=51..813; Strand=-
  SCN-specific regions: Sequence locations=1-65,87-157,182-184,216 -280,303-529,602-763
gcctccacgacggagcagacaacaacttcgactaccgtaccggcaccgtcttcgtcttcttcggctcatcaccagcagcagcagttacagtccccaccgtcgcccaccgcctcatcatttagctgcaagctgaagcttttcgaggcacaaagtcgcaacggtggtggtggtgctgctggctatccaaatgcaacaacagcagcagcagcagttggtgttggcacaaataatggatcacaatcatcgtcgacacgaccgtccggcattccgttgaaagtcgagaaaattaaattaaaaatttaccaaagccattgaattaaaaaaaaaaaaattctaagtgtattgaggatttattaaagaaaaatcgtttcttcgcccatttttcgcggttttattgcattttattgggaaatttccaaccccctctttcctcccttaaaatttccctgttgaagaagccgctggtgtgtgcgcaagatttggagaagctcaaggaagcggctgaacaggaagcggctatgagaagacgagcagccgcagcagcagcaaacagtaacaacgacgggaagcagtatcagcaacacaaccagcagcaacggcaaaattgtggcggcggacgattggcagaaaatgccatggaaatggacgaggacaacgactttggagatgatgacgaggaggcggatgagcaccgggacacggtgcacgagctgagccgactgttgagcagcagttcggtgcttgaccagcagcagaacggagg

SEQ ID NO: 73117 - DNA, 259 bp, Heterodera glycines
  Genomic contig location: Contig_ID=SeqID_1374; Location=824..1082; Strand=-
  SCN-specific regions: Sequence locations=1-196,218-222,246-259
atacgcccctgtgaccacgtttcggccgacgacattttgtcctgctccgcttacacccacccccctccccctctcattggcagggcaagtcgggcttgttcatctcccagctggtgcccggcggtgtggcgcattcggccggcttccgcgtggacgactctctgctggcggtcaatgggaacgacctgcgcggcctcacccaccaagaagccatccaatgcattcagacggcgggcgaccgcttggagctgttcattga

SEQ ID NO: 73118 - DNA, 1389 bp, Heterodera glycines
  Genomic contig location: Contig_ID=SeqID_1375; Location=1380..2768; Strand=+
  SCN-specific regions: Sequence locations=1-454,476-641,681-733,783 -976,998-1001,1032-1072,1095-1115,1169-1367
atgccaatgccatcgtcggcgttgttcaacagtgacaacagttcgggcgttgaaaggtgcgcaatcacggattggggccgccgtttgagcaccgaacgcaatggccgactctcctccaccggtggcacagtgccgccgggggcgatggcacccgtaattgtggcattcgccggtgattggttggacagcgaaaagccagcagcggcattctgtgaaggaatggtggattttttacggaataggtgccaactacgtccgggcattttttaaattttttcggaatgacccaactcttccaggcattttccgaaatgggctaaaactccgtctcggcaatttaaattttttttttctcggaataattctacttcgtcccggcctttttagaacgggtcaaatcagtcccggcttttctttaatttttcggaatgatctaactctgtccttcgtacccaatcaattcaaattattaaaattcatagaaaaacgaactcgaaattatggtgctagggcgtttcttaaaaccgccagggcgtttcttaaaaccgccagggcgtttcttaaaaccgccagggcgtttcttaaaaccgccagggcgtttcttaaaaccgccaactcatatgattatgtatgtatatccgttaaattaaatatacaataatatctattaatttttatttgttgtgcaagtaagtgtcagccggaaatattaattagtctagcagtgacagactaaaaatctttattaaattaatttacaattatttacttaatttttaatagctcctgtaatctggttttgcaactttcaaaaaagtaacaaattacgaattaacaattttatattcgaaaattttgcagttgataattgttgctataaccacgatgtgtgctacataaataaatatcagaaacgttacgattgtgatattaaattttgcaattgccttaatgaatatcctaattgctttctaacaaaagtctgttctccaactcatatcttaaatattttattttttagaatatattatgctggtcagttcatatttttggagaatgttttaaagaagggtaaaaataattattttattttaccgtcaatagatatgcatatgtattttaaattttttattgttatgtaaacttctaatatatatatatttatatacataatcatatgagttggcggttttaagaaacgccctggcggttttaagaaacgctcaaagtggcggttttaagaaacgcccacctggcggttttaagaaacgccctggcggttttaagaaacgccctggcggttttaagaaacgcccaatgtggcggtttttaagaaacgtcccagcaccccttcggctccttctaattaatgaaaatattttacaatta

SEQ ID NO: 73119 - DNA, 825 bp, Heterodera glycines
  Genomic contig location: Contig_ID=SeqID_1376; Location=444..1268; Strand=+
  SCN-specific regions: Sequence locations=85-87,135-135,684-684,716-825
atgcccattgtacttgttgactggtctgatattcgtgagcaaaaacgacttatggtattgcgagcttcagtcgcactacacgggcgctctgttactctttatgagaaagcgttcccgctttcagagcaatgttccaagaaagctcatgaccaatttctagccgaccttgcgagcattctaccgagtaacaccacaccgctcattgtcagtgatgctggctttaaagtgccatggtataaatccgttgagaagctgggttggtactggctaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccataaccgaacgagcagctcagagcgtttcgatatcatgctgctaatcgccctgacgcttccactagcatgttcacttacgcccgtaccgggagtcccggcaaaatcccggcgggatcccggtcccgtccgggctctaataattatttatctcaatactggtttgacttaa

SEQ ID NO: 73120 - DNA, 3892 bp, Heterodera glycines
  misc_feature (46)..(47): n is a, c, g, or t
  misc_feature (75)..(75): n is a, c, g, or t
  misc_feature (126)..(126): n is a, c, g, or t
  misc_feature (1417)..(1417): n is a, c, g, or t
  misc_feature (1427)..(1427): n is a, c, g, or t
  Genomic contig location: Contig_ID=SeqID_1377; Location=1285..5176; Strand=-
  SCN-specific regions: Sequence locations=1-192,254-659,692-809,831 -1350,1399-1598,1690-1844,1890-2060,2087-2337,2389-3041,3095 -3267,3289-3402,3430-3493,3515-3516,3551-3575,3604-3892
tttccccaaatcatttgtcacttgactcagctgtccagtctgactnngtccaacaatccatccactcatctgccnccggacatgatggggctcgtcaatttgcaggcacagttttttattaatttntaatgaaattccattaattactcaataattaattaactatcagcgtttttaaaacatcaaaaagggaaaattttttgaattttaaaataattcttttaaacggttaaaatcttaaaattataaaaaacattttccagcatcaaaaaaatgctcaaattttggcatttttggtgttttggcataaaatagttgggcttgggcaatatcccgaatttgggggaatattccctcggcgtggcacgcacgttttggcactgattaacctaaaccatttttagcaaaaaaaaaattatcggagagtctcactctgttttacttatcctctttttaaaaggggaaaattcgcaatttttcaataaaattttcaaaaaatttcccgaaaattccaatcctttttttttttgcagtttctcgatgttgcccaatgtgagctccgtctgctgcccccctcaattgtccgcttggaacggcttcgtgtgctcgatttgtgcgacaattatctgaccgaattggtcggtttttgattgtttttctattttatttatttattttattattatattttgaaaaaagtctggatttttgggttccatattggacctggaaaatcatgaaaattcattctcctcgaggtcttgaagtggattttttgaaatttgcttaaaataaattacatggtctgaaatcaatattaaaatcattttcaacacataaaaaagcgtttttcaattaacttacaccttcatttttttaatctctttgaataaacagtttaccacataaaaaatcataaggtccattacaatatgtgtataagagaattaattacctaattattttatatctctttttaatccccaaaaattatttgttgccttaatgtgtttccttttttttgtttagttttaatccctcgaattgttccactgtccgattattttttttaaaactatttttccaaaattttccataaaaaaatacttgcagccccccaaaatggactgtctcgtcagcctggagctgctcgacttgcactgcaacatggtcgcccggttgccggacgaactgttgcggtgccgcgcgctgcgcacgttggacatcagtgggaaccaattgacggaactgccgctgaacattggcgacctgcaaaacctggccgagctggtgctgtgcgagaaccaaatccggcacttgcccagctcagtcggtcggtgatgcctcatcaattaataatattatatttaaaaaatgcatttaagaaaaattatattaccgtttttcctataaaaantacagtaacnctcccccccccccccttaaaaatagagttcaccttttgaagagggttgaaaaccaaaaccaccgggggttctattattttaggaaatacgatattagtaatagtatttttttaaatttgagaccggaattttgtaaaaacccgggtccggatgaaattttgtttgttttccttttaataaaattgattttataattaatttttggaattttaaacaaaatccacaataaaattaaatccaaattttaaattaatttaaaaaagtccaaaattcatggcccccatttttgcaggccaattgaagcggttggaagtgctgaaggcggccaaaaacaatttgacggtgctgaccccgtcaatttgttcatgcgcactgctcaccgatttgattctgtgcgagaatcaactgcaggtgaacattttttttactatttaaaaatatattatatttttaaattttatacttttatgatttgagagtctcaattttttcggcaaaaaaaaaattaaaaaatgatgagggctcaaatgggttgctggcaaaactaatcatcaaattcacgtgttgaattttcgttggttctctactttttaactaaacaatgattgagcaattgaccctccatgtcctaacaaataataataaaataaaattttaaacataagcaaagttcgagtccgctcgagcgcgcgccaattttttttggccactaatgagctattgaccctcacaaatgttaaataaaaaagatacaaaaaattggaaaaaagccattattagtaagtagtaaatggaatattggaaaagaaataaataaattgttcatttcgtcgtgctatatatagcgcagtcggtagcgctgaggcgcttaattaatacatgaaagttcgagtccgctcgaacgcacggctaattattttcattattttttaaattaaaaaaaactgattttttttttattgaggcattcccatttttgtccctcgcaatattgtaaaaattaagaaattctaccgaacgatggcagtcaagttgagtagcttcctaatgagtttttcataactttttctatccttttccctaccattgaccctcatcaatgttaagaaatacacaagagtgatatttaaataaattggacgtctaaaaaggaagagaatctaatcatcaaatttactaattagtgaattttcattatccaccctttatcataaacgtatggacggactccatcactgagcaaagaatcattgaaaaggatttaaattggtttgtggtgtcgtgcatatagcgcagtcggtagcgctgatgcagccgtttaaatacatgcaagttcgagtccgctcgagcgcacgccaattttttttgaccattaatgagccattgaccctcacaaatgttaaataaaaaagatacaaaaaattgcaaaaaagccattactagtagtaaatggaatattggaaaagaaataaataaattgttcatttcgtcgtgctatagcgcagtcgttcacgctgatcctcttaattaaatacgtgaaagttcgagtccgctcgaacgcacggcatttttttccaaatattttccttttttcttttttccccataatacctgtaataatatttaaaatttttttgctttacatttataaataatatttattttttcaggaaattccttccagcattggcaatttgcggcggttacgatttttggacctgaacgtgaacaatttgcacgcctttccgccaacaattggtggatgtcagtcgttggcaattctctcactgcggcacaaccatctcagcgagttgccaatggaaattggcaaattgaatgtgggcaattaattaattaattggctaattagtgccaaggagcacagaactcaaatctttaaacaagaattgtgtttgcgaaattttaaaaacctgatttttgggatattaaaataaaaatagactgactgagaaccataaattaaaatattattaaaattaatggagttttttttaacaaaaaataccaatttcagtgttttttttcgtctatttaaaaatgaaaattgttcttgaggtcatgcccatagccagggggtgggaatttccccacccccgaagatacatttcaaaaatttggcaatttttcgaaaatttaaaacattttaaaaatttatcattgaagccgatttgcgcccggtcggaaattcttttaatagtttttttatttttttactattttttgtccgataaaaattgagattatttccaacaattttttgggtggggttggggtgggtttcgttgaaatgttgttgttcagcaactccaagtgctggacctagcggacaacagtctacagtacttaccgtacacgctgaccgtactgtacaaggccaaaacactgtccgccctttggctctccttcaaccaaccgccgctgcccaagctgaccaccacgcatga

SEQ ID NO: 73121 - DNA, 758 bp, Heterodera glycines
  Genomic contig location: Contig_ID=SeqID_10056; Location=209..966; Strand=-
  SCN-specific regions: Sequence locations=1-236,258-336,358-758
atgcccagaacttacaaagatgagctcaatttcattgaacggatttctcctgtcgaatttaaaatcaaaaaagggttcgtgccaaatatgaatgtaagtttgctcgcttgttcagaaacagttcattaattaaggtggaaggtcgtttttatgtgaatgcagcgctggagaaactgatgtttgatgagttggaagtcagcacgataagttcggctgctggttttctgcctgcagtgaaacaaattggaaatgttgcctcattacctgcaattgttaaaaattcgatcggactacctgacgttcattccggctacggattcgcaattggaaacatcgccgcttttgattcagctgacccacaatccgttgtttcgccaggcaaattgttgaaattgcttcgaccttattcatgcattgtttttcttaggcggtgttggcttcgatataaactgtggcgtacgactgatcagaacaaatctcttcgaaaaggacgttcagcctcacaaggaacagcttgcgcagacaatgttcgattatattcccgttgggatcggctcaaaaggaattatcccaatcaatgtgagagacttcgaagaatgccttgagatggtttgtgaatttccgacctgttgaacagttcaccaatttaacaaattagggaatggattggacgcttcgcgagggttactcatgggcggaagacaaggagcattgtgaagaatatggtcatttcgcaaaaaaatgcaggatgaattaaa

SEQ ID NO: 73122 - DNA, 1014 bp, Heterodera glycines
  Genomic contig location: Contig_ID=SeqID_10057; Location=130..1143; Strand=-
  SCN-specific regions: Sequence locations=1-776,798-1014
atgaccaaacgaagaacacaacagtctctgctgcccaacgcgctgaagagcatcaaaaacatagtcaaccaaacacaaaagaaggtgaaacgaacacaacaagtcttcttgagattggctgaattgttctgtaaaagcggcatgattaatgaaataacaaaggattaattaatcaattaatctgaagtataaacttcttttctaaaaacaaacttcgtaaggctacaaataatgtccatataaaatcaaagagcgaagaacacgagagatcatcgaacggatctttgtatttggccttttgagacggaattattgttgaagtttgttgagtgtcatggacaaatacgcgtcgaaaaatgggaagaaacttaaaaaatggtcgaataccgcatgatggcaaaaaaaacttttttgaagatcacagcagccactgccagattggactgaacacgccttacatggtcgaaaagccgacgagaagcggaaattagttccacccaactgttaagcttgtcgaaaactcaagtacggtgatttcacaaacggagagtaatttagaaagggagtatctgcagatgagctcttgtccaaatggtgtcgcctgcccaacagtagtaaaaaagccacaggccatccaagaaaagcggttgccttaaaaagataactacaaaggatattaatgtttggatgcctccaaaatattctgttgccggcctgtgtggtattgcttcaatccttttccaccaggttccccccgaaccaaggattccattctggaaaaaacttttaaaattcccttggaggttggttcgccaacttccaatcccgtgcctgaaaaactctcaatatttgcagtttctgaattatctgatttcgacattccttaaaaaaatggagaaattaaaaccaaggtccaaacaatttgtttcagctgcttttttaagttttcatactttttgaatttttaagcaatacagagtgagttccataatttctaataatttcgccaataaa

SEQ ID NO: 73123 - DNA, 930 bp, Heterodera glycines
  Genomic contig location: Contig_ID=SeqID_10057; Location=1514..2443; Strand=+
  SCN-specific regions: Sequence locations=1-46,68-552,574-832,854-930
atgatcctcaatttgatggtgggtgtacttttttgatcaatgttatctatttcattttgcagagcaagctgtgtcatttttattaaagtttggcgattttgaaaaacgacctataaacgcccaattaatgatcaaaaggacctcacaaaattgtttcgagaagctaagcaatcgcaagacaaatagcagacctccattcatcggcaaatcatatgttataacaacagaagtaacttatttttcatattcaaagcttttggaagaagtacggtttacgtcatttctcgagtgtcgttttgagactttatgttaacaattttagaatatctgcttataattctttatcattgtacgatgaaaacggtttaaattaacaacaaataaattaaaaatttggcatgatatgtgagacattttttgagcgagaaaggaaagaatcgcgataaggttttatgatattgaacggaggctcgttgtcaaaccaaaaagtatagtctcgaaacgacttacaatttatcccgaaacgacctgtagcccaagaagtcatttatatttctaagcataaaattgttaattttagacaatttgtccaagtgcattgtcttcggatgagcaaaacgaagcacaaaagattcgcaatttgttgtcgtcatttaagggaaacgaagacgatcttcttggttatttgttcgaagactgtttggaaaatccaaaagaatttgttgcagacaaaggcaaaaatcatcacatttagcatttatcaactccattttattttattatctaaatttcagttgaaacttggtctcggaattttgcgtgcaaagctgccaaagaaatcgctttgaattccaaatttgacagcgaatttcaatcagaaattgccatgcgaatagccgaagtagggaaaaagagcattttaagttagta

SEQ ID NO: 73124 - DNA, 1036 bp, Heterodera glycines
  Genomic contig location: Contig_ID=SeqID_10058; Location=1218..2253; Strand=+
  SCN-specific regions: Sequence locations=1-692,832-1036
atgaaagtcaccaaattggaaaggtaaaatgacattttaagtaattcaatttacaaattcgcataaaattattatttttgtgcatttattggtaatttttcaaaatttacatttttatagttttgtctcgattggattcgccaccaaggaaatgccactggacggagcaatcggacagcatttgaacagttacgggtaccgaagcgatggctcattaggctgcaatggtatcagtcggccgtataaaatgggatttggcaccatgccaatgccattcaacgcggcggttggacaacagagggaccgccgctacgttgggagtgccaattggccatttccattggaatttgtgcccgtgccaatgccatcggacggcgcattggcattccaatcgccagcattttccaccggagatgtggtcggatgcggcgtttgtttggccactcgacagatctttttgacgaagaatggccgacgaatcggtgggccaaacaaaaaacaaaaaaagcaaataatttaaattcaatttgtcagatgactcctcttttttcactacaactcccatcaattctctgtttccatgcgtttctctgtggactggcgacaaaattgaggcgaactttgggccaagtttcaaattcaatttggccactctttgaagaaagccgaagaaacaacgaaagggcgattagcattcatttaattaattaattcaataatcttttttctttattttatttttaattttttatattattttatgatgtgtatttgttaatcaaataattttctgtttttttattcacttttattttctgtttttccttttttatgtaaagatttggttaaaaagagaccaccgaagaaaatcttgaagttgaagtaattagtaattttgaagaaattgctaaaactattaaattccccaaatttcctctttgttctttccactcattttggtgccattttattaatatttaaaatcgtttaatgggcctttttattaattttttcgcacttccagcagaggcaacaa

SEQ ID NO: 73125 - DNA, 994 bp, Heterodera glycines
  misc_feature (988)..(988): n is a, c, g, or t
  Genomic contig location: Contig_ID=SeqID_10059; Location=336..1329; Strand=+
  SCN-specific regions: Sequence locations=1-83,117-140,169-292,314 -854,876-960,982-994
atgtcatcatccatcggttcgccagatacatttttccgttcagaaactgatcagggtaatagaaaaattttaaaagaattacgaaaaataaaaaaataattatttaaaataaaatacaaaatctctaaattttatcacaatcagaagcagcagcaggagcagaagaagtgggcaaatacgaagtgttcagttggcacggaaatttgagtgatcaattgtcagccgaattgttcgtcactgatcagcagttgctgaaggtgggccattttgaatggacaaatgatcaaacagcgggaggggaggggaggccaaaaacagagaaatattatgggaaattagcacaaaatttacaattcgttttaaaggttttctaatgatataaaatcaaaaggagaaagggccgacctattcctagagcaatttgatggcattttgccaaaaccattcaattatgaaattaagacaaattactaattattttttggactgaattatttgttttatttaaggaatgccgagaaaaacttgccaactccgaattgagggaaacgaaattgttgtggaataacggggagctgaatgctgagaatgtgagaaaaaagaaaacgatgaaatttcaaaagtgaaatttcagagggcgaggggcgaaaacagagaaaatttaaactttttttatttcagagggctctcaaagcagagttggaaaagcagaaacggatgacggaacacattgaactgaaggccaaagtcttcaatatggagcaggaaaagcagcaattcgagaaaaaatacggtatggagaattttgaaaattaattacaaatttccaataccgtatcccgagccttactgttaaataagcatttcaaaaagaatttctttaaaatttcatattttagtttccgtcgatgtgttcaattcattggtggaacgcatcaaacagttggaaaatcaacagcagaagaaagaggagggcagaaatggtaanaaataa

SEQ ID NO: 73126 - DNA, 1851 bp, Heterodera glycines
  Genomic contig location: Contig_ID=SeqID_10060; Location=765..2615; Strand=-
  SCN-specific regions: Sequence locations=1-60,85-515,537-809,832 -993,1015-1598,1628-1725,1747-1851
atggcgccgggatctgggtcgcagtgttggttcaacaccaaaaagtggcgaaaattgaccaaaattaattttattttaaaaattgcattttcagggcaaaagcagaccgaagccgtgccaacagcagatggagaggggacatcgacccaggccgccgaaaaagggccgtcaacgtcaactccggaccttcgtaagtcaaaaaatcactattttagaagaaaaacttaaattaaggcccgcgttcaagcccaaggccattgtcagcaactccgatcaggcgccatgtgcgtgtccatcaaaaaactgacgaaaaagcaacaaacatggactttacaactaccgacaatgcaacacacatggatttgacaatgatggacaaagcaacggacgtggatttggcttatgaggacgccgcgacacaaaccgagcaattggacaaacagctgaaggagcaggaacaagtgatcagctttcttcgacagcaggtccgcaacagagacgcactgatcactgcgcttcggcggcagttggaggaaaagatggcaccaccgatggagacaccgaccaccagcaaaagtgagtgaaactaaaatcccctttttatctttttcaaataattttctcttttttaattttagcaactccaacaggacgaccaagatgaatgtcgatcatttgcagcgcacctcacgtcgcaaattggctgatgaaatcgcggctgtaataaaacgggacagatcacgctcagccagccgggcgtccctcgaacggatcagtcgggaagttcggcacaaatttgctcattacacgccacagaagaagaaacaacaactgccaagacaaaaaaagtcagttgatccagaggatgatcttctgatcctcgggcttgtcggtacacagaaggcttacagacgaccaaaaaacactattcgcctgatcaatgccaaatttgatgtgttcccgccactcgaaaaagtaaaaacaaattttagcatttatatttatttaaaaattcaattgaatattgttagctgcttgacatcaaacgccgcatctgtgggtcattgcaatacgcaccaattgagactagtgcaggtgttggatttgtgtgcactgatgttgaggcagctctggaggcgcgtctttcatctgccaaggacaatctgatcagatttggcgacgaaatctacataaagctgagcggcgaccatggccagagttgtacgaagattaccgtctcattcagccaggctgctcggtcaaattctccatcaaacaatttcgtctgtgccgttttccctaccaaggatagccgcgaaaacttggagcgctatggaagcacactttgggaacaaattgacggaataggcacattggcgggcaaacgagtcaagtggtaaattttaaaatttgtttttttccatttttatgaattcaaaaggtttatgggcggagacgtcagttttatttggtcaatgatcgggcattgtggttctgcagtgacaacatttccgtctccaatttgcagttgcagaagtgatcatttggtgcaggacggcgaaatttgtgaactccggacaattgatcaaactgtgttgttttatttaaaaatttatatataataattcagagacgaagtgatcagagggaagagcatgatgagttcgatcaaccggaagaagaaactgacgaaatttcgcttatcaatgtcattgattgatggtgatttagcaagaagaaattggtggtcgacgggagacggacgaagaaaacaatggagaagaagaacaattcgattttgaatagacacagttcgataaaaggtttttcttcgttttttcaggaaataaa

SEQ ID NO: 73127 - DNA, 76 bp, Heterodera glycines
  Genomic contig location: Contig_ID=SeqID_10060; Location=18..93; Strand=+
  SCN-specific regions: Sequence locations=1-76
tagagaaaaaaagtaatgtttttctctggcactctctatttattggtacacatctcgttttttcgggacggtgtgt

SEQ ID NO: 73128 - DNA, 553 bp, Heterodera glycines
  Genomic contig location: Contig_ID=SeqID_10062; Location=386..938; Strand=+
  SCN-specific regions: Sequence locations=1-553
atgacagcaaagtctattttaaaccaaatgattttcagcagaagcagccaaggaaacgcagcagtcccggctcattgtccacttcaagctcttcgtcaatcatcgcaatcagctcaacttctcctaccgctgttcctgattcagtttcaccacctttccgtcctctggaggtatgttatcttggccattttcaaaacagtacgtcaagtggtatgaccggcactaataaaattgtcaaattccaacgttttcacatttttatgttcaaaggttttttaaataacaaacgaaagtcaaatttgttggttgcattgtataaaccttgtcgcttttttgtccatttatatcgcatttcctttccacttttttgagttattttgcaaatttattgtcagagagggccaacacttcaaaaaaatcatttgtaagaaattccgaaattttttttttaagacaactgggcctactaacagcaaagccactaaattgcataatgctgaagaaatgcttgccaaggctgacaatgagcagaggggtgttcaacgctttgtga

SEQ ID NO: 73129 - DNA, 117 bp, Heterodera glycines
  Genomic contig location: Contig_ID=SeqID_10062; Location=190..306; Strand=+
  SCN-specific regions: Sequence locations=1-117
aaattagtcaaaatacatgtcagattcgtgattagcgaccttttaaaccccggataaaaaattatcatggttttttatcttaaaaaaattttgcaaaacaaaagggtcccccctttt

SEQ ID NO: 73130 - DNA, 969 bp, Heterodera glycines
  Genomic contig location: Contig_ID=SeqID_10063; Location=639..1607; Strand=+
  SCN-specific regions: Sequence locations=1-38,60-155,177-217,239 -258,280-494,541-969
atggcggaacggaaagaattccgacgcatgtttgacgagacaaagatgccaaaagcaaacccgcactttgaccaattgttgatatccttcaaatcgggggtatttaaaaaaatcaatcggttttctccaaatgcacccgggtggggtgctgctaggcttaacactggtgtgaggagttggagaaaaccgatttcattttttacaatatattaaactcaaaatttttccctcctagaaatatgaggactctgtcgtactggagcttgaacagtttgccaaatttgttcagctgcagccagtttttacgatgaatcagcagcagattggtcaacattttggacgaggtgcaattttaaagttgacgtggaatttacaaaaaaaaaaaaattcttttttgagcattggcactgacacaattcattcactctcatgtacactttttgagtggcaaaaacaaacccaataaaggcattaggaccatcagtgccggtcagtaataaaatatgtttgtattaatttataatttatttttaaaataatgattcatctattttttgcatatttttgaagaaaaactgctcacttcaatggctgctgatggttcgatgggttacacggaaaatgttttacctgtactccgtttgttcaccgcttttttaacggacattaataaatcggaggtatgtttctatccagaccgtaccccataaaaatttacattttttcgctctgggtaaaaagaaaaatgttttcagttttttttttaaatgttcagagtaggaattgtagtcggtcgattaaaaaggccattttttactattttaggcccaaattaaaaaaaaaccccaaatacatgtttagctgaaatcaacagccctatctgaacctgacgttcaacaagtgccagttcgttcattgcgctcgcgtcccattaaaagggtggtgtcgccagacaatggagcaaactga

SEQ ID NO: 73131 - DNA, 171 bp, Heterodera glycines
  Genomic contig location: Contig_ID=SeqID_10063; Location=346..516; Strand=+
  SCN-specific regions: Sequence locations=1-171
gattgaagaaatcgttcaatgaattggaccgagaatcgctggccaagaatcttgcatttacagcaggtagcaaaacatactaacgaataatcaaatctattaccgattgatccttttctttcatagtccgtctcgacagtgatggtgttgacaaaatacagaactcatttt

SEQ ID NO: 73132 - DNA, 1848 bp, Heterodera glycines
  Genomic contig location: Contig_ID=SeqID_10065; Location=270..2117; Strand=+
  SCN-specific regions: Sequence locations=1-79,101-119,222-254,287 -353,427-612,634-910,934-1080,1105-1144,1217-1416,1453-1466,1503 -1787,1834-1848
atgggctatttggcggcaattccgatgctcatcaagcgattgcgcgacgctgcggcggatgggcataatagccatgatgaggggggcgaaacgcggcgaaggggtgggaaaataattgcaatatttttttattttaaagaaaaaaaaatttattttttttgtatgaaaatatatttaattttttattttatttttgtaagaaaataaataaataaaaatttccatttgcaacttaatatgctatttcttaaatgttttaaaattagaaattaaaatttttttatttgtccaaaaaataacggattttttctaaaattcaacggaaaaaaatgtgattaaaaaaattagtggggaaaaaattaagataatttaattgaatagctttaaatatttttttaattaaattttttttttgtaataaaataactgctcaagattccgtttcccacacctccgtgctgttgggtcgtcatgcgaaaacggtcacttgtggattgcatcgggctgaacgctcaacactcaccgcacaacacacaaatttcaccgaagccgagtgggggaaaccattaattaattaataatctaacaaatccatggaattgtgatcatcctgcttcggaaaaggcgattttgcgggaaccggaaaaattatctggaatttccgtaacgaacgccattgttttatagaaaatacccaaatcaaatattcttggtattattcgaggagccctaatgtttcgcttattactacaaaagttgaaggaaaaaatcacctaattatggccaaaaatgaggaaaaaaaacgaattttcaaaaatattttcgtcatcatttttcacaaaacgaatgaaacttttttaaatttacaaggtaatttcccattagcaaagctttttttttgtcatcctgctttgaaaatttttgaacaaaatttgtaccaaaacccttatataatttcactttttcccccctttttttacagtttttacaatgcgctccaggatgcgtatttgttgacggaccagcaaatgtgggataatggctatccccggtgggcagaaacttccgctgctgctgacaaagcgatggaggaggaggaggggcaagggttggacaccgacgaccccattgctggtgatttttgttttataatttattttattttaattatatattttttaataaaagtgtatttaaatacattaaaatttaatttgtttacaaatttatcttttcgacgtttcgttaaacaatcaaatatttaaatttctacaggaaaacggcgcgtcgaaattcgtcagtctgagttagatgcgggcaaaagtcgtatcccatttgtggacgatgcaggcaaatcctatgaatttatacacatatgcagactgaattcatacctggaaaaaacaatttttttcgatttaaaaaatatatttataaaaaaaattaaaatttcggtgaaatgttccataaattaatatattttttttgtgtatttaatttttccatatttcagtgttgtccagggtgtgtgatcgttgtggcaaagagtatcggctgaccaaggagggcgattatgcggccggtgcttccgctgatcagtgcattttccattggggccgggcgtggaagaaacggggtgggtgtactgtattaggatatggtattctggggcaaacacaataggaactcattatcagagttatgttggtgcagatttagaaaaagaataatggctccccctccgccgtttcctttcctccccttcgaaaattcaaaaaaatatcttgaaaatttttattaaatttctagaaaaaaaatttgaatttttttttagcaatctttgggtaa

SEQ ID NO: 73133 - DNA, 851 bp, Heterodera glycines
  Genomic contig location: Contig_ID=SeqID_10066; Location=972..1822; Strand=-
  SCN-specific regions: Sequence locations=1-220,242-422,444-851
atggcacccgctactgccaacaaccatggcgccggttcatccccagcccacgccgtcactgcggcttcatctgccgatcaaaatgacacatcgaccgcctcacaaaagggcaaatgcaaggcactctacgaattccaagcactaaacccgggcgaactcgactttaagggtacgaaacggaaaaaagggaaaacaacggacaaaggggacggggggggtacaagaagaaactgagagtcattcattagagacgtaaattgtaatagagagagagagttttctttttgttgcccctttgtcattaagcactttttagagggccaaatcattcagctcgattcgcaaattgacgagcattggtttgagggcacagtggacggccggaccggctttttccccatcacttacgtggaggtaccaaaaggaaggggaggggaaacattggactcttcccctttttgaggtgatcgtaccaatcccttcttcttccacgacggcacaacaataaactttgtagaacaccgaacagatgacacaaactgtgctttgggatggtcaacagaacaagtcaaacaaactcacctaaatttgctaataattccttaattttcactgtttgtttttcgacccgagattctcttcttacaatagaaaatggcaaatttctaaaccattaacttctcagataatttgttttatttcttttcctatttctgaaattatgtccgcggagattgttatagctaatcaatctaattgtaaagccatttattcgagcgaccgttacttataattcatcctatgacactttcatcaacattcacataatttcaattataaaatttaataaa

SEQ ID NO: 73134 - DNA, 1061 bp, Heterodera glycines
  Genomic contig location: Contig_ID=SeqID_10067; Location=197..1257; Strand=-
  SCN-specific regions: Sequence locations=1-401,423-501,525-624,646 -775,798-1018,1040-1061
atgtctctgtcagcgctcaaaaaacagttcaacaaggccaaccagtacctgaacgaatcaattggcactgctgaggcgacgaaacttgacgaagaatttacggagatggaaagagttagtgggggtatttaagcgaaatatgtatcactatcatagaattaagcttgtaaaaagtgcaaatctcatttagacagttgaaaatgcacttaaaaattttaacagaagtgagataaaactaattcatttttctaaatttaggattttttgctaatttaatatttcaccgacattaattctaatttccttttacagaaggtggacatgacaaacgaactgatcacgcaggtcatcgcgggtaccaacgaatatttacagcctaaccctggtcagtccggcgttttccaaaaaattgttttttccctgtgcaaattttgatataaattctcccaaattttaagcggttcgtgccaaaatcgccgcattgggcgcaatgtccaaagtgcgcggttccaccaaaaatcaatcgtatccccaaacggagggaatgttggcggacacaatgcaaaagtacggccgttcgcttggcattcaatcggactttggaaaggttttttgaaaaataatcgatgtattgtacaattttttgctctttctcaggccctttgtgacgcggccgatgccttccgtcaaatggccgacgtaaaataccaattggaggacaacgtaaagcacaactttctcgacccgatcagcgattttcaaaacaatgaactcaaagatttcaatgtgagtttttgcaatttaattatctcttttcttttttgaggataatttgttattctcttcacttattttaacatttttacgaaaagttttcgctttaaatttacccggggattaattttttagctcaacatttaaaaaagccattatttttggacaaaaagactgcgtccaatcatgttttcgtgtcaaccatggaccggcccagacccatagctccactacccgagcagaacaaaaaatttaacaatatctttccgatttaaattaataataaa

SEQ ID NO: 73135 - DNA, 879 bp, Heterodera glycines
  Genomic contig location: Contig_ID=SeqID_10069; Location=959..1837; Strand=+
  SCN-specific regions: Sequence locations=1-285,326-581,603-879
atgagtaaaaaaaaattaaaacaaaagtctgacgtgaagaaacccgtgcacaaaagatgggacaagcgggaggagcaacaaaagaagttggagagggcgagacaagccaaattggcaaagaaaagtgagtttctaatcaatttttaaagcctaaaatatttcaactaatttcagcagtccaacagcaacaaattgaccatggggaaggagaagctgagatggagcaacaagaaatggaccaagcggagcaagtggaagagacttacgaccatgcaagtgagttttaatgattttaatttcaaaaaatatcaaatattcaattttttagtgcattttgacttccagctggagaatgatgtccaaatgtcgccgaatttggccattgacgatcaacaaccgccgacctgggacgcaacagcagaagcgggagtccaatgcgcgatacaaacaatggaagtctcaacccaaaccgactggaacatccatgctctgctttctgctgatcaaatcgctgatttccgcgccactgctgatcaattccgtgttcacatgttggagcactttcgtcggcactgttcgacttcaaaatttcatcatttggtccaccatgcccctgaatttgctgaaaaccatggattttggggccttctcagtgagcagcctgtggagaaatttcacgcgttgttcaatgacgatctcgcgcgcaaagcaaacatcaaagatctccacgatattttgatgttctgtgctagagaatctgccattcgaaacgccatttttgattcaaatgaactctgatcagtcttttgtagttttttttataagtttattatactttttgttgttatttttcatacatttttcaattttttatattta

SEQ ID NO: 73136 - DNA, 91 bp, Heterodera glycines
  Genomic contig location: Contig_ID=SeqID_10069; Location=835..925; Strand=-
  SCN-specific regions: Sequence locations=1-91
ttaaaataactctaaagttggccttatttttgcattaaatttccttattaatcgattcagaatttttttctctatcgatatgcaaaatatg

SEQ ID NO: 73137 - DNA, 1629 bp, Heterodera glycines
  Genomic contig location: Contig_ID=SeqID_10069; Location=2978..4606; Strand=+
  SCN-specific regions: Sequence locations=1-46,69-235,257-672,695 -730,765-882,917-958,990-1525,1547-1629
  Gene Ontology: Mol. function=aspartate carbamoyltransferase activity; Cellular component=cytoplasm; Biological process=pyrimidine base biosynthesis
atgcatggcaaattgttcggtgccgcgcgggcggtggtgggcgaattggtgtttcagaccggcatggttggctatatagaggtgagactaattggttaattgaaacggtgaaaactctttgattttaatttttgcatacgaacgataaaattgtctagtttaatgtagagttaggactaatttgtttttttttcatggcatggcatttttatgaaaatttacgccgccataattttccatttttcagtcgttgaccgacccgagttatgctcgtcaactgttggtgctcacttacccactcattggcaactacggagtgccggacgaaaccaaaaaggacccaaaatggccccaacttccgtcaaaatgctttgaatctacacaaatttggccggcggcgttggtggtcaatcgcatttgtccggagggcgaacattcgcattgggaagcggtcgaatttttatggcataatttgcatggaaaatttgtcaattttcctaggggtcgattaaaccaacggatatatttttaggtccaatcgttgtccaattggttgagcaagtcgggcgtgccgggtttgtccggcgtggacacgcgtctgctgacaaaacggataagggagaatggcacactgaaagccaaggttttgtgttttttgagtggcaaaattagtggaatggaaaagcagaaaacgaaacgaatttgtaaataaatttgttaaattgattttcaaaggcctcaaacataaaatttctgcattaacagtaaaataagttttgaacgctatgaaaaaatagaaaaaatccggaatttcaaaaaaaaacaaaaaaaaattttttttcaaccttttaaaattaagaatatggtgggacttgtgtaatcaaaaattatttttatatatttttaatcaatatttgcaatttcccgtagccacatttttgtctctccacaaaatgctttgttttgatttttgcccatttttcagttggtgctcgagtcggatgatccggaacgctttcaatttgtcaacataaatgaggagaatttggtggccaaagtttcacggaaggtacatcccaaatccctcctcccacttaccccctcctatcaaatgattcaatttttcaaaattcagtctccccaatggtttggcgacaaggagcaatgtcagagccgaattttgacgattgactgtggcctcaaaaacaaccaaatacggtcagtggtgttacactacatcaacggctcaaaagatcttttttttaaaatttgttggggttggtagattttttccggaaaatgttacacaacacaaaaatcatcattggaattttgttaattcgtgataaaaaaatagggagcaggacaaaatgtcaccgtcggaacatcatcgagataacatcgttacaaaaaaattttttttgttttttaatagaggaaaaataccttggatttttttttttgcggcaaggttttcgagtgtatccaaataattgacatgaatttgaattgtttcatgcccttgtttttcaatttcttcataaatcatttccaatcactcaattttttcaggtgttttctgcagcgagactgtgccgttcacgtcgtcccatgggattttccccttga

SEQ ID NO: 73138 - DNA, 477 bp, Heterodera glycines
  Genomic contig location: Contig_ID=SeqID_10072; Location=1118..1594; Strand=-
  SCN-specific regions: Sequence locations=1-477
atgaacgacgacaagctaattaatgagattaccgacgatttaaatatcgccatggaacacgtcaacagtgctaagtcaaaaattacgactgttttggctatccagaaagagaaggaaggagctctcaaacgccgtattgacactttatacgaagaaaacgggaaggagaaagacaatagtacccgacttttgaaggagatgaaaaaattcaaaagtttcgcggaagtgacaatcaaacatggacaagagtgtttcagctcatccgccgatataaccttggggttaaacaaccccgtctaattttaccttagcaaccttaacatatttagtgcggaccttacggacatcagtggtgacattgaggagactctcaaattgacgacgatggatggctcaaacgaagtccaattggaccaggaccaccgaaacgtgaaagaaggggaattggaagtcgaagagcagcagatccttggataa

SEQ ID NO: 73139 - DNA, 506 bp, Heterodera glycines
  Genomic contig location: Contig_ID=SeqID_10075; Location=3118..3623; Strand=+
  SCN-specific regions: Sequence locations=1-66,88-166,205-392,414-422
atgtgtccgaaattaataacaaagcttaaaatggtcggcccccttcatgttagcaaaggttgatatccttgtgtgtttatttatgttcttttatatattttaaaatgtaatttagaaattcgaataaatatcggttcgttttaccgaaattcctaaagctctgatcattttttaaaatttataatatttttttcaaattttttacccatcgatttcacgcaaaaatcgccgtaacagaagccggattggcattgcattggcatttggcactaaattattatttgatcagttataaattcaaataatatttacctgatagcaaattcgttgggctcgaaaaccgccgggatctgctcttcgaattgctaaataagatttatttaaaaaaaaagatttaagaaaaagttattttgcgctgaacctttattttttgaatttatatctttttctagattttttctaaaattaaatttcagatgtaaaattattttatttttattattaaa

SEQ ID NO: 73140 - DNA, 706 bp, Heterodera glycines
  Genomic contig location: Contig_ID=SeqID_10075; Location=3319..4024; Strand=-
  SCN-specific regions: Sequence locations=1-109,150-218,486-494,516-706
atggccaacggatggcgccggaggcgcaggcgaaacattatgccaatggggacaacaacaacgattgggacaacaatggcacgaatgatcgtgccatttttggtgatttcggcagtgacagaggcagcagcagcagcagcggcagagcaaacggcacgaggtgacaaatgccaatcaaatgaaaagcaattttaggattaaaaacaattgcataattcaaaaatattttagtaatataaatatatttacaatttaaaatatttttgaaatatttaaaaatagattttttattctcgtaaatatttaatattttataaaatttactcaaataaatataaacataaaaaccataaataaaaaaattttcacttatatattttataatttttatataattttattttaataataaaaataaaataattttacatctgaaatttaattttagaaaaaatctagaaaaagatataaattcaaaaaataaaggttcagcgcaaaataactttttcttaaatctttttttttaaataaatcttatttagcaattcgaagagcagatcccggcggttttcgagcccaacgaatttgctatcaggtaaatattatttgaatttataactgatcaaataataatttagtgccaaatgccaatgcaatgccaatccggcttctgttacggcgatttttgcgtgaaatcgatgggtaa

SEQ ID NO: 73141 - DNA, 774 bp, Heterodera glycines
  Genomic contig location: Contig_ID=SeqID_1379; Location=746..1519; Strand=+
  SCN-specific regions: Sequence locations=1-157,179-203,225-774
atgtccagaactccattaaacgacatcacaaatcaccgcagccctggtcaaaatcagggaaatgcggcgcgaactcgttcagcaatgggtcgagaaaatatcgacccaaatgtccctattgagggacataatcttcccctttttgaggaagaaattccattggagaatccatggaattggagaaatttgactgaatctgattcagattcagtgactgagatcgcaagggaatttagtccaatgtctttggactcggacccggaatggacgtggaaccctccacgttccatatggccaagaaatgggagggagccattgagtcaatggtttccccgtgtcatgggaaatcactggcacgaaagagaaagacgatctgctgaagcgctccttagggacttcctaaggaacagcgcatttttaactaccaatcacctggccactaaccgtgaaatcatcttcgatggattgtcacgtagcggtgcagaacggaccaacatttatcccggattcaccgtcctcaatcattttgagggacggggaataaccatcaatcctcttgtaccattggtacaagagtgtggcgggtttagtccccgccgcggcgaaattcacatggattatttccccactgaagtggtggacttatgttattttgagagggagactgaaatcccccaacaaataaaccaacaattacgacaggacgacacggatccgggaggaaaccggaacctccgggaattctcagagccaccagtggctcgagaccgataa

SEQ ID NO: 73142 - DNA, 1133 bp, Heterodera glycines
  Genomic contig location: Contig_ID=SeqID_1379; Location=1892..3024; Strand=+
  SCN-specific regions: Sequence locations=1-6,35-288,310-310,332 -756,785-797,836-884,914-965,995-1073,1095-1133
atgactaagtcctcctcttcctcctctgagggagaattgtccgacgcatcattttcgccaaatgacaagattcccctttgtcaaagggggatcaaaggaaatccgctggagctggtggacgcggcccgggcggtaagcaataccacccggagaaaggggaaggaccttcggagtctcattgactccgaagcgaaggaggtggcacgaaagccgcctactgttccgactgcgggaaggaagggcatcggaggggcgctaaaaagtgcccctctccgaaggaggatcgggcggaatcctcccgaccccccgtaatttctcctaaaattaaggatactctgccgaaaaaggcagagggtcgcgcacgattgccgatccgagggccagtttcgatcgcccctcggaagccctcgcctccatcgccaaaggtcaaggccacgacagaatcgagcctgcgccgtcggcaacattcggatttatccggaatggcatgcccggatttatccgggttagccaggatttcaacggacgggagacccgggacgagcggctacggaggattagcaggatctctacgaatgagagacccgggactagcgggtatggccacagaaccgctagtgccgtcgaaagtgaactgattgaggccgtgaggagccttcaatcagtcgtggaagaactgcggaagagcatcccgccaaaattgacgggaggcaacagtgaaccattaggccaccgaaagaagcgccgacaccatgactcttcgtcctcctcgtcgtcctcctccgactcggagactgaaaagcggaagaaaaagagaaagaaggataagaagaagtgaagggaaactttggccgcggaagtattgtcgcggaaagcgacaaatgatatattttgataataattaatattttttcctttcattaatttagtatttttctctattttttattttgtgtgttactggttctctccctctttctttctctctctctctatgcgcgtacgcatgcgcacgcgtctctagggctataaaagccgcaccattcgcctattggggcacttcttctcacttctatttaatatttatatttaatcgtcccttctccatttattcacacatttatttgtgacta

SEQ ID NO: 73143 - DNA, 817 bp, Heterodera glycines
  Genomic contig location: Contig_ID=SeqID_1379; Location=6413..7229; Strand=-
  SCN-specific regions: Sequence locations=1-817
cttttatctcgaagaagagttcatgaggccaatgattttggtcctttgtgagccaattaggcccaccccaccacgaagaatgggttgagagctcttctggtgtagctcctcttgttgccagatcagccggattttcagctgttcgaacaaagtgaaacgaacactttgttatggtgcgaatttctttgattcgccgttcaatgaattttggttgggcttcttttgaagccacccaatttaaagcaatttgagaatcactccacaaataggagtgttcaattgctcggcgcaattgagtttgtatgaattttaagcctcgaattccaataagaatggccatcagctccattcttggaatagtgagtgctttcgaagcactctttggcttaaggcgattttttgagaaaatcaaccaattttgaattttatttgaactctccactcggagataaattgcggttgcaaatgtgtggatcgaagcatccacaaatgcgtgcaattgaagggagcattctccctgtatcattgtccttcgtgggactcggattcgcttgtctttccaagattcttggaaagcattccagcgagtcgagtcctcttctgagagggcatcatcccagcctttcttttcctcccataaactttggaagaaaagttttaaaggctggatgcatgggcccatcaatcccaaaggatcgaataaagaggccaaaaaactcaggacgagacgtcgattcactatctttaatgaatcgacagatgggaattcaaagacaatgtcgtctttgtcaatgtcccaaataagtcccagcacttt

SEQ ID NO: 73144 - DNA, 6145 bp, Heterodera glycines
  Genomic contig location: Contig_ID=SeqID_1379; Location=3295..9439; Strand=+
  SCN-specific regions: Sequence locations=1-519,558-784,806-944,966 -978,1005-4006,4043-4183,4205-5574,5596-5624,5646-5686,5708-5766,5798- 5864,5886-5969,5991-6006,6029-6032,6056-6145
atgagtgaactcttacgaatcacaatcgcgccgattgtgaagcgtctcaagttgtacattgagacggctcaggaaaatctgacaaaagatttgactgaggaaatcagaacagatttgcttgcagagagacaaaatctctgtagagcagtatcattgttggagaaaaacaatgacaagtgggaggctgtcttccaccgagttaaaggtcctgctcttcaggaagaagagcagaactacaaggactacaaacctgaaggaaaagccttcatggaatgggccgaccaagcccgagggcttgtcgacaccattgatggggctttaggcctctcagaacagggggacgatgtcgttcaccctgcacaggtccaacagcctgttcaaaacattcagccacaagtggttgtggctccgcagcgacatgaagtgatgttgccgcccatttcgcttccaaaattttcgggtgaaccccgagaatggcctttattttggaagctgtttgagacttccgttgaaagtcttcaaattgaagacttcaaaaaacacatttatctcttgggatgtcttcccgagaagtcagttgctcgaagagcaattgatttgtacccgccttcagatgaaaactacccgcgagtggtagaaatcctcaagaaaagatttggggatgagaagtcaattgtggagacactccaatcagagttgctccatcttccaaaaccgtcagattcggttcaatctctgaggcagttctcagagtccattgaaaggatttgtcagcagttgtcagattttggagaaaatgaacaaaataagttcatggcctccacgataaagtccaaattgccataccatctcctcactcaagtggtggagaaggaaatgcgttcaggtggaacatttgattgttccgacctacgcaaggcaatcacttccattgttgaagtgaaggaagaagtacaaagatgtacacaagtcttccgtggggaagaaaaaccccgaaattttcctcctcaaatgcagaggaacaatttccaagggagaggaacaaatttccctcccaaccaatttcgtcagggtcattggcgacccaataacagaaatgagtctgtggggatgatgtctccccaaatacacagatcatttaacactgtcaatcagagggaacaaacacacttttctcctcgagaacgaggaacgaacccactttgttctctttgtagtgacatgggacacgcaccaagcaagtgtccaaaatatccaacacctggagcacgcagaaggcggcttgcagatcaacaacgatgttttaattgccttatgcaagggcacaattctcaacaatgcagctcatcaaagaggtgcccaaaatgtggtgaaaaacaccacttcatgatctgctattctgaaggagacgctccgagaggaagcactcctcaacaaacatccaaaggaggggctgttcaaaagaaacagtcctccaatagacgaggagaaccacctcgtccaacacaaaatcatttttcggcattaaatgaacccttaagaataagggaaaatccgtctgaaatatcaatttttgacggaaaaagaacaaatgttttaaccagcgttgtgacaaagaagtcacacgcgtttttgatgacccgacgattgagggtccggtcaagtcgcgatcctcgtcgaatgatcaaagccatgtttctttttgacccggcgagccagacttcatatatgtctgacccgctaatcaaaaaactgaaaccacataaagtgacttccgaagaaatggaagtctacggtttcggtggtgaaaggaatggaccaatacggttccattcacctgtctactccgttcaaattcaacggagtgacaataagtgggaggaaatcctcctcaatcgaaccgagcaaatttccactccattcaaaatggtggagtggaattcacatgattacacatcggaggagcaggatgttttccaagctctaagtttttctcaggacgaacctgagattctcataagtgctcggcacttttggaaatttttccaaagcaaaaaggaagttttgcctgggttgtttgtcatccaaacaacactgggtcctttagtcaacggagaatcagactttggaccaaatgttcaaaatccaggactgtcaatgatgaccattgatgagtccaatcaagagcagatgccagctactaaagaaattgaatatttctttaatttggaatcgttagggataaaagaagaccctaacgaagacgatgatcaaacagcaatgcagctgtttgacaaatcaatccgtcgtgaaaacggcggacgatattcagttaaatggccatggaagaaagagacaccgaatcttccctccaactacagaatggctttctcaaggttaatatcgactttgaataagctcagacattctcctgaacttatacagcaatataacaacacaatccacgaccaattatcaaaaggtatcattgaagaggccagggaagcacctggcactcttgagcactacattccgcatcaaggagtgttggctaagggcaaaaaacttcgcgtcgtttatgacgcgagtgctcacacaaggggtacaaacagtttgaatgactgtttgtacagaggtccggtacttttacctgatctcatcggaatgcttttgcgattccgatgccccacatttcctcttctcgcggatatccaagctgctttcttgcagatttatttctttggaaccagaagatagagaagtcacaaagtttttgtggctcaaagacacggaaaagccactttcatcggagaatctgataatatacagattctgccgagtcgcatttggggtgattagttcaccttttatcctagcagctacactacaatatcatctaaaaaattgtcgttcgattttggctaaagagttagccgaatcgctgtatgtggacaatgcgctcatggagtgtgaaactccagaagaggcattaacaaaatataaggaagcgaaggctatccttaaagaaggctgttttaaccttcgggaatttattacaaattccaaggaggtgatggaagccatcccccctgaggacagactcgagaaagccaaagtgaaagtgctgggacttatttgggacattgacaaagacgacattgtctttgaattcccatctgtcgattcattaaagatagtgaatcgacgtctcgtcctgagttttttggcctctttattcgatcctttgggattgatgggcccatgcatccagcctttaaaacttttcttccaaagtttatgggaggaaaagaaaggctgggatgatgccctctcagaagaggactcgactcgctggaatgctttccaagaatcttggaaagacaagcgaatccgagtcccacgaaggacaatgatacagggagaatgctcccttcaattgcacgcatttgtggatgcttcgatccacacatttgcaaccgcaatttatctccgagtggagagttcaaataaaattcaaaattggttgattttctcaaaaaatcgccttaagccaaagagtgcttcgaaagcactcactattccaagaatggagctgatggccattcttattggaattcgaggcttaaaattcatacaaactcaattgcgccgagcaattgaacactcctatttgtggagtgattctcaaattgctttaaattgggtggcttcaaaagaagcccaaccaaaattcattgaacggcgaatcaaagaaattcgcaccataacaaagtgttcgtttcactttgttcgaacagctgaaaatccggctgatctggcaacaagaggagctacaccagaagagctctcaacccattcttcgtggtggggtgggcctaattggctcacaaaggaccaaaatcattggcctcatgaactcttcttcgagataaaagaggaagagttacatgatccaccgaaagaagatgaaaaaatatttttggctcatacatgtgcagagccaaaacagcaattatttaatgcaaagaggcaccattcctggaccaagttggtcaggacagttctctttgtaatacggtttctccatttgaaattattaaatggaagagacccttcagagctcacaaaaaagcaccggaaggaaatcgtcaaggtttctaaaaccggaccattcacagcagaagatgttctgctggctgagtaccttataattcgtttggatcaatttaatgatccagatgaattcacaaaatttccctcactaattgatagtgaagggattctcaggctgagaacgagattaacaagaagtgaccaaccttatgggttttcacatcccatacttcttggaaagaactcggaaatccgagatcttatcattttgcaatgtcaccaaaaaagacatcacctaggggtggacagcacccttacggaatttctcaacaattattggactcctcagtctcgaacggcaataaaaagggttataaaaaactgccgtcgatgccgaaggatgaaggcataccaatttgccttaccaaaaatgcctccactgccggaggaacgagtctgccgacaaatgccctttaagtcaattggaattgactttttggggccaacagagacacgattggcaggagtgaaagtcaaggcatggataattatagtaacttgcctcacaacgagagcagtttacttagaagccatgcttgacacaacggccgaatcttttttaaatgtcctccgacgattcattagtcggaggggaaaaccagacttaatttggagtgacaatgccacttcatttaaattgtctcaaaaaacgattgagcaattgacaactccaaagggagttgagcaaaacaaagatgaatttcttgcacttaataaaattaagtggaaatttatcgctcaaattagtccatgggcaggtggcgtttacgaacgcctcgtgcaattatgtaaaaattgctttaaacggacattggggagaaaaatcctcaatttcgatgagcttaacacttttgtggccgaagttgaggccactctcaaccatcggccaatcactgttgtgtcagagggagcggatggcattcagccactccgcccccatcgacttacttcaacccgatttacagataaattgggagacaacgacggaagaagccgatcccaacgacaagcaaatctcatcctcggagaaattggctgctttatttaaagcaaccagagaagcccatgaaagcttctggtacaaatggcataatgagtaccttctccttcttagagagagatctaagtgggatcacaaaggcgctcatctcctagataaaggagaaccaaaagaaggaatgatcgtcctcattcacgaggagttcactcctcgaaatcagtggactttgggaaaaataattgagcttaatggcagaccaggtgccattagaagcgttcaattagaaatgccaattcatggcattaaatcaaaaaggtatggaaccatgcctcgaaaagtcgttattacacgaccagtcaacaaaatctttccattagaggtaggatttgaaaatcttaccgaaaatggcaaagaaaatttgaaagttaacgaagacgaaactgcgaacagttcaacagaaaatacaactcctcatttgggaaataaattgccaaatgaggagcaggaaaatgaggacaaaaattctcatttgggtgaaccaaaagccaaccaaaacaaacatggaatgattacccgcagtaaagcaaaagtgatgacagttcttaactgtctcactattttctgcatttttggattggcaggagcctatccaacaaatcaatgcaatgagtgtaaactcatttgctcaaacaaaggtgttttggcaaaaattccgaaggaaattcggaaagtggaactttgctgctctgagaattgttacattgatgagaatgtacacaaactcacatatgagttgccaaaagaaatcctcctaaatgactaccaatgtcaaggtcatttttggatggattcaaagcacatgtttaaaaaggacattttatgtccagcagtcgatgagtgcgtactcatcgaatgctatttatgcatggaacaattggcaaatccaacgtgttatccgttggtgtcctccat

SEQ ID NO: 73145 - DNA, 810 bp, Heterodera glycines
  Genomic contig location: Contig_ID=SeqID_10076; Location=15..824; Strand=-
  SCN-specific regions: Sequence locations=1-257,288-439,461-810
gctaaacaattcaccaccaagcacggcttcacacaaaaataacaaggtacgttggataaagcaatttcgagagaacgagaaatttttattatctgccaacttgggtacctttagacaaaaaaaattctataaattgcatgaaaatatatttgtaaattattaaaacgcatatatttttattaaactcaaaatctatttgaacaaacaatcttggtgattttcttttactcaagatgatactttttcgaggccgctgattttgaaagtttttaaaaaatatatccataaagaggccagccaatcaacattctgtttatgtttcagttcgacgatgttaacaaattcatttgcataattagcactatgatgagcatgttaaagaacgtaacggtaagtgttcgatttttttgcttttatatgaaattggggggttgaatataaaataattgatatttttcattaaaaaggtaatctaaaaataggaggcatgaatgacatttatttgtgctttgtttgattaatttcgaaaattttcattaaaaatgcattaacgaaacattcaccaaagattgtctttaacttggagctcatttagtgatcatagattctatttcccaactaaaaactcctatacaatttcagtattaattatactctaaatttttatagcacattaatcttcacaaagaattgacctgcatggattcaagcggcacttatcgtttggcattcccttccgctgcagcgcttctcactttcatttacaaaaattgcccaaacattactacattcaatgtctcaaacgaagaa

SEQ ID NO: 73146 - DNA, 742 bp, Heterodera glycines
  Genomic contig location: Contig_ID=SeqID_10077; Location=552..1293; Strand=-
  SCN-specific regions: Sequence locations=1-18,40-86,108-145,184-742
atgggaatgaacaccatgttactaaatgcaatcaacgttgatttgcctaaccgcagtgcatttgttactggtggtcgatcaaagccatttgtaactgaagtaattttttatttgatttttgctgtaaatttattacctgcgccagttttaataatttttagttttaatttaaaagaaaattttcaggaaagatacgcaaaccgatgggccacgcttctagaaacaggaacaattcagaaataccatggtatatagaaaattctcatttcattattacattcctcaaaatgagttccataaaatttatctaccattttacacctaattgaataagttttataaaattaaaaagagacaattttctacaaaaatgtgtcgtaatataatttttttctttttctttagaatggtttttttcttttttaatatattttttcatcggaacccttttttgtgtttttaattaagtttattcgtgatttctctataatttgcgccctttctcattgctttttttttattaagccattgctcgtgccgctcatcaaaattactcctttcacggttttacggatgatgttcgtttttatcaacaatttttgatgaaacgagagacggagcagttctacaaacaatcgtaataccaaactgaggatgcaactaaggctgggcctaactgattttaaacgcaaatccttaattaccggggcctaaaaacaccgattttccgtcatttaataaa

SEQ ID NO: 73147 - DNA, 1658 bp, Heterodera glycines
  misc_feature (18)..(18): n is a, c, g, or t
  misc_feature (153)..(153): n is a, c, g, or t
  Genomic contig location: Contig_ID=SeqID_10078; Location=775..2432; Strand=-
  SCN-specific regions: Sequence locations=1-332,354-424,446-498,520 -677,700-1065,1100-1115,1140-1233,1256-1270,1316-1358,1380-1500,1528 -1658
atgcggaaattccaagtnaccttaattggacaacttctttgtcaacgacgaccagtcgcctttggccccttatggaacagaaaaggtggaatatcagatggggtgcgtcccttcctaaaaagttctcttttcgtctacccctcccatccttgntgcactatttcttttcaaaattggtccaaatttttttgcttttttgaaatttaattgtaaaaaaatatacaaaaaattcttttcgatttaaaattgtgcttctcaatgatggaatgaaaaatgcttctacagtatataagctggattttctaatttataaaagtatttgcggttgcgaattcggtactttttggttttgtgacccctctccacctgaaattttcaaataaaaagtcatttcaagggtaatttggggcgctgatcacgaatatgacatttatttttcaaaattccgaatcccgaacctgaattcgaacaaaaattcgaaattcataaattacaatgaaaacatattttgggggttttcgaggtcgctgaaaactgctatgacatccatttgaccaaattctaaacccggactctaacaaaaaaaaaggaaattaattctcgacaaaattcaaaatatgcaaaaccgacgcatgttatgggtcctcaaaatcgttaaaactatttttaaaccatagtcagaaattggtaaaagaacgtcaaatataaaagattgaatttgcttattgcgctaaaaaaccgccgcacactcgactacggcggccagtaggtggggcgagactacgggctacggaagaagtatttttcggtactgaaatgtccattttcactgggacttagttggcccagtgctcagatggcgttggttcgaatctataccttgttttttaacttagctcatcaagagatttcggatgataccaaatttgtgtgattttgaccgttttaaaagcttaggtgcctcccttttcactcaaattttcaagtcttaaaccggttcaaaaccggtttaaacgctttgccgcgcagtttttttatggtttaggcgttttcagcacctaagaaaacctataaaagtatttttatgcaattttgagtctgggacctatgatggatattttaccttttaaattttttagtaaattaaacctcggttttttgttcaagtcagggttcgagtttcgaatttggtcaaaaggcatgtcataatcgttttcagcgacctctaaaacccctagaaatatgttttctttgtaatttatgaattagaatttttgttcgaattcgggttcggaattttgaaaaataaatgtcatattcgtgatcagcgcctcaaattaccctagaaatataagcttattcagggtgctgattttgaatatgatatttatgaagaaagtgaaaacggcgtccaataaaggcttactataaatgacggacattgggcattaattgaaatatatttgaatcttcaaacgaaattaaaaaaactctgttagcataatattttattaattaattttaaatgaacaaattcaatcaaatgaattgtatcctttccaatttttcagttgcacgagttgaacaaatgccaaatcgatcgtgccaaaatgccgaccaatgcccttcattcgaaccgcgcaaattcaatttatctg

SEQ ID NO: 73148 - DNA, 794 bp, Heterodera glycines
  Genomic contig location: Contig_ID=SeqID_10080; Location=331..1124; Strand=+
  SCN-specific regions: Sequence locations=1-179,264-284,313-539,562 -572,594-624,651-794
atgccaaaagcattaaaaaaggacgccgagttggcaaattgcatgacgtgggtgaatattgatcgcctttgatgggtatgcgacacaacagttgtgtgtgtggtaaacaaagggagggaggctaagacatcaaagatcatttgatggccgaccgtgcaaacagacgccgccagcaagggaaaaaattttaaaatttttttggcacgtttggcaattaaaattttaaaaaattaattaaataattaatgataattattattattcaatatgtactgtattaagagaaaaataatgaaaaattatttttttattcctctgtgggggttgaaccagggcaaaacgcaaaaatgaacgcaggcttagccaataggctacaagcacattgaccgaaatgactttcaagcgttatatgtatgaaacattttttcacaattaaaaactttattcctttttccgaatttccatcaataattttgagttcgttcttcattccgaatctggacctaccggggtcgaattttgggttattttatgcgcacaatttttcaaaaataaaattaaatttcaggattttaacattttcactaaaaatgaatcatactcaaattcgaaaagcattctttttaggcttatttatgtatgtatgtacaaatcagagtccaactgatttttttgttttgccaaaaacaaattccaatgataaattcaatatttttgattgctaaaataatacgtaaaatggtggtccaaatgaacgggatcgaaacatgggcttcgagagtgggtttccggga

SEQ ID NO: 73149 - DNA, 853 bp, Heterodera glycines
  Genomic contig location: Contig_ID=SeqID_10085; Location=330..1182; Strand=+
  SCN-specific regions: Sequence locations=1-12,67-326,348-853
atgttgctgctgctcctcctcctcctcgacatgttgctgctgctgctcctcctcttcctcctcctcgtcagagttcccctcggtgcgcactaccacctccacaatgggcgatggaacccgggggaaaacctggtcctaaatcaaaaatttggctgttgccatgtcatgactcatcattaccaagggtaccctttctgcattgcgcaccccgaacacctcaaagttctcagggtgggcaccaccgacccgggctatttcgctaaattcctgatgtttatttgctgattttcgccccaatttcctcacatttggcgggccctctcgatgtcgatggcaccaccaacagctgcatgggtatacacagcgtccatcagacgagcgagggtatacccaatctataaaatgcatttcaattcttaaatccccgttctcgctaattttacatggctgagaacttcctcatctttgaggtactggtggtcagatgattggtacctaattaggtaccaatacctcacagcatcgcagatgagacatggcgccttgtcgtacagggccaaagacgtcacttcatactcagtggtgccatcgtcctcttctgctcgatcgtcagcgtcctgatccgggtgtcgatgttgacactaataaataaatttgtccattaaaaatgaggtagttgcgaatggcttctaactcattttgcactcaaaattatgaaaagatctatctcgggatgagtcaaattatcatttttgcctataatccataatttcacaattaatttagacttattagataaaaattaccccgaccgtccctaatcgcaatttcaacaaattttataacacattca

SEQ ID NO: 73150 - DNA, 893 bp, Heterodera glycines
  Genomic contig location: Contig_ID=SeqID_10085; Location=1456..2348; Strand=+
  SCN-specific regions: Sequence locations=1-148,175-186,209-603,642-893
atgcagtggattaaattcaactgcacgctttgcccaagtggacttcagtgtttctatccgcgcaagtacgcaaagcctgtgctttgtgctcatcccagcgtccgtaacatcacggactttttgagcaccgggcagcttggcgaagctgcaacgacaacaacaacaacaacaacatttccgacaactgcggaggtgtcggcggcggcgacagaatgcgcacctccgcccgtgcatttgaccgcgtggatcgcggtgtgcacagcgctggtggcgcttttggtgattgcggaggtctgttataattttggtcatttatccgctaaacccctattcctcaattaagcttgtgcgtgccggattcaaagtgcgcaaatttttgaaggaccgcgccttcaaaaaggggatgctgcgccgacatcgccagcgtgagtttctcgctattacatttttagcaaattgtaattaacaatttgtacaggaatgagcgccgcaaggcgcaaccgccagccggcaagcgcgccgactccgctcattttgccggctatgttggccggcgtttctctgcgccagacgggcgtcaatttgactgtggaccgggtgggcaattttaattaaattaaaatctttatatattttaatttctcactcattaaaattacaatttaaatttaaaggcagcggggcagcgccgcgcggatggtgcaattgaggagggcgatgagcccgtgtacgatgaggtgccgcttgacagcgacatcgtggtcgagatgcgcgatggagaaaatggggaggaggaggaggaggaagatgacagcgatttttagtgattcggcaagcgatcaaccaccatttattcaatcgatcgattttgcactaatttaaccatttaaaaa

SEQ ID NO: 73151 - DNA, 851 bp, Heterodera glycines
  Genomic contig location: Contig_ID=SeqID_10085; Location=2578..3428; Strand=+
  SCN-specific regions: Sequence locations=1-311,333-350,373-403,426 -591,612-618,643-813,839-851
atgtcggataaaaaagcattgttcaagcgtgttatcgcagaggtggacctcactataagcacgggcggcataaccttgagcggcccccgcctgtctgttccccgtttcattccgtttgaggaaaacgggcgttgccgagcatgtaaaggaactgaggctgaggtggacacaatggtcaccaaggagggaatcaccttatggtgcacacgcatagaaaaagctcagtttgtcccttttgacgttgtctacgagcttcccggtcattgtttctttcgcgtgaaaaataaggcaagggtgttcagcgttccgtacagcgaactgccgtcctcagacaggtgcacccagcctctaccaccaccaccaccaccaccaatgacaacagcaaaacatcaacggacaccggacgacgaggaggaggagaagaatttgaggcgtaaggcaaaggtggcgcttgacttagtggaagctggtctagcggcagacgcaatgatgcaggatgggacgcgttggaagaaagccaaaaccgcgatcaatgtgctggccaatttgcttttggcggaatcattaacagatgtctcgtcaacttttgatcaacaacaacaacaacaacagctatcgtcaaaagaggaggagaaggaggaatgcataaacaacagcagtgcttcagcacaactgaatctgctcccgatggtgatgtaatgggcgatttcgtcaatagcattcaagcggcgacaagcaatatgcaatagcaaaaaaagcgcaaaactcgctctgccctatatataaaagttgttgattgctgcacgatttgtcataatttttgaaaatgttaaattctcaatcgttcagta

SEQ ID NO: 73152 - DNA, 445 bp, Heterodera glycines
  Genomic contig location: Contig_ID=SeqID_10085; Location=3670..4114; Strand=+
  SCN-specific regions: Sequence locations=1-52,74-346,369-409,431-445
atgctgctcattctcgacgatctgatgctgtcaatagaggagcgctatctgtctgatttgttcaccaaaaaatcccatcaccatcagtttgcggtagtgttcatcactcagaatctgtttgagcggaagatcaaggtggctcgcctttcggcgcagtatttggtgctaatgcgcgcgcccaactcgctgctgtccattcgaaatattggagttcagctttttccgcgtcaactcgattttttccttgacgcctaccgcaaggcgaccgctcgcccctatggctatttgctaatcgatatgcacgcatcatctgatccggcgcttcgcctccgcaccaacatatttaaagaggagcaggaggaggacgagggaacagttgtgttcatccccaaaaatggagcggtataaacgtcaacaacaacaacaagctaaagttagtcaacta

SEQ ID NO: 73153 - DNA, 1292 bp, Heterodera glycines
  Genomic contig location: Contig_ID=SeqID_10086; Location=196..1487; Strand=+
  SCN-specific regions: Sequence locations=1-250,275-1292
atgccataccgtatcccaaaaagggaaccaaaagtcgaggaagcgccacaacagcaacaacctcttcctgctgccgctgttgtcgtcgaagaaatgcccgttgttcctccgcctaggaggggggccaaacgtcgctaccccgtatatgaagatgatgaggtgcagataagaaaacgagtgagacaaccgagaagggtaagggtacagtactcacccgagccaggcccatcgacatctgcacaaagtgatgaacaacaacaacgacaacaacaacgcgaactgtttgccattccatcaaatcagctgaccatgactcagcgggttgaacggctatacatcaaatgtaaccattacgctgatcgtatgggcgttcgtggaaatacaattaacaccgcaaacggcaagccgttggtgcataccaatttgcgaatggccatccgctatataatagacagaagagcgggccgccccaccattagaccaccaggagcggccatattggaagaaaggcttcagcaggacccaattctgtattcatggacggctccaccaaagagaccgtcacagagcaaaaccacgcggaccgcaccaaaaatcaaaaaggaatttcgtccgaaaaaatggagctgatcaacgcaacgcttgacaagctgtataacagtccatcgtcgcccgcggcgttcgcgggcgttaccgcgctgtggaaagaggcgcgaaaaagtatcaaacatttacgcaaaaaggacgttcaacattatttggaggggcaccgcacatacactctgatgcgcccccgtagggtgcgctttccaagggccagcactgtagcggcaggattcatgaccgatgtccaggtggatttggccgattttcaagcgctatcgcgacacaaccggggtcaccgctatctgcttgtcgcggtggatgtgctctcaaaacgcctgtttgttgttccactcaaaaataagagagccgaggagatgttggaggcattcaagctgctcatcgatcaaatgcccatggccccccaccgcattttctccgataagggaaccgagtttaagaacagattgctgaaggacttttttgagcagcgagaaattgagaagcatgaacccgtgcattcatcggtcaaggcgtcggtcgccgagcgggccatccgcaatgtgaaacagcggctgtaccggtattttgcggaaacggagacgctgaactgggtggatgcagcacagaaaattgtggacgggattaaccgctccccgtcacgtgcccacggaatgcgtccgattgat

SEQ ID NO: 73154 - DNA, 2382 bp, Heterodera glycines
  Genomic contig location: Contig_ID=SeqID_10089; Location=908..3289; Strand=+
  SCN-specific regions: Sequence locations=1-33,56-322,344-946,968 -1021,1085-1636,1661-2108,2141-2196,2227-2382
atgtgtggatacaccctgatggtaagtgtaaaatcataaccaaacccatttgaaaaacccgattgtccatgcctctgatcaatcagaatcattgtcatcgccatttcataaacataatttgatcactccgctccccttttgctgatcagatggctgctactcattggtgggccgtactggcgggtcggttttgaccgcacattttccattcgatttgcttttgtgtataaaatttgatcggtgcccacagacgacagccgttgagcttggacagcggatgcatccaagtgggcaccgttgtgcacgagctgatgcacgcagttgggtgggtaaaagggggagaagggcattcattgatcagtgccaagagagagagagagcgaaattgatggcatacgagtgatttgccgagaaaatttgtatacagattagagacagggggacgggccgagatctctgttcaggctgatcagtattgactgcgttattgcattgatcaattaattagatcgaaggccgagcataaatataggctctgtctaatgtcaatatcgaggtcggaaaagcaaggcatgtcgagactgatcagtcgtgatgaaagtgatcaggctggaagattgaatgctgacttgtacctttcgatatacataaatgtgatcttcatccattttatagtcaggctgtttccgaaagcgaaaaatgccctaaatttttgatttgaatctcaaaatgccgtctttttggcgaaatttgtccccttttcttctttacagcttcttccatgaacagtccaggtacgaccgggacagtttcatccaaattctgtggtccaatgtgcttcggggagcggacggtgagaaaagcgatttcaggggcagaaaataatagggagtggtcgagacaatgttcagatcaattcgaaaagtacagcttcaataccatcgaccaggttaatccatggcattgggaattaatggatttttttcttgcagcttggcgaaccgtacgattacggaagtaaggcggggggggggggggggaagggtgcaagggtgagagcggggaaagggtggagaacgggtgccaatgaaaaggcggcgagaattgtcccgaaaaattattctcgaccccaagtcgagattatccgggttaattgtcggaaatttaatcacgaccaaatgaatcgatgatcggtcacacggggtactccagcgaaacctcgacggagtttttggcattgtgccttcgagctttataatgcttaccagtctcggaaacccttcattctcgagggacaactctcgggaaccgagacgggaatgggtcttacaaaattctgttcaatcccacgctaccatacccacacaaataccccctaaaaaggcataatgcactacggagcgtacgccttctcctcaaatgggaagcggacaattgtgccgcgcagaaacggcgccaatcgaatgggccaacgggtgacgttcaggtggatatgatcagtagggcataaaattacatggaaattataataatcagaaaatggaaaaaaaattttaaatttgttatctgtcgctagattttatcaattaaacgaaaattttcagaaataagttaggttttatagaatccttgatcgaaatacattgaaattttaaaaattgggtcggaggaattcgaaaatttgcacacaaaaaagtaacaattattttgtaaatcattaccaaaagtgaaattgacctacggaagatcaacaaattgtaccaatgtgacaagcggacgccaaacacaaacagagtcagtttaaggggacttaatcagaaaatgactgctttttaatgaaagggacggcaatttacaaagagtcgggatcagagggtacaaccaagagtgaatcgactaagaaacccaaaccttcattgattttacgggggaaaacccaaaaatccaagtgaaattctgatagagttaagaacctctgatcatgtccgagccttatttgatttcggaattcgaatacaaaaaaacacctaattaaagcaattagctttaattaataattaatttcttgcatatttaagtgcaaattttattcattttcctgggaattcaataaataaataaataataaaaataattatttccaggccaatgccaacagcagaaattggggtcaacaacaacagcaggtggttattttcacaaatgccatgccatttaatgatgcttattaataatgcctttgtttttttttctcgctgctttcaattttggttgatcgctgccgcttgtatttgtgcttttcaatttcagtttaaggctaaaacgatagcaccggcattctcggggatgatggtccccggcccaacatctcaaaagtcccaa

SEQ ID NO: 73155 - DNA, 514 bp, Heterodera glycines
  Genomic contig location: Contig_ID=SeqID_10091; Location=646..1159; Strand=+
  SCN-specific regions: Sequence locations=1-201,229-398,450-514
atgggcttttcccggctgattctgatcactctgatcagttgctgtcttttgccattggcatccgttgttctggcacaatgtccttaccaggggtggacagtgagcggatcctgccaaataatgggatattgtgtagaccccagggataagtgctattacaggagttcgtgttgtaagttttttttgctattgcattattggttttaaaaatatatttttaaaaaatttcgtttcccatctcagctataagttaacaaaaatattataggtcgaatttcgaatcaacagtacgcgcagacaacaaagcaaaacccgaaaacggggctaatggaaacaaattactgccctttgggggcctacagagatggaggtcattagctaattagtagggatgggtgtaatttatagaaatgtatttttaaaaagaaaatttaaatattttaatttttcataaacataaatctcatcctaagtgattagcatacgaaatggcattttaattatattcacaaaa

SEQ ID NO: 73156 - DNA, 534 bp, Heterodera glycines
  Genomic contig location: Contig_ID=SeqID_10091; Location=2773..3306; Strand=-
  SCN-specific regions: Sequence locations=1-534
atgttcaggggcgggtcaactggtgaggaacaatcaaattatgttgcccttgatattcaaattctcaaagtaccaatgcttcaatgccgtgccgtggacattcacacgtcctcaccgctggcggggctgggacagcgcgcaattgccgtaatggacgacggggactttggcagtgtggacgacgtgcagcagaaataccgcaggacgggaagtgccggtaaacagtgagcaggcatttcattggaattacttgtaactttttccaggcacaaacattctctaccgtatccgtcgagaagagcttgcccaaggcaaacatccgacagttcgtcaaatggcccgcgcttttgaatcatttgaaaaactccaacaaaaggggaacagcagtgaagagccaaaacggaaaaggcgagaaaaagcgaaacaaaaattgttggaagggcaaataatttcagaataaaaccgacaaagggcggactattcggactgttgggcaagtcgagttcgatggaagtcagctcaatgtcggaaaag

SEQ ID NO: 73157 - DNA, 681 bp, Heterodera glycines
  Genomic contig location: Contig_ID=SeqID_10091; Location=1284..1964; Strand=+
  SCN-specific regions: Sequence locations=1-70,92-169,220-236,258 -316,341-462,484-608,678-681
atgtgttggacgccgagccaagtgtgcgtcaatcggcaagactgttgtaagtgttgccaattattgcttaattttttatgatagtataattggggggggggggggtgataatgatgaaaaaatgtgacttaatagaaacagcgggtgcacgacttcccccgcctcccgcaaaaaataatataaatttttagttttaaacttttttaaatattttttttagcataagaaattatgcttatgtttgaaaatattgcttagttttttattattagaaaaaaaatttgtttacgagaaaaaaacctctaagaaagacagaaagggaaaaaattaataaatttttcggcgggggggggagacaagctgctgctccccatcgcaccatcctgcaggcgaaattgttaatttaatggatgttaatttgcttttatgatgtttaggtgtccaatcaaacattccggtgaacagcaacccctacggcccgactaataccggaccaaatacgaattatcccggatttaacgcttacaacccgggtataagcggtgaagacacctgcagacagggccaaggacaatgtccgttgacaatgtgccaagacggatgtgagttttatttcttgaaaattcaaataaataatagtaagcaaatggacatttatttttaaaaaacgaaaagaaggga

SEQ ID NO: 73158 - DNA, 582 bp, Heterodera glycines
  Genomic contig location: Contig_ID=SeqID_10092; Location=367..948; Strand=-
  SCN-specific regions: Sequence locations=1-17,39-582
atggccctctctgcccttctgcttcttctccccctgcttctcaatgttcaaaatatcccaggtaaatcccttttcctgcttacttggatattcccatttgttgccccttaagatgagtcagtccaatcggatatgaaggctgtttattcggctatttcatcgccggaacaatggaagaactcacaaaattcattggcttcactcgaatcacaactgacagagccccaaagagcactggcaaaaatgcattgggaattggagaccatccaaaaggaaaagccggaggcaccgccacaattcgacttgggacttttctcggaagctttggaagtgatggtcgaaatggacgaagaagcgaaagaagtgaagctgaggaaggacaaactgattgaatgggcaggaggagaggaagcaaaaaaattgaaggaaaagatgacggaggaggacacagtgccggaagtgagggtgaacgagaatggtaaggttgaagtgaaggacggcgccggaggggaaggacggttggaagtcagacgaacaaaggacgagaaaggcagagagcaggtggtgatcacccttatgtag

SEQ ID NO: 73159 - DNA, 1159 bp, Heterodera glycines
  Genomic contig location: Contig_ID=SeqID_10093; Location=239..1397; Strand=+
  SCN-specific regions: Sequence locations=1-103,125-243,265-266,288 -310,332-440,463-486,508-634,691-845,867-903,926-1018,1040-1159
atgaagcattctgaggttgctgttgcatacttgcaaatgcttcatggtcatgtcttggctgtgcatttgtcgtattgcttgtcgaagtgtcagcgttgctggccagtttgtcacaagcagggcaattgctgtttctttttcgccttaagcactggttagtgtagcaattgagccctattattaaacaaattatattaccattttttcatgcagttacgatgaaattcatgctgaaatatttgcatattaaattaaaattaaaatgggtatgccaattcaaacatggcctaaactttgcgagcctatcaggttaatattttttataaattttgacttgatataatttcttgggtttttgtatcccaagcggctcacttacaagatatgctctatctagtagaataaaaaattacttcacatgacaatgaaacaattctttgattttcttttttcatttcattatcgcaaatggggcagtcattttccaccaaagcacctgttaaaaaatattaacttaatttgcgttagtgtttcaataaatttacttcgagcagttcccaacagaagaaaaagaattgccaagaaaatgaagtgtttaggaaaatgcatcagatattaataaaagaaatggaagatatttttaaataaaatattaaattataaacaaaaaaaaaagaaatatttttaaaagaaaatcacgaaatattagttcaaaatttatgaatattacgaatatgattaaatctttctgattagtaagaccctgaaacgaagacaatattaatatttttgaggtcatatttaaccttacatttagcaaatatgaagaaattttatacactcaatttggaaaattatgtccaaaatatgaggaagggacgagggaaattgaggattggatttgggggaataaggaataagccaaaatccgggccctggataaatgacctccctaaattggtaatcccatgggcgcctactagatctaatacgcgtgcggggatgggtgagaaggagcaaaataataatataaatatttgccaattacattaataataattccgccgcgttctgctctcgctcgccgattaactgcccgctcaactgactccttatcgagagaatgctcccgattaaatagttggacttatggaacgga

SEQ ID NO: 73160 - DNA, 1034 bp, Heterodera glycines
  Genomic contig location: Contig_ID=SeqID_10094; Location=1517..2550; Strand=-
  SCN-specific regions: Sequence locations=1-72,94-782,806-1034
atggcaagtgatcatttttggtccgcccgaatcgccctagtgagtttgctcaaaatgagacaacgcatacctattttacaaacagtttcccctttcacattttagcgaaggtggcacttttttggcacaactcgactttccgacgagttacccgcaacaaccgccgaagatgcgatttctcactaacattcttcaccctaatggtaaaccgtttgcatcaaccgttccttcatcatgcttttcctctccctacagtttacagggatggctatgtgtgcatcagtattctccacccgccgggcgacggaccgtttggcgttgagagagcggcagaacgttggcagcctgtgcacacggtggagtccatcgtcatctcagtccaatcaatgctttcggagccgaactttttgagccctgcaaatctcgaggcactcgtaagaagagcattcgcatgaaatgaatatttttaaactaattcccctctaatttcagctgatgtttcgcgtcaatccccagcggtacaatgagagggtgaaacaatgcgtgaaggagtcgaacgtggcgcttgaaagtgattaccgcgatattccaaacgatggaggaggacgccgtgcatcgatctaaccttgaaactgtgatctttttcatatgaaactcgttttgattgtacataatacgaatcacacacattgtccattcattctcatatgtatttattaatcattgtgtaaaattaaagaatttaataacttcgctttttctgataaaaaaattatatatccaggaaaaagcctagaatttgaaaatttgaggttgggaatcaggccgggattggattcccaggattcaaattctggaatttgggtcgaaattattaaaattaacataaaaattctcaagaattttcgaataattcgtatggtcgggaggccttacacgcacaggtgacattggaaaatttgagatgttgcaattggtggtaaaaagtcgggatctggatcagattccgggaaaatccacatgcggaaaataaa

SEQ ID NO: 73161 - DNA, 393 bp, Heterodera glycines
  Genomic contig location: Contig_ID=SeqID_10094; Location=1..393; Strand=+
  SCN-specific regions: Sequence locations=1-235,259-282,304-393
attcgagacttggacatttcgtgggctggacattttgtgggtcagcggccacactatgggtcaagcccagtgttagacaaaattgctcataacgccaaatagcgtaattggcgtaaatttttgcgcgctaattcaaacacactgatcactgccatttctgattgtttattttgatcagccatagctttgttcctctccaactaaattgacctaaattggtatctaaaataagaatttgaaaaggagaatctttttctagttaaaataactctacagttggccttatttttgtattaaatttccttattaatcgattcagaatttttttctctatcgtgtgcaaaatttggtggggttttaacaagcagaaaaaaagttaaacagcatgaagta

SEQ ID NO: 73162 - DNA, 236 bp, Heterodera glycines
  misc_feature (31)..(31): n is a, c, g, or t
  misc_feature (137)..(137): n is a, c, g, or t
  Genomic contig location: Contig_ID=SeqID_10095; Location=63..298; Strand=+
  SCN-specific regions: Sequence locations=1-62,84-148,172-236
atgtcacttatgcgtgtaagtaaggcctccngaccatacgaattattcgaaaattcttgagaatttttatgttattttaatatttcgacccaaattccagaatttgaatcctgggaatcctatcccggcctgattcncaacctcaaattttcaaattctaggctttttcctggatatataatttttttatcagaaaaagcgaagttattaaattctttaattttacacaatgatta

SEQ ID NO: 73163 - DNA, 624 bp, Heterodera glycines
  Genomic contig location: Contig_ID=SeqID_10095; Location=392..1015; Strand=-
  SCN-specific regions: Sequence locations=1-72,94-624
atggcaagtgatcatttttggtccgcccgaatcgccctagtgagtttgctcaaaatgagacaacatatacctattttacaaacagtttcccctttcacattttagcgaaggtggcacttttttggcacaactcgactttccgacgagttacccgcaacaaccgccgaagatgcgatttctcactaacattcttcaccctaatggtaaaccgtttgcatcaaccgttccttcatcatgcttttcctctccctacagtttacagggatggctatgtgtgcatcagtattctccacccgccgggcgacggaccgtttggcgttgagagagcggcagaacgttggcagcctgttcacacggtggagtccatcgtcatctcagtccaatcaatgctttcggagccgaactttttgagccctgcaaatctcgaggcactcgtaagaagagcattcgcatggaatgaatattttttaactaattcccctctaatttcagctgatgtttcgcgtcaatccccagcggtacaatgagagggtgaaacaatgcgtgaaggagtcgaacgtggcgcttgaaagtgattaccgcgatattccaaacgatggaggaggacgccgtgcatcgatctaa

SEQ ID NO: 73164 - DNA, 298 bp, Heterodera glycines
  Genomic contig location: Contig_ID=SeqID_10096; Location=679..976; Strand=+
  SCN-specific regions: Sequence locations=1-157,203-235,262-298
atggcattgaatgcacggcagagaattgtcgttctatgcttggtccggcacttttcaacatacgttttccggtttgtcaaacgtggaatttgcgaaggatattgataaaaaaagagattaaaaccaagtttaaactcattcaacaacgagtgtcaactttttaaaataattaatttaaataaataaaataaaaatttaatatgctttttcttatattttcagtgcattcaaaatgaaatataattttttaaaaattttattccattttttatccatggagaatattggcacaaattaa

SEQ ID NO: 73165 - DNA, 340 bp, Heterodera glycines
  Genomic contig location: Contig_ID=SeqID_10096; Location=1173..1512; Strand=+
  SCN-specific regions: Sequence locations=1-193,216-224,247-340
atgaatttaatgactacttttttgacaacaaaaagaaaatcttgggttcttatttcatttcatttccagtgagtcacaattaaaatttcccttaattgacccaattatggctaattaaggaactgtggacccgagcaaaggcttttacgacaaaagcgaggacaaagtgacattggccatcgatgtgacagtgaaagaagcaaaaaaggagcacaaataccaacataattttgtaaagtaaatgtttcggtttgaaatttacttgacgacatatttttattccgaaagtcattagagtaaatgttctcacattttgatggcttattttatttgagattca

SEQ ID NO: 73166 - DNA, 70 bp, Heterodera glycines
  Genomic contig location: Contig_ID=SeqID_10096; Location=3771..3840; Strand=+
  SCN-specific regions: Sequence locations=1-70
atgcaccagtctctgccattgtttctgccgcttttcatcttcttcgtctacgcgaccgattgtctcaacg

SEQ ID NO: 73167 - DNA, 1017 bp, Heterodera glycines
  Genomic contig location: Contig_ID=SeqID_123; Location=1120..2136; Strand=-
  SCN-specific regions: Sequence locations=1-188,210-342,364-707,729 -828,850-1017
atgtcttcccactcctcaagtagcagtagcagctccggtggctctttgaagcccgacacattggcacactctggcggttggaggaatgaccacttctgtcatatctacgaacatcaaaccgcaatcaaaatccgaatcacctcatatgacatgcttcccattgcgcctgctccaaagcaccattgtgctgtggtcacattcttgtgcaagacatgcgccaaaaaaactcacgtaacgtatgaattcagcagaaaaggaaagagcgcaatgtaaaattttttttgtggtgaccaggggtgtcaccaaaatcttacggaatccgatccgtcaaaaaacatcagatttttaacaattggaaaaagtgggagacgatggtgccaacaagcgccgccggaaaattttttaaaaattgagtgcaatacatatgttaactaacagaaaaaatttccattttttaatttggagctcatttttaagaaaataatggatttttgtgactggaaatttttagggattttggctagttttttgtccaaaaatgaaaatccaacactttaggttgggagagtacggaaacttcatcaaaatcgttcgaaccaaaaaaattgcgatgtcaccaaactctgaatgacgtatacgctgacatgccgttgaggggctattgtgtaatatggtacaattgtcaaaaatgggcagacgatttcttcgataatggtaattattaatttaagggggcgggtggtcgatttctgtcccccccccctctttgaagaggaccccaggctgggcggctcggaaggaagggcaaaataatttcagttcatatttagtgatccaaaaagaatggttgaagagtacctttgcccgtgcccatgctcagacaaaactttgatcaaaatcgaagttaacaaagtcaaaaatacagcgacacggcatgttataaccgctgaagtaaaatgcccgtgtcacggcgcaccgacttttgtcacttatgaactaaccgcagcaggaaaatga

SEQ ID NO: 73168 - DNA, 1004 bp, Heterodera glycines
  Genomic contig location: Contig_ID=SeqID_123; Location=3907..4910; Strand=-
  SCN-specific regions: Sequence locations=1-168,190-329,351-692,714 -817,839-1004
tagcagtagcagctccggtggctctttgaagcccgacacattggcacactctggcggttggaggaatgaccacttctgtcatatctacgaacatcaaaccgcaatcaaaatccgaatcacctcatatgacatgcttcccattgcgcctgctccaaagcaccattgtgctgtggtcacattcttgtgcaagacatgcgccaaaaaactcacgtaacgtacgaattcagcagaaaaggaaagagcgcaatgtaaacatttaaatttttttttgaggtgaccaggggtgtcaccaaaatcttacggaatccgatccgtcaaaaaacatcagatttttaacaattggaaaaagtgggagacgatggtgccaacaagcgccgccggaaaattttttaaaaattgagtgcaatacatatgttaactaacagaaaaaatttccattttttaatttggagctcatttttaagaaaataatggatttttgtaacgggagatttttagggattttggctagttttttgtccaaaaatgaaatccaacactttaggttgggagagtacggaaacttcatcaaaatcgttcgaaccaaaaaattgcgatgtcaccaaactctgaatgacgtatacgctgacatgccgttgaggggctattgtgtaatatggtacaattgtcaaaaatgggcagacgatttcttcgataatggtaattattaatttaagggggcgggtggtcgatttctgtcccccccccccccctctttgaagaggaccccaggctgggcggctcggaaggaagggcaaaataatttcagttcatatttagtgatccaaaaagaatggttgaagagtacctttgcccgtgcccatgctcaaacaactttgatcaaaatcgaagttaacaaagtcaaaaatacagcgacacggcatgttataaccgctgaagtaaaatgcccgtgtcacggcgcaccgacttttgtcacttatgaactaaccgcagcaggaaaatga

SEQ ID NO: 73169 - DNA, 1020 bp, Heterodera glycines
  Genomic contig location: Contig_ID=SeqID_124; Location=1129..2148; Strand=-
  SCN-specific regions: Sequence locations=1-188,210-349,371-713,735 -833,855-1020
atgtcttcccactcctcaagtagcagtagcagctccggtggctctttgaagcccgacacattggcacactctggcggttggaggaatgaccacttctgtcatatctacgaacatcaaaccgcaatcaaaatccgaatcacctcatatgacatgcttcccattgcgcctgctccaaagcaccattgtgctgtggtcacattcttgtgcaagacatgcgccaaaaaaactcacgtaacgtatgaattcagcagaaaaggaaagagcgcaatgtaaacatttaaattttttttgtggtgaccaggggtgtcaccaaaatcttacggaatccgatccgtcaaaaaacatcagatttttaacaattggaaaaagtgggagacgatggtgccaacaagcgccgccggaaaattttttaaaaattgagtgcaatacatatgttaactaacagaaaaaatttccattttttaatttggagctcatttttaagaaaataatggatttttgtgacgggaaatttttagggattttggctagttttttgtccaaaaatgaaatccaacactttaggttgggagagtacggaaacttcatcaaaatcgttcgaaccaaaaaaattgcgatgtcaccaaactctgaatgacgtatacgctgacatgccgttgaggggctattgtgtaatatggtacaattgtcaaaaatgggcagacgatttcttcgataatggtaattattaatttaagggggcgggtggtcgatttctgtccccccccctctttgaagaggaccccaggctgggcggctcggaaggaagggcaaaataatttcagttcatatttagtgatccaaaaagaatggttgaagagtacctttgcccgtgcccatgctcaaacaactttgatcaaaatcgaagttaacaaagtcaaaaatacagcgacacggcatgttataaccgctgaagtaaaatgcccgtgtcacggcgcaccgacttttgtcacttatgaactaaccgcagcaggaaaatga

SEQ ID NO: 73170 - DNA, 212 bp, Heterodera glycines
  Genomic contig location: Contig_ID=SeqID_124; Location=5383..5594; Strand=+
  SCN-specific regions: Sequence locations=1-212
atgagggtccgacggtgcaggtaggcgaggattctgatcgaaatttggggaacaaatgaataagcaaatcgtaattttcagtgcattcgtgattcaaacggctttttttgcggcatttttcaaaaaactttttttaggcttggggagtcagggtggcaacatgaagtttgggcaccgggaagtttgggcaccagaaggagggatttaaaaaa

SEQ ID NO: 73171 - DNA, 1020 bp, Heterodera glycines
  Genomic contig location: Contig_ID=SeqID_124; Location=3917..4936; Strand=-
  SCN-specific regions: Sequence locations=1-188,210-349,371-714,736 -833,855-1020
atgtcttcccactcctcaagtagcagtagcagctccggtggctctttgaagcccgacacattggcacactctggcggttggaggaatgaccacttctgtcatatctacgaacatcaaaccgcaatcaaaatccgaatcacctcatatgacatgcttcccattgcgcctgctccaaagcaccattgtgttgtggtcacattcttgtgcaagacatgcgccaaaaaaactcacgtaacgtatgaattcagcagaaaaggaaagagcgcaatgtaaacatttaaattttttttgtggtgaccaggggtgtcaccaaaatcttacggaatccgatccgtcaaaaaacatcagatttttaacaattggaaaaagtgggagacgatggtgccaacaagcgccgccggaaaattttttaaaaattgagtgcaatacatatgttaactaacagaaaaaatttccattttttaatttggagctcatttttaagaaaataatggatttttgtgactggaaatttttagggattttggctagttttttgtccaaaaatgaaaatccaacactttaggttgggagagtacggaaacttcatcaaaatcgttcgaaccaaaaaaattgcgatgtcaccaaactctgaatgacgtatacgctgacatgccgttgaggggctattgtgtaatatggtacaattgtcaaaaatgggcagacgatttcttcgataatggtaattattaatttaagggggcgggtggtcgatttctgtcccccccctctttgaagaggaccccaggctgggcggctcggaaggaagggcaaaataatttcagttcatatttagtgatccaaaaagaatggttgaagagtacctttgcccgtgcccatgctcaaacaactttgatcaaaatcgaagttaacaaagtcaaaaatacagcgacacggcatgttataaccgctgaagtaaaatgcccgtgtcacggcgcaccgacttttgtcacttatgaactaaccgcagcaggaaaatga

SEQ ID NO: 73172 - DNA, 1374 bp, Heterodera glycines
  Genomic contig location: Contig_ID=SeqID_1380; Location=458..1831; Strand=-
  SCN-specific regions: Sequence locations=1-168,190-275,297-305,327 -1264,1297-1374
atgcatctgaggtagaattgatttaaaaaaaatttaaatgtgtggaatttaaatgtgcctttttcaggatattcgcaaaaaatccttaaaaaaatgcaataaaaaccaaaaatacacccctaagaaatggcccgaaaaaatttcagaaaatactccccctaagaattgaaaaaattttcccaaaattgatcccgaaaattttatattttcttcataacaaaaatttttcgtttatatccttattcgaaaaaaagtttatacaattgaaattgttatgtttttaagtgttttggtacctaaaaagcgttaataaaaatttttaattacctattttagtgcctatttgaggatttttgtgcctatttaatgcctatttcgctattttttgtgcctaaaaaaggaagccctacttaggttgtttattaattaattagttcatccatttttcagtacatttatgactttaaagcgcaagatttttaaatcttactgatttatgttgatttttggaaaaaattctcaaaaatagccaggctcccggacatttggacagtggacattacgacagtggacattaggacagtgaagtcatttggacagaagtggacatttggacagtggacattacgacagtggacattaggacagtgaagtcatttggacagaagtggacatttggacagtggacattacgacagtgaagtcatttggacagaagtggacatttggacagtggacattacgacagtgaagtcatttggacagaagtggacatttggacagtggacattaggacagtgaagtcatttggacagaagtggacatttggacagtggacattacgacagtgaagtcatttggacagaagtggacatttggacagtggacattaggacagtaagtcatttggacagaagtggacatttggacagtggacattacgacagtgaagtcatttggacagaagtggacatttggacagtggacattaggacagtgaagtcatttggacagaagtggacatttggacagtggacattacgacagtgaagtcatttggacagaagtggacatttggacagtggacattaggacagtaagtcatttggacagaagtggacatttggacagtggacattacgacagtgaagtcatttggacagaagtggacatttggacagtggacattacgacagtgaagtcatttggacagaagtggacaattgtgatgcgcttgacatgcgcattccagaaaaattttcagtgaaacaaagaaaaaaacaaaatgcaaattccttttttttattagctttaatgacgcatgaaaaattgttgaccataaaattaatgtggcaagaaaaatcgaaaaataaa

SEQ ID NO: 73173 - DNA, 2433 bp, Heterodera glycines
  misc_feature (2215)..(2215): n is a, c, g, or t
  misc_feature (2245)..(2245): n is a, c, g, or t
  Genomic contig location: Contig_ID=SeqID_1381; Location=1428..3860; Strand=+
  SCN-specific regions: Sequence locations=1-379,401-572,594-814,858 -862,884-1135,1162-1241,1263-1267,1290-1334,1375-1433,1505-1569,1592 -1612,1681-2051,2073-2141,2163-2344,2380-2401
atggttattccgccgttagcatcatcagcagcagaaaatgcgttggtgacgcagcaaaagcgacgcacaaaacggggctttgaactgttccgtcgacacgacggctgcgccggcaattggagcacgggccaagaatgcgcaggtggagctagtatctttgtgctgtccatctttgtgatcattctgtgcgcatttcgactgtcgcacgaggccaaattgcacacgatgtcccatccggggaccatccaattaatcgcattgctctcactgattgccttctgtgtggctctcatcatcggcctttacatgatgctccgtggctgttttggcgcaaaattagacggaggttcggcatggggccgaatgtgttagagaagaagatgaaaggggtggggatgaactgctggcgacgaacattttttttgtcaagggggattttcgaattttctgtttttcctttttcatttggtctgtggaaaatttgtgccgaaattttcggcccaaacattttcgcctttgctttttttaatcattggtagcataaaaaacattaactctactcattgtatgtcaattaattaaccattaattaagctgcagttaatttgtgctacatttttattttcataaattttttgtttcaaaccgaccacaacacaggcgaaattggcctgctgctgatacgcatgttactgaatgggcgaagcgggccgttgcgtctgacaataagcaaagtttaaaaccgtgctgagacaaaccgaaaatagtttcagtgtcaattaaaatattaattatacaattcaaatagatgtcgaaaaatatgaatttaattatactattaatattaaaaatataaacagaaaaagatgaaatcattccatctccgaacaaaaaaaatcacattgaaacgaaaatttaattccaattcttgaacacatcaaattgattggcaagtcaacttactagaggattgttcatttttagaaaaaaagcaacaacaaatctactaattttcttcttaaatttcacccaatatttattaaatttaagttctttattcgattctccagaaatttcatgtgtttttccataaattttccttcatccctattctttttccactaatgttacaattgaaaattgttctccatttattaattgtacgaaaattatcatttatttcgagaactttttgttttatttatacatttcgatagtccaaagatttttctattattctgttaaatttcagaaattttttattaagttttaaaaaagttggggcaaaattagtgagtcaaaattttttggaattttttggttacacctttttgtaaatttataaaattaaataataattaaaattaaatatttcaatcattgatacttttgtaacttcgtcctagcacctaaaaattcggtaattgaataagatattaatttattgcataattttaaatgatatttattttgaattaaaaattttttttaattgataaattttctgtgcgttattaagcggtttaaagaaatattaaatatcttatcaattaaacaacatttcgtcacaaataaaattttatttttccaattccttcatgtattaccgttcaattttttattaatatatttagatttctttcattttatatgttatttttaattttaattattttatatggcatcggaattataataaacggcgttgtaattttggtcatattaacttttaacaaaatgagaaaatcctcgatgaatttgcttctgttaaatttggtaagagctctaaaaatatatcagtttttcaaatattgaaaaatctccgcatttatttggggtttttctcatattttttttcttccacaaaatgccactgttgccaaaataatgacagtccctggactttgacttggaaattgtggcaccattcccttccccgccatccaacggtgctgcaatagacgtgccgaagaaaattttgaaattatagagatttgttaacagtttattacaataaaactggctaattttggagtttgaaattacaaaagtttcctttttcccttaaaactttctatctcccctatgggaacattaaagagggccattccaaaacaaatttgttttgaaaaaaatttcatacatatatttttattttcagggcttgtccgatctatgtctgctgtcaataactcgcttatctatgcccaaatgnttgacgaccattcttgagttttactgattnattgcatttcaattttttgaaccggggttggggcctgccccattctgcttaattggcaccgggggggaaaggaagttcaatcctgcaaagggatgaaaagggggggggggggggggggggggggggggggggggcgcggctcctttttttttttttaaaaaaaaaaaaaaaaaaaaaaaaaaaaaaaa

SEQ ID NO: 73174 - DNA, 1886 bp, Heterodera glycines
  Genomic contig location: Contig_ID=SeqID_1382; Location=526..2411; Strand=+
  SCN-specific regions: Sequence locations=1-267,289-485,514-664,687 -1362,1384-1685,1717-1805,1828-1886
atgcctgctgtcaataaactcgctttatcttatgccaaattgtttgaacgaccaattctgaagttttcactgatttattgccatttccatatttttatgaccggcgtttgtggcctggtctctattctgacttatatggccatctgtgtggaaaggtaagttcaattccatgtcaaaagtggggaaaattggctgggaggggggggggggggggggaatcccgcatttttgacatgaaatgaaaatgcctagaaattagaattttaatgtggcatttttggttttggtggcgacgatgggggtgtttttctgtgctatatttcaatcttcaaaaaatttcccgtcattttttcgtctcgaatccctctttttttctgcccgtggtaactctgttcgacaatgccattacgtcaagaaaatgccatcaccaaagttctcgaaattataagaaaattaaatgacctccgcataatgaccaaaaaattacattttaaaatgtgttttaaatttcaattaagatacattgtaattatttgtcctcttcacgcatccaattggtgcacaaggagccgaattttgcttgtgataaattcaatttgggcatttgccattatgtacagactaccgtattttgatcttattggcacagaaaagcgtaagaccaatttccaattacaacaataaaagtgaccgggggaaaatcactccgggggatttacagtggtcgttggttggcctctaatctgacacccatttgaccaattcagaattcccaactcgcacttatgtatgtcagatcacttctttgattttaatagaattccaaatcagccatttttaaataacgccggatattaaaaaggttctcgtagataatttgagtgatttctccaggtgccagagatagtgttgaaagttattagttcgtcgtgataaaattaaggtcctttgcctaaaaaaggattaacgtagatgatggcgattgctgtcccattcttagaattttaagaacccatggagacactaaactaatagaggggatacggtaaaagtaaatattgtgttttttcattcccagatgagtacggttgttttttggagtttcttccatttcattgggtctccgaatttgcgtttatccatctgtcagtgttcatcatatcagcaactctttactacaaaacgtgcaaagtgttgtggtcaatggaagtgttggattacacacggctaaatggtcacagtttaattacctaatttgtatctcaattaattttaatcaataattgcattaattttatccgattaattttcagagcgtaaaataaggcaacgccgaaaagtgatgaaagtgctcattttctgctttgttttatattttctgtgctcctttggatcaatttcactcttcataatatggttctttttatattttacattttaaattatcgcaaaagccaaaaaaggcaaaggaaattttcaaggaaaagcaaaaaaattgagcactttagtaaaaaaaaattctgtttaaataatgcaaaaatttagtgaattgtacgggattgacattcttcggtacgcaattcgactgttcgcaatgcaaagtgcgatcaacccattcatatacacactgatcgggaaacaattccgtcaaaatttcaccaattttttttctcgtatttttaaccataaataatttttttttaaatttctttatttgtattttcatttatcgctgatattccactttttattgcaaatgacttcattaacacctaattgtatgattgatgaaattccatgaaatgtaataatttattttatttttttgggacattactatacattaggcattgttaattgagaaaaaaatgattcaaaaattgaaa

SEQ ID NO: 73175 - DNA, 385 bp, Heterodera glycines
  Genomic contig location: Contig_ID=SeqID_1382; Location=2525..2909; Strand=-
  SCN-specific regions: Sequence locations=1-385
atgaagcctattattgtatggggggaggtctctaggtgcaaattattgaacaattattttgcattgtttcagcaattgaaatcacccaatcggatcggttatcggcaagttcaaatcacggacagtgtgttgcgtgttcaagtggaagaccggtctcagctgatcagtcccgaggctgagattaacccaatgctgggcgatcaaccgcacgcacaacgaatgctccaaaatgttgtgcatatgccgaaattacaatttatattcattccataaatccatttttaaggccccagaagcccattgggacagcatcaccgatttggccacattatggcctcatttgctcgtgtccgccggccgtgagggagtgatcaaaatgtggaga

SEQ ID NO: 73176 - DNA, 1240 bp, Heterodera glycines
  Genomic contig location: Contig_ID=SeqID_10097; Location=1..1240; Strand=-
  SCN-specific regions: Sequence locations=1-150,199-297,319-474,783 -927,966-970,993-1150,1172-1240
ccccccccccccccccccactgacccaaaatttgtatggaaaatttggaattttgccgaaatttttaggtttttttgggttaatattctcttcaagacctttgcccttattatttgtttctttaatttaaattacaccaaaattttcaacaaaaaatgttttaaaaagaaattttaattttttttaattttaaaatttgttcatttttgaaggcatttgcctcttctctgaacggcactttggccacattggcagtgctcaaaggtgtcggcgttggaaacgaacaagcggtaggaggcaattttgaaaatggaaacatttttttttgaaaaatttaaatttgagacagttttggcggcggcactgacatggattttgaaggacggagtcggcatgttggcacgcattgcattcgcttgggccaaaggcactcggctcgactcgggtggggcgagccaaaaatttggaaatgcaaaaaaaataattaatttaaaattttaaataaaggacattttgatcaattttattactttttattaaaaatcataaagaaaacaataattcttttaaaatattcaatgttgctttcttaaataaaattgaaaggaattaaaaacataattaattaattatattttattcaatatatttttatttaaattattatttttcattctatttaataaaaagaatttctataataaatatttatataattaaatataatttaatttttttgcatcatctaattatttataaaatattttttattaaaaatatttggcaaataaacaattcattttaccaaaaatggaatgacggtgtaaaatgccattattaattgtactcactcaagactctcgagtttcgcctaatgtattagtcaatttcaaaaaccttctcagattgcaaacgatggcgactttttgccgacctgctcaacgatgcaagcttttttatagtaagtttctttgaattaaatttttaaaattgaagccaatttttttgacacgattaaaattatttccatttaattacgttttgtttatctgatattttcctatcatttgcaccttttgatcattttatcacaacttactgagtgagtgagcactttgtttatttttcttaaaccatcgaaacttttttggatcagatttcctttccgctcaatctaacatacctacctaattggtaagataacattttttatcaatcgtttcatctttcccaagtgaaa

SEQ ID NO: 73177 - DNA, 123 bp, Heterodera glycines
  Genomic contig location: Contig_ID=SeqID_10098; Location=143..265; Strand=-
  SCN-specific regions: Sequence locations=1-123
atgccaaaatcattagcatcacaagtcgaagccatagaacaacaacaacagaacattgtggaaacatacaatggcgaaccggtccatgaatacagttttgctcgaccccgaggggacggcgac

SEQ ID NO: 73178 - DNA, 723 bp, Heterodera glycines
  misc_feature (97)..(97): n is a, c, g, or t
  misc_feature (104)..(104): n is a, c, g, or t
  misc_feature (107)..(107): n is a, c, g, or t
  Genomic contig location: Contig_ID=SeqID_10098; Location=714..1436; Strand=-
  SCN-specific regions: Sequence locations=1-52,74-126,167-431,453 -524,584-651,672-723
atgctgaactgcgaacttatttattggaaatacatacaagttgatgagttcagtttaaaaggtagaaaagtagttcgcagccaagcggattcgaacnccagacnccngcattatgactataagaactttaaaaaaaatcattaaaataactaaaaatttaatttttcattcataaacagctcattctcaaactatttgtgagttctatactatgggttttaccagcaataaatttttagaaaaactaaaatttttggaaaaaaatcaactatctgatgaaaaatcatcgaaaaaattaatgattttacagaatttgagtttctcaacttcgtgatcagtgcattttttagccctagaaaatgtgtttcttaaattttaaattttcgcataaacaacaaaactttggccatgattaaacccgattaaatgagaaaaaaccggaattttttgggataaatattaatttgtaaaatattgataaaagtcaattttcgaattattctatcctttctctattagtctcctattatattttttaaattattcgacaaaaatattgaatttttttttaaattaattttttcttcctttttttaaaccacactctcttagtaggggaaaacggggagcaaaaattgtttccttctaatggatgatgatgatgatgatgaaagtggcaaatatttaattgatccttttcattaggatttggtgcaaaataaa

SEQ ID NO: 73179 - DNA, 1863 bp, Heterodera glycines
  Genomic contig location: Contig_ID=SeqID_10099; Location=759..2621; Strand=+
  SCN-specific regions: Sequence locations=1-110,132-410,434-461,484 -567,589-663,701-1241,1263-1489,1511-1531,1554-1863
atggacaacaattcgcctggtccctcaaataatgtcaacccggaaaacaaaattgggaaaaccaatgttggtggaccattgtcagacatcgacttgttcaaagtttgttcaatttgaatttgtttattggcatattaattacccctactacctaagttttgattttccaggagatttgtggcattgacgaaccaactgcttccgcgttgttgagggagtcgggcggggacctcgaggccgcgattcaccaatttttcttcgtatttttttttgttgcctatttttgaaaattgacgaaccaattttctttagacccgcgagaatcccgaagttctccagaaccaggacaacgaagtgcaggagcttaggaggcgtgcaattggtgacagggcacggaataatcagcagaagtgcgtttgtttgtttcttgttttggcacttttgctgttgggggaacaccgaaaaatgccaaaaggttgggggacccttatggactgatttttaaaaaaagttttggactcatttggtcactgcagaacagagaaattactaaaacttgttctcggctgtatgtttttggggccaaaatcaggacagttccaggatgttgcgttggagggtgacgccctaggcaacgacccttttttgcggcgcgctttctacaaaatttttggaaatggggaaaatttaaaaaattttctcgtgtttgttaacggattttcaccttaaaatgaccaattttgggacttacaattagagctattttttgtgggttttccgaaaatatcgaattttttttttttaaatttgggttgtggaggtcttggaggggctatcactaaagaaaattggacgttttgaacccagcagaaaatactatttatccctaaccgtttgctatgtttagccaatctcttccggtggtttcggcacctccgaatgccccgctcatttcgtggtctcaatgggttcgtggcattttcctcatcccgtttcgctacctttacacaacggcaatggacgtgttcttcttcgtttgtacgtttgcaacttcacttttaatttaataccaccgatatttagttgatttcttctttggagggcggccgccaagacgtccaatcaccggaaataatcgtcaaaagtgagcaccaagcttaatttcttataattaaactgggtatttttgagacacaaaaattattatctgtcagtgttcattcgttaagttaaaaaacggcagtgttttaaaaatgaaagctaattttttttttgtagattttaaaagacgcaaaagtaaatttgggttctattgcactttatgagtccaaattcggagtttaaacaagttaaaatattcataaaacaaatttcgtatcgaaaaaatgatgaattaagcaactgttacataacatactgaatttgttgttgtcctttcagcaatgccaatccactggcacgagggcagcaggacgttttggcggatagaatgtgaaaaatgattgttttttccatatttttcgcaatttaattcaaaaattgcttccttttttcagcataatgcgtgaacaacaacaggcgtatgagcaggcgctggccattgacaagcaaaaagcggagcaactcaaaatggaaaagcaacgggcgcaggcggaggcggacaaagtgaacaacaggaaggcatttttggcacgaaaacggggcgaagtggcggcaaacattggcaaaacggcggcggaaacgaatggcaccggcggcggcactgtggcggaggagaagggcgaggatttggtgcgcattcggctcgtgtttccgagttctgcccgcatggaacagaactttcgccactccgacagtctcgag

SEQ ID NO: 73180 - DNA, 2123 bp, Heterodera glycines
  Genomic contig location: Contig_ID=SeqID_10100; Location=861..2983; Strand=+
  SCN-specific regions: Sequence locations=1-142,202-230,281-366,415 -667,689-770,816-1300,1322-1476,1498-2123
atgagaaccctgccttattttatcattttcattacttcacgtgaaaaattgttggcaaaaatggcggaagtaaatagaaacaaggatattgttggctttttattaattctgatatataaattaaagaatttttagctcagtctttatattattttattattactaaaaaagaaaattaaaaatgtttaaatttcttattttcaatttgttattgcttggaacacgaatttttcaagaaacaaaatgtcaaaaaggttatttttaaaaaataaatgtttatacatacttaacggggatggcattacgaggcgaccccaaaaattttaggaaatcggaatttctattcccaaaaatgtcggaaatctgaaattttgaattaaaaaaataatagaaattttctaaatattttaattactaggttttaaactaaaccaaaaattaaaaagtaattttctcaccagaatattttttatgtcaatcaatttacattgtttaaaatattattgggaaagtgactatttacattgacgccatttttaaaggcccgcgttttttttaaattttgggaacgaacataagcgtagtccggtgggtgctggggaaatttttttaaaagtttatgcgatttaaacagaattatacaaaaactgctaattttgagattttgggctaattttttaggaaaaaacaaggagtttttggggtccggcgggccgacaggcgctgaaaaactaattatttcgtaattaaaaaaaatcattccgaattggtaaaaaattaataaaaaataaatttccgattttttattaaaaattccggaaaccgaaatctgacctccaatttttttcgggaattccatgcagtccctaatacttatcatttttaagtgtatccaaaatttaagttttcaaaatttcaaagataataaaggcacccagacttattattaaaatatttgatttagctaaattatattgaatgcttattaaaatatacaaaatttaagccacttaattttcaatttttaaactgctttttcgtcttaataaatttaaactccgcttcttctaatttagatttgattatgacggaaaagaaactgttgagcacagctccgagcgtattcttccaatctgatgaatttttgtttgaaaaatggttccaaaattatatttttggcattttatgcgccgaagaatccgaacgaaaaattacaccggaaaattatttttacaatttttatgaaaaagctcaaaaattgcggaaagatttctgttggacaatgaaaaatggacaaagcgtggaaaaagcaacagaaaaatttggaaagaatgcaagaaaattaataaaagagttggaaaatgaccaaaaaataaaacaaagtattcaaaaagcgatgaaaaataaaaatatcaaaaaattaaatgaagccgaaataatttcggtgataaaagaatttgaagcaaattcagcggaagaaaacaaaaaccaaattaactcattagtcgtccaatgggtttatttggcgttgaacggactgtggaaagcaatctaactcttctctcttcatgatgcgcgcagataggaaagtatcccccggaaaaagtgggataaagcacatgggataaccctcaaaaagaaagcggcaaaagctcagtcgtttcgagcaataccatggtatggaaaggccgtgggttcgagtcccaccaggcgagtcaccttttatcttctacaactctccctctctcactccttttctcttgtgcaaaaaaaagagttggtactttttggttttgttcctacacctcaaaattttaaatgcaacaagacgacaaatgtcccgggcgcaatgtcatgtaacctttgatcgctatgctaatttagggtcactgtgagtttgtgcgctcacgtttgggtgctcacgtttgggcgccaacatgtttttccacgaaagctttctataacttttttcaatgtcatccaaatccaacatttttgatatcattcgaaagcttaacatgtttagaagctttttctaagctactgcttcacgattagacaattaccaaaaaagttatacactgaaaattgcaaaaagtcgaaatttttgaagttttttctta

SEQ ID NO: 73181 - DNA, 84 bp, Heterodera glycines
  Genomic contig location: Contig_ID=SeqID_10100; Location=1..84; Strand=-
  SCN-specific regions: Sequence locations=1-84
tttaccagcgaaaaatgcacttggagaataaacaaggagagaaacaaggggagacgcgggcgcaactcaaagacgacgcctttc

SEQ ID NO: 73182 - DNA, 1924 bp, Heterodera glycines
  Genomic contig location: Contig_ID=SeqID_10101; Location=458..2381; Strand=-
  SCN-specific regions: Sequence locations=1-401,425-544,568-726,748 -1003,1041-1133,1155-1626,1648-1924
aattatgataattcagttattttttctcctgatcaaaaagctgaaatttttgcaaaaattttttctgaacattatttacataattctaagtctttaccttttgatttatctagtcactctcctgtaattaatgatattgaatttaatgttgttgatgttggccgggtccttaaatctttaccaaataaaaataatacttcaccggatggtataaatttcaggttaataaaaaaattgtttcctttcttttgcaccttatgttaccgaacttttcagaatctcatttgataccggaaaattaccgaccttttggaaaaaatcaataataattcctctctttaaaaaaggggataaaagttgtctcaccaactatagaccaattgccctcacatgttcactgtgtaaaatttttgaaaaatttgttgtcagggcaattactagtttccttttaaaacatgacctaatctcagtacaccaatttgggtttgttaaaggtcgttctactgttacccaacttattttaactcttgaaaattggtttgacggtatttacaatggaaaaaatattgactgtgtttatattgattttcgtaaagcttttgatgttattccccatagcttacttttatataaggttcataaaattggcattagaggtaaaatccttaattggatttctgattttttggccaatcgctcctttttagttcgtgttgaaaattcgttttcttctgaatacaaaatgtgctctggcgtcccccagggctctgttctaggacctattttgtttcttatttatattaatgatttacctaagaaaattccgaaaggaatttttatcaaactttatgcagatgatgtcaaattgtattcaatacatagaactaaaactgacagagtgataatgcacgaagctctgaggcaattgtccaattggtctaatgaatggtgtatcgacatctctattaacaaaacctttgttttgtacttgggaaaaaataaccctagagaacaatataaaataaataacaacacaatttgtgaagtggacaccattcgagacctgggtattcttatcgacaataaacttaaatttactgaacatataaataccgtaactagaaatgcttacggtagaatgcgatttttatttcggattattaagtcaaaaagaatttcaatatggaaaaacatttttatctcgtatatccgtcctcttcttgaatatgcccctgaggcatggaaccctcagttaaaaattcacattaataaaattgaaaaatgcaaaagtactttactcgtatagctttaagaaaatgtaatttgccatataatccatatggacaaaggcttgaactttttaaattaccaactcttgaaaaacgacgaaaaaagtttgatattcttacaacatataaaataattcatggtttcactcgtcgggtccccaagttgcaaatccccaaaagtcgcaccacgatgggaccaactgacgggttccggctataagcaaaatatgtgacagtattaaactcaaaaaatattttctactgctaataaatcgctctaattcgtgaattgttcgatgaaaatgaatttttttggactttctgcgaaaataggcagaaaaataattaaaaaataaaacattttctttgattatgtgaaatgctttattttctactgcataaacaacaatagtagactaaatgtctgctacaatttggcaaattatgaaaaaattgacgaatgaatgatgagaatatttggtgcctaattgacttaattattgacaaaacgcagcacttccatttcatcggaaaattggaataaattttcgaaatttgtacatttccgcgtgaatgtgatcacttggacaacaaacagaagggaattgaagctgatactgatccaaatcaaagcg

SEQ ID NO: 73183 - DNA, 1887 bp, Heterodera glycines
  Genomic contig location: Contig_ID=SeqID_10102; Location=2064..3950; Strand=+
  SCN-specific regions: Sequence locations=1-495,518-909,961-1005,1030 -1271,1309-1429,1455-1476,1522-1708,1731-1819,1841-1887
catccgctcgtcgaaaaataagtgaggactacaaggaaattcaactaccgtctccggtgtttctggatgatcaggaccaaacgttgtgggacaaacgggcggccaagaagcgattgttgttccaccattcgtcgttggatgtgccggccatgggaagcattgacacggcacacgacgatttggcacaccgctacgaagacatggattccgaggcagaattggccattcaggaggagccgcctcgttacatcaacgacgaggaagcggaagactttgaggagatgatcaagttggtggcacgaaaaatgccgaaaatggaatttttgcaagttcgaaagtgattgaaattcgaactcaaggccacaacttcaggtttaaggcgaatcgaattccgaccaaaaattcggaaagaggaattggaaaatttcgaggattaaaaaaaattcaaaattccaaataaaatgtcgcaaaaatcggaatttcggtgcccaaatattttttccgcatattgaaaattgcaatttttctgatccaactgttccgatattttatttagaacaaattgaaagacagtgaaaaaaacaattaagggctgctcgaccgccaattgatgcgttcagcaacccaattcttcttcgtgacgcagacccattgacaacgcgcaaaaagttgacaaaacgcggcagcggtaaaggcagtgccgcgtctggtggtggcggtggatcaacactgttgcgccaacacagcaaaagccgcttgaaaaagttgagcgaacagtcggactcacgaacaccgtcaggtggtgccacatttgatagtgacgatgactgattgatgagatgataaagccaaaattcacacaaaggaccagaatgggcaggcggcacacacaagcaataaagggcacaataattaattaattgcctaattaccagattaatgaatattttaattaattaacgcaagcattcgtttttaattttgtttttacgataaataaaatactcagaataactttttaaaacctctactaaatttattactggttacggattatggaaattatggcattttgagcccacttaattacggattttggttattgaaaatcctagttacgctcatttctaatacataaatatttttgaattacataatattgtgtcagaaacccgtttccacttgaatctaaaattacgacaaccaataaaaaaaattgattttcccattttaatatattcttcagtaaattcttttgaaatgagttaatcaaattaaaaattttgaaattttatttaaattaaatttgcctttgtcacgtgccgctggttttctgtgaacgcgggatataataatgaatgaattcacaaatttttgcataaattttgacaaattttcatgtgcctccttttttaagtaacctgcactaatgatgattatgatgatggggcagataattcaagcattggtaagaagtttttttattaaaaaaatttttaagatttcaaataatttaaaaaacttttactagggatcgaaatttgaaaatgcctggatttgggtttcatgtttgtcatggacctttttctagataatccagcaaaatccaggtcaaggatttgtaaaatgaagaagagttaattaaattattaaatagctagaaatccttgcagaaatccttgcaattttattacagattttgtcagtatagtggatttaaaatttaagtttttagctgacgccaccgaaatgctggccgaactgtccgccatggtggccaaatcgacggcccattccggcgccaccagtccagcaaacattctccagtttattgaggagcaaaaacagaaagcgtcaagccaagcagttgctggagaacaaccatga

SEQ ID NO: 73184 - DNA, 804 bp, Heterodera glycines
  Genomic contig location: Contig_ID=SeqID_10103; Location=124..927; Strand=-
  SCN-specific regions: Sequence locations=1-48,77-184,207-249,290 -304,448-504,525-624,668-804
atggatgatgaattaaacacaacggtaagaatttactattaaaaacccaaataagttttttaaaatattttaggcgtccagagaaaagaaaactgaaccaatcacattaattgaggccaaggaggatgtgattagcaacattgaaaatgtaaaagcagcaaagttggaaaatgaggatcaggcaaaagctgaaaatgaggaaaagggacaaattggtggtgataaaagtgaagatgtcagtgaaaaaacaatataataaataaatattacatattaatttaaatattatgaagatgtcagtgacaaaataattatataatattatttttaaaaattaattaagtatttaattgaaaaatatgaaatatcagtaaaaataataattaattttatattattttaaaatatatttattttaattaaaattatttgaaatttacatttttagaaaactgccatttctgatggacaacaacaaaatgaaggcataacagtgaaaggttgtgctgctgctgctgctgctgatgaagaagatgatgatggcactgttgtaaccagctcaaacattgctgcacaacggagtctaaaatgggacgatactgtggttagtggtatactgtaacgaaaatttgaaaaaattgaaatctaataaatttttaattattttcacattttaagcctgatcaaaaggaggaaaagccggcggcaacagaagaacagaaagtgcggacaaattcgtgcaaggatgagaatggctttacttattacaaatgccgcttttgtgggctcacatttaattatatg

SEQ ID NO: 73185 - DNA, 600 bp, Heterodera glycines
  Genomic contig location: Contig_ID=SeqID_10104; Location=428..1027; Strand=+
  SCN-specific regions: Sequence locations=1-20,56-253,275-600
atgaaaaatgacaagggattggaaatttcggaaaaattggagcaaaaccaagaaattgtgcataagtttttgggaatagaatctgaatcgttagaggatgagagtgatgaatatgatggaacaaatgaatatgaaaaggatgaagcgagctatgaatatgaaaacagagggattttgtctgatattttggaaatggacagaaaaaagagaacaacagtgactacaccggacgcgcgatgggttaaaaaagtggagaaaagcaaattaagaaaaagtggaggacaggagaataaaaatacaaacacaagagtgaattatgctctttataagttgaatgaggaccgaaaacggcaatatgatcaaatttttacccaggcttgcgaaaattcaaaatttcagctccaattggccaaagccattttacaaattagtccaaatgagggagtaagacggatatttaatcgggatgatttggtggccaaatggaagggagaaaaacttgaggtcggattttgcgctccgattattcctgaaaaaataatttgggacaaaaaaatcggaaaagaatgctttgaatgggtaccaatattgccgaaataa

SEQ ID NO: 73186 - DNA, 4763 bp, Heterodera glycines
  Genomic contig location: Contig_ID=SeqID_10105; Location=67..4829; Strand=+
  SCN-specific regions: Sequence locations=1-283,305-346,368-771,793 -964,991-2012,2036-2182,2212-2536,2559-2820,2852-3032,3055-3620,3642 -3642,3665-3984,4006-4763
gaatattcaaaatcctttggtacttaaggcaggtgcattatttgagtccgacagtattagagtggaagaagccatgatggagtaccgtaaaagaattaacaatttacccgcctcaacttttcgagtggtcaaaaggcccaacatttcggaagtcataaagctaattaaggcagaagcaaaggaaacacttgggatagtaatgggaaacaccggaaatttgctggatttaatgagaaacattcccgaaaaggcgaaggaagcagttaattatttaaaaggaatgtcatttttattggtgattttgcctattttggtactgattgcaatcattggttttattgtgaccaaatattggcccattatttatgccggatttcgggctgggtcggtggcaacacgagtcattcgccgaattattgggatgaaaagacacagaacaagggtagcggcagtgccaacggcaccggaattagcagatttaaattccgtagacgaagaggcttatgttttggactatttaccacctagaaggattgcagcaattacaaatgacccgagaaggcttccatcgattcgcgtgcattttaatgggctattaaccgctgctttggttgactcttgcgcaagtgtttcttattgtcgggagtccattgcccgtaaggcagggctcacaattaatgatttaaatggggaaaatgcaaatttaactgcagcaaatgactcacggattcaaattttgggtaaagcaaacacaaaaatacggattgaggaccaaaatggaaaatgtggtgaatgggaaataacggtacttgtctctcctgataaacattgtcctggcccagttcttttgggtctaccgattttaacagatttaaaaggagtgatcgcattcagtgaacggaaagtacgattgggcgaaatctgggcaaatataatttccgttgtcgaagcagaaaagccaaaaaatgtgaaaataacattggaaaatgatgaaatttttgaaccaaggactgaaaatgtaattacagcaaaagtaaatgaatctttttctccggatcaaaattttttggtaaagggaacaataaatcgatacccgagtataattgtcgggagaactttggttgcacccggggacaaaaattttgttacattgcaaataatgaatgcgggaaaaatgccggtgaaaatttacggcgggtcgcatctcgctgatttggaattggtacggataaaggctttacctggggacgaaattcatccgaaagattatataccatccgaaacgagatggcatgaaaaactcccaaatttgccaaatatggccataaatcgattaccatcagagagattaaatttggaaggcacaagattaagtggggaaacacaagaaaagctcaaggaaattgttgacaaatatagggaggcttttgtggcagacgatggaaaaattggactttaccggggaccgatcgcacataaaatcgatttaatgccagggtcattgccttttcactttcgtccttatcggtatccgcctgaaacccagaaggaaattgaaaggcaaataaaaataatgttggatcagaacataataagggaaagtgagtctgaattcgcatctccgatcgtgatggtcccaaaagcggacaaaaaatcctggcgttttgctattgattatcgagcattaaataaaatgactaaaaaacgggtttttcatttaccaaatatacaagaacttttggatttaatgggggcaaaaaagtattacacatgcatggatatgcaacaaggctttatgcaaattccaatggcacccgaagatatcgaaaaaacggcatttatttcacatttggggatttacgaatttattatgatgccgtttgggctaacagccgcaccggacaccttccaaagagtcatgaattcattaagaagacggctaacggcagctatgcttatttatctggatgacattataattgggagtgagacggaggaaatacatttattggacattgaaaatttccttaagttattaagagaagttggattcaaattaaaaattgaaaaatgtcactggggaatggctgaaatacgatatttgggctttttactaagcgaaaaaggcgtgagaatggacccaaaacaagtctcagctgcaaattttaacacaagacaaatttgaagggaaaataaaagaaaattggggaaaagaacaaaatgaatctttggagaccttaaaaagtatgttaacatccgcgcctgttttacaatcaccccgatttggcaaaaccttcaccattgaatgcgatgcctctcgaaaggcaatcggagcagttttgcttcagaaaaatgggcctgtggcattcatttctcgtgctctgaatagacacgaggccaattacccgtctatcgaaagagaggcacttgcacttgtttattcggtcaaagaattctcaccctacattattgggtcagggataacaaaaattattacggattgtagtgcgctgacaggcatgatgaatgcaaaagaattaaaagggagactagaaaagtaccaggtcaccctccagggtttcgatcttgagataatataccgcccaggcaaaaaaaataaggcagcagattttctttcaagatacaatattccgggaattttggaggaaaatgatgaaaatggggaccaaattgaaaaaccaaaaaagggaattaatgccttgaaggcactgaaaacaaatccgaatcagaccgctgaaaacgaaaaatcggaattaagaatttcaatgttcgaaataatgaaagagcagagaaaagtgcgggaaattgcaaaaatattttatattttaagaacgggtaaatgctctgacgacgattcaaaatggcgaaaaataattcaaaattattgcttggtaaatgaactaatttattataaaaatggaaaagaaaacgacggaagcccaaaattacttattccttactcactaagaaaacaaatttttgatttaattcacaatgagggacattttgggtttgaaaaaacatttcatgaaataaaggaaagattccattggaatggaatgaaggaagacgtgaaaattttggttgagacttgtgaaaaatgccaaaaacggaaaattttgccagggcaaataaaatcagcaccaggggtcccaattcctccaactgaagctccatttcaacgcgtacattgcgatttaatgggcccgcttaaaaaaacagaaaaaggaaatttatacattttattggccattgacagtttttcaaaatggatgatggcaaaagcgatcccagaccaaaaagcaaacactgtctcagaatcatttattgaaatggtggtccaccaacaatcgacccccgaaatagtcgtaacggatcaaggacgacaattcacgtcagaaatatttaatgatttggcaaaaatttatgggtttgagcaccaaatgtccacaccgtatcaccaacaatcaaatgggcttgccgagggatcaatgcgcataatggctaatataatttcacaattaattaatgaaatggggaataattgggacgaagttttgagtcatgcattatttatttacaacacatccattcattctacaacaaaattttcaccattttacatattacatttgcgccacccgcgcatgccaacagatcgcttacttaaattaccatccaaagatgaattagtttctgaaatttctgtttttacgaggaaccatgtcgaaaaagcctcaaaggcttgggaatcagtaaaagaatcaattataaagtcacaaataatacagaaaaatgagaatgataaaagccgaaaagctgaggaaagggaatttgaaataggagaaatggtacttttaaaaaaggaagtgttaaagcacaaatttgatcaaagatgggtaggtccattacgctgcgttgggattgaaacggataagaaaaatctgattttacaatcattggatgggaaaaacaaatttaagaaagtacaccaggaaaaggtcaaaaaattcaatggtccagcaattctcccactaagagaatcggatgaaccgttaaattgggaaaaatatgtggatgaccccaacgttgaacaggaggaagccgaaatgagtgaagattcgggaaaagaagacaaaaaagggaaagaaatcaaaaagttttcaaaatttggctttgaaagcagtgatgaagaagatcagagcctcaaaattttttttgtaagaaataatgaaaactgggacttaaatgaaaatgagcaaatttgggaacaaaatggggaagccgaagaggaaaatgaaattccgtgcacaacaacagaaatatttttggatggggaaataactttggcatatacaagttggcctgaagccaatttaatctcattaacatcattagttccgacaaatttaataaaagatgactgggaaatacacacaaatgaatttggaaaaagatacattacggcatggctttttgggataagttttgaattatttttgagcgatgagcctgacagggttgtcctaggaattcaggcacaattttcaataaatgacgaatggcactcaaaaactgaaggggaaagggaaacatattgggaacaattgggtgagattgacggacaaatcctcgaaattcagagaattcccgacataaccattacttattccgagaacccattaataattgattatgaatttgatcaaaatgatgatcagaataattcaccgacaattaat

SEQ ID NO: 73187 - DNA, 926 bp, Heterodera glycines
  Genomic contig location: Contig_ID=SeqID_10106; Location=4112..5037; Strand=+
  SCN-specific regions: Sequence locations=1-118,152-312,545-829,857 -897,923-926
atgccagcaacaacatttttcataacaataataacacttgtaatatttagtcatctccattttttggcaaatacgtcatcagttacaaatggcacttctctgctaaatgaaactattggtaaaaaattttggttttattttttctcaaaattaccgtatttttctttacacagtaccaaaattacgaattttgatccttacaacgagaattccaatcaccgagacacattatgtgctacaccgtaaaatggctgaactgcttgcagacgatgcagaacatgtggagaaagtggtatattcaaagaaaaagacttttataatatgatttttaaataaaatgtaaatttataaattaaaaatttttatagtaaaaggcaaatttatcatttgaaaatattattatgaaattgattttcctaataaatttcatttagaaaccaaaatttttcataatttttttaaaaaaatattttcaaaatgttaaattgaaaatttttattttttatcttttataaatctcattaaaaatcaaaatttaatttttcatcggcttcaattgacggcatcaatggatcacaaaaaatctgatattaaatgatatcaactaaacctattctgatataaaaattcagaattttaatcattcagcttttgcttgtcgcaaagcctgattgtgccgagacaagtgaagtgccgtcaaaatttcatggacgattattggtgtggaatcggatgacttttggcacaaatgccgcacaaaatgtggaagaatgccaagaaatggtcaataaaattatgctggacatgcaaacgcgacccaacttatgggagaaaaatggcacacaatttttgccaagtgccgataaaccgtatatgggcaaccttggtaaataaatgggattaatgattttttaattaaaaatgaa

SEQ ID NO: 73188 - DNA, 716 bp, Heterodera glycines
  Genomic contig location: Contig_ID=SeqID_10107; Location=1085..1800; Strand=-
  SCN-specific regions: Sequence locations=1-716
atgaacggcaccgaccgcacaaataacttcgccgaagcataccattgcacgctgcaactttcgatcggacaaggacaccccaccgatctggaaattcataaacaatttgcgcgagcatcagaaaataatcgacgtggacttcgaacatttcctcgccggaaatgctccgccgctgaaagcaaagcgttaccgtgtagtggacagacgaattttgaggattctggagcctacaatgaggaaaaaacgcagccgcaaatcgacgatgatcaccaatatggccaaaaccaaaataaccgaaatttgattattgaaatgctcaggggaatttcgagcaattaccaaatgggtaaatgaaactttgttaattttgttaaaactttttattttttctataaatttttgaatatttcttgtcaatgtatctgtgaaaatgaaaatatagcatacagaaaacttaattaatccattttactctataaaaaatgtttgagacgcaactggccccttaagtactaagacgcaaatggccagacgcaactgacccccccccctaccgtggaaaaatatgtctcgagttgcggaaatgccaaaaaaacggtttttgaacaggttcaaaactcgaaaaaatggagacggagaaattatttttcaacagaatttatttaacgaaactttgaaattttgaaggtgtcccaaaaatgtcacgcgtcaataaa

SEQ ID NO: 73189 - DNA, 70 bp, Heterodera glycines
  Genomic contig location: Contig_ID=SeqID_10107; Location=2519..2588; Strand=-
  SCN-specific regions: Sequence locations=1-5,27-70
gatttgaacctgtgaccccccattttttgactaactcacagaccactaagacgaaaaaaccaacttaatt

SEQ ID NO: 73190 - DNA, 450 bp, Heterodera glycines
  Genomic contig location: Contig_ID=SeqID_10108; Location=93..542; Strand=+
  SCN-specific regions: Sequence locations=1-116,261-300,409-450
  Gene Ontology: Mol. function=protein binding; Cellular component =axoneme; Biological process=eye photoreceptor cell development
atggcaaacgatgagccaacggaagcggcaaaattggcggaggaatttgccaccaaaaatttgacgacgaaagaacggatggatgccattctgaagatgatcagcggaagaagcggagaagaaggagcagaggaggaagaagaaggagaggaggatgaagaaggagaggaggatgaagacgaaaagatgacgggagaagagttggaggagagggaggaagatgaagaagaagtagagttagaagagagggaggaagaagatttagaggtgatggaagaattggaggaggtggaagagttggaggaagaagaaaagttaaaagagagggaagaagaaaaagaagaggaggaggaagaagaagaaggagagctggaagagaaggaggaagaagagaagaggatggaagaaaagaggcgggaagagtggcaaagaagcaattcattggtttaa

SEQ ID NO: 73191 - DNA, 45 bp, Heterodera glycines
  Genomic contig location: Contig_ID=SeqID_10108; Location=1099..1143; Strand=+
  SCN-specific regions: Sequence locations=1-45
atggcctttgaattatggctctatgatgtgtctccaccgaggaag

SEQ ID NO: 73192 - DNA, 186 bp, Heterodera glycines
  Genomic contig location: Contig_ID=SeqID_10109; Location=2129..2314; Strand=-
  SCN-specific regions: Sequence locations=1-186
gaggcaatccaacgctatccgccaaatcccgtgtcagtgcacgcgggccgccctatggctgtgtccatcacccaaagcacggagagcggcacgctctactcattggcacagatccgtcgcattgcgaacattgcgcattcgcatggcattcccttgcacatggacggggcgcgattcgcaaacgca

SEQ ID NO: 73193 - DNA, 1142 bp, Heterodera glycines
  Genomic contig location: Contig_ID=SeqID_10110; Location=3105..4246; Strand=+
  SCN-specific regions: Sequence locations=1-242,264-277,368-410,433 -851,873-969,999-1018,1040-1078,1100-1142
atggcccaaaaattccattcaatgattgtctctatcacccttttggtcaccgtaatggcccaccatgcacacagtttaaccactccactgacagcacatgtccaccccgtgccacagtacaccggcttcccggagactgtggctgtcccagtgccaccacttccgtgcaagccgttgagtgctgcacagcgagctgcactcgctcccgcccatccatcggcggccgacgcgtcaccccaacaagaaatgctgcaattccaccgcatggttgccaagcgtggttgcggctgttgttgttgtaaaccatgttgttgttgctgttgtaagccgtgctgttgctgttgctgtatgttgtggatgtttttgtaaacagggacaaggctcgtgttgcaaaacaagttggatgaggcaaattaaaacttgggttaaaccttgactccgagttcctcgtcccgatccccgggctttttgggcctgctccccgactccgagcaaaaaaaaaggtgtaaattttttgttgaaatataattttgaccatttcctgatcgggattaccgacaattttgcactcgccgaccccgctctgccctcgcccgtattctccgagaatttcttccccgagggatcgagggaggggggcttaactctaattaaagcctttgttatttgctgggcctttttttcacatattcaattccttttatctatgcttggctatggacccaaatccgtagattaaacaaaattcactgcccatctcgaccccggccttttccaaaattcccggttccgtacaactctctaaaactaaatatatatataactccaggcaagccctgctgttgttgcaattgctgtaactgttgttgctgttgccataaatgcatgtgcatctgtgtccgcccatcatgctgctgcaagtgctgcccaagctgctgtggatgtaaaaatgtttaaatttgggcaaacatttttttaaaattaattattcaaattatggagacaataatggacatatattacagtattccttttgttagtttgagttgtacggcgattaatttatttttttcccacgaatttgatttaaaattaaaaacaattggcaattgtgaagattattggtcccacaaaaaaaaaga

SEQ ID NO: 73194 - DNA, 534 bp, Heterodera glycines
  Genomic contig location: Contig_ID=SeqID_10111; Location=113..646; Strand=+
  SCN-specific regions: Sequence locations=1-295,317-347,369-534
gccctggctatgggtgtggatgccggcgccgccgtagacgagcattgactgctccatttggttatccgatgccaatgttcttacaacagttacgtacgccaatctatgagccgagattatgccgcgaactttgtcaggtaacaaatttctaattaatccagttcttatttaattaataaattggttttttttaaggtcagagttttgagtgagcgaagccattcaattggtgaagtgcacacaaatgtgaatttaataagcgcagacgaccggcaaaggatggccgcttcggcggcaggaaatgaaaagctgtgaaaaagcaatgacgacatagcaatataaaagattagataaataatatattctattgtgtatgaatagggtgtatgcattgtttattatttaattatggggagataaagtattttctgctacctatttttgtttttcaattaaaaaaaaacaattgaatatatttttggtaggacagtttttcttcgaataattatgttaccaaaaaatgaaagaaaatca

SEQ ID NO: 73195 - DNA, 604 bp, Heterodera glycines
  misc_feature (102)..(102): n is a, c, g, or t
  Genomic contig location: Contig_ID=SeqID_10111; Location=816..1419; Strand=-
  SCN-specific regions: Sequence locations=1-169,191-371,393-563,597-604
gtcgtcttccacgttgtcggcgatcgtcaattggttgagcaggacatctcttcacgccatccgtgcatcaatgcattgcgaaatgtcatccgtttggcaccncattctggcatcaatcatatcacatttccattacttttggttgagcacatgactgaggtgtttttgcatagttttttatattatatttctccccgaccctcggggtagaaaaacggagaggattttttttaaatctaaaaaagatatttttctaataccaaaaagtcttataaatccatttaagaagtctctcatccgacttaatccatttcttccacacaatgttttttcccgctagtcaatgacgatcagctggtgtttgagccgtgccgaactggtcttcaagtgcctgaagggttttctgatggaggtgtgctccagcgggatgagcacagctatcgccggaggcggtggtgccatcgttggcgcctcgggcaatgctggtggcgcgccccattttaatataaattttgtgttgccgtctgcaatttccccttcattatttcaacaattggtggaaatgttctcctccatttttcattcagttccctcgctaaatgct

SEQ ID NO: 73196 - DNA, 835 bp, Heterodera glycines
  Genomic contig location: Contig_ID=SeqID_10112; Location=370..1204; Strand=-
  SCN-specific regions: Sequence locations=1-342,371-567,591-629,674-835
atgaaagcgaaccgcaagcgtcgtgcggcggcggccgctgtacgacaacgacgaaggcggcaacagcagcaaaacgactgtgacagtagtgaaaaggcgaataatgaaccgccgccactcgccggtttacaagcatcagcagtagaagaaggtgaatttggttagggtacagtacaccccaaaatatcgccgagacaaaatatcgccacagaaattttaaaagaaaatttttttttggaaaattttttcaaaaaaacttagcagttttcataaaatttcgaaaaaatcgcaaaagtttttcaaaaaaatttttcttgagattttcttactaagaaatttcctaagaattttttatgaaatatttctgtttgaaaaaaaaatttttaaatttctgcggcgatattttgtctcggcgatatttcggcggcaatattttgtcccgtccccatttggttacaccacatttttccgggactttaagtcttcttcaatttatgcaaagaatgtgtaagctttgaccaatcaattacggaaaaattgatggcctatgagactgatgattgtgagaatgttctctaattaatggaccaccccgtaaactgcaatagagtcgcttttaatactactactatatatatatatatatatatatatatatatatatatatatataattatagcatcattgccacgcctgatgatttcgacttgtaataacgacattgtggacgacaattctgagttttctcaaggtgcagtgtattacactagaacaagcagttcggctccaaacaatcagtgcaccaccgcacgcatttataataaagtcatgtga

SEQ ID NO: 73197 - DNA, 285 bp, Heterodera glycines
  Genomic contig location: Contig_ID=SeqID_10115; Location=311..595; Strand=-
  SCN-specific regions: Sequence locations=1-285
atgaaggaggggaggggggtaagttaccccctcaaattgaaaaatgcatagggagttgcattagagattttcctgattttaaatttatcagtcaccattttgtcgtcggacaacagaagttcaagcagttcgtccgcacttttgtgcgccagtcgatgccgattttcgtcagctaaattggtgagaaattttttttcaggattacggttcgaaattgctcaaatataggggagaatcatggaatttgttccatttttcggcatttgccccagtctaacaaataaa

SEQ ID NO: 73198 - DNA, 970 bp, Heterodera glycines
  Genomic contig location: Contig_ID=SeqID_10115; Location=787..1756; Strand=+
  SCN-specific regions: Sequence locations=1-102,124-190,212-267,289 -414,437-476,520-773,796-970
atgcacgcgctgttcgcctgccgattgtctgtggcacgcgcgttggtcgcccaccaattggcccattgcgcggccgcggcggtgatcaaacggagcggtgagttgtgggaaaatggaataaatggactccaaaaatgcttaaatccggcaaaattttgtttgtccaatgccaatctaatgcccgacttcctaaaatattttaaaatggcattttccatggaatttatccaggcacaacccaaaatttcgctgtgacataacgccaccaaattttttttatttaattatcaaacttagcaattttcaagatcaaaaatcttggaaaagttaaaaaaaattcaagaaaaaaattcgtagaaagatttataaggaggatattttaagaaaaaattgaaaacttttttagggtatttgaaattttataataaatatttttccgttccgtagaaaattgtcaaatgttttctttaaattttctaatgttttcttttaaaaatttgcccattattttcagtactaatttatttcccctctttttcagtcacttttctgctcaactctttcaatccgaggtgatcgtcgtccgtctcatatattttcctcgccttttttggctttttcaatttttctcccctttttcctcagtttttgcccctctttggtggtcacttttgtggccaaagtgtgcggcgcgccagcggaggacaccaaagttggcttagtgctcaacggggagcaatgctttgtgttggccctttacgttttggaggcacttaattaattaattatctaattggttgcctaatcattttgcatcgtttaatgaacgcgtttgttttaaggacattgaccaacaattcacgcctgacatggtcagttcggatggtgtcatttctacaaaaaaatgaataataatttgctacgatattttcattgcacttttcggttttatgaccactgaaatttttaa

SEQ ID NO: 73199 - DNA, 326 bp, Heterodera glycines
  Genomic contig location: Contig_ID=SeqID_10116; Location=497..822; Strand=+
  SCN-specific regions: Sequence locations=1-24,46-77,120-134,156 -301,323-326
atggaattgggcatttctaaagagacatttataaaatggaaaaaagaattaacgccaaattataataagagtatgagtttttttattttaatttattgtttttttattaaataattttagctcaaaattccattgaagaaaaattacaaaagatgaagcaatattttgaaattaaagaagcaaatccaaaaatcagtgacgaaataattgctgggaaattggatattcaactcttagaaaatgggaaaagtttcttaatatataatttgttaatgtacgactactggtttattgtaatctaattgctttgatgaaatgcttttcta

SEQ ID NO: 73200 - DNA, 439 bp, Heterodera glycines
  Genomic contig location: Contig_ID=SeqID_10116; Location=2086..2524; Strand=-
  SCN-specific regions: Sequence locations=1-391,432-439
atgggtgaagaaatggggacagacccaaatggtcaaatgagcgaatattccaatcaaatgttatcaaaagtgatcaaaatacgcgaaaagaaccaaatgatcaacaaaaaagtaaaatgatccaaaaatttgaagcaattaaagaaaagttgaagaaaaatgaaaaataccaaaacaaagacagagcaaaaattgagttgaaaattgcaaaatcattaggcgtaaatcgacaaaaaatatacaaatggaaaaaagaattaaatttaaatcaaaataaaaagatggaaaagagtttttatgtggagaaaaagatcgaattcattgaacgatttaatgaatttaaaagttttatggaaaagggaaacagaaagaatttgtgggcatttctaaagacacattttggagatggaaaaaagaattaacaccaaaatataataaa

SEQ ID NO: 73201 - DNA, 658 bp, Heterodera glycines
  Genomic contig location: Contig_ID=SeqID_10117; Location=924..1581; Strand=-
  SCN-specific regions: Sequence locations=1-112,157-450,473-592,614-658
atgtcacaccttttgactcaattctacaggattaatgtcgatccagtggtgtcgataggcgccgccggtaaatttttttgcaaattctaggtgaaatttgagatgaaaattgaatttattttgattgattttattataaatttattcaaaaattttggcattccgtcttttaaaattttcaaagaatgcatgcggatcctgccggatcccgcacaaaaatcaaatgcggatcctgttgcaggattggaattcaaaattttttgccggaccggatccggctggattaataatgcaaatcctgcaatcctgcaaatcctgcattttccaaacaatgcaggattgcggactgggatcctgcaaaatcctgcgcatgatccggtcctgctccgggctctaccccttagtgccctggttcatttccatggttttgatttttgaaattaaattagccatttagttattttggtaataatttttgaagcctaccagaccgcttgacaatcggaatttttctctcaatgtttgaactgattttcttttgaaattttcctttttgcttcaacttttctttaattgcatcaaacttttgaatcatttttcttttctgttaatttgttaggccattttctttgccattttgaaaaacagaatgaataaa

SEQ ID NO: 73202 - DNA, 58 bp, Heterodera glycines
  Genomic contig location: Contig_ID=SeqID_10117; Location=2039..2096; Strand=+
  SCN-specific regions: Sequence locations=1-58
gtcaagccaagtgttagacaaaattgctcataacgccaaatagcgtaattggcgtaaa

SEQ ID NO: 73203 - DNA, 1421 bp, Heterodera glycines
  Genomic contig location: Contig_ID=SeqID_1385; Location=94..1514; Strand=-
  SCN-specific regions: Sequence locations=1-149,188-299,323-332,355 -634,656-1269,1291-1421
atggccatattaattttggccattgctcttccgttagcttattgcctcgtcgatattaaagaattggaatatttgcgggccctcgacgattccatttcgtacagagtcgtgtttaagtcagtttcaacaataataaatgctttaattacttttgtaaattgctttatttttataatttaggccatttgacgaattacctgagcaatttcttccatcagagcccacaacaataagtccaacgaccgcttctccaaagacaacgacagcggcacaagaaccaatttcagaacatgaaaaaggtccctaatttaaacatgttttacgatgaatgccttttttcaaattttgaaattgctacaaataacttgtttttttagtgggggattagttaaatttaagtattttttatgttgttgtttaaatttttgttgtttgctaattccctctgttatggggtggtcaagcgtgacgtaattttcataaaacgaatttgtttttcaaactgccgacttaattgagtattttaaatttaccactcctttttaaaatggcaattattaaattaatttgtttagtttcttgttttagtcttgcagcagcagcatgaagataatgataatgaaattgatggaagtgaacaacaacagcaaagtcagtcttcgcctttgtcttctccgtcgtcgtccttttcgagcagttcggccactgcggaacagcccaaattggtcaaaattgtgtctgctgacgcggaggaataccaatgcgtgttgcccgtgttggcctcgtctgtgcgtattttctaaatttatttttacctatttttgtttttaaattggattaaaatttgttttagtccaaaaagcggatcaagtcgtaccacgggccgagtccggccgaactgatccaatccatctaccgggagcagatctgctcctatcgcatcgagccgtactggaactacgagctgtgccatggacggtatgtgctgcagtaccacgaggacaaggagagcaagaagcgcacggagtactttctgggcaattttgtggccatgaacgctgaagtggtccgttttttgggctattacccccaaaattcgaataatttgttgccgctttctcccccttccactcgaatttttgttgaactcaaagcgtgtggaatttgggaacacattcaaactttgattaaaattcgggttcaaaatacggaattgttcaaacaaaagcctcttttcataccattattaaataattgcaatttctaaccattttaaaaactttttcattttcggttacaaaaactgattatttatttcactgattcaggaggccagacattttgaccagctgaacccgccgactcgcaaaatgggcgacgaacggttggcttattacccagtgacttacacccacggcacg

SEQ ID NO: 73204 - DNA, 693 bp, Heterodera glycines
  Genomic contig location: Contig_ID=SeqID_1385; Location=2296..2988; Strand=-
  SCN-specific regions: Sequence locations=1-173,195-693
atgaagcgaaccaacgcaacaaacatcactccgcctcgcgccaaacgctcaatggcaccggcattggacccaatcactgccgcactcgcagagcaagaacgccaacgtacactggtgttcattggcctcccagaaagcaatgccgttcgcccatcggagcgtgttcaggaagacagggaagccaccaccaaaatcttggaccatcttgaagttgaggccgaaccaaccgccgtctttcgactcggccggtacgacccgcagcgaacaactccacgcccgctcaaggtggtcatgccgacacccacacaacaacacgtggcactcggaggatggaagcgtgagcgtgctcgactccgttctcaacaaaacctggcgcgtctgttcgtccgcccagcgctgaccaaagagcaactcaaggaggaatacgaagaacgcctccgaaaacgtcaacagactccagctccattggcttctgcgacgaagttctcacaaacgacaaacgaccaaactcccgttgttgcaaaaggaccaaacaagaagaagaccagtgaagacatttcccaaccgccggaagttttcgataaaacaatcctcgtctgttatgaaacattaaattcattgccaccaaccgacaaaattgttcaccaaattcaatcgctcaaaaaacaacaccctcatcttttcaataaatag

SEQ ID NO: 73205 - DNA, 150 bp, Heterodera glycines
  Genomic contig location: Contig_ID=SeqID_1386; Location=4966..5115; Strand=+
  SCN-specific regions: Sequence locations=1-150
atgactgtgacatcgacaaaaaacaattcttttccgagctcatttaaagacattactctacacgacgtatgggccagcaatttggaggccgaatttgccaaactgcgcgacctcatcgacgactatccattcgtggccatggacaccgaa

SEQ ID NO: 73206 - DNA, 1169 bp, Heterodera glycines
  Genomic contig location: Contig_ID=SeqID_1387; Location=610..1778; Strand=+
  SCN-specific regions: Sequence locations=1-196,222-436,458-504,528 -716,738-741,763-793,815-938,960-1135,1161-1169
  Gene Ontology: Mol. function=transcription factor activity; Cellular component=nucleus; Biological process=regulation of transcription, DNA-dependent
atgctggtcaaactgcccgaggacgagaaggacttcttccgctaccatcgcaaattgttcccgaacagtttcgacatcaaaattctgttgcgacagcccgggccgcgcgacgccatgctcaagggcggacttcaggaggtacggacgccacgggcaattttgcagttgaaattgggtgaactgctccccccccgcccacaaaatttatttagttttttaaaacgggacaaattatttttattgtcataatacttactagttttgtacatcgttatataaaacggttttgttagcctttcagctggccgaccaactgcacgtcccgcgcattggccaatgccaccaggccggctcggactcgttgctcactgcgatgactttcttcaaactgcaggaattgtttttctcggacaattggagggaggtgagcaacagtttcccaaccattgtttacggaccaataaccattggactacgaactaataaatgaatttcagatttctgccaaagttcaagggcacatggccggtctgtccaatagtcagctgaatggtggcactggaatcacgacgaacaacaacgggttgggttaagggcgccggaagagggttttttctgtccattgtctcttttattttggctgcacaaatctcgcttaatcaatggatgatgatccgtccgtcatcaattatcatatttattgttattcgtttctctttctcgatttgatgttctttatccatttttctttccttcttcactcaattttcattgaaattgtaaatgcactccgaaaaacaacaaatttataaaaatggaaatcgactattctttgactcgttagtttatgttttgagtggttgatgaacggtagcgaaatttctgtaccatgcaattcgcccctccccgctctaacaattctttatgaaaaaaacaccgtgaaaatctgaaaaccaaaatagttaggtaaattcaaactttggtttaataattaattactgtttgtgacgccccgaatttttttccataaattgaccctggcttacaattagtcagaaacgagatctgcttggtcattcttggttctaaactcaattctatgctgacttatccctgtgatttatatcaaatctaattcataaacaatagaaatttatttgctttaagta

SEQ ID NO: 73207 - DNA, 1852 bp, Heterodera glycines
  Genomic contig location: Contig_ID=SeqID_1388; Location=410..2261; Strand=+
  SCN-specific regions: Sequence locations=1-1,23-338,360-377,399 -622,652-800,883-892,914-1102,1124-1787,1809-1852
tggggacttccgccgccgccgcaacccaacggcgttcaaccgacttggctcagtcgttgctccaacgacggtcagtgctcagccaatttggcagtgcccagtcgtcggtgtcttcctccgtcgggaggtgagaaataatgaaatattggtgaaccaaaaccttatcatgcattgtacatttaccagagttaagggtacttttggtttttggggaaaactatgtaaatatccatgtttttacggaactcattgtcagttacactccgtcaatgatggccagcaaaattgacaatcggcccgccattgtcatcgaaattggcactcgactgaccaggcaattttttcaaaaattccctttctaatcatgggccgtgaaatttatttttccttttgtccaggattggctttgccggtgattttttgccccaggagattttccgctccgaattcgttgacccattggacggtccgtccccgtcctccccaattgcactgtttgaccggtcgcgcactgagcaacagcagtacgaagtgctcgtcaaattcttcaaaaacatcgttttcgggtcgcccaaaagtgccaatttaactaaaaatctaaatttttctgacatttttgtggatttttaattaattttaaatgaatttaaaccgaattttcagcaaattgttgaccactatgagctcgcgtcgtgtggtggtggtcgaatcgcttttggtgtccaattggcaacggaatgccattgcccgtgccctcttccaatgcccttctctaagcgctcattccgtaattaaatatctgttgttgttgttgttgttgttgttgtttaaatatccgttgttgttgttgttgttgttgttgttgttgttgttgttgttgttttgtattatctttataaaattgcagattttgttcgctccgtcccatttgtgctgcacttttcccttcaacacaaaaacttgtctggtcattgacatgggtgctgacgaagccgtgctctttccggtcatttttttgtaaaaatttgtcgaaagcattcatcgacattccatcaaattaattttattctcgaagatagaaaattcaatgaaaaattttgaggaataaaaatcataattttttgactaattttatagtgttggaagaaaatttgctcggcatatgccatggaattctttagttgacgcccttttcttaggtagctgaaggggtgctgatgctgaacagtttggagaccagtgtggcgccctccgcgacggcgttggagcaaaatgtgcgtcgtttgatggcccaatttggccgtctgcggaccgggggttggcaaaaaatataaatccgaaatgtaagacaattaaattattcgaataacatttgacagccgaagacgatgcggagggacggccgctcactgagactgagttggaacaagcggaccgaatgcgactgtgggaggacgtggcggtgcgcttctgtttcgccacaacggccgcgcgcggaaaacgcattcagacgtattgtgcgtggggaccggtgaaatgattttcccttcattccaataacctggactgtttagtgaggggggggggtacgtgcccacttaaaaccattaaatttcccaattcgcttttttgagtggccaataccgattccgctgcttcttcgtctgccgattgttccgctgcgtttgacgcggcttcggctgcgccggcggtggagctccaatttggtgccgcccatctactgacagtgccgggcattgtgcgcgaggcggcggccgaagtgtttttcagcgccggcgacgaggaggacgtccgatcggtgacccaaatgattttggacagtgtggccaaa

SEQ ID NO: 73208 - DNA, 2305 bp, Heterodera glycines
  Genomic contig location: Contig_ID=SeqID_10118; Location=7..2311; Strand=+
  SCN-specific regions: Sequence locations=1-366,388-642,664-874,896 -1126,1149-1539,1561-2305
atgtgcgccgcacaccatgaatggctgacaaagcaaaagggacaaaagctaggcaagaagatgaatgtcctgcgaattggtggcctcatggtgaacatcctgaatggatcaacacgactgatggaagtcacgatttgggtgaatgacattccgatcaaatttgtgcttgactcgggtgccgatttgactgtgctggacgaagtcgcacacaaggctattggaaagcctcggctgacccactgcaatgagcaagccgtgtaccatgacggtacaagctgtaagcttttgggtaaaggcacagcacgtttttcatttggaggaaaaacagttaatgggaaatattatgtgacgaagaaaggatcactcagtagaggaagaactggaccgattgttggagcagaaggtgatcaaacctgttgatcacacccattgggccgccccaattgtggtggtgaagaaggccaatgggtcaacgcgtatttgtgccgatttttctaccggtttgaacaatgcgttgctgcttcatcagcatccacttccattgcccgatgatatttttgcgaagctgaacggtggaaggattttctctcaaatcgacttaaaggatgcttatttgcaagtcgaattggatgagaaatccaaggaagtgtgcacgattgccacccaccgaggaaattaccagtttcagcgactgccgtttggagttaagtccgcgccaggcatatttcagtcaattatggactcaatgctggcagactgtccatttgctacggcatatttggatgatgtgatcgtcgtaagccgatcatccgaagatcatcagaagcaccttgaagaggtcttcaaacgttttgaaaagtttgggttccgtgtcaagccagagaagtgcttcttctgtcaggaccagatcaaatatcttggatttattattgatcaggacggaagacgaccggaccaaacaaagattcaggcgatttctgagatgcctgttccgacaaacgtgtccgaggttcgatcatttttgggaatgatcaaccattaccaacaattcgtgaagaacatgaggttcatccgacagccgttggacgaattgttgaaacaggacaaactgtgccaatggtcggaagattgtcaaaatgcctttgagaaggtaatcaaaattttgaaatctgatcaattgctgacacactacgatccggcacaagagatcattgtatcggctgatgcttctgagcatggaataggagccgtgatctctcatcgtttttcggatggaagtctaaaagccatagcacatgcatcatcgtccctgtcagcagcagaaaagaattattctcaaattgagaaggaaggcttagcgattgtctttgccgttcaaaaattccacaagtatcttttcgggagacacttcgttctgcagacggaccacaagccgttgttgtccatttttggcaacaaaaagggaattaaggcttgcacatcgaatcgattgcagagatgggcaatcactttgctcggctatgacttcgaaatcgaataccaaaatactgctgattttggtcaagcggatgttttgtcgcgcctaatcgcgaagacaccagtgccggacaacgaagtgatcattgcaaacattcgtgaaagcaatgaaacgggagtgttgaattttgttgcgaaaactctcccactggatcacaatgatttgactaacgccgcgaaaagtgatcaggtgatcaaaaatgtgaagaaatttgtctgctcacattggccaacaaagaacaaaatggccgcagacattgttccgttccatcgacgacgagacgctttgaccatcgaggatgaatgtctgctttatgcggacagagttgtgattccggcctcgcttcaaaaagatgtcttacaacttctgcaccgaggccatcccggaatgaagcgaatgaaaagtctcgccaggcagtacgtttactggcctgggatggacgaacaaattgaaaattttgtcaaaatgtgcaacgaatgcacaatggaggcaaaaatgccggtgaagactgagcttcagtcgtggccgaaagctgacggaccgtggaaacgcgtacatttggattacgccggaccgtttatgggaaaaatgtttctcataattgttgacgcgtactcgaagtggcccgaggtcttcgaaatcgttcatcgaattccgcagctacaatcgacaaattgcggtcactctgtgccagttatggccttcccgaaattttggtcacggacaacggcacacaattcgcttcaaaagaatttaaggaatttgtga

SEQ ID NO: 73209 - DNA, 1593 bp, Heterodera glycines
  Genomic contig location: Contig_ID=SeqID_10118; Location=3619..5211; Strand=+
  SCN-specific regions: Sequence locations=1-171,193-618,640-1081,1103 -1593
atgccaaatttggcaaatttcgactgttttggtcttggtgaccatggcgaaagcgacatcgagggttggctggaacgcttcgcccttgcgcttgactgctcaacaccgaaccttcaggacgaattgaaggttaagctcttgctgacaaagctgagtgagacggcctacgccgagtacagcaaacattgtttgccgaaaaagccaacagagtttgactttggcaaaacttccgaaatgctgaaaagcttattcgcgaagcacaaatcagtttggatcaaccgatatgagtgcttaaaggctgaaaagcaagacgaggaggactttcgcggcttcatcaaccgtcacaaaaggctgttaagcgattttgagtttaagaaactcaacgaagagcagttcaactgcttgatgctcctcgtggcgctcaaatcgccgaaggatgctgaattgcgaaagcgcatactgtcaaagttggctgccgacggtgacagagcaacatatgaaagtgttgttaacgacttacaaatgtttctgtcgaccatatcggaggcaaaagtaatggagagaccatcgaactccaatattttggctgtaaagcgcaggcagcaaccgaagaaggacaattttggagaaaagggctataagcagcaatcatgttggtgttgtggcagagagcacaccccattacactgtccgcatttgaagacagtttgtcgaaaatgctcaaaagttggacatgtgcagagtatgtgcgccgcacaccatgaatggctggcaaagcaaaagggaccaaagctaggcaagaagatgaatgccctgcgaattggtggcctcatggtgaacatcctgaatggatcaacacgactgatggaagtcacgatttgggtgaatgacattccgatcaaatttgtgcttgactcgggtgccgatttgactgtgctggacgaagtcgcacatatggctattggaaagccacggctgacccactgcaatgagcaagccgtgtaccatgacgatacaagctgtacgcctttgggaaaaggcacagcacgtttttcgttaggaggaaaaaccgtgacagggcaatattatgtgaccaagaaaggctcacttaatcttttgggaattgacatgttggatgcctttggcctattggacgctttcagaagagaagttgataaggccatgaaagtcaatgtggtgaagaaggaagcgaaggattcgccgaaccctcaatcaaagaccactttgaccgagctccaatcaaaacacatttggttgtagtggaagagctggaccgattgttggaaaagaaggagatcaagcctgttggtcacacccattgggccgccccaattgtggtggtgaagaaggacaatgggtcagcgcgtatttgtgccgatttttcaaccggtttgaacaatgcgttgcagcttcatcagcatccactcccattgcccccgacgatattttgcgaagctgaacggtggaaggattttctcacaaatagacttctccgcacttcacactttgtcgctgaccgaaacaattacttattttttataataatccaaaacatttttttaatcaaaaaga

SEQ ID NO: 73210 - DNA, 941 bp, Heterodera glycines
  Genomic contig location: Contig_ID=SeqID_10119; Location=35..975; Strand=-
  SCN-specific regions: Sequence locations=1-4,116-150,172-360,382 -836,888-898,920-941
atggaagagaaaaaaggcaaaacacagacagatgtaaaagaaaaggcgaacgagagagaggcagagaaaaagacggaaacaaatagcacggaaaaggaagagacagaagagaaaaaggaaacggaattgccaaaggaacagccgaaaaaagtgccaacagagaaaaagacgaaggcagaaggagcaaagggaacaaagccgacagaggaaaaagcgacgaaaatgcaagcggagggaacggcggcaccagcggaggatgaagccgggggaagtgacgcggcaaaagcgaatttggaggtgccaaaaaaggagccgaacgcaaaaaacgcagtggcacaagctgaaacggtgccgacattcacaacggcaccaacagcaactgccgattcaaaaaacggacaagccgaggggtcgtcgcatcagcagcaccatcggggaaggctgctgatggtaaggagcgaaaatgggcaagggacgaaattatataacgaggggtaattaaataaaaggggataattaactaatgggggataattgaatgggttgcttttaggtcaacgggggagggagcagtaacagcaacatcagcagaatgatgacggtgaattgctgcaaattgtcccttcgtttcacattgccccacttctttgaagactcctcggcgaacattggtcgaagtaaatggcacaaacagtgccaatggaaacgcaaaccatcgaaaaccgccattgccggcgcggcaattttcaatgggtgccgaaaatggaacaaaaaacaaagcgatgaaaaagacgagcggagacattgaccaaattgggacggaattatttggccgtaaaaagagagaagaggaagaagaagaggaggaagaagaggaagaggaaaaacagaagggaggagcggaagagagaagggggagtcgaatgcaaatccaatcgcaa

SEQ ID NO: 73211 - DNA, 898 bp, Heterodera glycines
  misc_feature (881)..(881): n is a, c, g, or t
  Genomic contig location: Contig_ID=SeqID_10120; Location=1..898; Strand=-
  SCN-specific regions: Sequence locations=1-49,77-272,294-421,486 -609,631-759,784-898
acaatgtcggagagggaaaaagaagcgcaaatggaagagaagcaaagggaagaaaggccaaaggaaacggagaaaaacggcgccggaggcaatccattggaacgcatcgaacgactgctcacttgcccaatttgtttggacaggtcaaatgggggggggggttaataagtgtgtaggtcttttgaaaaaacaatgcttttagtgatattctcggaagtgtcgactccgagtcgagaaaagtttggctttctcgattctctgggcccactccgattttgggcttactttttgttcaaattttgtttctttctcttccactctctttcattagcttcttcttttcttccttgttaaagttcagctccttttcaggtacaaacagccaaagcttctcttctgccaacacactttttggtggcttttcccttcttttctctctctctctctgtctctcaccgtttccttctcttccctcccctttcctttagtctttcttgcttggaaagttacgtcgaatcgtccgccattgctcggccccgaattcgttgccccgaatgccgtggcgaaaccggtagtaaacataattcattaacaaattcttgggcatcgtttgttttgtgtttctttagcattgtcagacggagggaatgtgcaaagtttgccgacgaatttgacacttttggcatttttggaaattcatttggaagcgagcgatgtgaacgcagcagaaatgcaagcgtatgttcagaggtaggacaaaggagcagcagaagcagcagccaacccaccacattggcatttccacagattcaacttggaacggtgccgagtttgtgaagaaaaggccgagttggaagggtgcgcgcattgcgagcgcaaantgttgcggggaatgccg

SEQ ID NO: 73212 - DNA, 1224 bp, Heterodera glycines
  Genomic contig location: Contig_ID=SeqID_10121; Location=801..2024; Strand=-
  SCN-specific regions: Sequence locations=1-77,276-286,466-500,597 -597,623-792,814-988,1012-1224
  Gene Ontology: Biological process=N-linked glycosylation
atgccgagaaaggaggagaaaacgacaaaggcaagtcaaagacaagcgcaagacagaacagaaacaaaagcagcagcagaaaaggagggagagagaagagaaaaaggaggaggaggcaaaaaagaaaaagaggaaaaggaagaggaggacaaagaagaaaaagaggaaaaggaagaggaggacaaagaagaaaaagaggaaaaggaagaggaggacaaagaagaaaaagaggaaaaggaagaggaggacaaagaagaaaaagaggaaaaggaagaggaggacaaaaaagaaaaagaggaaaaggaagaggaggacaaagaagaaaaagaggaaaaggaagaggaggacaaagaagaaaaagaggaaaaggaagaggaggacaaagaagaaaaagaggaaaaggaagaggaggacaaagaagaaaaagaggaaaaggaagaggaggacaaagaagaaaaagaggaaaaggaggagagcaaaggaatcgaaaatagcacaaaagagagagaaagaggcgaaagagaaaaggagagagaaggaagaaaaggaaaaggagacgaaagggaaaaagagagagaaggagagaaagagagagaagggggaaaaggagaaaagggaaaagaacagtcttcatcggatcaacagcaatgccaaaccatttgtcggcagctttctccgcccattcgactgcgaactcagcacaaccggcgaaaaccgcgagtgcttttcacgccggaacaagtgagtgaacaagaaattgggcgaaggcggggaaaattggaaattggcaccaaaaaagggatggaatggcatttcaagtggagaaatttcgcattttgaggtggccaatttggaacaatactttgaacgccaaaaatatgtgaacagttcggagagagagcaattggcacgcgatttggggctgacaccgacgcaaattaaggcgagaaaaacattggcattttgttcattaattgctcactctgttcagatttggttccaaaatcgccgttacaaagttcgcttttcatttcgctttatttttgaatttttattatttagtgcaaacggattgaccaggatatgatcctgcatcgaatgactgcacagctcagttccgtccatcagcagctgatcaccggcggacgcatcggagcaatgcaaacgcaaaacgaatttagccgaatcactttggccagcattttttgcaaccagaaattttga

SEQ ID NO: 73213 - DNA, 1820 bp, Heterodera glycines
  Genomic contig location: Contig_ID=SeqID_10123; Location=1222..3041; Strand=+
  SCN-specific regions: Sequence locations=1-504,526-538,561-635,670 -718,757-851,873-1504,1555-1763,1804-1820
atgaccttccacgaacgaagaagggacgaatataatttgtacacagaaaaactcagaaacgacgaacggataagcagcattgacacgcacattccggtgcgcattaatgcatttgagatgaagggccgttgcagtgtttacgtgcatgaactgtccttctttgccaaatatggagaagccgaaataaatttggcggatgggccaaacaatgagtcagttttttttaataatgggttcgattgaaattgaaaataagtctttggggctttcaagggcgctgatcacgaatctgaactcgggtttgcccatttccgaaacctgaaccagaattcgaacaaaaaatttaaaaaaatttccaaatacgcaattttatggggaaaaactttgaattcatttaactactatttaattgatgcataaaatctcgttaaatctttaccttttatttatccaaaatatctatgtagcaattggcttgtggtttatgttttttttggttgattatttcccctcaactttttaatttttaaattatcccatgacaatcaacaaccttttataaaagtcattatttatcagaatataacgattttatgataaaatctgatacacgggaaagttcggcttatttgttgtaattttttaaaattttaaatattgaaatataatggcgcaaatgaactgcttgcacaaactttcagtaaatttttccaaaaccaaaaattaatatttttgatgaaattttatttaaaaaatctggccaaaaagacgttttttgtaataaggtcaaaaaagcaaataatttgttttgaaaaacaaaaattgtttttaatttataagattttaatcgatttttaaatgtaaagggaaaattcttcaatttagtcacggagttttcggtctctaatatcgggaaattttcggtctcgagcatcactaattcatcccggcatattctttgtccgaactttgcacttattttgattttcggtcccgttctaataaaagccatgaaaaacgaaaaactatgctagaaacacaataatttcagtgtggccaaagagacgcgtcgcgagttgcattggtctctctggcagattcttttggccaaatacaaaaaattttttggcggcgacaatacaaaagagtatttctgctatgattgtgagaacaagctcttctcaacaaaatcgatcataagaccaggatctttcaaagaatttatcatcgacttgaaggtacggtacagggaccgtcccagggggaggggggggggggtacagtatccctccccaggcccctactcacatggaatttataaaatcagaatttttgttgaaaatttcgattttgcatgttggtacacccttcaagcctaccgcacacaaatttttcaaaaaatttcgctaaacttttcccacaaaatagcatattttgtgagaaaaaatctgccaaaatgcacattcttccgtctcctatcggcaccgccggacccaaagaatccttaattttaatatataaaatgtatttaaataaataatatgaaataaatatcatctcagcaaacactgatattgaacagtcgctgctatgattatttgcacaaacaaaattttgttgctttgcgcgcctctctaaaggcaattggctacgaaagaatcggcgaagtgactatcacagaaccgggctgcggtgagcaatcgcacacgcggaagtttttcgaattattgtcgtcacaaaagttatttgaacggtaggttttgttttaaatatctaaattaaaattattttcaaatattaaaacagtgaaaatccttgaa

SEQ ID NO: 73214 - DNA, 1642 bp, Heterodera glycines
  Genomic contig location: Contig_ID=SeqID_10124; Location=449..2090; Strand=-
  SCN-specific regions: Sequence locations=1-437,459-473,503-1059,1081 -1104,1141-1189,1211-1268,1290-1642
atggaaatgggcgtggattcattccacgatcggttgtacgaccgattggctgttcaatacgacagtgacgagcaaatggtcaatgccatccgagggttggcacgaccgctggtcgaattccacaacagtaagcattttaacataaattttaattcaaatgtattagtttcaattttttcttttctttttttgcgcttcagtcgcaattcatatggacgtaaacccgagaaattatttgtacgtggagaaagatgggcatttggtggtgaaactgatcgatttcgagggtgccaagttggtctccacgtccaacaaaaatgaatgtgttgtgatcggcgaagagcacgcactaagcccggaatacacagggcccgaatattacggcgaacagagccaagcagtgtgtttatagagcggggcaacattaaaaaagtgccggaaaattgggtacaaaacccaaaaaatgaaatggcaattaaaaaataaaaacaaaaatttaaaactaagtcaaactcagagtgataaagttttataccagaatttaaattttggtaatttttttcaacagataagcacaaaatttgacatttggtcaatgggaattatgctcattgaaattgcatttgaccaatttcgtgctcaacaaagagagacgccgttaattgaagtgagaaaaaggaacatcaaattaggaaaagcaaaacaaattttggttttttcaatttacactttttttttgaattaggatgaacggaaatcaaggctttttgccattggcaatttgtacctcggatttacgcggaatcgtttgggcactcagccgggcattttcaaagagactcaaattgtgtattccgccggcacagaatggattgagcagcaccaaagtgcaattgaaacggtgctgcacatttggatgaagtatccgaagacggcacttctggttacagtaggaaacgatgggaaaatgatggaccaattaaaaaattaatcaggattaaaaatttcaatttttgagttttgggaaattagaaggaaacgggcgaacaaagcagtaaaaaggagcagaatttttggaaaagcattgtcaaacaaacaattttgaataaattatctaaatacatttaattataaaattttcgaattttcagaatttgctaaatttggaaagaaaaaagcgattaaccgcacaaggaattttaaattacattgacggattatgccaaattggagaatttaaagaagttaaaacttcaaaaaaattacgcatttttaattcgttgaattttggagattttttaacgaatttgcgtgtcacaaaatggaaaaacaaatttaattttttgaaagaaaatcgatcagaattggataaaagttataaaaatctgaaaaaaattctaaagaaagtgatcaaaaagcagcgaaaagaaatgaaacggctgaagcgcgagggaacggcaaatctcaacgattgcgaaacggagtgatcggcgaaaggagcgggtgattgatcagaaggggtgccatttgcaaggataagccggcagattcctttgttgatcactgatttgtagagaccggatttttgaaaattcattgcataaattcgaggactgtacccgggccggctttcgggattaaa

SEQ ID NO: 73215 - DNA, 327 bp, Heterodera glycines
  Genomic contig location: Contig_ID=SeqID_10124; Location=2506..2832; Strand=+
  SCN-specific regions: Sequence locations=1-72,115-125,148-183,219-327
atgacttgtaagaaatctcaacttgaagcgattctattgaatattttccgcattttgttgcattatttgtgcaaattttttgaataaaaataaataagaaaaacaataataattcttctattagcattttaactaaaattttaaaatccttgttaattaattttggttaaaagttttttttggttattatttaaataaagattaattcttttaaaattgcagggaatggaaaaatgcataagcatcagaaagaaaatttatacaatcaattaattcttgttaaaattgatattgcaaatgaattatgacagcaatagcaaatggaga

SEQ ID NO: 73216 - DNA, 2282 bp, Heterodera glycines
  Genomic contig location: Contig_ID=SeqID_10126; Location=793..3074; Strand=+
  SCN-specific regions: Sequence locations=1-65,95-276,298-530,552 -631,655-725,756-811,833-847,869-952,974-1166,1190-1343,1370 -1400,1429-1446,1475-1746,1786-1908,1930-2282
atgtcaatgttctgctacagaagaagcacaagcagtaccagcaccaacacatggacagccctttcaacatcagcggcagcagcagcagcggacgtgccagtttcggcggcggcaaaagcaaatggtggcgcaatgtgatgtgcggcgccgggcgcggtggtgccaagcaaaggcatgtgtgttgagtgccgaaaaatggccatttaaaaatgatgaaagccaaaatgccaagattcccagcgctagcccttcaaaaaaaattgtttttttttgaaaattggcagtttttaatacttttgcatatccacttcccaaatcagaacctgatgaaaagtcgaaatttgaaaatttggttttcggctttgggttcgaatttagttgaggttcaaaattagccaaaatcaatgttttatcgtaattattaccccgtaaacaccttaattaaaaaattttcacatcgactcttcgaaatttcaaaatgttcgtttttcagtgaaaattggcccagaaaacggcgacgcggcggcgtcgacactttggacaatggtcaccaaaacggaggtggcgaagaggtgacggatgggctttatgagaaaaatattgctattctcaaactcatatttaaaacttgtccctccccttttttccccggggtaaaagttaaaaattttccaagaaaaatcatagatattttttaaaagaaattcaaggggaaaaaattgaaaaattctaacatttattgaaattttataaaagattcgaaggatttttgaaaattttatgattttttttttgctttgaattttgttataaaaaatttgaagatttttcttgaaaaatttctaagtttaaaattaaaaaaaaatttcggcgaaattttgtcctgttctcttttcccccattatattctcctcaacatcgccaggtgatcacgcttgactccgactcgtcttcctcctccacctctgacaacaatgcgcgcagcgctgccggtgccattgccaacctgcgcatttcggcggcgactgccaccgccgccggtggtgtgcgccgctcttcgtcctcatgctcctccgtcgatggcgccaaatccgccggcgtcgaattcgcaccgccgccgacggcaccggcacgcattggctgctatcaacgccggcgcagcagtggcagcagccgcacgggcagcagtagttcgtcttccgcagcgccgttcccgtccagcaccaccaccaccaactcgtcggcatcattctcttccaacacgtcattgtccaacatttgctttggcaccgcctctcacggcagcagcaacaacaaccatgccgtcgtcgcgttgtgtgcccgtgacggtgatgatgatgatgacggtctgaaggatgtcgcgttgccgcccatttgtaacgatgaggacgaagatgatgatgacggtgaactgcttgaaagcgttggcggtgaagatgatgatgacctcgacaacgttattgaggtggtttatcgatcggttgcacaccaataaatttgttattgattgatatgctcgttgaccgactgatcaacggctcttggcggactttttgttttgaagcaatgaactttatgtaaaaaatggcaggaattctccatatggaaaagcaatttgaccggattttttgctgcgatttggattcttgtttctttttgccttattattgggcttttatcgccgtccaaaaattttaatcattctaccaaaaaagcaaatttcgcatttttaaaaattttacaaaaaattaagaatttttaaatgtagtttttaaacctttttctgtttgctacaaaatctaatctgcaattaatcgccttaaaggcgaattgggtgccaaaaaatctgggtctgatcactccaaacatttttccctcctctgatcacctcttttcaacatcagattgaccaaagtgcgccgccgactgttcatcgccaccagccacaacaacaaaatgatgcttcgcaaatgatggaagaggatgaggagttggattgggactgggagtttgaactggtcgaacatgaaggcttcaagctacagccgactgccgcttccgatttgtgttctgctgcgttgacagtgccttcgtcatgttcggtgccggcagcgagcagtccatgtgatcaatcggcgagttccatggcggcgagcagtccacaaaaccaaccggcgacttccatggcaatgaacagtcttagcccatcggcgacttctattgtggcggcgagcagttcgagtcatttggcgacttccatg

SEQ ID NO: 73217 - DNA, 713 bp, Heterodera glycines
  Genomic contig location: Contig_ID=SeqID_10127; Location=1037..1749; Strand=-
  SCN-specific regions: Sequence locations=1-193,225-450,474-583,605 -607,629-638,674-713
aaaagagaaaaattattcaaaattatgagttagaatggcatatttggtgttttttccttttgcttctatcgatatatagattcaaatcagatcataataataggcatgtatgttagttaaaatgacaaaaatgtgatctgaaattgttcgtttttcaaaagtcctgagaaacaaaaaaaaatggaaaaatgagttaaattaaacaataaaaataataataattaccatatggaaatgagtgaattaaaaatgtgtgtgaatgaatatttgagaacgaatttggaaaagatttggtgagaaaagtgagacaataaaaacaaaaatggcaaacaaaaaaaaggcacgtggtttttttggacatcatataacacaacaaaactgtaattacgctaattagtggatgcagcagaagtaaacccatgaaaaaattgcgtcaattctttgtacaacaaaaaggggaattaaaattaaaatcggaaattggcaaaatccccgcacggggatccgaacctcgtgtggcaaagcggaaacaactcgctgttaaccacttgaccacaaagtggaccagcgtttgtttttgtcatacagaaattttttggaaaaatttgacgcaaaatacaaaaaacaacttccgcgtactctctctctctctctgtctccccctccctttctcgtctgcgccagccactccattttgcatgtgctctctcgtc

SEQ ID NO: 73218 - DNA, 260 bp, Heterodera glycines
  Genomic contig location: Contig_ID=SeqID_10127; Location=1812..2071; Strand=+
  SCN-specific regions: Sequence locations=1-239
aaaatggtcattgctttgattattaacatgaaatatccggaaaatttaattgagtattggttatccaattttcacattaatatttaattgtccaactttgaattttttgcaatttaatccactgaactttttggcaattttaatttttttcatcaaaataagcataatgaaatacctaacaccaaacatattttttgattgttttttaataatgcattcctctaaatttgatcaatcacaattttttaaaattaaaaaaa

SEQ ID NO: 73219 - DNA, 257 bp, Heterodera glycines
  Genomic contig location: Contig_ID=SeqID_10128; Location=89..345; Strand=-
  SCN-specific regions: Sequence locations=1-257
atgctcacggttcatgaactaagaattcgagacatggaattggcctcggaacgaaatgggtccaaatcgcatttaagcataaaatatggaagtgagagaatttcggtacttatgtggtttacagaccataaaaaaaaatttttttaacacatttctagggggttttcggggtcgctgatcacgaatctgacatccattgcgacgaattccgaatcccggactcgaattcgaacaaaaagtcgaaaattaaaatttaa

SEQ ID NO: 73220 - DNA, 315 bp, Heterodera glycines
  Genomic contig location: Contig_ID=SeqID_10128; Location=242..556; Strand=+
  SCN-specific regions: Sequence locations=1-315
gaaattctctcacttccatattttatgcttaaatgcgatttggacccatttcgttccgaggccaattccatgtctcgaattcttagttcatgaaccgtgagcatgtctcttaaccgattttctggtcggtctaaattttggtcaaatctcggctatgccaattttgacattccaaaatttggcgatggcgatcaggcctaccttcttcaaataattatttggccacagatttgtacaatggcgcaaaaaaaagttttaacgggatttttcccggtcccggtcaaaatacttaggtactcagttgtacgtgttttt

SEQ ID NO: 73221 - DNA, 403 bp, Heterodera glycines
  Genomic contig location: Contig_ID=SeqID_10129; Location=1703..2105; Strand=+
  SCN-specific regions: Sequence locations=1-93,116-283,305-403
atgccttgggtctggcatagcgcagggcaaggtcgccgtcgccaacaacaacaacaacagcattatggatcggtgaaaattcttttttttgcatttaaaaattttctgtttaaatttaaataacaccaaaaatattgtcacgcttttctgtttttttcaatcttaagaatttaatcaatccttttctttttttagcctgtaaaatttttaattaagatttgaattactacggtcttcaaaaaaggctcaaaatgccatttttgtgttttatttttttttcagtaactttctaaaattattttgtaaattaacctacaaaaaatggaacaaatttgagactgtttgctaaatggtttttaaatagtgttaaatttttcagatacaacagaattttaaaaagtga

SEQ ID NO: 73222 - DNA, 483 bp, Heterodera glycines
  Genomic contig location: Contig_ID=SeqID_10131; Location=1918..2400; Strand=+
  SCN-specific regions: Sequence locations=1-48,70-226,248-446,468-483
atgattcgtcataaattacaaaatgagcaggacgtttcggagattttatttttcttgaaggccttcaccaataataaggctcagatattagttgtttgtcgcaacatgcaaaaagttacctttttaacattgtgtccgaaggaaggcgaaaatcgcgaaaatctctttcaattaatcaaacaaaatctattggaaagcatcggaccttattcatttgtacggtacgtataatattatttttatattagccaaatgaacatttttttaaaggtttgaagagcagccgctttcatcagatgaagaagtgctgaatctgttttgatataagttattaacgaagtctgggcagtggaatattttgaagttcatttactatttcatttgcttcactttgtgtaaaatgtccacgccgtttcaaaaagtttaccatggaaatcacacagagcagaaagacaggaaaaattataagataaagaccaaaaa

SEQ ID NO: 73223 - DNA, 1924 bp, Heterodera glycines
  misc_feature (180)..(180): n is a, c, g, or t
  Genomic contig location: Contig_ID=SeqID_10132; Location=62..1985; Strand=-
  SCN-specific regions: Sequence locations=1-226,265-429,477-503,534 -804,827-847,872-897,919-1222,1244-1272,1303-1356,1410-1417,1439 -1525,1550-1646,1670-1924
atggactcggaagccaatgccaacggcggtgccaataaaccacaccaaaatgtcgtcggcacgaaattgcgcaggagggcgtcgtccgctgaacagcttgcggtcatcggtgaagcgtcgtcaacgacggagtgccatcatgccaacgcgggcattgacagcgccgccccccaccgccgnccccctccgtttccgacttgagtcgaccgttgcgcatacaaatcccggaaaatgtaggcattttattttattttatttcaggaattgagagcatgaaaaatttaagattacagtgtaatttaatataggtaggtcatgctgaatggataggaattttcaaaaaaaaaaaaaattgtacgaaatttcctttaaatgagtatgtggtaacggtgctaggtggaaccgaaaaaagtatcaatggggcgaacctaaaaaaaagttttaaatgatagaaatatttaaatttaattttatttgcagaataataaatcgtactttagctcaaatttaattgttattttaattaaataatagaactctttggtcgatctaattataattagggattatatttttaggcaaaagcctattttttcctgagctctccgtggcctgaaacgcatgaaaaacatgttttttgggctgttgttaagctatttttcgagtttttagtgcctattttctagacttttatttttagcgcctaaaaagcctaacaaattttgaaagaacctatttttgcattttacccaaaattattaacaaaattgtaataagaacaaaaaatacaccccctaagaatcgaccaaaaattttttcaaaaaatacacccctaagaatagactcgaaaatttttcaaaaattcttctccagaatttatttatttattgacaagaatttgtgattttaaaaatatttatctcaatactgatttggcttaatttttttaccttttttgaaaaatttttatgattttacacccccctaaaaatgggttttttttagagcctattttgcatttttagtgcctattttttgggttttttagagcctaaagcctacctatttttgcggtttttagagcctaaaaatgtaatccctaattataataaataaaggaactgaaatttggcagtttctgaaaaaagttctgaaggaattcaatgagtcaaatttttatggtcataaaaaatttaggacattctaaatgtcataccatgtttaatttatgattaaatttaaggcaagttataatttatttttctgcaaatgaaattaaaataataattaattttaatattactatcttccatttacaaattagctcctacctaaattaaaaaaagattaattgggtaaaaaaaaatgaaaaatataagaaattttcttatataaatttaaaaaaaattcatttcttaaagaggatgccgccatttttccaaaatcttacaaattagtgccaaaagtcccaccagatttggcatgattatttgccatttaaaaactcaaatttcagtatggaccagcaacggcaacagcaacaacaacatagtgacagccgtggccagcagtcatccggtcagcaacagctgccaccaccgtcgcgctgcgtgcgcatgatgcccatgccatcgtcgttccaggcgcaaaagcgtgctgctgctgctgccggaaaattgggtgccagcggtttcggcggcagcgctagcgcagaagccgcagcaccgccatcttcctgctccgagtgttgctgttgcgaggcggcggacagcaccgcggtgaccggccattgctgcgtaattggcaacgctgcaacaccgcccatcatcagttcggttgcggaacgctttgtgctgcagcagcatggcgcgggcggcgttggcgtgccgaagaagaagttgccgcagcacaggcggttgcgcaa

SEQ ID NO: 73224 - DNA, 2122 bp, Heterodera glycines
  Genomic contig location: Contig_ID=SeqID_10132; Location=3171..5292; Strand=-
  SCN-specific regions: Sequence locations=1-188,211-492,514-663,686 -687,709-725,750-758,788-1172,1207-1236,1265-1276,1305-1342,1402 -1436,1500-1571,1593-1651,1675-1733,1785-1808,1830-1836,1873 -1931,1956-2021,2072-2122
atgcccaaaaaacgtcggcaaaattccccaaatttgagtgagggagaggacattctcgcccgtcttgaccggcttgaaaagttgttagaaggttcagggaatcccacactgaacccaatcatcgaactgctcgaaaagttggaaaggttggtggagcggctcgtggagggcgagaatcgatatggacatcgatttggtgacccccagcacacctcccccacttcggctcccacccccacaaacggcaattttcaatggggtcaaccgccgccttttgctggcaccggcgcagtgtcgcggatgataaccgacgcccattgattgtcattacattgtattttattgcctatgctcttgacttttctcgccccactcgccccgcccccccttctcatcaatctgttcccctctcttttgttctattcattctgatcggggggattgggccaagtgcccgtccgatccttccctccccatctgtcccgtacgaatcgggggccgctcctttccctcatttactcattatgtaattgtgtgcacaccttcggaataaaggatattattccaattttgggaatggtaatgcggacgtaacagatcatagaacaactttgggaaaggaactacggtaaccatattcaataccgttcgataattttgtcaaaattcaaattaagacaaatgtggaaattaacaaaatttgaaatttttcgcttgcttatctcaaaattcaggtttttataaacaaaagactgtctaaccttttttaaaatttaaaaattccaccatttaaataaaagtgtttaaaattttgaaattgtccccctccaccgttcatccccattttgctcaacggcatttttccaccatcgcaaaaaattgtctccccgtgccaaaataccggcgcttactttttaccgcatttttccccggagggcacacacaacacacactcacagctttttgcttgagcggagggcagcgtaaagctcattaacccaatttgcgccttggccacacggcaaaagagggtgggaggggacggcgcaatgccaacgaatggcattggcacacacaaatccgagagcaaccaaagcgtataatgacggtgctgattggggggcggttaagagggtagagaaaaaaaagaaaaaagaaaattcccgattttcaaaaatttaaaatgaaaaatttaaaattttattagttccttgtatattaatttaactaatttcatccattttaaaaataattttctattttaatggcttttgatttgtttaaaaatatgaaaatttgggaatcatttgaaaatggttgcattaaaaattagatcaaaacgaaaattagttaatttaaattgaatttattttattgtaaatttttatttatttattaaaagcattgtttaattgttgttttctttcagaggccttctttttggaaaatttaaatttcaaaaaatttttcttccaaattcccaaaagccaaattgacttgggcacgtcattccgtggctagcaggaaaaatccattacctatgctgccattccccatgcactttagcataattaaattttgtgtgttaagcattcggaactatttacataaatgaaagatccttggaatttttgggaaaaaaaattctaaattcatttttcattaaattttaaacaaatttctcgtttgttgttaaattttgtattctatgtatttggctaaacaaaacaaagaaaatttttgaaaaatttttttacaaaaaacaaaaaatttttaaattatatgtgagaatttaggtttttgtctaagaataggccctcaaaattaaagcttaataaaggtagcatctaaaacaagttttttaatatttttcaggtctatatgacctagtaaaattagaaaaattccttgaaaaaattgacgggcacggagttatccttaaaatttcaaaataatgttagttattttaattaaattagatttatctctcacaaaaaatcttttaatgtgattttgcccaatttttttttttttttaatttttttttggcgttttaattttttttattgttgggaattccttggcaaactgttaagctgaaaacaattttcaatgaaataaa

SEQ ID NO: 73225 - DNA, 805 bp, Heterodera glycines
  Genomic contig location: Contig_ID=SeqID_10133; Location=1296..2100; Strand=-
  SCN-specific regions: Sequence locations=1-36,59-297,335-538,560 -760,782-805
  Gene Ontology: Mol. function=protein binding; Cellular component =mitochondrion; Biological process=protein folding
atggacgtctacaaacacacttgcaagtgtaacgtaaaggtttgttcatctgcattttataattcttgcttcaattattatattaaagcttggtcatgttgctgaggcgattcaagagtgcacggaggtgctgaaatatggcgatgaaaacgatttggatgttttgctagatcgtggcgaggcattcttgcagaatgagcagtacgaaaaggcggttgaagacttccaaaaggctgtgaacgctcacgagggttcaagacgagccaaggagcaactgaatcgggcacaaaaattgctaaaactgtcgaaaaagaaggattactacaagatcctcggtgttcgaaggtcagtcattaattgcaacactttttacactgttcacgtggaaaaatgttaagaaatgcggacaaacgtcaaataatgaaagcctacagaaagcttgcacagcaatggcacccggaccttttccaagacgacgcggagaaacagcgggctcaggacaaattcattgacattgcaaatgcgaaggatgtgcttaccgacccggagaagaggaggaggtaaatcgttctctcccaccccttcttcaaaggaggtacaaccattgtttgtatgtacaaaatacaaatttttaaggtacgatgctggggaagacccgcttgacccgcaaggtggtggtggaggccaacaattccatcagtggcgctggtctggtggacagggcggcggattcaatccatttggagaaggcttcaatccgtttggagaaaatgatggaggattcaactttaaattcaatttctga

SEQ ID NO: 73226 - DNA, 129 bp, Heterodera glycines
  Genomic contig location: Contig_ID=SeqID_10133; Location=507..635; Strand=-
  SCN-specific regions: Sequence locations=1-129
atgagtgaaaatgaactcggtcgtaccctggaccagtgtttagcggatactgcgcttaaaattttggcaggtggttctattggtgttgtcacagcgcttgcgcttttcaaggggaagaggtcttggccg

SEQ ID NO: 73227 - DNA, 458 bp, Heterodera glycines
  Genomic contig location: Contig_ID=SeqID_10134; Location=200..657; Strand=-
  SCN-specific regions: Sequence locations=1-198,220-458
  Gene Ontology: Cellular component=mitochondrion
atggtaaatttcaattacgagtggctaaatcctcctcttggcgttcttggtctacctcttccaatacttcagatttcctatttgtcttttatttcgttcactcttattcattttggtattttcataattaattataacaaaccaaaaaaagaattattttagcatcttcgcaacgcaaagaaattgagaaacatcttgaacaaggaaaacattggctgtctaagggacaattccaagaagcacttcaggtgttttttagacgatatgttattttaaacttccttttctagcattatcatcaagcagttgctttggatccaaccgattatcaaatttattatcgcagggcgaccgtttttttggcaagtgggaaagtgaacgcggctttgcccgacttggacaaagttgttgaactcaagcctgattttgtagcggtaattgaaaaaaggaataattaa

SEQ ID NO: 73228 - DNA, 337 bp, Heterodera glycines
  Genomic contig location: Contig_ID=SeqID_10134; Location=1159..1495; Strand=+
  SCN-specific regions: Sequence locations=1-88,111-154,176-337
atgcagagcctgatgcgttagcgaaatatgtcattgcattgatcaagaaaccactttctgatgcagacttggagaagttgtgcacagacaaactctctgtatttcttcaatcgcgtaaactcgaaaattcatattttcaaccagaaaaagaccctaataaaatatcttatttttagataccgagtcatttgtgtcacgattgtttgaaacactcaaaagcggtcaatatttaccgaaaacagatgcactgacttcatccgaaccaccaaaattgattcttcaacagaccaaatctaaaattgatcaaaaatctgctgctgagcatgacgaggtttaa

SEQ ID NO: 73229 - DNA, 1084 bp, Heterodera glycines
  Genomic contig location: Contig_ID=SeqID_10135; Location=62..1145; Strand=+
  SCN-specific regions: Sequence locations=1-194,216-338,360-512,534 -862,884-1084
atgggaaatcccctttttgctcagaaccaaatcgtagaacaagtcgttgagaattcacattccggcattagaaatgaaatacagcatccaattggactcgaaattgagcggtacggacgcccgatcgctaattcctctccaatcaccagaatgggaagttcgcataacgagccacacaattcttttgaaaacgcggagtttgaagagataaggcaatttcgggccaggcaactttacgaaaatccacgcggatttcgtgaacaaaattttgtcggagaacaacgagaaaggatgaatgaatttgagcaaaaccatgctccggtcccaaattttgaaagaagaaatgtatttgttggtgatccgcacggaaatcagctaatttttgggaattttgaaaggaacatggaacggaattttggacattttgaaaattttcccggactcgcacgaggtggaaaccaaaatttgaatgttgggggaccaagaatggaacaaattcgagacccacacagagaaagaaatcagtacgaggaacggcatttcatgccaattcccgaaccaaatatgaggcaaattgatggacaaaaccaaaatttggcttttcgacaagtgcagggccaaaattttcaagaaaacatggcgagagtgatgccatacaccgaaggaattcctgatattattcttgaacttcacaaagtcacactttcaaatcagtacgcaaatgtccttagagaaattcctactctttttggcactgaagggagggacaaaatcaacgattttttcaccactcttgaattgtgtacaggagattggatacccgagaaaaagttggaaattttgagagcgaaattaaaggggaaggcatccaaagcattgaatttgtccctacgaaaatttggtcaccaagtgccattcgaagtcattaaaaggggtgacaacccagaacgtcaccggacagaacgtcaccacccaaaacgtcaccacccaaaacgtcaccaacccaaaacggcaccactcaaaaacggcaccacttaaaaacgtcaccactcaaaaaggtcaccgacccaaaacgtcaccaaaa

SEQ ID NO: 73230 - DNA, 1243 bp, Heterodera glycines
  Genomic contig location: Contig_ID=SeqID_10135; Location=1338..2580; Strand=+
  SCN-specific regions: Sequence locations=1-73,99-260,283-314,336 -650,672-700,722-763,785-1053,1091-1243
atggcttcatttattactacccaaaaaggagcaaaaaaactgctttacgatggttatgcttatttaaaacataaggatggtgctggtggcaaaatttattggcgctgtgatcaggccaaaagttcggccaaatgcagtggttttgccattgcaataaacgacgaaattactgtaactaaacaacataaccacgctccatctccgacacgtattgaagttcaaaccattaaacacagcataagagtgaccgcagctgcacaaccagcaactccacctcgttcaattgtaaatggagcaattcagggctctagcgatgctgccaaaatacagctcccagaattacgacacatgcaaaaaactgccagtcgaattcgaaaagccaatggcaacttcaaagaaacaccgaaatctttaaaagatgttgaaatccctccggagctccgtcgaacccgcactgcttcacaagaaggctttgtctttggcgatacaggccctgaagacgaacagcgtatcatctcacttgcttcaagaacggacataatcaggctgtcgagttgttcggtttggatggcagatggtacttttaaatcagctccttcactttggtaccaaatttgggtcatccatggcttatacaaaggaagagttctcccttttgtatattttttattgccatctaaggtattggttgaaattttgcatatatttaaaaattttcaaataattagtcagaagaaatctactgcagagcgattaattttcttacggattgtatccagaatgttgtgcccaattccccaaagccgaaaatgatctgcgttgactttgagatggctgaaattaaggcttttcgtcgtttttttgatgctgcaacaattcatggctgctattttcattttatgcagtcaatttggagaaatattcagagttcaggccttgcagttccttacaaagaacacgaagaattcagagtgtcgctcaaatgtcattctgctttagccttttgttcaccagcggacgttcgagagcgatttatcggcttggcaggcatccataaaacataaagaaagaaaatttttaaaaaattataggaaatattgttgacaaatttggacataataatggtgttcccgaatttttggattattttgaacggacgtggattggtagaggattcgccacccgcccgcattgtatagtagggccgaatatcaagagcaaaaccaacgtttactcaatgtga

SEQ ID NO: 73231 - DNA, 142 bp, Heterodera glycines
  Genomic contig location: Contig_ID=SeqID_10136; Location=822..963; Strand=-
  SCN-specific regions: Sequence locations=1-11,83-142
atggcacttttgcagcaacagcagcagcaacaacaacagcagcaacaggccaagcgccagcagcaactgcagcagttgcagcttgttcaacagttggcacagctacgacagttgcaacagtccgcggcactttcctcatccg

SEQ ID NO: 73232 - DNA, 381 bp, Heterodera glycines
  Genomic contig location: Contig_ID=SeqID_10137; Location=241..621; Strand=-
  SCN-specific regions: Sequence locations=1-218,251-281,318-381
  Gene Ontology: Mol. function=transcriptional repressor activity; Biological process=negative regulation of transcription
cgccaggcaaacggcggcgtcaagactgagccggccgcggtcacattgtcaccagcccttgagcatggagtggaaccgctgcaacagttgaacattgctgccgatggagatggaactgttggtgatgatgccaatgttccaagtgcactcattggcgacggcatcggcgtccgtgccgacggcgacgctggcgctatcaacggcacggcttccgccactttggcacaacaacaacaacagcagcaggcgttgatcacggcattggcacagctgatcgtggcacgacagcaacaacaacagcagcaacagcaacaacaggacgtgatgatggcacaacaacagcagcaaatgttgcagcagaagcagcgcgaaaaaatggcg

SEQ ID NO: 73233 - DNA, 628 bp, Heterodera glycines
  Genomic contig location: Contig_ID=SeqID_1389; Location=607..1234; Strand=+
  SCN-specific regions: Sequence locations=1-628
tgaataatgcctgtcatatacttcgacgacgtgcttccgagggagccgatgtggctcatccaattggtacatccgttttatttcttcttttatttacactgttttgtccggttttcagcccttctacatcacttcctttcttgtgctgctcgtgtttatgctctgccctggcaatatgtttctctatactcttatcagtgcgttttgaggagagagtgccgtttttgtgcagcctctgctaactaatcgctttcctttgtttaagctgtggcctacccaatgtacgcgagcttgttgaccctcaacactcaaaacacatgtgggttttctgctgtgctttccctccgagtacaaagccaattccccaatttccagcggaatacacccagtggctcgtttattggtgcgtgttcgccgtgttgggccagttggactttctctttggctctatcaatggctgccttctgctgctgtacgtgcctttgaagaccgtctttctgctctccttggcctttccgcaaatttatggcgctcacaacatgtacgtgaagccggacgtattggacaagatgaagaagatgttgtgatcgaggagacaacgtatcactgtgtaatgtctgtaggatga

SEQ ID NO: 73234 - DNA, 200 bp, Heterodera glycines
  Genomic contig location: Contig_ID=SeqID_1391; Location=2206..2405; Strand=+
  SCN-specific regions: Sequence locations=1-111,133-200
gctggttatccattgccttttaagcgcccctcgggatgggaggagccctatcggagagataaaatggggggggggaagagggtaaaggccatttccggtcccggccttacacctccggccctccaaaagaccgtccctggtcgttaaaatgtaaataatttccaaatttgaatgaagtcctcagactttttctttctttt

SEQ ID NO: 73235 - DNA, 844 bp, Heterodera glycines
  Genomic contig location: Contig_ID=SeqID_1392; Location=51..894; Strand=-
  SCN-specific regions: Sequence locations=1-308,347-844
atggactcagtgtactctcgttggacaacgaggtaatcaatttttttgcccacggcttcgaattccgatgcaatttggctttgcagttctttcagtgcctgcagttggtccgaatccacctaaaaatattaatattcgctatatactacgattcttctcaagtttcaacgtagcacaatttttttcgtgcatttctacctatttttattgattatcgctaaaacatcaaacaagaaaaaaaaaatttattttcagatcagttggactttctggttaattttgataaaatcaattaagaaattttgcttaaattttcaaaattatggtttatttttgtttataatttaaatttgtcacttacaattttcataagaatggcgtgtccagcaagtcaagcacgcgaccacaagaaacattgacacatgtcgaaacatatcggcacaaattcggaggaacaaatggcaaaatctgacaatgtgtcaaaaagaatttaagaattttttagttttggaaataagaaaaatgtcggcaccttggttcctggggcctgggggggaggggggggtacgtaggacgtaccatggataggctttcttcgcattcgcgttttgcaatttagaggaatttcgcttctcgcatttattttatttcgcattttttgcttttgcgaatttcacgtttcgcattttttttcgatttgggccatccctggtacgtaccccgccacccctccccccgcctgggaccatccctggactggtgtgcctaatttttacaatttatattattagcttaccaaactaagcagtgctcctcttcacgaaataggcttttcttaaataaa

SEQ ID NO: 73236 - DNA, 1400 bp, Heterodera glycines
  Genomic contig location: Contig_ID=SeqID_1392; Location=1141..2540; Strand=-
  SCN-specific regions: Sequence locations=1-147,173-186,208-673,696 -716,753-870,892-1235,1257-1400
atggacgaaggagtgcgaaaagcaaagataagaaaatgtcttgagcgacaccaagacaaattgaacatgcccaaaaaacaacttattttggtaatacaataaaaaaaacatcataactttacaaattttaagtcggttcccacccgttggaattccacttatcacatgcttgctgccttcaaagagcagaaaaaagttctgttctcaatgcaatttgaacgtgaccaacgaaatgccggacttttgtgcttgtcaaagcggcctcgcctggcagagatggaaacaatacctgcttcattgcccaccattgcaccaaatgattttgaaattttgcgccacatttgtcctgtactaaagatatttgataccgagacacaaaaagtgggcgagatcagcaaataagcaattatatccaataactaatgaatttcagctgtcgcgcgaggtgtcaacggcgtcagtgattttgccgactcttaaacgacttcatgtttttttgcaagagggaaaatttccagaaattattcaaccgtttatcgacagtttggtggactcattaaatgaaagggtgaagaaattggtccagaatatgttaattcgtatttgttctctaatggacccgcgttttgcttatgatgaatctatgttttcaaaagcaaattggaatcttattgaagaagacttaattgattttgcaaatgggaaaagtaaatgatggattttttcaaaaatatttaaaataacattttacagttaacaatgaagacaccacaaattttgaagagcagaatgagacgacattgagtgatcttgagtctttgtcagacttcaatggagaacaaagtgatgaaagcataaaatgtaaaatttataatggttatggttattgttggttaattagtcctttatttttagacgacatttggaagccaaaatcgcccggatgtgtttcagttccgtctacaatttcaggaacttcgcattcgacacaaacgacgcgcattcagctacagttagctgcatacaaggcatttgatcggccgtcagtcaacgctgatctttttacttggtggagagaaatcggcaatcaatttcctgacttaattattttggctcggattgtccattcaattcctgccacttctgtttcttcggaaagattattctcaaaggcaggactaatttacagcaacaaattaagaaatcggtatttggagtataaaatcacaatttattttgtaaatttttattttagcctaggtgcagaaatggccgaaaatcttttgcttatcaaggccaatatggatcgagtgttcttggcaccgtctacggagccggatgaagaggagcaagaaatgttagactcggataatttggaagtgattgaagaagaaaaatga

SEQ ID NO: 73237 - DNA, 2180 bp, Heterodera glycines
  misc_feature (1647)..(1647): n is a, c, g, or t
  misc_feature (1683)..(1683): n is a, c, g, or t
  Genomic contig location: Contig_ID=SeqID_10140; Location=1191..3370; Strand=-
  SCN-specific regions: Sequence locations=1-39,98-135,157-267,289 -567,604-651,675-847,885-2002,2035-2068,2091-2147,2172-2180
  Gene Ontology: Cellular component=nucleus; Biological process =organogenesis
atggacgggttggacgacgacgagccaatgccgccaacacatcaccagcagcaacaacaacaagcgctgcagcaacagcagcagcaaaagaagaagcgtggccccgtggcgggcgctcgcaagggaagcgccgacggcgggccgggcgagccgggcacgtcggcgtcgacggcaccaacgaccggtgccggcggggaaggcgccactgtgccaaaacagcggggccgaaagcgcaagaaggcgctgcccccggaagaggaggttcgtgtgtgtgttttgggttgtagttcgagtccacggcacgggaattgggtccgagatttgtgagcagttcgttccccccccttcgaaatttaaaaaaaagattcgtttttagcgatttttcagaattttaaggtgcgtttactaaattattcttaaaaatgccagggttttttcgttttaattagggactggaagcgcgtcacattgggaatgtgtcatgaatgtcattccgaaactcaaaaacccggtatggactcccgaaacccggcaaatgccgtattttccgggcaaaatgggcacccccaggggatgacgaataaacaaacaaacaaattttataattacctaatacaatattgctaacttattgttagtttaggtgttgccgaagaaaagagaaacaagaaacaggaaaaattcctcggtaaatcccacaaaaaaaaacaattagcaaaaggcacacaattggaattggaggtgggaaacacacaaacaaacaatgaatgggttgaactgacaataaatgagacacggcacaagaacaattacgcatggcattggatttaccgtttttgcggaaaacaaaaaaaaatttttttgaaaattttaaacaaatttttccccctctccgtgtacagcaaagtcaggcggactcggacaatgatgatgcggcgccgaagggacgccgtggccctggaggcgggcccggaaagcgccaacgcgtcaccaaatcgccggccaaccccaaactgtacgccaagctgaacgcatgtttgaacacactgctcaactacaagacgaggtacgagggggagcggcgacggcgtgttttggttaccggtttcgagaaaatgggcaaattttctagaattatggacatacaattcagtatttcttacattaatgaccccggggttttcggtgtccagaaaattaattgcgatcggcttcaaatttatggatattttttcaattttaaatggcattaaataaatgccagaactgattacttattgccagagccatgaattttgaaaaagtattgatcccagatcgattttgccgtgatttagatcccgaacctggccatttttcctaatcgatcctttgagtttatccgaaatatccttcgaatgtttagcaatggcaaaaagttggccggcccattcgtgcagttgccttcccggcgtgaatatcccgactattatgaccaaattgaacgcccaatggacctgcaacggattcggaagaaaattgaggaggacaatacacaatgttggcccaatgagcgcagacgtggatttgctgtgcgaaaatgcacaggtacatatgctaacaaaagagtgtatgtgtcatgaaaactttttttgagatttatttttntaagaaaaattgtgactaaattcatcactatatgtntagtatagggaatttccattttacgttttatttaaatgcttagggatggcaattcaaatattttcgggcccgaaatttggcctatgtcaaaatgtgggtaccctaaaaattgcaaataaatagaaaaaaatgcacgccgtgcctccaattttttgtaaatggtataagcccaattttggattcacaaaattttcaaaaaaagactaaataaaaatcgcccccgaaatttgcagcgcttcaacatggacgggtcggaaatccacgaggactccaagctgttgaacatggtgtggcgtcgcatcgcggaggcaatcggtggccagggcggcaaggaggaggaggatgagaccacaggacggggtggtggagctgcacggcacacgccgcagcaggaagaagcggctgctgcaccgtcgacatccggccacgcaaaggcaccagccgaagacgatgatgtgccagtgtctgctgctgctgctggtccttccacttcatcg

SEQ ID NO: 73238 - DNA, 1358 bp, Heterodera glycines
  Genomic contig location: Contig_ID=SeqID_10141; Location=1..1358; Strand=-
  SCN-specific regions: Sequence locations=1-563,586-932,954-1358
  Gene Ontology: Mol. function=ATPase activity; Cellular component =nucleus; Biological process=organogenesis
ccaagaaaagaatccaactggtcaagttcaattgataccattttttaaacaaaggaaccttttttgtatcatccctttaaattgaaaactaggagatattttatccgaatatataattgtaagaaagtatgaagctacctcaattgattcaaccaaatcacgttcaatagcaaaatgtggtggggacaaactgtcgtcttggatatcagaagcagagcatccatttttggaggcgttgttggcatagaaattcatattggttgaatgtttgaagttacgattcgatgaagaattgggtagttgcatcaaagggttccggttggactgggttatgttcggataaatcaggtgacacaattgaaaaaagttttgaaggcgttcatcggtggtgaatactgacgaaacgagtcgaagtcgaacgcggaatagaggacgaccatattcaacaaatttgagatcaaaattgggggacacctgtcggttataaattgaaacaaatatttgttaaatgacgcacctctctcgtgccagaagaggacaatggcttaaattcgtagtattttgaagacaagttggcagttactggaagttcaaactcctgacttttgtccgacatgacgaagtgaggaaggccacgagaatccgttttgaccatcggaagccatgcataacccaccggagtctcaatgctccggtactcccctgtcccccaaaaaaaatttttcggaaaaaccgcgccacataaaaaacgggtgtgaaaagcaaaaaaaaaaaaaaaggtcgtcgcacggggggaggtgccccccccccaagccaaaatcctgggaccgtccctgatggtgattcctgtataattcctcattcatatatatatatattctcaggttcaacgcgcccttcgccgccacgggcgagaagttggagctgaaccaggaggagacgatgctgatcatccgccgtctgcacaaagtgttgcgtccgttccttttgcgtcggctgaagaaagaagtgcgttttgggcactttattttatgggttttggggcataaagccaaggatggcatgaaattattttcatttttgacatttttcatttcttttttccatttttctaattcctcccaatgtttttcagtgataaattcattaaaaataccatttaaatttgtaaataatgtttggcatgtttaatccgtcttccttccgtgttcaggtggagtcccagttgcccgagaagacggagtacgtgatcaaatgtgacatgagtgcgctgcaacgcctcctctacaaacacttgcagaagggactgctcattgacagcaaacatgtcagtgagcgaacaattacgcgaccttttc

SEQ ID NO: 73239 - DNA, 1421 bp, Heterodera glycines
  Genomic contig location: Contig_ID=SeqID_10142; Location=347..1767; Strand=-
  SCN-specific regions: Sequence locations=1-320,342-500,542-551,582 -591,624-835,894-1009,1054-1076,1133-1421
atgctcaacaaatggaatgagctgaagaagcatttgttgggtcataagggcattttcgggtcgccaccaaagagagacaaacagcagaaaaagccaaaccaaacaatttgggaattcaacaaggaagtgaaggagcagatcaaaatcgacctcatggcactgatcagaacgaagtcgaaggccaattgcatgtgccaaccatgtgaagaaatgaagcaattggcacggaacttttcggaaaaggacgcaaacggcgaaggattgtcggcgaaaatattcaaaatttcatcgcaaaattcgagagtaatccctctggagataaaaaagaaaggaaatgagaagcggacggacgggaagagctgagcaaaacgaacagttgaagagcgaaaaagagggaaaagctaatcgaacgatcgatcactttttgtagagaaaacagtgaattgaatggttaattttaatggtagaaaatagataaatcattacctccctcgccaattaattaattagtgcctttaatttatttaacattttcaaagagtcaacaaaaactcgagttgttttttcttcattttatgcttggtttaactgcttctctctcttctccttttccttccgtttttgccctttttcactttgtcggcaccacacattggccacaattggccgtttcgggctgatagccctcaatttgaatggtcgactcgtgcacgttgaagtcgcgtcgaagcatcaaagtggtggccctcagaatttgttgggagtccgcagccgattcgacctccaaatggaccgaaattgcaactgccaaagaaacgattcaagtcattttcacatttatttatgtaaaaataagaaaaataatttaattaaaatttaaaaatttattttttcacaaaaaacaacctttgtccatagtgagagcccaaattcgaaggtcatgcacttttttgacctgaacgattaatgaaaggatcggtctattctgaccgaaaaaagtgcgaaaaccaattatttgttaattaattattatatttccaaaaaatttttattggatatttggtgcatattcgaagtttatatatttcttaaaattgcattttttttaatatagatataatatttatattttgcgattctattaattgttcttctctttatttgtgttatttattatccatttgcttcctttgtgaattattttattatttttttgtccacgagtaagcggaaatcttaggaaaaatcgaatgcttaattttgctgtcaaaggggaaggaacaattagtaacttaccccttcaatgtgctcaagtgcgtctgaaactcattaaaagtgttaattgtaagcaaaaaatttggattaccaaaaacatggcgaaaatcgatggtcgacggacgacctaaaaaagttgaaataaa

SEQ ID NO: 73240 - DNA, 1133 bp, Heterodera glycines
  Genomic contig location: Contig_ID=SeqID_10142; Location=1..1133; Strand=+
  SCN-specific regions: Sequence locations=1-590,612-635,692-714,759 -874,933-1133
  Gene Ontology: Mol. function=zinc porter activity; Cellular component= synaptic vesicle; Biological process=transport
cggtggcaatcgccagacgcacggcacgcggagacagacgtacatcaacgtcagggcagcatttgtccatgtgctcggtatttgttgagaaaggcaaataaacaaacttcgaattttgaggtgatctgatccaaagtgtcggggttttgttcgccggattgctaatttattggaaagtaatttcgaattttatttggggcaattaactaattacagccgaattggcacattctcgacccaatttgcacgttgcttttctccgcaattgttctcagcaccaccatttatatcatccgcgatgcgctcgttgtccttttggaaggtccgctttttatatcttcttttatttatttcaacttttttaggtcgtccgtcgaccatcgattttcgccatgtttttggtaatccaaattttttgcttacaattaacacttttaatgagtttcagacgcacttgagcacattgaaggggtaagttactaattgttccttcccctttgacagcaaaattaagcattcgatttttcctaagatttccgcttactcgtggacaaaaaaataataaaataattcacaaaggaagcaaatggataataaataacacaaataaagagaagaacaattaatagaatcgcaaaatataaatattatatctatattaaaaaaaatgcaattttaagaaatatataaacttcgaatatgcaccaaatatccaataaaaattttttggaaatataataattaattaacaaataattggttttcgcacttttttcggtcagaatagaccgatcctttcattaatcgttcaggtcaaaaaagtgcatgaccttcgaatttgggctctcactatggacaaaggttgttttttgtgaaaaaataaatttttaaattttaattaaattatttttcttatttttacataaataaatgtgaaaatgacttgaatcgtttctttggcagttgcaatttcggtccatttggaggtcgaatcggctgcggactcccaacaaattctgagggccaccactttgatgcttcgacgcgacttcaacgtgcacgagtcgaccattcaaattgagggctatcagcccgaaacggccaattgtggccaatgtgtggtgccgacaaag

SEQ ID NO: 73241 - DNA, 1391 bp, Heterodera glycines
  misc_feature (10)..(10): n is a, c, g, or t
  misc_feature (52)..(53): n is a, c, g, or t
  misc_feature (84)..(84): n is a, c, g, or t
  Genomic contig location: Contig_ID=SeqID_10143; Location=800..2190; Strand=-
  SCN-specific regions: Sequence locations=1-852,875-919,942-1230,1270 -1391
  Gene Ontology: Mol. function=signal transducer activity; Cellular component=plasma membrane; Biological process=invasive growth
atgaatgttntacagtttgatgcacttggatctggacgaccgcgatgccacnnaagcgaaagtccgtcgaccagcgtcgattcncaattccttccggtcaccaaatctgcttcaacaaccatcgcgtcggcacttggatctggacgatcgccgatgccaacaagcgaaagtccgtcgaccagcgtcgattcccaattccttccggtcaccaaatctgcttcaacaaccatcgcgtcggcacttggatctggacgaccgccgatgccaacaagcgaaagtccgtcgaccagcgtcgattcccaattccttccggtcaccaaatctgcttcaacaaccatcgcgtcggcacttggatctggacgatcgccgatgccaacaagcgaaagtccgtcgaccagcgtcgattcccaattccttccggtcaccaaatctgcttcaacaaccatcgcgtcggcacttggatctggacgaccgccgatgccaacaagcgaaagtccgtcgaccagcgtcgattcccaattccttccggtcaccaaatctgcttcaacaaccatcgcgtcggcacttggatctggacgaccgccgatgccaacaagcgaaagtccgtcgaccagcgtcgattcccaattccttccggtcaccaaatctgcttcaacaaccatcgcgtcggcacttggatctggacgaccgccgatgccaacaagcgaaagtccgtcgaccagcgtcgaatcccaattccttccggtcaccaaatctgcttcaacaaccatcgcgtcaaattcatctgactgtgcgctaactcctcagcagaaatattgccgcaaaagagcactgatggagccatcgcaacacgaagttagtctctctgttttttgttatccctacttcgccagggccaaaattcaggcgaaaagcttaactcaaacccagaattgctttttcagttggctatcatccgaaatgttctcagcttcgatgactactcacaatatcgcattattaccgtgcttctgcatcgtccgcagggaattaatgagggcgccgttggcttattattgcgcacgatggcagagagatcaaagccagcaaatgcgccgttttcaattttggtattgttggagagtaggaaaggaaaacattgcgaaatattcaggttcatcaagtaacgggtgggtccattgcgagtaaaaatggccatttgatgcaaggtgaccgggtaaggaattgcacaaatatttgaatttaaacatttattttttaaaataattaggtgttcttcatccaacatcagtcgacagtgaatgtatgtgcaaaattaaaatagtttactcgtcatttcccttcagatgtctgtcgccgaagcacgttctctggtaaaaagcccgtcgcca

SEQ ID NO: 73242 - DNA, 2986 bp, Heterodera glycines
  Genomic contig location: Contig_ID=SeqID_10144; Location=610..3595; Strand=+
  SCN-specific regions: Sequence locations=1-1512,1534-2068,2090 -2835,2857-2877,2899-2986
ctcaaggttaagattcggatgaaccgaaaaccagccaaattgtatctcgacactggatcggacgtcataatcattgacgaagggacacatgccagcgttgggcacccaccgatcaaagagtgcaatgaaattggaaaaacattcgatggcaaaagagtccaattcatcggaaaagggactacaacgtttgaattaaacggccagtcgattgttgaggaattttatgtggccaagcaagggtcactaaatctactgagtcgccgagcaatggacaaatttgggctgttaagggaattaaggcagaaaatcagcaatgcggcagtgaatgcatgcacagccggcaacaaaactggacaaattatccctgatggcgcatcgcaaattgacggaaacgaagctaaaatctaggtactataatattgcttcaccgatgagacttctaaaggaaagtttatttgctttaactcttattcaaatatgaatttaatggatttcaattttacactgattaataatcttttccgttgatttactgtatttggtatgaaatagaccgataattgtttcgtgattattaaatgagagccataacaatatcctaccatatggagtgggcagctccaattttgattgcgaaaaaggccgacggatcagcacggatgttcattgactattcaacgggattaaacgacacgcttctcgactctcaacacccactgccaattccagaggatatttttgcaactctaaacggaggaaaaatattttcacaaatcgatctgcgtgatgcctatttacagatcgaattggacgacgaatcaaaattattatgcggtttggcaacgcataagggaaattatcgcatggagcgattgcccttcggaataaaaacggcaccagcaattttccaatcgattatggacaaaatgctggccggattgaattatgccaccgcttacctggatgacataattgttgtcagcgggacaatcgaagaacacactcaacatttgaaagaagtgttcacccgaatccaggcctatggactccgagtcaaattggaaaaatgctcatttttccgcaaccaaatcaaatatttgggacagattattgatcggaatggtcgccgtccagattcaaccaaaatcaaggccatcactcaaatgccggcaccaataaacatttccacacttcgctcatttctcggcatggtgaatcattaccaacaattcgtcaaaaatatgcgtttcatccggaaaccattggacgacatgctgaagaaggagaatgaatggaattggtcggaaaattgtcaaaacgcatttgagaagttaaaggaaattttgacttctgatttactgctcacacattacgatcccaaattggagattattgtggcagccgacgcatcagaatttggaattggagcggtaattcaacacaaatttccgaatggacaggtcaaggcaattgcgcatgcctccaaatctctctctcccgctgagaaaaattactcacagattgagaaggaaggacttgcgctcattttcgccgtaaaaaaatttcataagatgctttacggaagacattttacactgcagacggatcacaagccgttactaaacatcttcggcagcaaaaaggggatccgccaatgcagtgcaaatcgattgcttcgttggtcattgacacttttggcctacgatttcgcgattgagtacatcaacacgaaagactttgggcaggctgacgcactctcgcgactcattgccaaagacacaagcggtgaagacgaaagagtcatcgcttcattttgtgttgaaaaagaaattgaactcaatttcgacacgaccattgaaaaattgccgatcaaatttgcagacctcgtcaaggcatcggaaaaggatgaaatcatccatacaagtgaaaaatttagtcaggaatggatggcctgacgaacgccaattgaagactcgaatcggaggcaatccagcttttcaacagacgaaaagctgagctttcaattttaaaagaatgtctcatatacggagaaaggattgtggttccaaaaatttttcagggaaaaattatgaatttgctgcacaagggacatcctggaatgaagaggatgaagcaattggctcggcaatacgtctattggcctaaattggacgccgaaattgagcaatttgtgcaaaattgccagccttgtcaagacgcagcaaaagccccaacaaaaacgaacttgcactcgtggccaaaatcgacgagtccatggcaaagaatccatgttgattatgccggaccatttttcgggaaagaattccggattgtcgtcgactcattttcgaaataccccgaggttttcgaaatgacgaccaaatccgcggccgcaacaattgatcgtttgcgttatctcttcactcgtcatggaattcctgagacgctggtgtcggataatgggacgcaattcgccagcacagaatttgccaaattcatggccaacaatggaatcacacacctattctcggcaccgtacaatccaatgtcaaacggacaggtggaacgatttgtggacactttcaagagggcttttaagaaaataaaaagggagggaacggcaaataaggaagtaatcgaaacttttctgatcacttaccggacgactcctaatgattcgctctcggaatcaaaatcaccagctgaaatgcttctcggacgcaagccgcgtaccacgctggatctgctcaagcctcctccaccaaggccaacggagagagatgagaaaatggagcgaaatttcaaccgaagatttggcactcgtattcaaaattttggacctcatgaaaaagtttgggcccggcaccgtctatcgcaaaattggaaggcgggaaccatttttaaaagcgccggagtgatctacaaagtgcgatttggcgatggaacagctgggcgcttccacgcaaatcaactccgcaggcgtcag

SEQ ID NO: 73243 - DNA, 1151 bp, Heterodera glycines
  Genomic contig location: Contig_ID=SeqID_10144; Location=4421..5571; Strand=+
  SCN-specific regions: Sequence locations=1-1151
atggcggcaaatgtcaatctccaagatttgatcaatttgatggcccaacagcaacagcaaatgcagcaacagcaacaaatggttcaacagcagtcacagcaaattgcgcaactgctgaaccaaaatgcaccgaatgccgcaggattggcacagccaaatctcatcaccatcatcccggctcttcccgacatttcgccgttcgaatcaaatgatgaacgcagtcgcgtcgtggaatggctggaccgtttcaagtttgcgctcgattgtgctgcaccgatggccaatgacgaaatcaaagtcaagtgcctgatgaacaagctgagcgaaaacgcattcagtgagtacagccgatcagtgcttccggccgccgtcaccgattttgattttgcgacaacaatccaaaagctggagaaattgtttgccaaacctcagtcaattttcattgacaggtacgaatgtttgaaagcggtgagaggggatggtgagaacttcagacaaatcgtaaatcggcacaaaaagctgctgtcggatttcaaattcgacgacttgaaaaaggagcaatttaattgtttgatgttgctgaccgcattgaaatcgccaaacgacgcagctttaaggcagcgaatccttgctaaattagcaacggatggcgacaatgtgaggtatgacggagtcgtcgaaggcaaggaaattccccgcaaaagtggtcaactgaaaagacacaaaacaacgcagctaaaatgaagtgctggcgttgtggagaagaacgacaccggccggacgattgccggcacaaaacaacaaaatgcaataagtgcaattttgtaggccatattcagaagcaatgcgaaagcgtccatgcgtggtggaaaaagatgaagtcaaagagggctacgacaagcaaagtcggtcatcttcgcattggcatggctggaacaacgaacaccccaaatacggcgctcaaggttaagattcggatgaaccgaaaaccagccaaattgtatctcgacactggatcggacgtcataatcattgacgaagggacacatgccagcgttgggcacccaccgatcaaagagtgcaatgaaattggaaaaacattcgatggcaaaagagtccaattcatcggaaaagggactacaacgtttgaa

SEQ ID NO: 73244 - DNA, 311 bp, Heterodera glycines
  Genomic contig location: Contig_ID=SeqID_10145; Location=1737..2047; Strand=-
  SCN-specific regions: Sequence locations=1-94,116-311
atgcattcgcaggccacgtctgccctcgctcatacaaacaatggactggaggtaatccatctgcattttatggttgttttaatttactacaggcaaattaaaaaatatatgtttagaaaggtctctgccaccaccctgcactctcggacttcatttgtgaaatcaatgaaagcaccgactgacgatggacgctgcccgatctgagctgctcgccatttcattcgcatgtgacgaaagcgatacaccatgcaggacgccgtcattatgagaattttggcggacgcgaaatgcaacaacaatggtgaaataaa

SEQ ID NO: 73245 - DNA, 1020 bp, Heterodera glycines
  Genomic contig location: Contig_ID=SeqID_10147; Location=125..1144; Strand=+
  SCN-specific regions: Sequence locations=1-226,258-387,410-639,666 -1020
atgaacactgccaaaaagtcagaatttttgcatattttaatttataacttttttatttgtcagtatatctttgtgatttttaggaagccgatagagcttgttaagagctttcgaatgataccaattttgttggatttggtcaacaaagaaaaaagttatgatgctctaaacttggctcagacgcaactggcccgtttcgaattttgggcacaatagtaaggatttgaaaaataaacaatttaaaatttataaaataacacaattaatttgaagcacattaagtttttaatcaaattcggaaaataaaattttaacgacttgtccactcaaagaatagaaaaaatatttttttcgtcaatatttatctcacatatttagtaccaaacttaaaaagcaacataaatatttaatgaatagaggaaaaatgagcctgacaatggaggaagaatcgaattcaaagttaattgatcagagacaatacacttcgaacataatatttagcagaagaccaaattgtgacgaaaacaaaatttggaatgagtcagtgaaaattgaaacggaataataaaaactgacaaaatttttggtcgtatttagaattggaaatgaaaggtcaaagatgatcgcccgtataaacgaattaacaaaaattttaaaagcaaaaactgttcgtttgttgcgaacggcacaaatttcgtgttgtctgatcagaaaagaaagttgaagaatccctttgcggcctgtttaaaggaaaaaatcattggattaacaaacaaaaagcagaaaagaaaagaacacaaaattaatgttatatttcttgttaattgcatactgattcaagagacatgctcaactgaaccatcgcttggtgaaccgcatgctttaaaaattcgttgtccgaactgattggtgggtcgtaacgaagctccaaaacgtcataatgcttcttaaaaacaattaatattattttatcatttaatgcttcagctaaaagttataattgctcgttcccaccggaca

SEQ ID NO: 73246 - DNA, 1142 bp, Heterodera glycines
  Genomic contig location: Contig_ID=SeqID_10147; Location=957..2098; Strand=-
  SCN-specific regions: Sequence locations=1-85,108-150,173-291,314 -392,414-563,613-678,708-709,731-925,956-1142
gcaattgacgccgatctcttaaactcgcgttaccacatgcgcgttcttgtgccacgaattcaccaggacccgcaaagattggccgaagtgtttgccactctttttgattacacgacgagttctccgcacgcgttggtcctattcattattaattgttcccttttatatattataaatgtaaagactatttacgcatttaaatctgttcataccaataggaccttttacgtggccgtggcaattgatccggcgctttgcatcggtgaccaaaccattattaaatcggtaaaataattttaattattcatgatatttgataacttaaataatttggaagaaatctattttcatctgcatttaaataacatattacaattcttttttatcactattttagtttactttgttataatcccttacagagaaatgcattagcaaaagcgatcagcaaaaaagtgaccggaatttcatttggaagtgctaaattcgttacgcttgtcgacaaggtcgtttgcactttttaatatgtatggcctaatgaagctttacagctgattaaatgctttttattattgtttactttttaaagatatttaatatagattaaattttgacattaaaaaaagcctttgcacggattttcttggcaaagaaagatccagagaagttgccgaatgagtcatgatttaaaataaaaaatcaatacctcaccattttataaaaaattgtgcctataaattttttgataattaaatatgtaaaaccaggttttattcatggaactggacttggaattatagtgttattcaccataattttcaaatggaattcctattgaaaatgaaccggccccggcttgatgcttggtccggaccgggatttctggggttaaaatatttatttcaccagtgttgccattccagtgttttttataaaatttaaattacattttattgtccggtgggaacgagcaattataacttttagctgaagcattaaatgataaaataatattaattgtttttaagaagcattatgacgttttggagcttcgttacgacccaccaatcagttcggacaacgaatttttaaagcatgcggttcaccaagcgatggttcagttgagcatgtctcttgaatca

SEQ ID NO: 73247 - DNA, 120 bp, Heterodera glycines
  Genomic contig location: Contig_ID=SeqID_10147; Location=470..589; Strand=-
  SCN-specific regions: Sequence locations=1-56,79-120
attaactttgaattcgattcttcctccattgtcaggctcatttttcctctattcattaaatatttatgttgctttttaagtttggtactaaatatgtgagataaatattgacgaaaaaaa

SEQ ID NO: 73248 - DNA, 773 bp, Heterodera glycines
  Genomic contig location: Contig_ID=SeqID_10149; Location=100..872; Strand=-
  SCN-specific regions: Sequence locations=1-71,95-227,265-289,697-773
  Gene Ontology: Biological process=protein biosynthesis
atgattgccgaagtggaacggctgttgacacgaaaaaggtccgcaccggtgcatgcaagttttgggaacattgacgacgacgatgaggaggagggcgagattcttgacgtctcgtttgttgaggaggaagaagacaatacgggcgaagcgcccttaaacccactttcatatttgaccaagcaatcagcggctcaacaagaaacgttgcggcatgaaaaatgggcacaagaagagagaaagcgaagggaagaggagcagagaaagcagcgagaaaatgaacgtagacggcgagaagaagaggagaggcgtcgtaagacagaagaagaagatagaaggaagactgcagagaaagcagccaaggaaaagaaggcaaaggaagagaaagaggcaagtgaaaagaaggcaagggaggaaaaattggcacgggaaaagaaggaagagcaaagaatagcaaaggaaaagaaaggcgagaaagagaccaaggataaaaaggctgaggaggagagagtagcaaaggaaagaaaggcagaggatgagagagtggcaaaagaaagaaaggcagaggaagagagagtggcaaaagcggaagcggagagagcggcaaaggcggaagcggagagagcggcaaaggcggaagcggagagagcggaaaacgagaccaagaaaaagcaagaggaggaaaagcagttggaagagcttaaacgacagcaacaggccataagaaagcaaaaagagttggagctgctcaaagagttcagaccgtggcgaggcgg

SEQ ID NO: 73249 - DNA, 739 bp, Heterodera glycines
  Genomic contig location: Contig_ID=SeqID_10149; Location=1141..1879; Strand=-
  SCN-specific regions: Sequence locations=1-552,575-739
atggtgagtcgaaacgggaaaatttttcccctcaaaatgatgatgacgtaatcacaattggagacaacaacactcaaacactgcttgacctacaaccggggccctcaaaaaggggacgcaagcctcgcttggacaaaatccatgaggaaattgcttccgcaatgaagaaagcaaaagccatggaagctgaaggtttggctttttctgcaaatttctttgaattagccaaattttagtagatgaatcgcccaaaaaacaaccgaccaatgtgtttgagtacccgaccatattttggaaattggcccgccccaaggttttggctaatatttaatttgaaaacaaataggaaaatttcttaagtacggagtgttcacgttcatgtgcaaagagtgtcgtgatgacaatttccggcaggggaacagctgattcaaactcatcaatcagaatggcgagcagcaacgccttgagttcacccaatcgttttgccaagactgtgcaacgctgaactttgactgcacagatctgatcatgaagcaccaaaagaaggatgaaccggcaacgacgacgacgacgatggcaaagagtttccgctggatcaaagatgggggaaagtgaaccgagatggcacaccatgatataaggacgatctcattttgaagaatttatacttgttgatcaaatgacaaactctttctttgtaattttgccgagcaacacgcctggctttgttggaaataaa

SEQ ID NO: 73250 - DNA, 1262 bp, Heterodera glycines
  Genomic contig location: Contig_ID=SeqID_10149; Location=1247..2508; Strand=+
  SCN-specific regions: Sequence locations=1-59,82-636,663-955,977-1262
atggtgtgccatctcggttcactttcccccatctttgatccagcggaaactctttgccatcgtcgtcgtcgtcgttgccggttcatccttcttttggtgcttcatgatcagatctgtgcagtcaaagttcagcgttgcacagtcttggcaaaacgattgggtgaactcaaggcgttgctgctcgccattctgattgatgagtttgaatcagctgttcccctgccggaaattgtcatcacgacactctttgcacatgaacgtgaacactccgtacttaagaaattttcctatttgttttcaaattaaatattagccaaaaccttggggcgggccaatttccaaaatatggtcgggtactcaaacacattggtcggttgttttttgggcgattcatctactaaaatttggctaattcaaagaaatttgcagaaaaagccaaaccttcagcttccatggcttttgctttcttcattgcggaagcaatttcctcatggattttgtccaagcgaggcttgcgtcccctttttgagggccccggttgtaggtcaagcagtgtttgagtgttgttgtctccaattgtgattacgtcatcatcattttgaggggaaaaattttcccgtttcgactcaccatttctttaaatttaaaattattataaaaaactcaaaaaatgattacttttgttctcaaacaccaattgatcattgatttttctcggggccattacgattaagaaatagtttatgattataattgttaaaagcataaaatgaacctgcgaaaaaacacgtaattattgattgatagtgagaggggtgttagcgcgcagcgacctccagacgggctgtcccttttaagcgataggccacgcccatccacaaacacatagacgagagagtagttgttagagaaagatacaacagggcgccaattcaaacacacagtgaaacccaagccaatttattgattttttacagattatggtactccctctgactgctgccctatccaaactgctaaactgtaaacctgaaaatttagcagaatatttgaacaaccccgaggcggtgaacaaagcgaacgcttacctggccggcaaaaaactcaaaacaacataccagggtcgtgattccaagaccaaagaggtaaagttcggcacattttcggtgaaagccgctacggaaacctacgcctttgagggatttcttggcaagtttccaaaaattcagtttcggtctaacacacatgcgttcagaggttaa

SEQ ID NO: 73251 - DNA, 1544 bp, Heterodera glycines
  Genomic contig location: Contig_ID=SeqID_10149; Location=2994..4537; Strand=+
  SCN-specific regions: Sequence locations=1-353,376-404,428-1544
atgctgaaaaagctgccaaagccttgtctgattgtttacgatgacttgatgggtgacattgaggccaagaaattggccgatctgtacaccaaaaagtcacaccataacaatttttccgtgattttcctcacgcaaaacctgttcgataaatcaatgcgggtgccaaggtccaacgcccagtacatcttcctgatgcgggctcccaacgacatgcttagcattcgtaatttggccagccagatgttcccacgcgagcagggattcctgatggatgcctaccgacaggcgtgtgccctaccgtacggctacctgttggtgactctccacgcgaacagagacaacattatacgcctaaggacaaacattttcccagacgacgaggagagaagcatttttgcccccaaaaatggttaagcgagaacagaagatcggtgagcgggttgtgcacaactacgactattttaagaagttgggaaagacaacgtcggagaagaagcgccgtcatttgttgaacagtgccggttgtgaggaactgttaacgcttgtcgagatttgtctcaacgttttgaacgggagtttctgtctgagcagaaaacaaaagcagagacttgcgccatttgcaaaagacatcagacagttggcacgtgtgcgaagcgagaggggtgcgcgaaaactagtgcagcagtcaggcggatcactttttgcccctttgttggcccccattctgattgaggctgcccaatacctgctttcgcgcagcaataatggccaataaacttattctgctgccgtacgagcactacaaggggctggttgcagcgagggagacaaagaatgacgacgacgacattgctgagcggacaaacttgggctttgtcaaacgacaggtgaccgctgcagtacagaagcggaagggaaacgtcagcgagcggaacgcaatgtacaaccagcagctgcgccggtaccttaagatgcgcaaggaacataaggagcggcccgtccgggtacagctcagcaacggcgctcaactgctaaataaaacagtggagacgggtgtgcaggtacggcctggtccggacgaaccgaaggacaagtccgtgatggttaccgacgaagatgaagaggaagaaattgaagtgccaaagtttttaaccccaacaagccagacactgggaagcagccgatcacccaggaccaataagaaagcagcaaaacagcaaaaattgatcgagaagaaggaccacctgttggccatcattatgtctgatccgcagagattcggcgcaacagaccgtgggaaaatcattaacccaaagacgggccgagagtttatcgactcggacctggcctggtcaattgaacgcctggtggaccctcgcccggagaatgccccttcgccaagcggaaccaaagagttgaagaggaaactcgcacagaatccgcttgccagtagcctactcaatcgactgtttgttgggtctgggttcgtcggacaagtcaaacaaacgagaggatttgttccctcaaaatggacaagaaaataa

SEQ ID NO: 73252 - DNA, 2054 bp, Heterodera glycines
  Genomic contig location: Contig_ID=SeqID_10150; Location=1744..3797; Strand=+
  SCN-specific regions: Sequence locations=1-151,186-370,394-574,632 -686,724-967,989-1012,1042-1144,1166-1254,1277-1363,1417-1448,1477 -1730,1755-1932,1955-2054
  Gene Ontology: Mol. function=anticoagulant activity; Cellular component=plasma membrane; Biological process=skeletal development
atgccgttgagccctcgcattggccacaacccgtcgtaccatgttgtcaaggaggtggagatcattcgtgaagtgatcacctccggtgggccaaccattcaacacgataaaatcattcatctgctcacttcgccaaataatgcccaggtacaattaataatttaaatttaaacaaattaaattttgtcaaatttttcagcgccaagaactgctccacaactaccgtactaagtacggtggtgctgatctggcccaagcgctgaaggaaaagttgccgccaagtgaagtggcgaccaacagcctgtatttggcactgttggacacaccggctgagcatgacgccaaatacttggccaaggcgatgaaggtggtaattttttcaaaaaattttactcgagacagtaaattcccgattaacaaacggattcgcacataataatagcttaactttggtaaaattattaaatccagggttaagaattttcgaaattgttttttttttgatcagcgatcttttaaaacattaaaagtatatttaatttaaaatcaaattcctcatatgatcaaaaatgcctaattaaagaaataaataatccatcaatcataattaattaatcaattaatattaattcttgctttcttccagggatgggcaccaacgaagacatgcttattgaggtaaccacataattttttttattagtttttttaaataattattttgcaattgcaaaatttgttccctagattttggtgacccgcagcaatgcccaactgcgtgccatcaaggcggcctaccagaagttgtacggtcatgggttggagaaggacctggcggccgagacaagcggcagctttaagactctgctgctcgacttggtcgaagcgaaccgggatgagtcgtaccgtactgatctggccaaggcgaagacggtactatcggattaaaaaaaaacaacttacattagccctcccctccctccctcccgaaaccgaaaaatcaaaaatttctaaccaaaaaggggaaattttttgacaaagtataccggtttctaacaaatttcgttaaaattttcttaggcggggcttgtttaaaatttttttagtccctgcccaaaatcgacaaaatgcttaatatcgtggacattaaagtcaaacaaaaatggctagctaattgaaaacaaagattcctgacaatcccgctaattaattaaattcgccacctattttattaataaatttaggatgccgagaaactttacaaagccggggaaggcaaatggggcactgacgaagatgcgttcatcaaagtgttggccaaccaaaacttgagtcagcttcagctgatgttcaacgaggtgagaatctaatttagatttaattaaatattaaattaattaaattttaaattaatttttaagtatgaaaagcttggcaagaagcacaccattgaacaggcaatcaaagctgaattcagtggagacgagctcagtgctctgttggcaattgtcagctttgtgcgcaatgggccaattggcgaaatggcggaaatgctgcacaaaagtttgacggtcagtcagcaaaatgccaaattttagaaaaaatattaatgacgtcattaaagtgcaaaagataaagtaaaatttgaaaacattaattaaaaaataaactaataaaggttgtttaatttcaaaaatgccatcaaaaaatagattcgattgtttcaagccaaaatttttaaaataaaatattttcgacgaccaccaaaacgccaaaaaacaagtatgaaaatgccaacaaaaaacaaattacctttcagaaaggtggtaaggacgatatgctcattcacctgattgtgtcccatgctgagcttgaccttggcgacattgcccacgaatatgagaagcgcttcaaggtgtgtgatttttgaaaattttagatttaaaattaaattccattttaattagactccgcttgaacatgcggtagagaccagtggaaagacgacgacgttgaagaatgcgcttgttcgcatgatcaaaggcaacaaataa

SEQ ID NO: 73253 - DNA, 991 bp, Heterodera glycines
  Genomic contig location: Contig_ID=SeqID_10151; Location=187..1177; Strand=-
  SCN-specific regions: Sequence locations=1-101,136-492,556-572,603 -783,811-991
atgagtgcactcattatcattgtgtacacattttgttggttctttgtgttcaaatttgcttcaacctcacaaagttggtttgacttttttgttggacgcgctttttttaaataaaaaattaattaattatttttactattctaaacagacgtgacagaaaacaatcgcaaactgaacaaatcgctgatgttcatcatcgcactaaacctgatcggagtgttcacaaaaatcatcattgatctgattttgcaagcttgttcggtggccaacgtgttcatccatataccgtactccaccgtatattccttcctcacaatagctgtgtacagtgcaaatgcaccggtgctttacataatgaggtagcaattagactgaaaagttgaaaacataggggccatataggttttatttatcagttttgtactaattacgccgattttggtgtattttatattaaattcatcttgattttccaaaattttaacggaaacgaaattttttatatgaattttataaatttacccgtattttaaaaaaaatgtttattttaaattacttgcaaggaattttgcaaaatatatgaattaatattaaataaaaatgcacacaaaaaaagggcctaaaactctctaaattttggaaaatacacataaatataacaaaatttgccaaaactaaaagcacagaaatgtttacaatgacattgttaataccgtagaattcttttaaagactcgaattctgtacaaagataagatatttaaactactttggcgttttgacgattaaaaaaattaaaaaattaaaaattcagctccgaataccgtgcgcggtttgaccaacatttcccatgggttgtcaaaatatacggcaaaattgctcgcagtacggcaacagtgatgcctttggcaacacctccaaggccatggatcatcattaacaatggcattggcccagcaatgaatggagggatcacaccaagacacatttaa

SEQ ID NO: 73254 - DNA, 467 bp, Heterodera glycines
  Genomic contig location: Contig_ID=SeqID_10152; Location=107..573; Strand=-
  SCN-specific regions: Sequence locations=1-19,52-104,128-188,236 -273,295-467
atgtataggttaattgagaattaattaactaattctattttaaattttaattgtagtggtaccaatatttcactgcggatggtccacaatggctaatgctgctttttatgtacggtttccgtgcactttgggccaccattggcattctgttcgaccttggcattgtgtacatcacagtcaaaacgccgtaattaaaaaaaataaaatatttttttaatataattttttttatttagttgtttgcgcagcatttgcaacattttgatagccacagaaagcttttgtgcactggtattgaatctcggctattttgtcagcttttttgtcgtcgcttccggcacaaaattcatccgttatgagcactgtttttgggcactcattgtgccatgtttgtttggcactttggcacagccggtgatggtgttcaccgggttggaccgagtgtttgccgttgcgtgtccattttg

SEQ ID NO: 73255 - DNA, 1817 bp, Heterodera glycines
  Genomic contig location: Contig_ID=SeqID_10153; Location=206..2022; Strand=+
  SCN-specific regions: Sequence locations=1-28,50-1342,1407-1543,1574 -1714,1789-1817
atgttatatggccttggggaatttgcaattttttgggtttggaaattttgcatgttttagttcagaatttttgaaaaattttctccaaaattttccaggggaccgtgttctttttcctggaatttctcaattacttggatcaactgaatgccgagccagagaacacggaccaaatttggcacaaaaagctgcgctcatggctcaaaaacacgggcggatcgaaccaatgggactcggacattgtgtacacggaaacgggcactttccgagcctatcggttacaggtgagaacggcactcattgattcgttgattttgattggagaattttcatgactcaaaaagtgatcaggcccgttgattgagactccaactgatccaaaaagagatcagaatcattgattgagactcccacttttctaaaaagtgatcagaatcattgattgagactcccacttttcccaaaagtgatcagaatcattgattgagactcccacttttccaaaaagtgatcagaatcattgattgagtccccaattgaatcagaaagtgttcagactcattgattgagacttaaactgactcaaagatttaagctgatccaaaaagtgatcagaatcattgattgagactcccacttttctaaaaagtgatcagaatcattgattgagactcccacttttccaaaaagtgatcagaatcattgattgagactcccacttttcccaaaagtgatcagaatcattgattgagactcccacttttccaaaaagtgatcagaatcattgattgagtccccaattgaatcagaaagtgttcagactcattgattgagacttaaactgactcaaagatttaagctgatccaaaaagtgatcagaatcattgattgagactcccacttttccaaaaagtgatcagaatcattgattgagactcccacttttcccaaaagtgatcagatccatttattgagactccaattgatcaaaaagtaatcaaactctgggctttcaggtggccatgaaaaatattgtggagcctgatcagcacaaattggcggccaaactgttgcgtgaaattgccgatcgacaaccatttcgcttggaaatttaccatgaggcgttcccatttgctgatcaatatttgatcattcttccgtcaacctatcggaacgtaaggctgaactgatcactgaataattctttcaaattttttttaaataagttttcaaaaaaatcttagaaaattgttctaagaaatttcaagaaaaggtaaaaaaaaatttctaacgattttttcaaaattttatgattgatgaatattaattttcacaattttccaaaaaaaaaaaaaaaaattaataaataaaaatttttcaagatttttttataatttaaaaaaaaagttttccgagggggatattgaccgatcaaaaaacacttgaaatctgatcaataacttatcccctttccaaaggtgttcatctcgttgttgtgcatgacgatcatcgccattttgttgatcccgagtattccgtccggtaataaaaatttaaaaattttcaaaaaattccccttcattttaagccattctgatcattctctccattgtgtccatctccacgggcgtgttcggctacatgacattttggggcgtcaatttggacgcgtaaatttaaaactttgaagaagaaaatacataaaatttccggcattaaaataaaaaatttcccaaaataaaatttatctttatttaataaattcagaaaattttaaacattatttttctctacgaataaacaattgtctgccggca

SEQ ID NO: 73256 - DNA, 1170 bp, Heterodera glycines
  Genomic contig location: Contig_ID=SeqID_10154; Location=369..1538; Strand=-
  SCN-specific regions: Sequence locations=1-275,297-763,788-999,1021 -1049,1073-1170
atgtcccaagatttgttcggccacagcaaaagtgaggaatggaaggatttggacgagacgggcaacgactcggacaaactcagccaaatgtatgtcggcattcgcccggtggacaaatgcctgcgaattgcctatgccaaagcgatggacatgaagcatcaggtttgttaattattcacacttttaatttacatttgatgacaatttttggcactttaccaagttagggtacccgaaaaaccaaaatggaggggggggggtgcctttgtagttcgaaaaaaaaattttttttttttgccattataagtcgtgcaaaatttgttcgaaaaggttttcggggttcactgacacgaacttgacatcagtttttgaccaattctttaattcgaactcgaaggaaaggtcaaaaaattccaactttttcctcgcccccccccatttttcgaattttttttttcaaatctcgtgaaaacttgtttctgggggtttcacgaattcagcacccatttcgaacaactagaattccagacccgaattcggacaaaacactgaaaaaacaattttaaaatctattttttaatttttgcgtcaaaaagtttggtggcataaatgaatttcgaaaatgcttttttttatttgagttcggaattcgaatagatgcacgcacgattaagcttttgtgggctatattttcgtttacgagaaaaatccctaatttcaaaccaaaaaatgaatccaaattttcaaaaagttttaaatgagcaaaaaaaaaaaattttttttttaacgaatcgaatgtaaaaaaaattatatgcccctcaaaaatggcttattttaatttccctttttttccccaacacagaaagtgattgtgatggtggagaacgacaacgattttcgcacctacgacacgaaggaagtgcccgtgggtgaaatcatcaaatgtgagtttgaatttgttgtggcaaaatgttgatgggtaattggtttttttttttgtttaattttcatttttgcactaggtcgtaacataattacaatatacttgatttagtttttgataaatatttagtgtatattgataatatgccattctaaattcttaaaaatgatggatatgcattattttggcgtaaaaacaagcattttcaaaatgtttggcgcaataaa

SEQ ID NO: 73257 - DNA, 1425 bp, Heterodera glycines
  misc_feature (953)..(953): n is a, c, g, or t
  Genomic contig location: Contig_ID=SeqID_10154; Location=2077..3501; Strand=+
  SCN-specific regions: Sequence locations=1-35,57-440,469-503,525 -999,1021-1425
atgaaaaaattcatgaaaatcctgaggattccttgcaaaatcccatggaattatttaaaatgggaaatgatgcttcaggttgacaatggtcatgggtttggtgcatgggctggtgttcattccggtgttgctcagctttttgcccatggcattcttccaaattcggcacaaaaaaccacaaaagcacaaagaacaacaaaaagtggtggcaaaaacgaattcgttggcggcaaatggcacaaaaagatgacaattctaaaaatggcactgatcagaggcatttccatatccggtgaagaaaatgactgaaaatcttcaacaaacacacattatggccaaatttggcacattttcattttgttttgtttttttttgacaaattttcattgaactttggtttttaggggtataatttccattttttccggcaaattttcatctaagtttaatttttaaatgagttatattttccattttccatgcaacattcttttatgaccttgaccatttttcatccaccaaatttttcggtggcacaattggccctcgtgtcgggtgtagaattgggtgttgttcaattggaacggcacaaaactcaacaaaacaagagccgtttttttgtgccctacaatttctgttcttttttccttttttttcttcttcaaacagttttttgccgaaacggaaaaacgaaaattgaatttaccgaatattattatttgttgcacatatatttttttgttgctcaaactcattgaaaaggcatttcttttttttgtttgatcaaaataaaaaaaattgattgatcgaaatgttgcaaatatccgactttttttggatcaaattcattggcatagcatggagggggactaaaggggctataaccccatgaaaaagaaaaaattttatataccgtatatgctctaattatagcccatgggggattatttttncacctcctcagaaaaggggggataattagagactgggagattatgatagagggattatttttcaaacacctcgtagactgggggataattggagactgcgggattaatagagactgggctataatatagcatatacggtagcctcctttcctgccgaaaacgaaaatattttttaactttttcctgactggcgttgtttatcggtatcgccggtccctacctccaagaaatttttgaaaaaaatgcggcaaaaattaaaagaggtcgttgttcagagtggttaacccccccccccagaaaaaaaaaaaaaatctcacacttagaaattaaaaaaataattggaaattttttcctcagaaattacaagaaaaaaaaaatacttttcaaattgaatttttcaatttcggacagtttattttattttttgaaaaattagaggcaatttgggttcgttcactaatgcattagacaa

SEQ ID NO: 73258 - DNA, 1575 bp, Heterodera glycines
  Genomic contig location: Contig_ID=SeqID_10155; Location=1..1575; Strand=+
  SCN-specific regions: Sequence locations=1-63,120-284,321-467,503 -697,735-1129,1175-1459,1481-1575
ttgtttctgtcgtctgtgaggagcattatgactattatcatccaacagagtgagaaaagggcgaaaaattaattaatttaaattaattttttacttttttaaaatacaaaataattattcaaaaatcatccaatttttacagaaaatggcttctcggcgtcgtggcattgcctttcattctgtgcggcctttgtgccaatggaatgtccgtcgccattttttcccaccgccaaatgcgccaacagtccgtcaattggtaccttctcgttttgggtgcgattcgctttttaatttaatttattttaaatattttttattttcctccatttctctcctttttaggcttcagtgatttgatcgttttgctcggcgccttcttcgttctcactttgccgaggctaagcgaaattttgcactggtggagagggacggcgataaggtgaaatattcgaattcatttccatgagaaaaaatgaaattaaattttaaaataaaataaaatgcagttattattcgacccccttgatgtattcgctgatgacaatggcgcaaacgaccaggtgacccattaattcattcattcaatggcaaataaagcattgtcttatccccccccctttttcgcagtgtttggatgaccgtggccatgtctttgcatcggttggcacccccaaaatgccaatgtccgatttgaaaaattaaatccccccaaaggtttgtcggcgtgtgctttccctaccaatccggcaccgttttggccacacgaaatgtcaaatcactgattgttggcattctttttgtggccatttttttcaatggatgccgattttttgaggtttttctcaagtttccttcctttctccactttatccgttaggtcagcttccaagtgtgtcggatgaagccaataaatgtcgaattgcccgtcctccgaatgaccgcactcagacaaaacgaattgtaccgcaaagtgttctatgaatgggcgtacactttggtcagacaaagcgccaattgggcgccaaattgacaattcaaaaaatgagctttcgtttttcagattatgttcgccattccgttcactattctgattgttgtgaattcgatggtgattttggccattcataagtaattaaaataagaaaaatttaagtatatttaataatgattttttgaggtcacggaaaatccacgccaaaatgaacgcgcataacgacgggattcggaagcaagaattagccaaggagataagcacctccatcatggtacggtgtgaaaggggtactgtatatgcaaaactgtaatgagaccatcgtttagcttgttgccattgttatcgcctttctgttgtgcaacactttggtgagttgtttttgaataattatcatcgtaattattccgccgttttaatccaacattagaacaattaccgtacccaattattttaccgtaccttccaccttttctaaattccccccgcttcagactttcgtggtcaatttgatggagaagttcgacctgaatgagctgtacgtgctgctagtgccctggagcaatatgctcgtgctgtgcaac

SEQ ID NO: 73259 - DNA, 1149 bp, Heterodera glycines
  Genomic contig location: Contig_ID=SeqID_10156; Location=220..1368; Strand=-
  SCN-specific regions: Sequence locations=1-44,87-391,415-856,954-1149
  Gene Ontology: Mol. function=transmembrane receptor activity; Cellular component=membrane; Biological process=development
atgacgggcggcacggaacgcggaatgaacatgcaggacggacaggtggaggaaaaaggacggaaaagggcaaaaagggaaggcaatgccatggcatttcaggaaaaaatggtaaccgaaatttacctcactcgcctgctgacgatgaaggggactctgcaacgattcatcgaggaactgctcgaggcggtgttctccgtctcctccaccccccaatgtccgttcccgccatgcataaagtacttgttcgacttcttggacgaccaggcacacgaacttggcatcaccgacccggaggtaggcaaaaatggacttgggcaatgacaggggggaggatttgcgatcacttaccattccgattactggctacttcatttcctatctctctcccttcccatttctcaggttgtccacgcttggaaaagcaacgcccttccgttgcgcttttgggtcaatctgatcaagaatcccgacttcatcttcgacatccaaaagcccaccaaaatcgaagggtccctcaacgtcgtcgcccaaactctgatggacgcctgctccacgcaagagcaacacttgacgaaggattcgcccagcagcaagttgttgttcgccaacgaaatggacaagtacagagaatgggtgcaacggtaagcggacagagggtacggtaatgcaaagcggacttttgtaggtattacgcgaccattgccaacatggagccgatcagtcagtcggacatgagcatgctgctggcggacgagtcgcaggagcattcgcaggagttcatgctgtactcggcactgaacgagctgtacacatacgtcagccaaaacaaagtccgttttcagagcaattcacttctcttccccctttctctccctacttctctctctcgctctctcctattaaatctctccctttactctaatccactctgatcacccctctctctccctaaggaaatgctcttcgacgaattggcccaaaatgagtttgccctccagcagcaattgcccggtgcgttgcagaaattgttggacacgattgagtcgccgcccgaatcgttggcaccgctcaacggcgcgcttctcgtcgacgcttacgccgactcaaaggcacgcctcgtgcagccaaacgcacagctcggcaacg

SEQ ID NO: 73260 - DNA, 620 bp, Heterodera glycines
  Genomic contig location: Contig_ID=SeqID_10156; Location=1381..2000; Strand=+
  SCN-specific regions: Sequence locations=1-126,148-620
atgaaacgcccgcagcgtcgcacccgcgtcggtcgcttcgcgcgagtgccctccggcggaactgccggtaccgccgccgccgacaaaaaatccgccggggcgatggacaggcgaatttgtggtggcagtgggagcaccgcggacagcggacagtccgcccgaggcggacgatttgtcggatttgtcggagatcagcgacagattgtaggaggaggaagtggcattgtgcggcacaagtgccaaagtcgctttgtcttccaccgaaaacagaaaaagacaatgccaaagcaaaccaaaggagtcgatatgccaaaactcactttgtaatgtgccaaagtgttgtagcgccaaaagccattttcacagcgcgaagtgccatccaagtcttggagaagcattcggtgggtggccgtgcgcagttccaagtcgacttcggagggcaacggccgttcggagtacggtgtggtacggtatttggcatccaaacagcgcattttgacctgaacagtgggatgatggatttgtgaaggatgccagtgaatataagtgcctggctgatcgagtcgcagtcgagcacgcgcacttgcgtatcgcaaatggcggaggaacagtccgccaga

SEQ ID NO: 73261 - DNA, 1430 bp, Heterodera glycines
  misc_feature (1286)..(1286): n is a, c, g, or t
  Genomic contig location: Contig_ID=SeqID_10157; Location=32..1461; Strand=-
  SCN-specific regions: Sequence locations=1-86,108-931,954-1430
  Gene Ontology: Mol. function=semaphorin receptor activity; Biological process=signal transduction
atgccaactgagcgcagggcgcagttgtccgtcgagcggcccatgaggctcgactttgggttcgacttggacggcacactgaccgggtccgtccccccttcgctttttcttccgattagtcttacaattcgcccccccccctccgtttagcaatttgactgctgatcgcgctttccccaagctcctcgtcttccccgaccctcgcctcgtccctctgcccgaactgctcgccatccgtcccggcggtgacctcgttttgaaagggcagaatttgaatttggccgcgtcgccgcgtgatgtgcgcgtgtcggtgggcggtttgccgtgcaatgtgagcgcactcgcgtccaacacattgacttgcgtgttgcccgcgcatttggacgacgcgcacgacgacgcggtggacgttttggttcacatcggagacaaaatgtacacacgaagctaaaatgttgcgaattttaaatgtcctttcagtgaaaaggttggcgaagcgtcccaacgcccgcggggccaagacccttcggaatggctcattttggcggtggcggttgcattcctcggcgttttcctcgccttggcactgttcgtgttgtaccgcagaaagtccacttctcacaaccgccagttgcgctatctgaaggcccaaatgaattccatcgaaatgcgtgtcgcgcaagaatgcaaagtgagcggaaaaaagagggacaattagagccaaactaattagttaatgatgggctaattaacaatgttactaacaaacaaacagcttaccaaagattaaatgatcaactgattgacaaattacggactgatagatcaattagcatttctgactcattgccttcccccttccgattcgcaggaggcctttcacgagctgcagaccaacatcaacgcactcgcgggcagcgtgccccagggcacctcttttatcccttttctgccgtacgcggattatgccgcgcgcattctgttcccgaattaccccggacacacccatcccgcgctgtgtcccctctcagttgaccaggaccgtgccttggccattgagtcgggacttcgtcagctgcactatttgcttcaggtggccaaagaatggcacgcaaattacacgctcaaaatgccatttcccgacactttcagaatcggcactttttggtctcttttgtgcgttccatcgacgccaacaaatatttgctggtgaaggaccgcgtctatgtgggctcgttgctgatggttatccttcaggtcgagcgaattagtgccaatgggcaggngttaccgtaccctttcaggagaagatggcatactgtacggaagtgttgaagcaattgctgaaggaactgatcagacgaaatgctgacggaaaattccatccgaagaatttgttcagaagagcggaaagcgtagccgaacgaatg

SEQ ID NO: 73262 - DNA, 414 bp, Heterodera glycines
  Genomic contig location: Contig_ID=SeqID_1396; Location=2008..2421; Strand=+
  SCN-specific regions: Sequence locations=1-213,235-414
atgggcgcttcttcttcgacagccgctggtataaacggaaaagaacggcggaaaagtacggaagaaagcggtgcggcacttttggaagcagacaaaagggcgcgaaggtgagcagagaaagggacagatcatttatttatgaatcaatttcagattacttcttcaaaacgggctccttcgacgcaaatcaaaggctggcaacaacaccatggcggaggacgaggcgggaggaaacagctggcagacgaaagcccattccatgtacgatctgcagcagatgcgcggaaaatcggcggaagccgaagagcagctgcaaaagggggacgacgctgcggggcacgaggcgacggaacgccaaaatggggcggggagcacaaatggcaaaaagcatcggttgaacaaaatcgtcataag

SEQ ID NO: 73263 - DNA, 1434 bp, Heterodera glycines
  Genomic contig location: Contig_ID=SeqID_1397; Location=490..1923; Strand=+
  SCN-specific regions: Sequence locations=1-384,406-468,500-546,568 -904,929-1090,1112-1142,1175-1384,1406-1434
atggcaacaaatgaccggcagactgaaggaatttttggagtcagtggtacgaaaggtgagaagacgcgaattctgcaaattaaatccaacaattgcttaatctcaggtggacaacatcgaaatggtcgaacgtttgtcgcgcaaatacggcgaggagcacgtacagctcaaatgctttggcttcaagccggacttttgggtgagtctggcggacgcaatggtaagcggataaattgggaaggcttttcaagcccattttaattcactgcttttaagactgtcgaatgcgtcattttggaccaagccacgcatcaggtgaacaccaaaagttgacaaaacaaaacaaaaaatgggggggggagggaatttgtggcatttaacaccaagaaaagagatagtaagagaagggtgggactgatgtgccatctcaacatttggggccagaaagtggaacatttcgcttcatccctggtagtgaaaacaaaacgaagaaaagagacccatttggcccatactctcgaatatcgcctgacatcaaaaatgccctttttggaaatcaattttgaacactcatattctctgttcatttggccgatttgcttagccttcggacacgatcactgcttggtctctgctcgtctccgttatgttcagctccgtccgggacggctattaccaggcattgcgcgctgctcgcatctcgcaaaggcatcgcaatgtgcagcagcgcgaaaacactcacaatttgggcaccaaccaaacaccaaattccccctcgggggtaacatttagtgcactatttatccattatttttttctgttaaaaatgcaaacatttgcccttccgccacaggtcgaaaagagtgcgtcagccatcgaattgcagtcgcccgagcggaaaacttccggcaacaacaaacaaaacacattgaggcaacagatggagcagaagcgggagaagtcggcttcgccaaatggggcgagcggagtcattgtggaagaggtgggcaggcaattagcaattaattgcgcattcattaccaagccaatgctatctcattcattaagaagtcaattccggttcaattcttctgaagaacatttggattcaaacatacattttgacagcttttaaagtgcacgaaaattgggcacaaaaaggcaaaatataaaatgccaaaatttactttgataaaatggaaatgctattgctcgctttttggcactttttcgatattttttggattcctttggccaattagtgccgcccaatttgcgtgacatccctttgaagtgcgtgattgaacctttgttttgatctctgttcctaattattctgattatgtccattcatttatattttttcgtcattcaatcatcgcattaattaagattaattgatcatcatcactttccaatattttattgtctaaa

SEQ ID NO: 73264 - DNA, 1423 bp, Heterodera glycines
  misc_feature (1387)..(1387): n is a, c, g, or t
  misc_feature (1394)..(1394): n is a, c, g, or t
  Genomic contig location: Contig_ID=SeqID_1398; Location=1664..3086; Strand=-
  SCN-specific regions: Sequence locations=1-326,348-982,1005-1423
  Gene Ontology: Mol. function=ATP-activated inward rectifier potassium channel activity; Cellular component=integral to membrane; Biological process=potassium ion transport
atggtgttgaactgtgccatgaacgaaatggaggtgaacaaagcaaaaaacatgtccaaaattacaaacattccaattccacaaaaaggatttattaaagccaattttagaaaggatttacgcggttaccggtgccccaccccaaccgacggccttccaaaaaaccgaggaacagcaccgcaagcatggccaaattggcacctaagcaatggcctcggcttgtggccaaaaacggcgaatgcatcattcgaccaaacaacctacgcaattcgtacacaatttggtcggtgatttgttcagaattattgtttgcttcttctacagtatttcttcctcccccctaccgtaccctcttccccgttacagtatgcgcaactggttccatttgatcattgaacattcgtggcgtcgcattttcggtctgttcgcctgtggctttctgtgctcatggctcacttttggcctcttctattttctgatcgtccaatttttggttgagtatcaagtcagtaataaatttaaaaaaacatttagcgtttgaatttgatcagaaatttcgcagggattgcccgaagaaaatcaatgcattgccaacgttcaatcattcgccagtgcctttttattcaggtgatttttggctcaaataattagcagatcatttcattaaatgttcagccttgaaactcagcatacgataggctacggtacccgatacatgaccgagggttgtccattggcatacgctgtgctgtcccttcagtgcattttcggcgtactgctacaaaccttgctggtcagaatttataacaaaatcaataaagtattcgataatttgcaaaaaatcaatcaattaggctggcattgtgacggccaaagttttgcggcctaagaagcgcaagcaggaaatgcggtttagcgtgcaagccgtgatcggtccggtggacgacgaggacccacggccggcactaatgtatgacaaagcggaaaatatttatttcaaaaaagttttatctttttaattataggattcggctagccgatattcagcatcgcctttatattgccgagtcccacgttcgtttgtatatggccacaacaaaaatcaacaaagttgtttattcgagaaacaaactcattgaattaatgactgaaattaactagtaataaccttttagcgtggtgaatgcgaattgatcggtgtccaggacatgaacgttggctacgacacgggcatggacagggtgcttttactgtggtgggcaaattaaaaaatataaatccattttcaaaattatctgaatttaaataaaggcccgtcgtaatccgtcatatcatcgaccccgactcgccgttgtgggagatcacggaggacaagctgaattcgtgnccattgnaactgatcatgaccttggaaggaatgtag

SEQ ID NO: 73265 - DNA, 441 bp, Heterodera glycines
  Genomic contig location: Contig_ID=SeqID_10161; Location=1292..1732; Strand=-
  SCN-specific regions: Sequence locations=1-227,249-253,275-441
atgtcttatgcttttttgcacattaaacaagtgaactcactttggctttttgcgcagtttccacagaagcatttggtgcgcgagtgtcttcatttgcgtcgcaacgaaattcagaaattcaagcgcatggccacatggtgaatcgttaacccatcagctaagccttgcggtgtccgtttttgaaaagaaatccgaagagctcgtagagcagaccaagcattttccattaccaatcaaaaggaaactagcaaaatgctaaaaaatttactgtaaaagattagtttcagggcagtggaaatctcgacagtggacatttgtacagtgaattcgtttgtatagaagaggacttgaacagtgggcattacgccagtgaatgaatttttggaaatagtacggatggtactcccccccccccttttgaaattctaaatatgcaataaa

SEQ ID NO: 73266 - DNA, 773 bp, Heterodera glycines
  Genomic contig location: Contig_ID=SeqID_10161; Location=2129..2901; Strand=+
  SCN-specific regions: Sequence locations=1-160,185-200,227-773
atgttcgcaattgcgcctgcagcggcgagggtggcaccgttatttctatggtgcacaacgaattcggcacaaaaaatgtgtgtgtggcaactgttcgctgtgcttgcaatagcgtgtcaaaattgacttatgaactaactaagtggggacggcgtaaaaagcaagtttattttataagaaatatttggcaccaaacatgcaaggaaaggaaaaaatagaaaatcaagagagaacaatttttgactaaagttttggtactttttaattatcggtactcacaatcagatttcactttttttagcaatgaatttgttttaggggttttcagggtaggatccgatatttatttcaaccaattccggacccggactcgagcaaaagacaaatttattttaataattgggttatttagcaatggagaaccaaccaccaacatgagttgtattcggttaattgtgatgaaaaacattcaactggaaaatgttgagaagatatttttggctatgcccgaggactattcattggtgcgcatgaatgaaaaaatttgggccaataattttatggacgaaatagtgaagttgacgaattagttgtattttcttttgtcgcataaatgttatttgaagaatacccatttttctttatttctttttatttaataggtcgtgcaattaaaaaactaaacgttggaaattaggtgtgtttgtgccaaattgtttaaggatttcattgcaatgcttgccaaatttagtcaatacccgtatcttttttca

SEQ ID NO: 73267 - DNA, 1170 bp, Heterodera glycines
  Genomic contig location: Contig_ID=SeqID_10162; Location=257..1426; Strand=-
  SCN-specific regions: Sequence locations=1-101,123-144,166-260,282 -479,501-510,534-779,801-1033,1055-1065,1091-1170
atgatcaatgcacggcgcagtgccaactccgccgccgttggcactgactgtgagatcgtgccattgtcaccactcacggtgatcgaccagtactacgaacggctggcggagcagcggtgagacattcattgcatttttcagtagaagataaattcagaaaatatagagaaatttcttaataattattgaaatcctaatttaaaagcatggacaagagcaagaaaaaaacttgtttatgtttcttttgtttcagttattcacacaagaccatccacgagctgttcaaccaaatttgtggcaccaaaagtgaagctgctgcagtcattgctggtgctgaacagcaacactcccatcgcccatcgctggtcactgtgccgaaggatttgctgtcccggtggatggcacaattttacggggacgcgacaacgctttggatggccaggaaaaaggtgaaacaattgttttttaggataagtaaatctttttctttgaaatttactgacctaatcctttttttaaaattttatttttaaccaaaatcttttgtaataaatggaataaataggctaaaaagcgaaatttcttcaccgagtccatgttgaaaagtatgggtttgttcccgtgcctttctagctcggaatgaccaaccattttcaatgccaagttctcatcgccttatatttttgtcagttggccatacaatttgctctgctcggtctctctgaacacgcgctctttctgtcctcaatgcgtcctgacgcgctgttcctggacctgtccaccggccaactctttttcaccgactacaaatttgacctgaccaaaaaagtgtgcgagacaatcgccggcaaagtgccgttcagtacgttcttttctttttactataaataacactaaagggttgcttcataaaaattgtttttctgttctgtgaaaatcgttcttttactgtttgggtcttaatttgtgtgaataaaaacgtttaaacaggcagggataatttcgagaggaaggggacaaaatctcgccgctgaaattttttaaaaaaatttttggggtgaacccattttaagaatttatttatttttgccaacatttttgtccattactatgtacatttaatttttgcagttgaacttgacgcaaatcgtcctgtgcccttccgtctga

SEQ ID NO: 73268 - DNA, 128 bp, Heterodera glycines
  Genomic contig location: Contig_ID=SeqID_10163; Location=146..273; Strand=+
  SCN-specific regions: Sequence locations=1-128
atggccaccggaatgatttggacccgttactgttttgtgatagtgcctaagaattactacttggccagcgtcaacttctttgtcggatgtaccggactcgctcagatattgcggattgcgcactatca

SEQ ID NO: 73269 - DNA, 484 bp, Heterodera glycines
  Genomic contig location: Contig_ID=SeqID_10163; Location=609..1092; Strand=-
  SCN-specific regions: Sequence locations=1-152,174-181,206-249,288 -439,461-484
gttttgcagaatatatgatcaaattctgcaccaaaacgtgtctaaagtgtggcgaggctacgacgagcaaagcgaacggcgcaaaatctgtggcggcggtcggaccaccgcccatcgaattaatcattgaaccgatgatggagacaaaccacgaaaaggggagaaggagcagtaacagaaacaacagcagcagcggggggaggagggaatgtgtggacagaggcgaaaggtaatggaaaaagccaaagggagggaaggaaaggaaaagcatgacggagggagggaacggcacgaaacgccaaaatgacagatgcatccaatggaagggcgatggactgtgcgatgccaaaagtgggacgactaaattcaacagaggacagcgaagggcgtgtgccaaaacgtgcggcgattgcaaatgatcagaagcgaaagaattacataaatgtacaattacttattgtgctttgcataaacacctaaaata

SEQ ID NO: 73270 - DNA, 1383 bp, Heterodera glycines
  Genomic contig location: Contig_ID=SeqID_10164; Location=354..1736; Strand=-
  SCN-specific regions: Sequence locations=1-109,132-433,517-622,645 -689,714-768,790-799,821-1201,1243-1340,1363-1383
atgaatgaaaaaaagaaaaggtattctgccgaagataaaggcaaaaagaatctgaagaaacgaactccaacgagtggaaaatgggagaaacagaaaatcagtcgaagagcggtgggggaggaaaaaggacaaacggaggagaaaaaggtaaacggaacggaccacaaacattcgtttcggcctgcctttaagccattcactgaagaaccaatgggttttacgccaacgccgcaaattcgcatcaatacaatgagtggttggagatggacgacggtgccgaaaaggcacaattattggacttcgacaacaaaattaatggtggaggaccgaaggcaccgaagcgtttcgaaatcagtcgagaaaagtgccgaaaggcgcgaaaaggtaatttattagaaaggaaacgaaggcacagtaattagtgagagactgcgagacagagagagtgtgatagaaagagggagaaggagagagtgagtgcaagagagagggaggaagagaaagacagagaagagaattttgaataccgtattttactgaattagagcccccggctctgtttttcaaccccactcaaaaggggggctttatttcaggatggggggggggggggttctaattgagtaaaatgataaattcgattttcacagttaacaaatggtccctcttcgaaggatggccatcgcgtcgcaattagcagcagcaacaaaatgagaaaaggcgcaaaaacgccgaacaaaaaacaacaacaaaaaagtgaatgtgctgaaggggggaaaagaagaagagaaaattaaaagtgaaggccaaaaagaggaggagcccattttgcaaatgctttgggaattgggagaaaattttgacgcattttttaaccgaaattttgaggtggtggaaaagcgagttcaaattggcgcgaattgaggtggaaaagcgaatgaattattgggattgtattatatttttgctaaagttccactgaacagtccatttctctgatgttgcgctgccaaaacgtcgacacgcgccaattgctcccctcggcgacgacgtgtcgcaatttgcgaagtgataaggcaattaaaatgtcaaacgattgccaactgcttttttttgttagttcaggtgtgcaactatctgttcaaagaaattgacacacggacaggacaaagggacatcaaatgcaaccttcagggtggaaggggacaggggcagggaagtgctgaaaatggggcggggagggaatgccgaaaagtgggcggacggggaatggaagtgccgaaaatgtggcgggggagggaatgcctcttttttggttcattaggcgaggggcagaagggtgctcatttttggagagttcagtttatagcgtccatcaataaa

SEQ ID NO: 73271 - DNA, 3303 bp, Heterodera glycines
  Genomic contig location: Contig_ID=SeqID_10166; Location=231..3533; Strand=+
  SCN-specific regions: Sequence locations=1-617,639-2699,2721 -2969,3000-3303
atgctcatccgttttcgagcgtgtcaagtgcccgtgatcgccgacgtggagaaggcatttctgatggtcggaattgaggaggcggaccgtgaagtgtgcaagttcctatgggtacgggacccattcggaccgttgacaacgagcaatttggtgccctaccgatttcggcggttggcattcggcttaacacccagccctttctgcctggctgcggtggtccgccatcatcttcgtaaatacggcacagacttcgccgaacaactcatccgggacacgtacgtcgacaacgtactcattcccgccgacacagtcgaagaagcgacggacaaggcacgagaggccaagcggatgttttccgaggcccaaatgaacctgcgggaattcttgaccaacgaccgaggtctaaacgacagcttcccggaggcggacgcattgggcaagacaacggcaaagatgctcggactcgaatggaacgcggagaacgacagcctgcgaattgtctttccgggagacactcccgacggggcgcaccgcagctcaagaaggacagtcctcaggaccatcgcacgattattcgacccactcggactgctggcaccagcaacactcaatgccaagcagttcttccaaaagctgtgggactccacccacagctgggacgcgcctctcgagtcggacgatgggcgagaatgggacagaattttggcaagttgggagggacaatcgatcactattccccgaggagtgcgggcggagggcggtcgcccggtgcagctgcacgtattcacggatgcctcggagtcagcttacgcggcggtggcttacctccgatcagaagggcaagacggaagagctcactcccgactcatcatggcgaagtcaaggttgaagccgaagaaggcggctgggacgtacaccatcccgcggatggaactgatgggcctggtcgtaggagttcggctcgcagcattcgtcagagcgcagctgcatcgcccaattgcggaagagcacatgtggagcgattccatgatcgcactgcattgggtgaggaaccgtaccccccagccccaattcgtcgcgaaccgattggctgagatacgaaaagcaaccgccttgacgttcggacatgttccgacaggagacaagcccgccgacgcagcgactcgggggttctcccccgcacagcttcagcaagccaatctctggtggagcggaccgacatggcttactaagccgtgtgagcattggcccaaggaacttacttttacagtggactcggaagacgggggaacctcgctggacgaacgagggctgaccacatttgttgcacggcgggaggacactcccgaaacttcgacagaacggactgactggctactcgatcggtgcggccggtggacgaaggcagtacgagttatggcgtggatgcgacggttcatcactgggacacatcgcccaagagatgacggcacgggcgaccctcggtgccaagacacgagtcacgggcggtgcccgcccgtcctaagcaacgaagaattgacgcgagcaaaatggcagctcattcggtcagcgcagagcgaatgccaagcacgggagggcatacggaccaaagtggacggcaacggagtgaccaggctgatcagtcggatcggctggtgcgcggaggccgaagtcagtaggccagtcatactcccgaagcactcaagggcgggagcactcatcattgacgacatccatgggcgacttcatcatctcggtgtagacggaacgctggccgaatttttgagggactggtggtccccgagcgcacggcagcaggtgcgaaaggtactcggccaatgcaggcagtgccgacgactcagggggatgccctaccccctaccgacaatgccgcagctaccgatggacagagttcggcggcgcatcccgttcgagtcggtgggccttgactacctcggcccgaccgtgaccctcgacgcgaacggacaacgacaaaagacgtgggtcttgctgatcacgtgcctgacgacgcgagccatttacgtcgacgcaacacgagacttatcggcacaaagcttcatctccgtcctgcggagattcatcgcgcgccggggtgccccgagtcggattctcagcgacaatgccccaaccttcacagtggtgggaaaaacgctgtccgacttcggcatggcgggagatgatccgcggcattttacggactcccgtggcattcagtggcgtttcactccccagcacacaccatgggccggagggatatttgagcgagcagtccagctcgtaaaacgagctttgcagaagacgctgggcagtgctgtgctcggctatgacagcttcgccacgttactagctgaagtggaggcaacggtcaactcccgaccaatcacttacgtcaacagcaaggcgggagagcctctcccgctccgcccaatcgacttcatccaagagaatgggcggctttgggtggacccacccgacacgactggtcaggcacaggacgaacggcgggacccgccgcacaagcagctagccaggcaatggcgggagtcacagcaacgactggaacatttttggcgacgatggcaccgcgagtacctaatgacattgcgagaaaaagccggatggaaccatgctcagcggcgtgtgaacgcacccgggacaccgaaggtcggagacatggttttggtggaggataaatttcacccgcggaacctatgggccatgggccgaatcgaggaactcagaggatcggacgggcacgttcggagcgtgctgatcagaatggcgaacggaagaatttgggggagaccagtgaataaaatttgcccattggaagaagcaccgccaaaaatgcacgaccaagctgatcaagcagtacatgaaccatgcggagacgacgcacgggcagttgagactcagagcgaagtgaggagtcggaacgaactctcggcagcaccaaaagaagaagaaaatgaaggaaatgtgagcgaagaaagtgccgaaaagcgaggacgagaagttgaagctgtacagcccgacggaagggttaatcgagaaattcggaacgacaattctctggggaatggccccgacgatccggacgagaaattcgatgacgcaacaacgacggaggaaatggcagttttcgaaaaagcggcagaagtgccttcggcagcagcaggagaaacgggaattttggcacacccgcattcggctccgagacatgagaaaaaatatttgggagatagttcgacggccccaggtctcctcgatgtccctacaaaa

SEQ ID NO: 73272 - DNA, 1336 bp, Heterodera glycines
  Genomic contig location: Contig_ID=SeqID_10167; Location=1005..2340; Strand=+
  SCN-specific regions: Sequence locations=1-37,59-210,232-1336
atgcgcagcaccagcttttggcagaattcatgtgggctcccagcgccgtcctgcctcttctaccggtgggcagcggttccgtcgacgaccacagtctacgaggagtactcgtgccttgagtgggacatgcagataagtgcctgggtggaattggagacgaacagcggtcgcgtggagtcccagcgactgaccatccatccgggagtaccagagcagtgggggaacatgaccctatcggtcgtccccacctctctcccgcctatgcctgtgctgtccgctcacttcatcaccgacggacgggcggtggccatggggagacctctcccctccgatttgcattgccccgacgaggaggccgcacggggctttgacaattgccagctgtccatcagcgcatgccaaaaatgtgcgcctgaccatgacaacggcacggtgcattgccattgccgggaccttaccattggccgagtcatgaacgaccctgagcatcgtctaccattggatgtcgctcgacttcacctccacaacagcggaccagtcgtaaaggcggaatttcagtacacgcctgtgcaggtgcacatccaactcaacggattggagttggtcagcgagtacagcaacacgaagtgctgggtgacatcacccaaactcagcgggtgttatcgctgtgtcacgggcgcagcgctcacagcctcatgcaggacggaccacggaatggccttggcgaaggtcaaatgcgcggatggaactctgttcgcccttcattgcggtggcaacgactcgacaacgacggaggcaataccattcgaccgggcggaggtgttcacggagtgccgggtgaaatgccccgcggggatcacgaactttcggctaaaaggggagcttgcctttctccccaagcagcagcagttcggcttcaatcagcgagactcaaccggcgggcgggtcgagcccgggattagcctcagcctacccgactggcgaatcgaccctttcccccttctccatctcttattaagcgggaaaggactgctagtggcggtgggagccaccgcgatcggactggcagcgctcctcgttttcgtcaagttcagtccgcacttcagagtgtacagatcattaatggctatggccctaattacggtggtaatcccgatagtggggaccaattcagcgggtgaagtcacccgggccaaattcccggggacaacgaccaaagcggcgatcaatggactcagcaacggcgagctggacggggaaacgatgcggcattttcaatcggatatgggggcctacccccaccgtgccgtcgctattcttctgtttggcgcagcag

SEQ ID NO: 73273 - DNA, 315 bp, Heterodera glycines
  Genomic contig location: Contig_ID=SeqID_10169; Location=348..662; Strand=-
  SCN-specific regions: Sequence locations=1-315
atgtgccgcccgttgctgctgtttgtctgcttcactgtcgcttttggcattctgtccattgtggcgccaaatcaagcgctggccgagccggtgataggaggaccaccaccagcaccaccaattgaaggagtagcagcactggcaggaggtgttcagagtgattcgctggcgaatgtcaataatttagcagttgatccagcggaccaaccggttgcttctggtgttgcaccaccgaagcaaccagttgtagtggaagcgtcacaagtggagcaagcggaagtcgatcagctgccaaaaagttatggccgaaaatga

SEQ ID NO: 73274 - DNA, 611 bp, Heterodera glycines
  Genomic contig location: Contig_ID=SeqID_10170; Location=325..935; Strand=-
  SCN-specific regions: Sequence locations=1-382,406-414,441-611
atgctttattatgtgtattattttgggctgacatgtaagcctcggaatttccatgagaatctcagtggtaaaatttttttttttacttggctgaagtgatcggatgcatttaagcctcccaaattttcatttcagtcaaagcttttgcgcgtggtattcatttccctgcggaataatcagtgaatgataaacagtttcaattggttaaatggtctgactttaaaggtccaatcaaacaattaaacaatgatattaatgtactcaaaaaaggagagaatttcatgtttgacatggaatgaaaatgattggtgaagtgcccaatttggctgcgaaatgaacggctcagaacctgttttacggggggggaggacttttgcgtgatcatcgccgtcgccgccatcgccaaaaagcggcgaaacgaaaggaaagaaagaaatgattgatcggaggaggggggggggggggggggtgaattgctctgaacttggacgccacgaaattaggcatggatcataataagatataataatgatacaagcgataatgcaactggtccaatgtttaccaattaacgacaaactgtttgagccaaacaaatacaacaaaataaa

SEQ ID NO: 73275 - DNA, 691 bp, Heterodera glycines
  Genomic contig location: Contig_ID=SeqID_10170; Location=733..1423; Strand=+
  SCN-specific regions: Sequence locations=1-416,461-565,588-691
caattgaaactgtttatcattcactgattattccgcagggaaatgaataccacgcgcaaaagctttgactgaaatgaaaatttgggaggcttaaatgcatccgatcacttcagccaagtaaaaaaaaaaattttaccactgagattctcatggaaattccgaggcttacatgtcagcccaaaataatacacataataaagcatttttttgtttttaataaacctaaaacagtgacaataaagacaataggtaaatgatagaattttataagtggtcagcaaattatattcattcttttggtgcctttcggttctgccccccccccccccccctccgaaacttatcggtgatttgattttctctgattggtctgatctgatatggttaaggcaaggtgtaaaaaaatcaatcgtccgaattaattttatttttaatgaaattttaattttcatttattttacgaaacgaaaaaaatattagtcgaaacaataaaatatttaaatcctttctttccctgcctctaaaaataagtcaacaacaatccctcttctgtgaaatgaatgctttagctatttttagtctctttgtccaaagcacaaaaagccgcggcccgggcgaaatattcagtgaaacatccatcagctgatgatgatagccaaaaattgagaagaaagccatcattttattcact

SEQ ID NO: 73276 - DNA, 371 bp, Heterodera glycines
  Genomic contig location: Contig_ID=SeqID_10170; Location=1639..2009; Strand=+
  SCN-specific regions: Sequence locations=1-173,250-319,343-371
atgaattcggtaataaaaaaatattatatgttatattcaacatttagaattttggtattaaatatccgacttaaaagaatcacagattcatgcaagaattaaaatttaacaatttttttcaggcggaagaaccgaataatttttttgcttatttttttacttttgaatgccgcaaaatatttttttaatttggatattatttaaaccttttttaaataattaaaataaaacaatcatatttttttatttcaggtccatcagttaatgtgcaaaaaagcgttgaaaatgaagtgtcctcacaacaaacacaacgaacatgaacatttttcaaatgatcaacagaaaggacaaaagttaacataattaaaaaa

SEQ ID NO: 73277 - DNA, 1035 bp, Heterodera glycines
  Genomic contig location: Contig_ID=SeqID_10172; Location=174..1208; Strand=+
  SCN-specific regions: Sequence locations=1-116,150-211,261-308,330 -333,421-629,652-844,867-1035
atggttcaattcttagacagtttctcattcacttcgacttgtgagccgggcggaattcgggtgagtcactaattaatcactcttttttggaatttgaattttgcaattaaagtttgatatttatttatttattttttaatttaatatttcaatggaaatattgagttcaaatttggctactttctttatttaaatatttcaacaacaaaagtttttatttgttttttttaatttagaaataattttttatttcattatttgacttattttattcacacctttttccaataaattcaaccaaaagccgagtttttgtcattttcttattcacacttttatttaaaaatataaacaaaatttaaaataatttttttacgatcctttttaatctaaaattaaaaatttttaaaaaatattttaggtccgagtcgattcgcgcatcccttacactggcgcactctacggcttgtacgacttcttctcgtgccgaattgagcccaaggagtccaaactgttcgactttctttttccctacccgcacatttccaagaactgttcggacagcattcgcattatggtcaaattaaattaattgttgatcatctgattaattaactacaagaggaggggatgccattttacccttgaaacctggcatttggttttggggtcccgtgcccagttagttttgacagtcacccggttttttagaaatatcgcacaaaactcaatttttaaattttcatgattaaattcactaatttgttgagacggttgaaaaatggtgctaaatattctattttgatgcacgaaaatctcggtcctaaagagtctcgacatatttcttcaacaaaataaataaatttgctcaaatttttaattactacatataaaattaaatgttcctcaaatttgtcagggccaagaagcactgctcgaagttgtgctgtctacggacggagtggagccgctgtactttatcacagccgacgatttgacctatcagacaaaatgccctctgcccgagcacagcag

SEQ ID NO: 73278 - DNA, 979 bp, Heterodera glycines
  Genomic contig location: Contig_ID=SeqID_10173; Location=27..1005; Strand=-
  SCN-specific regions: Sequence locations=1-239,263-938,960-979
  Gene Ontology: Mol. function=MAP kinase kinase kinase activity; Biological process=activation of JUNK
atgctgcgggcccgcggggaacagttcgaagagtcgcccgaacttcagcaaattgctgttgtgctgaacagtttgttgggccgaaagggcgcattggccaatatgacggactattgggacgtggccacattcttcgaagtttcgggtttcaaaagccatttcggcgcagtgaaattcactgtttattcagttctggccgaagattacaacaaggcttgtttggcagcagagaaaatggcaatgtgagagaaaaataaaatctaacaaaaaaagtttattataccgaattccattgtacgaactgtcattactgtaacaccttttgattgactaatcgaccgattgattgctcttcaggttgaagccacctgtttggtttctgaagtcgaccatggagaacatcaaactgatcaatcaatgcaccgccactctccaactgtcccccgtggaacgcgacaagaaaacttttttgttttggaccgaatttttcatggaaagcatcgaatctcagcacatcgaaattacttcttcgcgcttcccagtgctaattcaggagctgaacaaaatgctgacgccgagctatttgaatgtgaatgcggacgatgtgagaaaaaaagagggggggggaggatatggagggattatttaactggaaaaagctgaacaaaacccctccacgaaatgtcagatcattctgtaccacgtgttggaggacagccaaagggcgcagatgaaacgacaaatgcaactgaacggcgggttggcgagcggaagccataggtgggagttcaaagcgaacaacatcaaagcggtcagtgcctccaaaagggacgaccggtgagttgggcactgccttggaccaatcggcacatgccatttgaccaattgaatttcagatccatgtttttgtatgtgttcgaaaattcggacgatttcaacttcacttttccttcttcaaaacattgtgcaaagtaataaa

SEQ ID NO: 73279 - DNA, 1357 bp, Heterodera glycines
  Genomic contig location: Contig_ID=SeqID_10174; Location=128..1484; Strand=-
  SCN-specific regions: Sequence locations=1-437,459-1357
ggccgccgacttttcgggccaatgtcttcaaacagtcgtcgcattcgctggacaaatacggcggagtcggctcaaccagcggcaacttgcgcaggctgaagacggtgctggtgatggacaaaaaggtgcagaaatgcctgcgggttcgggagatggcatgccaagagatagaggcgatggcggcgatgctcaacgtcaacctccaagtgcccttttttggtgaacaaaaccaatgctggcatttttagttgatcgacttcgaccggcttgacttcggcgagtcgtccacacttgacaagtaaaaggacccgagaacgaaattataataagcaaaacgccaaaatatttctcagcttttacaacgccgacattgccctcatagacttttccatcactcagcaacagccggtgagttcaaattcgaaaacaacgaccagtgaatacttttcatccccaccgttcagagtctctgttaccacgtggggtatttattcgttttgtttatttccgaattatataaaacatttggaaagtgtacgagaatcgatgggccaaacttacaacatcatcataatgtactcgcccgatttgccggacgaccaaaaggcggagatgcaaatcgaagcattgaaagttgggcaaaaataccaaagtgataattgaaagggacttaagaaaacgttggcacattgttcgctgattgtttactttctgtccaaagacgatttgcccacgttactctccgcggacagatcctcaaagtttggctcacaacacgagcgatatcagaaaatgttgaagaaaggccgaagcgattcttacgtactcatggcattgtttaatttggccaattttcaattttgaccaccaaataatttctccagggcacgttctctgaccgtattcggcaggcactgaacaatgtgaccatcgaggcgaatgcgcacgcccgcgagaagtttctcagcgacctgcgcaaagtgcgcgacatcgaatcgccgcccgaccaaaacaaatttctggaaaggatgcgcacgcgactggacaacccgggtgagactgactgactgatcggtggttgttggcctttccttcactttgaccgctaatcgctcgcttttggctcaccctttggcatttgccgttctttcaattagcaacatttgacccgcttctcttcccccgtcagatgttctctccgtggacactgtgcatcagtttctgctttgcttgaggtttccctcgcttcgttctgtccatttgcttcgtttgcagggacactcaagattatgacggaatcatcggacttattgacgacctcgagcgaattgaccagaagcaaattacccatgcgcag

SEQ ID NO: 73280 - DNA, 4822 bp, Heterodera glycines; identical to SEQ ID NO: 10176
  Genomic contig location: Contig_ID=SeqID_10176; Location=1..4822; Strand=+
  SCN-specific regions: Sequence locations=1-128,152-327,400-410,460 -783,805-1271,1293-1704,1726-1741,1848-2114,2140-2210,2234-2287,2323 -2577,2599-2677,2699-2858,2906-3058,3088-3218,3269-3352,3375 -3416,3501-3503,3529-3765,...
  SCN-specific regions: Sequence locations=...3801-3894,3963-4089,4111 -4125,4147-4147,4194-4363,4424-4560,4589-4607,4652-4822
  Gene Ontology: Mol. function=protein C-terminus binding; Cellular component=synaptic vesicle; Biological process=synaptic vesicle priming

SEQ ID NO: 73281 - DNA, 458 bp, Heterodera glycines
  Genomic contig location: Contig_ID=SeqID_10177; Location=56..513; Strand=-
  SCN-specific regions: Sequence locations=1-458
atgccaatttccctccaatttcttatcactcaaccattggcatttcaaaaactcacaaccaacacagtgccaacaaattttgcctccctaatgtgtgcaaatattgtacaaaatcacttggcgacggcggcggcacttcacacagacgctacaaaaaaaagaactgtgtgtgctgtgccgtccgtgccgagtgcaaaatatgccgacaaattacttcgttcagaacaaactaattaatgccaatttgtttccagacaaatgggcaatgctaattattgtcaagatgagcaaaatgacttttttgtggtcttgtttggctggtccttaaaatttgctgaattatcctaaattttggcttcgtgggaaaaatgtgaaatttttagccattttcgccaaatttggaaaaacaaaggcaattacatcaacaaatgatcagccaacagcagcagcagcagcag

SEQ ID NO: 73282 - DNA, 3030 bp, Heterodera glycines
  Genomic contig location: Contig_ID=SeqID_10178; Location=291..3320; Strand=-
  SCN-specific regions: Sequence locations=1-413,436-1501,1523 -2095,2117-2469,2491-2924,2947-3030
atgcccccattaccgatggatcgagtgcggcgacgggtgccctttgaatcggtggggctcgattttctcggcccaacagccactcttgacgacagtagacaacgacagaaagcctgggtgcttctgatcacttgcttgaccacccgggcaatttacatcgacgcaacccgggatttgtcagcaaaaagcttcatcgctttactgaggaggttcattgctcgtcgcggagcaccaagccggattctgagcgacaatgcaccgacattcacgattgttggcaaaactttgggcgaatttggcataacgggagaccatccgctggaattcgcggactcccggggcattcaatggcgattcaccccgcagcatacaccatgggccggtggaatcttcgaacgggctgtgcaactcgttaagcgagcattgcagaagacactggggagctgtgtcctcgattacgaaggtttcagcacgcttttggctgaagttgaagcgacggtcaattctcgaccgatcacttatgtcaatggcaacccgggagaaccgctcccgctgcgaccgattgatctagttcaggagaatggtcggctcatagtgaatccaccgccgggatcctccgaaccgaacggccaacgacgcgaaccaccgcacgaacaactgacgagacaatggcggcactctcaacaacgacttgagcatttctggcggcgatggcaccgagagtacctcatggcactgcgagaaaaggcgggatggaatcacccgcagaaacgggtgaatgcacccggagcaccaagagtgggggacatcgttttggtggaggataaattccacccgcgcaatttgtgggcgatgggtcgcgtcgaggaactcaaaggatcaggcggccacgtccggagtgtgctgctcaaaatggcgaacggaagaatttggggaagacctgtgaataaaatttgccccattgaggcgggtcccgagacggaagaaagcgatcaacgagaggcgccggatcgtgatcccggcgaagcaaatgaagcggacggcgcagacaaggacaaaagggagagcaatactcccttcagcacggatgaacgaacgaaggaaagcacgcccgagcctgagcaaatgctgggggaagaaccgccagtgacgcagcggaacgaacaattgtcggagggtcgagcagtgcagggagatgaacgacgaaaatcacagcggaatcgcaagccacggagaatttggtcacctgagcatcggaaggtcgataaaagggggagcaaattccccctggtcgccttggcggtaatgatggcacttatctgcccaactttggcatgggggtgtcaacccaccccatcgctaccaccgttggaacaatcggacccggacatgcgcacgacgatgttgccgtgccacatggaatgcacgaaacgcggcgtgaagacaagcagcggtcggcggctacggaaagccgaaatttgctgcccagacggatgctgggcaactgtgccaacagcgacagtgatcagctacgaactaccggctgaggtactgattcatggctactcatgcagcggtcagtgttggtgggggtcgggcccccctttcaatgtcactcagcggtgcccagcgagagaggaatgtgaactcatcaactgctccttctgttgggagcagctcgccaacccaacgtgccacccgcggtgggcatccaccctcttcggttttggagcggcacttgtgctagccgttttcggctgctgttgctcattggtctcccgattctggtcgggagcaacgcttttctcccgagcaattgccttgggagtcagctaccccgtcaaattcatcaattgggcaaccggacgacggctcccacaaccaacagcggaacgaatcgagggcaaaatgcgaaagggagcaaaagttgcgcgggcagaaatacgggagttacagcggcgactccaactcggcagaagagctcgagcaatggcccaggcatggcagcatcccgaacggggccatggggccaggacgggagtagtggcggcttcacttctccctcttctgctcgtcttcggcaccacaatggctaccaagcccatctccgtaatggttcgatcggaggactgctcgagatcggcggaaggactgaaatgcgcgggaacagcggcgacagtgctaacactactgccatcggatcagacgaactcattcgtcattcgaacccaacaggacgagctgctcggagccgtccgacttcgcctcgcctcaatcacgatgatttgtgtgccaaaaacggaaagttggctgcgttcctactccatctcaacgacagccgtgaagcgatgtccatcggcaggatcgtgtcgcggaaacacgtgcagtgccattcgcaaccgggagacgattcccgaacttattgccctcaatcatcggcctgggcattcattctgtatgcgcagcaccagtttttggcagaattcgtgtgggctgccctcggcttcatgcctcttctaccgatgggctgcggtgccgacaacgaccacagtcttcgaggagttcacgtgtctcgaatgggacatgcagatcagcgcttgggtggaattggaaaccaacaacggccaaattgactcacaacgactgacgctacacccgggagtttcggagccgtggggaaacatgaccatctcagtcatacccacctctctcccgccaatgctggcactttcagcacatttcgtcaccgatggacgggctgtggccatggggagacccatgccgtcagacctgcactgccccgacgaagagacagcacggggtttcgacaaatgccaactctccattggggcgtgccaaaaatgcgcccccgatcacgacaatggcacggtacactgtcactgcagagacctcgacattggacgggtgttgaacaacccggaacaacgattgccattggacgtggcacgattgcaccttcacaatcacggctcttcgatccgagctgaatttcagtattcacccgttcag

SEQ ID NO: 73283 - DNA, 1401 bp, Heterodera glycines
  Genomic contig location: Contig_ID=SeqID_10178; Location=3856..5256; Strand=-
  SCN-specific regions: Sequence locations=1-193,215-1337,1359-1401
atgcttatccgttttcgggcatgccaagtgcccgtgattgccgatgtggagaaagcatttctgatggttggaatcgaagaagccgatcgagaagtgtgcaagtttttgtgggtgcgcgacccactcgggccgctaacgacggcaaatttggtgccctaccgatttcggcgattggcgttcggcttaacgcccagcccgttctgcttggctgcggtggtgcggcaccacctacgcaagtacggctcggattttgcggagcagctcatcagggacacatacgtcgacaatgtgctcataccggcggacacagtcgaagaagcatcgcaaaaggctcgggaagccaaacgaatgttcacggaagcgaaaatgaacctgcgcgagttcctgacaaatgatcaaaacctgaacagcagcttttcagaggcggacgccctgggcaaaacgacggcgaagatgctgggactcgaatgggacgcggagaaagactcaattcggatggtcttttcgggagtgactcccgccggtgccggaggccacagttcaaggcgggcggtgctaaagactattgcccgactgtttgacccactgggactgcttgcgccggcaactctcccagccaagcaattcttccaacgattgtgggagtcgacacacagctgggatgccccgctggacgcggacgatgcgcgagaatggaacagaattgtggcaagttgggacggggaattcatcactatccccagagtcgcccgagcggaaggggccgaatattgccagctgcacgtgttcaccgacgcatcggaaaacgcatatgccgctgcagcatatctccgatcagaaggagtggacgggagcattctctcccgcctcatcatggccaaatcccgacttaagccaaagaaggcttcgggaacgttcacaatcccaagaatggagctgatgggcctcgttttaggcgttcgactggcagcgtttgtcaagactcaattacacaggccaatttcagaagagcacatttggagcgattcgacgattgctctccactgggtgaagaaccggacaccccagccacagtttgttgccaaccggctggccgagatacgcaaatccacggacgcaacattccactacgtgccaacgagcaacaacccagcggactcggcaactcgggggctctcccccgcgcatttgcagcaattcgagttatggtggaaaggcccagtttggttagcgacttcctgcgcaacctggccacatgagctcgagttcaaagtggatgacgacgaagaggaagcaaccccagcggaggaactcaccagcgccacgctcgtagcccaaagggagggcactccctgtcaaaaggaagaatggcccaattcgctgcttaacccgctgcagtaa

SEQ ID NO: 73284 - DNA, 1185 bp, Heterodera glycines
  Genomic contig location: Contig_ID=SeqID_10180; Location=1630..2814; Strand=+
  SCN-specific regions: Sequence locations=1-598,620-827,853-853,888 -1154,1176-1185
atggtcatcgccttctctctgagttgggtttggagtgtgctgtacaatttgcttcgcgactacgagtgccttcccctgctcatctctcgccaagagttcttcttcggcattctcacccattgcatcgctatgagttccaccgtttggtccgtaagccatttcaatgccattgagtcgcttttgactcattaaaatggctaattgccccgttaattcgcaggaatccaattttatacgctttgctgaacctccaactccgcgccgccttcctccaactcattcctgaatgtgcaaaaaatgttctggtcgaattatgcgggagggaacagacgcagcaacaacagaggaattcggccgagaaaagcaggtgggccaagcgaagcatagactgagagagacattggattgatcagtcaagaaggaactgatcggatactgcgggatgatcaaggaatattgattggactgatcgggattgaggctgatcagccaagacgggactgatcggatacagcgggataatcaaggaatgatcaaaattagagctgatcagccaattatactagttgaactcattaaattacattaagcaatttaagattaaaacataaaggatttttggttactgtattaatttttttttcaattttttcagacttttggacataaataatggcataaaagaatctgaggaacggacaaagaaattgctgagctgtttcctcacttcgcgtggttcggtcgaagtgtcgacaagcagcgaatttggcaaaatgtcggagggaaaagcaaagacagcgcaaaacgcactcaaactgaagacagttcagcagaagaagaagacgaagaaggtaaaggaaagaaaagacgagaaaagaaaagaaaagtgattggaatttaaagggcacggaaaaaagaaaagatgaaaacaacggaagaggggacgaaacgaaatgggagggaagtgatcggcggaaaggggacgaagcggaaacgacagaaacggcacaatgggagggaagtgatcggcggaagggggaagaagcggaaacgacagaaacggcacaatgggagggaagtgatcggcggaagggggaagaagcggaggaagagaagcggcagcagggagacggacatggcacagcggcagacatcaaagagatggacatggacgaacagatctga

SEQ ID NO: 73285 - DNA, 1509 bp, Heterodera glycines
  Genomic contig location: Contig_ID=SeqID_10181; Location=434..1942; Strand=+
  SCN-specific regions: Sequence locations=1-19,42-241,263-619,641 -843,866-872,901-1276,1299-1509
  Gene Ontology: Mol. function=mannosyl-oligosaccharide 12-alpha -mannosidase activity; Cellular component=membrane fraction; Biological process=N-glycan processing
atgtttttgaataaagctcgcgatgttgctgacctgctcatgccgtcatttaatgccagccctttcgggattccgatgtctttaatcaatttgaggaccggtcgaacagggaattacggttgggcaagcggtggttgctcaattctgtccgagtttggctctttggaattggagttcaactatctgtccagactgaccggcaatctgacgtacatgtcaaaatgtgctcgagttcgggagtatgtcattgaactccaaaaaccggatggactttatccggttggaaaacaaaaatgtttaccactttcaaacaaaaaaactttactagaattatctcaaccctcaaactgggaaatggtgtcaaagtatgttggtcttacttttaaaacattttggcaattaatttttgcttccattaattgtaagaacatgtttcggtcggagcgcttggcgactctttctatgaatatttgctcaaaatttggtagactttacggctgtgcgtttttcttatttcattctgtttaggattttcaatgggaaaagagacgaccatttgaaagaagcgtatcggaatgccataaaagcgatagaagaaaagcttttacacaaatcaactcaaaataatttgtggtattttgcggaaatgaaaagcagccgaattgagcataaaatggaccatttggtaattatttgggcaattagtttccttatttccatttcaggcttgttttattgctggaatgttcgcacttcagtcgctccaagagaatgatgaaacaacgcgcgtgaacactttgaaattggcagaacaaattggacacacatgtcatgagtcataccgaaagacaggtgcattttaaattgcaacaaatcttttgaaaactttgttttcagtgactggcattggacccgaggcatttcgcttctcatcggacgccgaagcgcaagcgacgcgcatttccgaggcgtattatattctaagacccgaagctgtcgagggatggttttatctgtggcgggccaccggggatgagaagtatcgcgaatggtgttgggaagcagcgcaggccattgaacggcattgccgggtggaggcgggctattcgggaattcggaatgtcaacgcccagcaggtacagccgtttaacaaggaaaccacccgaactgtctagtaaagtgcctataaatttggtaccaatgggcaaagcagtttatggcgaaaatcaaaaagttatggggcctagctggacttaatccgaatggttcccttgcaaatataagcaaaaacctttttagattgaacatgacgatgttcaacaatcgttcttccttgccgagacgctcaaatatcttttcttgatattcagtgactcaacagaaattccactcgatcaatgggttttcaacacggtaattcagagtttagagaattcaaacaaacattatttcttattctaggaagctcatccttttccgattgcacattctgctcaacaagttcagtga

SEQ ID NO: 73286 - DNA, 1063 bp, Heterodera glycines
  Genomic contig location: Contig_ID=SeqID_10181; Location=2562..3624; Strand=-
  SCN-specific regions: Sequence locations=1-92,114-157,182-560,582-1063
  Gene Ontology: Mol. function=protein degradation tagging activity; Biological process=endocytosis
atgttcaaatctgttggagatgtgttttcaaaaatcgcctttccgatggatgagaatgatcgttggttggttttttaacatggattctgaaatttctgctttcttccttatatgccatttccgtatttgcaggtttgagcaagtgcatagtcaggtggatgagttggaggagatgctgacccgtcttcaaacgcacgtcgattcgttggtcactcatcgcagggatttggcattcagcgatgatcagtcaagcaaagcattgtccatgttggcatcgtgcgaggagaacacagtgttggcacgaattctatcaaaattagcggagacccacgagaatttggccatagtggagaagcatgaagcggaacaggacgcacagcaattggaggaagtcgtcaatgtgagggggaagtcggtctggctgtttccgtgtcaaggggggcggggtggtcgacgcctaactctacgaaggggaccaagccatgtaaatcagataaaaacttatcgggattgggaggcccgacgttgcctgtaggcgccgccgggaaacttttatggaattttttaatgaatttattagcgacccccacctcctccccttaaaaaggtccggcatttttttcccacgaattgcaaatttttcaattactattaaattttcatacatttttttatataggagcatctccagctcctctcggtgcttaaagaagttttctacgaacgcgtgaagggttggcaaaactggcagaatcagcagcaaactttgacgcgaaagcgcgaaacgaaggcgcgtctgtgagttgtggcgtttattaaatttatgctatttttactcaatttcaaagggacttaaccggtaaaactgacaaagcggctcagtgcagagaggagctgaaagagtgtgagaacaaagcggaccaaatggagaaagactttctggtgatgagcaaagtgattcgcgaggagtacagccgactgttcaagcagcgtagagaggacattaaggcaaattgggggatggggcggaatggagggaaaaatgaataattgaacaaataaa

SEQ ID NO: 73287 - DNA, 1336 bp, Heterodera glycines
  Genomic contig location: Contig_ID=SeqID_10182; Location=836..2171; Strand=+
  SCN-specific regions: Sequence locations=1-75,99-1161,1183-1336
  Gene Ontology: Cellular component=cytoplasm
atgggcattcttggcttaccgaatgttgggaaatcgacgttcttcaatgtactcacaaaatcggaagcccaggcggaaaatttccccttctgcaccatagacccaaatgagagtcgagtggctgttgaagacacccgattcgattggctggtggagcactacaaaccgttgagcagagtgccagcctatttgaccgttgttgacatcgccggactggtcaaaggtggatgaagctttttcactattctcatgagcatttcaaattcaggcgcatctgaaggccaaggacttggcaattcatgtaatatttgattgattgtcgtccttcactttcgttgctcatttaatttttttagtcctttcccacgtcggcgcttgcgacgccctcttccatttgtgtcggtcctttgaagacactgaagtgacccatgttgaaggtgtgccaaaaaatcaccagaacatttattgaataattttaggtgacgtggacccaatccgtgacttggaaattatcaacagtgagttgcggttgaaagaccaggcatatttggtgggagcgttggacaaagtggagaaattggctgtccgggccaatgacaaaacgaagaagttggagcacgacactttgttgaaggtcaaagagttgctggagacaaagtttgtacggcaacacgaatggaatgagaaggtgagacagaaaggggcgaaatttggaagaattttggcaaagtttaggaaattgaagtgctcaacaaacaccttttcctcaccgcaaagccaatcgtttatcttgtgaatttgagcgaacaagacttcatcaaaaaggtaggacagccaacccaaccaagttttgttcggttagcccgaaatataaccaaaaacattttcagaagaacaaatggcttccgaaaatcaaagcgtggatcgatgagaatgacccgggcgctgtgagtaaacaaaattctaaactcccattccgtaaatggccctttacaggtattaatccccttttcgggtgcctttgagttgaagtcggttgaactggaccccgaggcgagggcccaattcttcaaagatacgggtgcttgcagcgcacttgacaagatcattaagactggctacaagaccctttgcctcgagtatttcttcacgtgagtaagcccttcaatttccaaaacaattaatcatttgtcaaattgaagagccggcaaagacgaagtcagagcatggaccatccaaaaagggaccaaagcgccgcagggggctggacgaattcataccgattttgagaagggattcataatggtgataatataaagggaatgatggttggata

SEQ ID NO: 73288 - DNA, 1200 bp, Heterodera glycines
  Genomic contig location: Contig_ID=SeqID_1401; Location=551..1750; Strand=-
  SCN-specific regions: Sequence locations=1-16,38-61,84-273,303 -303,325-574,596-888,911-1200
atggtcgcatgtttcaattcaatcaatcaatcatttatacgcaaaagcgtgacgccgaaaaataaagaaataataatgtcaaaacaatcaattggtcacttttggagttggggtggcaaagaaatcaacaaattaagatcagatctttcaagaagtttggcaaactcatttggatttagtaatctcgtctctttaggtaaaagtctatagagacgagaggttcgaataaagaacgaattgtatctagcattggttgagcaataagctgttcttatagtgtattcattttttacagggtttttggaaaaagaaaaggattcattattttgtaaatttattttacctaaaattatttcatgaaaaagttttaagtctatttttaacctacgactctcaagcgacttttgatcataaatgtttaacaattcagcataattaggtaaatcagcagcataattgttacgtctaaatattactctcaaaaaaattttttggacattctccagtttttcaatatccttttttaaataaggattgaaaattggagatccaaattctaaaattggtctgcaataaatattaaacaaatttacaagtattttcgtatcacgagttttgattgactttagtatagcgaaagcagaacgtaatgcttttttcgagataatgtcaatatgttctgcccatttcaaatcattagtaaaataaatgccaaggtctctgactggttcgtttccgggatttttaggaatttgaaagtcatcaataaaataatttattttttggtttttgtgtcctaaatgtaaagttaaacatttatttgaagcgattttaaggccgtttaatttacagtattgattaaatttgttaataaaattttggagtggagaaaaggaaatatttgaaagaacatgataggccttaagatcatcggcaaatagtttaattttaacattttcagtttcgcagaattttggtaaatcgtaaatgtaaataagaaataacagtggtcccaatattgagccttgcggcacaccactgagacagggatattcgtcagagaaatcagacccgattttgacgaaaaactttcggttttctgagtaattctgaatccattttaataaggaattatttataccaatgttttggagcttagatattagccggttatgtggaaccgtgtcaaatcaaaataaa

SEQ ID NO: 73289 - DNA, 1104 bp, Heterodera glycines
  Genomic contig location: Contig_ID=SeqID_1401; Location=534..1637; Strand=+
  SCN-specific regions: Sequence locations=1-307,330-622,644-893,915 -915,945-1104
aaaatcaattgatgtaatttattttgatttgacacggttccacataaccggctaatatctaagctccaaaacattggtataaataattccttattaaaatggattcagaattactcagaaaaccgaaagtttttcgtcaaaatcgggtctgatttctctgacgaatatccctgtctcagtggtgtgccgcaaggctcaatattgggaccactgttatttcttatttacatttacgatttaccaaaattctgcgaaactgaaaatgttaaaattaaactatttgccgatgatcttaaggcctatcatgttctttcaaatatttccttttctccactccaaaattttattaacaaatttaatcaatactgtaaattaaacggccttaaaatcgcttcaaataaatgtttaactttacatttaggacacaaaaaccaaaaaataaattattttattgatgactttcaaattcctaaaaatcccggaaacgaaccagtcagagaccttggcatttattttactaatgatttgaaatgggcagaacatattgacattatctcgaaaaaagcattacgttctgctttcgctatactaaagtcaatcaaaactcgtgatacgaaaatacttgtaaatttgtttaatatttattgcagaccaattttagaatttggatctccaattttcaatccttatttaaaaaaggatattgaaaaactggagaatgtccaaaaaatttttttgagagtaatatttagacgtaacaattatgctgctgatttacctaattatgctgaattgttaaacatttatgatcaaaagtcgcttgagagtcgtaggttaaaaatagacttaaaactttttcatgaaataattttaggtaaaataaatttacaaaataatgaatccttttctttttccaaaaaccctgtaaaaaatgaatacactataagaacagcttattgctcaaccaatgctagatacaattcgttctttattcgaacctctcgtctctatagacttttacctaaagagacgagattactaaatccaaatgagtttgccaaacttcttgaaagatctgatcttaatttgttgatttctttgcca

SEQ ID NO: 73290 - DNA, 871 bp, Heterodera glycines
  Genomic contig location: Contig_ID=SeqID_1401; Location=2430..3300; Strand=+
  SCN-specific regions: Sequence locations=1-18,179-432,460-566,590 -684,706-830,852-871
atggcaatatcaggaagtacaacgacaatggcaacaacaacgacgacgacaagcagcacaacaaaaacaacaatagcaaaattggctacaacaatggcaatgccacaaacagaaatgccaacaacgacaatgacgtcaacggaaatgccaacaacagaaatgccaacaacgacaacaaaaggcatgggccagcaatgtcaggttggctgctgactgttggacaattttattttcgaatctcttttttctgtttgaatcttgaaaaataatttatgtccttcctttatgttttggctttttctggctttcatttttgttttcgactttagccttttccacttttgccggttcgtcgcgaggatataaattcgcgggcgatagcacaaattgcgggaacagctgcaaacaatgcatgtaaagcataaaaataatatgaatgaattaattaattaactaattgcttattccctccctcccttcggcagtttcgctttcactgcgatgcatcggccgttcgccaaactcggcactcattctaacggtacttattctttttaatcattttgtgattttaaattttgaaatttatattcacagtattttgggccaaatggtgccgacattgacagtgtattcggcacaggacaaatcagtgccgtgctcagttgtacaacggcgggtcaatgggcagtgggaaatgtgacaaatatcgtcgaattggaatgcatttcaggataaaaacacaatcatttaacaaaatataatcctgaattattttattatttgaaaacgaatggtaaaaagaagagtttacgttgttaatgaatttgagtttgtattttaaaacaattggcatagaaataattttaaa

SEQ ID NO: 73291 - DNA, 701 bp, Heterodera glycines
  Genomic contig location: Contig_ID=SeqID_1401; Location=3351..4051; Strand=+
  SCN-specific regions: Sequence locations=1-308,352-379,401-618,640-701
atgcctaaaatttctacgcacttaatacgcacagataagcacgaaaaacgcgttttccgcttggtatggggtgtctacaatgacttttgcaatgcctaactttgcctattttggactttttgtgcttaatgcctaaatgcctatttttgtgcctatttcgcaatttttggcgccttttttaggattttcgaaaaaatccttaacaaaaatgcaataaaaacaaaaaatacaccctaagaaatggcctgaaaatttttttagaaaaacacccctgagaattggaaaaattttcctaaaaattaatcgccaaaatttaatatattttttcttaataaaaatttttgttttaaagatttgtcacttattcgaaaaaactttcaaatatttaataatttcatttacaattgaatttttatgtttttatgtgttttgctacctaaaaagtgttaataaaaaattttatttgcctatttttgtgcctatttaatgcctattttgtgattttttctgcctttttaggtgtctatttcgcgattttttgtgcctaaaaatggagtccctaattataatcaatcaaacgcaattggatggattccgttgagagttgcgattcatccctaaaattttattaaatttttacgtcgtctgcttttttgaattcaatcgccctctcccaagcatttgtttatcctgctttgcta

SEQ ID NO: 73292 - DNA, 1781 bp, Heterodera glycines
  Genomic contig location: Contig_ID=SeqID_1401; Location=4206..5986; Strand=+
  SCN-specific regions: Sequence locations=1-261,306-450,522-890,912 -956,1012-1121,1146-1179,1202-1638,1660-1736,1776-1781
atgccttccgatacggccatttacgtgccgttgttaaaagaattcccaacgcgaccaccgtactattatcggaccccaatgtcactgatgtaccgtattactgtgacgacattttccaaattacaaaattgcgccggttttttgaccggcattttgtttggactgattttggctgcttcggttgtgcattttgtggacaattttgaccattttgtactgatgcccaaaatgtcgaaggagctcaaagagttcagagaacaatttaggaaaattgaaaaaacatataaatacacatataaaagtaagagaaaagaggtggaaaatgaacaatcaaaagcaaacaaaaataccaaaacagagaatggaactgttgccgttgaacttgctaagaaagtgcgcgttttctgttggatattcacttacgaaaaattccacgagagtcgcgccaggtaattaattaattaggattaattaaatcattcattaataaattcattaatgaataattaatttatttattatgactgattaatggaagcaccgcccaattcaatttaacctcctttgtgcccttaaggcatgtccgtgccacgtgggcccagcactgcacccgctatttgttcttctcctcaaaggatgacccgactttgccggcgattgacgtcggaatgccattgggcagaaaatacatttggcgcaggacgcgatggattttaaaatatatttacgacaattttatggtaattaaaccatttgagtttaatttgtctttcttaagagcattccttttttccagaatgacttcgattgggtttttcggattgacgacgatgcttatgtgatcatggaaaatctgaggttgatgcttctgccccattcgccggacgaactgatttattttgggcacaaattgcatacaaccattttcaaggaccacttgttcccgcagggttagcaattttaaaattaattgaaaataaattgaaaatgattgatttttatatttaaattgtataatgattgattttcaaatatcttttaaggaggcgctggatatgtgctgagcagaagtactttgaaattgcttgtggaaaggggcctcaatgacagcacaaaatgttgggatggagatgactctgaggaagatcaggttgactgaatgaccgtcacaatttttcaaatattaattacaatttaattagtttgttgctgtctgtttggaaaggttgggagtgaaatttggcgattcgcgcgattcacaaggccggcacagatttttcggcgattttatcggcaaaaatttaccaccgataacgctgtgggatccatcttattattggatacaaaatttgacgtattatcccatgccgcaggtgatcattaaatgttattttcaattgctgctttttattcctttttttcgaattttctgcctttttagggacccgaatattgcagtgactacgccatttccttccattacactgatgcgcgaatgctttatctgcttgaatatttcatttaccatttcgatgcttacggcgcgcgaacattggccacagatcgaccaaattatttcgaagaagcgatgcgaaaggcatttgataatgttgggccgggcgacattttgagcaagtaaagagaaggaaaaggcgggaatatttcaaaaattggaaaatgggccggtaaatcatcaaaatgccaaaataagtagagaaacggataaccttttttcgataaattgaaattgcatcaaaaatggtgaacataaattttacaaa

SEQ ID NO: 73293 - DNA, 302 bp, Heterodera glycines
  Genomic contig location: Contig_ID=SeqID_1401; Location=6690..6991; Strand=+
  SCN-specific regions: Sequence locations=1-302
atgccgtcaaaagtcacagtccgtggaccaaccacaaggaaattgttggtgttcacaacaattgcggcattcagctcaagcgctgggttgggttggctaaaaaagcacagacaaacaaacaaaacaaaaaaagctaatttcagcaaaaagacaaataattacgagcaattagccgtcactcttgaccggcaaacgttgctgtcatagacaaaggtcagaacgccatcggcaaatgcggttgaaggtgacaatgtctggttcagaggaggacaacaacctgcatttaaacacttgcaattcaa

SEQ ID NO: 73294 - DNA, 3388 bp, Heterodera glycines
  Genomic contig location: Contig_ID=SeqID_1402; Location=4936..8323; Strand=+
  SCN-specific regions: Sequence locations=1-95,124-134,156-662,691 -788,811-1209,1240-1431,1453-1456,1478-1934,1965-1978,2000-2127,2149 -2203,2225-2249,2295-2301,2323-2569,2628-2707,2734-2987,3031 -3115,3138-3388
atgtccacacttggatcggcggcgacatggtcagttagttagttgttggttgaacgtaaaattcatagtatcaaaatggcacgaatagacaatcatgtgcaattttattatattttttagagcggtttgcccacggcacctcaagaccccatctttttcatgcaccactgctacatggactacgtacgtgcttaatttcaattaaatttacttgcttttcaaaaaagtttatcgacttatagttttagatttgggaacagtggcgcctgagatggcaaacgcgtgcccagcgcgagacgcaatttccatctgatcagcaagttgttgcggtgagtggccgtaaactgctaacaaattgctcttattattaccttaattaacctcccgactgcgtaaggcgttttacttttttactgtattttacagtgttccggttcaacaagctaccgtatcggcgaggtaatgcgtccattccaagacccggtggtgctaaatcgaggtcggtcataattgacagtgattagtctgatcaatcacactgcttttggcgtttagccggccttagcaacgattacaccgactttctgtacacttacgcccctcggccgacttgtcgcgcagcggggggatgcggatcgccgtcagtatccaaattcaaaaacattatctatttaataataaaaattcttaagctatttgttttgcgacacaacaaaacggactccgttgtgcgtctccaaaatacggcccgggggcaattgctcaccattcacacgaaacagtgggtgtttatttgatagaattgccaaatgactgctgataactgactgttgaacaattgtgcagctgaacaaccgtgctaccagtcaacgtgtaccaacggacggtgttccgcggcacgaccgagggtattgagaagaggaattaaatgcaaaattagccattatatggacaaaacataattttaatgtgccatgtaaggcaatatcataatgctttatcaaaaaatcacacttgacaggtggcgcgctccaaagactcatcatcgccagaagtggcggaacacagcggcgaaaaggccgaacgtggcgcaccacgaaaagcatacggacacagtagcgaaaggggcggacaaagtgccgaaaagcgcggacaaagtggcgaacagcgcggacaaagtggcgaaaagcgcggacaaagtggcgaaaagggcggacaaagtggcgaaaaggcaggcggcaacaaacgaaaaggatacggatacggcggcaatgttagtgaataagacgggttgtcaaacacctcctaagtaaatttgcagaattctccaacaacggcggaaccaccgaaaccgacgacagtgccagcggacgaatacacaactttggcaccgatggtagggccaaaaagggacaattaccaatgaatgccttaattaaagcaattaaagcacacattttaaatttaaatgcttttctcagtacacaccgccaaaagaacgtgtctgctacgataatcacgagtgctgcgcagtgtgggccaccaaaggcgcgtgtaaaagtgcgccccgttacatgaacacgtggtgtccaggcgcttgccgctacgatggatgtcttccgcaggcggtgaaacgcgcggcaggtgggtcattaatggattttgttggctgaccaattagtgaagcctattatggataaatgaaaaattaatgagttaaggccttgactattattctcaatgcaagcgttggtccattttccatgaaaaatactcccacgccgaggggtggcgttcgtacagaccgaacttggtgttacgaagggagaagttgcgcaacgaatgtgagcgcaacccgcattggatggcatgcaactgtccgcaggcttgcagcaaagtgaagcgcctaaaggaggactgcaggtggcacttggaaatggcattggcattttgatggcattttgtttaattaacctaatttagccaaaacatgccaaaggattatgtgctggaaccagtggacaatagttgataaaattgccttggttgtgatgatgatgccgcttaagcaaatgattttttatcgtagataaccgattattaaaacatatagttatttaattgaagaatactaaaagtaaatttaaatgctggaaattgttttgaaaattattggtaaaatattaatttggacatcaattcattttagaaagatttatttattggaaggtgaaactaaaaaagttagcaaaaaaaatatttttataattttctaaaaattgatatttaattatccgtaatttaaatttcttttttgcttttgcattggcacaaaatttgatcggaaaaaatgaagaaaaccatcggattaaaatcatttttctccctctgtgataatctttcggtttggcgtctaattattttaaattatctctaatggacaaacaacagtcattggtggtcactggcagtgacagatggagtcattcacctcaaacactgagctaatcacaacaatttgctatttaaccaccaaattttaataagtccgtccctcccttattattgctattataatacatttttttattaattaaaatttaagaaaattatttatttattaaattcattatgttcattaaacgtggccatttttttgcgatattttttctcacaacttttagtatatcaaaagcaatgtttatggtaaaaaaattataataaattttaattgaaaattcgacaaaatttttttaaagcccttcaaagtgtccgttcgtttgttggtgtacgataatgcaaacgatattttttgggacttaagcaaggggacattgcacgaggaaagtgtgccaacactgatcagaagtgccgaaattgaaattggaaatgatcggacgacagtccgtgaaattgtggaaaaagtggcgaacgaattttgcaagcaacagcagcaggtgattaaggatcgagaaccattaaataccaattaaacaatttttatgaaattttgtttattaaatttataatgtatcgatttatccttaattatttgcaaaaaaaaacagctgttggatgaggagggagacgaaaagccttatcggataatgacgatttttgaggacaaacaattgaacatgcaaattcagcgggagatggacgccgagccaaacactgaatacaccgccattttattgctcaaaaatgggcaaaaggattcagtgggtaaataaattgcaccttttatttttcaacaatttagtggcttttctgaagaattggaaataatgaagagattaagtgaaagacgatcgaatttttgaaaagaaaaaactcaaaatccgatgaaatattattaataatcaccgaaatatgagtattttaaaca

SEQ ID NO: 73295 - DNA, 750 bp, Heterodera glycines
  Genomic contig location: Contig_ID=SeqID_1403; Location=36..785; Strand=-
  SCN-specific regions: Sequence locations=1-271,293-339,361-578,600-750
atgcatcaatcgcttgctttcaaaattattgccattttggctggcattttggcattgttcgggcccatcgattgtcgcgcaacccatggcacgtgtgtccaccaaggcagacaataccgagagggcgaggaatgggtgagtttggcatataattcaaataaagcaaataaataggggccaaaatttggaaaattttgcgtaattaactggtataatttgaaatcctttctttaaaaaaacagattgtcaaccgtttgttcattatgcgctgctttgtattttacaattacaatcggtgggagacgcgggtaagaaaaattggaaaaatgagagcaatttgacactaatgattattaattaccccttttgaggtggtcggatgcctttcgctacgaggcgaccgaatccctttgaatggccaaattagggacagccaaggcatttggaagtgtgtgagggatgcgaagggcagcaccaaattggtgcagcaacagggatgagaagaacggagagagggacaatgccgggggggggggcaaacagagtgccaaacccacgaaatgacggagtacaaaaagacattgtgccaaattcaaaaaaggtgccggaggatagaaacaaagtgccaacagcatttttagatgccatttgctgctgcttataaaacaattatcatgaacatttacagtacaaggcttaaagtttctttcttttgcctaatgtgcttttgatttttttttacataataaa

SEQ ID NO: 73296 - DNA, 344 bp, Heterodera glycines
  Genomic contig location: Contig_ID=SeqID_1404; Location=44..387; Strand=-
  SCN-specific regions: Sequence locations=1-99,124-344
atggactgggtgaaattttcttgcaacacgacggaaacccagcgaaattcacccgctgcaaacatcgcaaagggtcagtgaaccaatggcattttatgctttttaaatgccaaattcccattaatttttcagatgaaaaatgtttggttgagttcatcgacaaattcgctgctgcgaacaattcgtatgtgacctgggaacaggtggtcgcattctgctcaaatattcacgaggggttgcaacggatggcattggacacgattatcaccagactgacggcaaatctaaccaaattaacgcggcaaatggaggcactgcgagaagaggcgccgccaagggacaaa

SEQ ID NO: 73297 - DNA, 1165 bp, Heterodera glycines
  Genomic contig location: Contig_ID=SeqID_10184; Location=49..1213; Strand=+
  SCN-specific regions: Sequence locations=1-554,577-750,772-786,808 -872,894-1140
ccaccaacattccaatcaacgggactcaatccacctgcatttcaaatcactgggactcaatccaccaacattccaatcaacgggactcaatccaccagcatttcaatcattgggactcaacccaccaacattccaatcactgggactcaattcttctgcatttcaatcactggtactcaacccaccaacatttcaatcattgggactcaacccactaacattccaatcattgggactcaattcttctgcatttcaaacactgggactcaatccaccaacattccaatcaacgggactcaatccaccagcatttcaatcattgggactcaacccaccaacattccaatcactgggtttaatcactgggactcaacccagcaacattccaatcaacgggactcaattcaccagaatttcaatcactgggactcaattctcccgaattcatatcactggactcaatctcatcaatccttcagcaacacaattaccgggactcagttctccgacatttcaatcatcggaactcaacctcagcaacggaatacagaactatttaaaaggaatccagaaattgaaatataacccataaatcaaaacactatggtgtataattattgcccccaccccataaattcaaattaaaactgacctgtttaaaactttccacctaaatttgatcccgcaagtggcacgtcaatatcccaattgcatataaatattccactcgaacacaggcaaaacatgagatgtagcatttatattgctttttctatccatcaaaggctttttctttcattttttattactatcataacatgctttttattcaaaacaaatatcaaaaccaaatcagattcttttcatattataagcaaggaaaagtacaaaaaacttttttaagtaacaaacctttttcattcaaacgaattctaatgcatttttttaaccaaacaattctccattatcgtttacataagcaaaacaaaagctttcacatcaaaatcaaatcaattaacaaaaacgaaaatttagacaaaaaaataatgataacagcaaacccacaaattttttcttacacacaaaaacagaaccttcatataccggattttccactcaaacaaacacaaaaatgtgctcattattttattaattattttatata

SEQ ID NO: 73298 - DNA, 234 bp, Heterodera glycines
  Genomic contig location: Contig_ID=SeqID_10184; Location=1686..1919; Strand=+
  SCN-specific regions: Sequence locations=1-54,86-234
atgaagaaaatgaacgaggcaagtcgaagtggatcaaaattagtgagtttcattttaaacattttatttttaattgttcttatatgaatgctcaaaagggtaatactgcagaatagcggtcccgacgaaaaatatttttatctttcgtggggtaaaaattgtactgattacgaatctgaactcaaactttgaaaatcattgatttttatcacatagattttttcaaaagtttta

SEQ ID NO: 73299 - DNA, 226 bp, Heterodera glycines
  Genomic contig location: Contig_ID=SeqID_10186; Location=1251..1476; Strand=+
  SCN-specific regions: Sequence locations=1-46,91-164,204-226
atgggggtctgggtgagaaaagagaagggaattggtgagggatcagaaatttttgataaaaataaattaaattatttattttcatttatagcatctgtgcatctgcataagtggtcaagtggctaaactttataataatttttctaaaatctctttacattgtgaatttattttatttttattgaaaatatgtttattattttcgaatgagctccagtagaaagta

SEQ ID NO: 73300 - DNA, 639 bp, Heterodera glycines
  Genomic contig location: Contig_ID=SeqID_10186; Location=1981..2619; Strand=+
  SCN-specific regions: Sequence locations=1-187,210-611,633-639
atggatcaaagaatttggtcttcaaaaaacgcaaaatcctataaatcaaaaactgatgaagaaaaaattgaaattgtcaaaaaatttattgaactgacaaacgaatataagcaaaaaagaaaatattcgcacatcgaatggcaacaaaattatgccgaaatttgtaagaaagtcggagttagccatagaacaattaaaaattggaagaaacaatttggaattagcagtaaattaacggagaaagaaaaaatggagaaaatgaaaaaatattggcaaataaaaatagaaaatccgaaaatgagtgagaaagaaattgcaaaaatattgaaaattgatagaaaaagcattacaaattggaagaaacaattagttttgaaatgaataaatgacccaattctttcttttttttattaagaccaagaatttgttttgttgagtgttagagaggcaaataattcaaatatttgcaattccctctcttgggctctttgaccccatattgattttccccatttattcatgcccttcccttcatccatcccacaattcattctgttaattttccttccttttgtgtgctccccaatttgctccgtccctccgacaaatattatttgtattatttttccatttgtgtta

SEQ ID NO: 73301 - DNA, 1090 bp, Heterodera glycines
  Genomic contig location: Contig_ID=SeqID_10187; Location=146..1235; Strand=+
  SCN-specific regions: Sequence locations=1-46,91-114,136-177,273 -456,494-532,559-940,963-1025,1071-1090
atgggggtctgggtgagaaaagagaagggaattggtgagggatcagaaatttttgataaaaataaattaaattatttattttcatttataggatgtgttcatctgcataagtggtcaagtggctaaaccttttactttcattatttgtctcttcggttcaattccccgatggaacagaaaatttttttatattttctttaccattattttaattgaatttaattaataaaaaatattttaatttaaaattattatttttttcatttttaatagcctaaaaacccataaactaaccaaatatttggtcattttttgacaaattctgttaaaaaatctcgctcaaaatttcaaaatttttccggcggtgcctatcggcactgccggactccgccccctcccactgttccaaaaaatttttttgaaaaaacattgccacaaaaacagcgatttaaaagcaaaaaatttaaaagattgtaaatttatttaaaaaatacagaattttgggactcagaaaattccaagaacccccctgaaaacaaaatttttaaaaattttcctcgaactcgtcccccaaaacgtaaatacaaaattttatgggtacatttttgaatattggcaattttcgtaacaaagcgcacttaaattttcaatttttttcaaaaaaaaaatttcacttgggaaaagtcccggttggtccccgggttttttcgcggtccgtcccggtcccgacgaaaatcgatgtcccagtcccggtcccgacttttctagtcccggcaagtcccggtcccggtttttgtcaaatttcccggtcccgctcaactctatatttataaaatttcgctcgtcaaattattacattagtaattttttttgcaattaataatttttatcaagctttatcattgagaaatatgaaattgcatttatttgcatttttatttttaattgttgaaattacaaaagttggaacaaaagagaaaaagctgcaacaaaagtcatttgccgaaatatttggagaaaaatggaagaaaaagaagaaaaagaaagaaatgagaagaaaaaaagagaaataatcagaaaattttataaa

SEQ ID NO: 73302 - DNA, 397 bp, Heterodera glycines
  Genomic contig location: Contig_ID=SeqID_10187; Location=1427..1823; Strand=+
  SCN-specific regions: Sequence locations=1-397
atggcaaaggaatataagcaaaaaagaaaatattcacgaaaagaatggaaccaaaattataaagaaatttgtaagaaaattggagtaagccgtgaaacacttagaaaatggaagaaacaatttggcatacgcagtataaaattaacggaaaaagaaaaaatggaaaaaatgaaaatttattggcaaacaaaaaaagaaaacccaaaaatgactgacaaagaaattgcaaaaattgtgaacacttctcaacagaatatttccaattggaaaaaacaatttgtggctgaataaaatcattcgatttttagaattaacatgaaaacttttttgataaattttataaaatcatttaggtttgctgtttttttcaaatgtcgtaaatataccgaattattaa

SEQ ID NO: 73303 - DNA, 699 bp, Heterodera glycines
  Genomic contig location: Contig_ID=SeqID_10191; Location=650..1348; Strand=+
  SCN-specific regions: Sequence locations=1-190,224-417,439-480,515 -543,592-648,670-699
atgtggcacattccctttccctcccaattccgaattccaattcccaacgccagcacgaccaccgcgctcggccgcgctactggtagcaccggatggttcacttttgtgaacttttcatcaacctgggcggaacaggaacagcgaaagggaggtgagtttgagtgagggacattgaggaggcgcctggtgtgaaggaaaaggagaagaagaaaaacgcttcggcgatttaaatgccccggggatgaaaaatgaaaataaaaggcactaaatatgagagaaatgtataattgttgcctgcagatgtactaattgccgatgacagcacaaaataaaaagcaaaaagtgccaataaaaaaattttagaatttttcctatccaaatgaagatttttgaagattttctgcgtttcaatgaggatttataaaattttaagacaaaagctccggttacgattatttaacaaggaggcactggtgaatgattttaaaatttaattataaaatgtttattaattcacaagaaaatccgccgtaaaaaacatgctttttattttattcaaaattttttatatattttttttctaaataatttgtagatagatttattatatggacagtcggaaatcataacaatgatggttcgttactaagaaaaaattatttacaatagaagcaaattcagcgtatccaattgagaaaa

SEQ ID NO: 73304 - DNA, 312 bp, Heterodera glycines
  Genomic contig location: Contig_ID=SeqID_10191; Location=1465..1776; Strand=-
  SCN-specific regions: Sequence locations=1-109,131-312
atgtcaaatgaatacaaacaaaaaggaaaatattcgccaaatgaatggtaccaaaattatgcagaaatttgtaagaaaatcggagttggctatgacacaattagaaaatggaagatacaatttggaattagctgtaaacgaataacgaagaaagaaaaaatggaaaaaatgaaaaaatattggaaaataaaaagagaaaacccaaaaatgagtgacaaagaaactgctaaaatattgcaaattgatagaaggaccatttcaaaatggaagaaacagtttggaggagagattttggaggatttaaatggatga

SEQ ID NO: 73305 - DNA, 1285 bp, Heterodera glycines
  Genomic contig location: Contig_ID=SeqID_10194; Location=576..1860; Strand=-
  SCN-specific regions: Sequence locations=1-223,246-276,298-458,480 -756,799-851,962-1285
atggacatggaaatgcgactgttaaaattggaacaggaaaatgtgagaaaaattcctaaaaaataaatcatttaaacttgggacaaaaatatgaaccttgggtttttcggggtcactgatcacaaatcgggcacccatttcgacccattccgagtccctgacacattaataacaaaaattgaaaactcaaattttcgattttcacatttggtaactcgaaaatgtgagaaaattgttcatgaattcctcgaaatttgaaaagagctaaaaaaagcaacacaatttctttcctttttacagcgggcaatcaaagcgaaactgaaagagcaaaaggcggacaacaaattggcgttggaacatcagaagaatgagtttgagcttcgcatggtgaagatggaagctgggctcaatgagcgattaatgaagatggaaggcgaacatgtaagtttaaatttaacaaaaatcacatttaaatttgaaaaattaaattcatttcataaattccgttcctaaaataattcaaaggcacttaaaaacagaaaattcccttttacagcaagcattccaagcgagactggtcattgaaaagctgacaatggagaaccatcagttaagaatggaggaagcgaaaaaattgccattacaatttaaatattgatgatgagagtgattgaatagtggaaaaagtgtcttttttcatcgcttttttattattaagcagggctcggattttttaactaatacgcgaaaatatcgatttttaaagttttgtttatttctaatatttaaaatttaaatctgaattttttattccaaataacagcaaattttgccaaaagttttgcgccctgtttattgtttttaactttttatcataattttaatttgttttttccattttattatgaatttgttatttatttaattctcttttttgtttctttaattttttttaatcttaaacatttaattgtgtttaagtaaattttttttgtcttcagttttaatgattagtgaacggggggggggtaattaagggagttaaaaagttatgattagggcttcgatttatagttttttcactatttttttcctgagctccccgtagcctgaaatgcaagaaaaacatgtttttttcggctgttgttaagctacttttcgagtttttagcaactattttctagttttttatttttagcaactaaaaaactttaaaatttttgaaaaaactattttcaactattttggcgttttgcccaaaatttgttaacaaaaatgcaataaa

SEQ ID NO: 73306 - DNA, 1929 bp, Heterodera glycines
  Genomic contig location: Contig_ID=SeqID_10196; Location=2434..4362; Strand=+
  SCN-specific regions: Sequence locations=1-113,135-319,343-401,464 -522,544-705,728-728,756-952,1013-1173,1230-1434,1478-1619,1679 -1775,1797-1896,1923-1929
atgtggtgccattggatggccaacggaaaaggattattgatacaacggtgggcggtatttgctaattatcagagggtaattaggaattgatttgctaattgtcgccattttcctttccagccctttgactttctgtgtccctattccattttctgtgccgtcggctgtcagtgctgccaaatcaaccacgcagatgaccacctcttctcaatgccaatgctcgagtttctgctatgaaaattggtatcgtgcgcaggccccaaacctaaaaaaattccggagggaagatgaagatttttttttgctcttcggtcttgaaattttttctcttatttaattttaatatgtccagctattttcttccccattctcctgattcctgaattttttgagtctttgtctatatatatttttttaaattaaatatttctaataattcaaaaattacttttaaataaaatttgcataaattgccaaattcctaaattaaaatttaaattttgttgcattttcaggagccgtacattcctttcatggagaaagcatgccgtctctgtggctcggctgtcactatgctgtttttcatctttttggtcattgctttactgttcgacatcattgtgtaccgaatgtttttgattcgagtttttatgccagcacattttcaatgcctttttcgagattgcttatccgtaagtaaaatcaattcaatttcaaatgaatttagcaattttattttatttttaaataaaaatggaattagtcacaattaaaatcaatatgaaattgaactgttattaaccagggttcttgaccgaaacccacgtttaaaaaaacctggattttttcacgacccgaaattttttttgaacgtcactatccaaaccccatcttccacaattcctgacctgaatttcaattcgggaatattttacttacatcccgataaatcaaaaattatgaattataaatttttatgtttatttaaaatttaaatttttttaattttaaagaatgctttcctattgggttcgacgatggtgctttaaaaattccagcgacaaagaaacaaaaatgcgaacggatttgcaaagaacggcgtcaaacaattaaatgtatcaacccgaacatcaaactcagattatatgtgcagctgggtgggtggtggaagagaatttttcaaattttttaataaaacttaaattatttttattttttatattaaatttgcctaaaaaaattacatgttttcatgttcctaaaattagaagccctggggggtttaatttatattccatatgactcattttaaatgttttgaggtaatacaacttggctttgtcaccttgtttgttgccgctttcccattagcacctttgtttgcgctgatcaacaacatcctgggtcttgaaaattcgaattcctatggccgtcaaaaaattttaaattttacaaaaattcttaattaaaattaattcagaaattacatggtttccttcaaatttactttttcatttactaaccctatctaatgattgcttgatttcttttgatggtttttccactaattttttcaatgtttttatttatttaaagattactcaacaccttttcaatagaaattttatttttaaataaatataaatttttatttttaattaaaaaaaaaattttttttcaagacttctttgtcatttcccgcaatacaatcggaagcccagcagatgcccaactccgtcgctgctactccttgcgcccacaacccgttcaacaacaatcacttcccacaatcagatgcagaaaagtacaacaacaaacagtgttgaagtgcttcagaaaaatgagcgatgacaaaattttgctgtggttttgatggtcgacaaaaattccgaatgcttttttattttttaatttatttatttgatcgga

SEQ ID NO: 73307 - DNA, 906 bp, Heterodera glycines
  Genomic contig location: Contig_ID=SeqID_10196; Location=1418..2323; Strand=+
  SCN-specific regions: Sequence locations=1-6,50-132,165-247,269 -371,393-416,438-676,698-906
atgacgaacagcaactacaacaacaacaattgcgatgacaacaaacaacgcgataattcacgttcatcccccaacgacacgcacaaaaagtgagaaataaataaaatgagaattttttcaattgtctaacttaagtttttctattaaaaatattaaatttgtttcaacactaaaaaaaatttttttccaattttttattttcaagaaatccaagaaaatttcaagggaacattgaaaattttttcagcagttgtttctctgctccgtctgagtgcccatttcttagccggtcttcatgcgttggaacggctctgacaactttccatggatgccaatgccatcggcggaggggcgaaagacaacgcaaagggcggagagacggcagacgccgaggcaaatttgttttaaaacttaaatttagttgtttattttttgtttcttcagctccctctgcgcagtgcttccctcgaaaaattggatctttcatccaatgccttgcgcagagtgccgaccaaattggtggcccattaattgcattccctcaaagttttgagtttggcggcgatttcaaccgaacggatggaaccgaaattaatggccaatttcagcgcattgaaacaggcaaaattaggtaatggacgttgaatggacaaaccaattatgtaatttggccattttcagttggacttttcccaaaatttcttccgttttttgccctttggaattttcgatggactcgacgaattgcaagctctgctcggattggcctcccttcaatgggtcaatgtcagtaaaaatgcaatgggaaaagagtaaatctaaatgaaaattcagttggaatggtgcccaattcttgccgaagctgaacagatcgaaattgaggcgaacggaaacgaaatgttctaa

SEQ ID NO: 73308 - DNA, 481 bp, Heterodera glycines
  Genomic contig location: Contig_ID=SeqID_10196; Location=4809..5289; Strand=-
  SCN-specific regions: Sequence locations=1-159,206-291,332-481
atgttcactaaaaacgtgaaatacaattcattttttggtttttacacaataaaacgtgaagttgcgattaggtaattttctgtgtttttatacactaaaaacgtgaaattacaattttgtgggtctaaaacgatttaacttttacgtgtatttgtacacgagaaaacatgaaatttaaaattacaattcatttttgggtacaatttcacttttacgtgcacatgttcactaaaaacgtgaaatacaattcattgtacgggatttctcacaaagttttgcaggtaaagaatgaaaaaaataaatacactaaaaaaataaatatatttatttagctccaaatatcatgaaataatgaaaaatgaatttccttgtgtcaaatttttgctgtgctcaaataatcataaaccgccggtcgttgttgtatccgtgtcataatattatgaattaagaatttagtttttttagcaaaattatgaataaa

SEQ ID NO: 73309 - DNA, 1750 bp, Heterodera glycines
  Genomic contig location: Contig_ID=SeqID_10197; Location=817..2566; Strand=+
  SCN-specific regions: Sequence locations=1-50,127-271,313-474,497 -604,631-668,698-830,875-1196,1230-1341,1486-1750
atggcctcgattaacaccagctcaactgatccggtaacaaaacgaaaaacattttaaatttaaaataaaagaaattattatattccaatatattaattaattccagttaaatttttattttaataactgttttcagttttatttggcctaccgtttcgccggtccatccgccgatttgattgtgccggccgttgcactcaatttggttgcgttggttggcattgtgttgaacggcacagttttggtggtcactgtcaaatccaagtaaatcattttttaattaatttaaattttaatatttaaatttattttcagttccctccgcggctccgccaattttctgatggctttgatttgtctttgtgaattggtccaccaaattgggcacactttcttcctggttgttgtcatttcgggcacaaattttgtcagtttactcactgctgacttaattatgacggtaaattttgaaagttaaaaattatttttaaatattccaatttttagccaatgctatttgcatcaaattgtggcttaatggcaatgttttgtgctgcttttgatcgcctttttgccgttgcattgccatttaagtaagggaacgaattaaaaaatattttatttaattaacatccacaaaacactaattaaacctaattaattctttctatttaaaactttaattatttaatttttagacattcctccatttttgcacattacaaattcacatatttgcttggacatctgttaatttgtgtaatttacggtgcatttacactgaattatgtgctcgcttatgcattcgaaaatgcgggaaagtatggcgcaattataattaaaaataaattaattataaaattttaaatttattcagtccaaccaccggtgttgtggccgaaactttgctgggccccgttggttataaattcttcgccggcacattcattatttcattttgtagcacttgttgttatgtgtcaatttttgtaattatccgatgcaaaaatggcggtaattttttattggcattttgccaaaattaaaaaataaaccgaaatttttttacagtaacccaacagacgaacacacgagttttacggtcattggtcatcattttgtccattaacattggcgggtatctgaccaatttggccatgtatcagttgctgtatgcatttggctcaattttggggtattttaaattaattttatttaatttaaattttccaattttcctaaggcccccaattcgtgcatggcaatttggttttatttctggcatttttttaaatgctgctgcgggatcaaatgctgtcgtcctttattttaacaggtcagtataataaataataaataactaattttaatgaattttaattaatatatctctatttcaattttaataattatttattgaataatttatcattttaaaattttaattatatattcatcatttaatatattaaagaatatttttaagctctgaatatcgccgcgtgttcaagaaagcatttcgagcgttgaagggttattttggcaacaaaaatggtatttttaattaatgtttatttttattgtcaatatctagaagtagaacgtttttagctgtccacgccattggcacaatccaagtgcgaagtgccaacccaatcaataacataaacatgcgatcaagccaacagataaatgcgcaatccatccaattgaatcgcttctcgattcgattcattttattatttgtaaa

SEQ ID NO: 73310 - DNA, 203 bp, Heterodera glycines
  Genomic contig location: Contig_ID=SeqID_10197; Location=3169..3371; Strand=+
  SCN-specific regions: Sequence locations=1-9,31-203
ttttattgcatttttgttaaggaattttccaaaaaatgccgaaatagtgaaaaaatagtgacaaaacgccaaaatagtgaattttcactattttagtgacgaactcgccaaaatagtgatttctagtgacgaaaagtgacgtccaaatgaaaaaattttaacgcagaaatgcgttttttgagctcctttcttcaaaacaattg

SEQ ID NO: 73311 - DNA, 1125 bp, Heterodera glycines
  Genomic contig location: Contig_ID=SeqID_10198; Location=93..1217; Strand=+
  SCN-specific regions: Sequence locations=1-314,337-805,827-1125
  Gene Ontology: Cellular component=integral to membrane
cccctggggcgtcaatcccgttccgatcactgctgacaatgtggccgaaagggctcaacttttggctgatcagtaccgtaagaaggcccaactgtacggtcacaacacacttctggtgccactcggcgatgactttaggtggtcatttaccacaaattggcacatattccatgactttttgtcttttcagatttgacgaggacagcgaatggaccgaccaatatgccaattacaaattgctttttgagtttatgaacgccaaaaaggagtggaaaattaacgtgagaaattagagaggaggcaaagggtccacgtgtttaattttgactcttaaaaggcgcgctttggcactctcggcgattacttcgatgcgttggagcgtcgtttggtggaaaaacaggcggacgacctgcgacgtaaaggcattgttcggcacagcgttaagaaaccagaaaatcggtaaggaaaggtcgttttaaagctttaattccgggggataattttcttcgtttatttttgatgccgttttttgtcatcccatttgtgccgtcctccccccaatcgtgccatttcaattgtccatttgagtggtgccctttctgctgattcgccctcttctgccgcttcgttgtcgcttttgccgcttctgtccggcgactttttcacctacgcggaccgtgacgaccactattggagcggcttcttcacctcacggcccttctacaaacatatggaccgaacgttgcagcatttgctgcgagcggccgacattttctacacaatggcacgatgggagagcaaagggaacagtgaaaagggagaggaggacggaggtatgagaagggggggggcagattggcactttgtgaggagggcacttgaccaacaattcggtcatggatctattatcctgcaattagttaactgtaagattcgaagaacttttttgaaaccaatgaaatttttcgaaattttgaaggataatagagaacaattagagctatcaaatggtatcaaatttgttagatttgtacaactatcacagaaattataccccagcaactttcccaacaggcgacttcgacttgcttttcgacccattggttcgggctcggagggcactga

SEQ ID NO: 73312 - DNA, 468 bp, Heterodera glycines
  Genomic contig location: Contig_ID=SeqID_10199; Location=83..550; Strand=+
  SCN-specific regions: Sequence locations=1-60,83-468
ggcgtggaggacaatttgttgacggagagtcgcttccatcttctgctcgagcacttcgaccgcttctcctcccctcctccgtcttcttccgccgaggggacaatcgcttttcattcattggccgcccaccattcgtcacttcgtctccattatccgcccatttcactcgccggacaaatggacgacgccaaaggtggacaagtggcacttcaaacagagacaatttgacaaaattcagagtttaaagcccgtcgtccatttgggtccgtccttcgccattccttcccctgcaactttcacccggtgactctgcgaacgcttagccatccgacggtctactcgcccaattcctcctccacgcggccccgggacgaagcggcgctaattttgcaccgattcggcatcgaatgtcgcctgggcacgtcgttgggggagagcagttgcccggcaggaatggcaacggcagaa

SEQ ID NO: 73313 - DNA, 1171 bp, Heterodera glycines
  Genomic contig location: Contig_ID=SeqID_1405; Location=544..1714; Strand=-
  SCN-specific regions: Sequence locations=1-457,482-954,976-1171
atgaccttttgtcaggcactctcatgcgcccgtacaatttctgcttgtcttggctcccatctccatttgattctgccgccaattctgtccgtattggacgaccgcaaaacggaggaaaaagtgcgtacgtcggcactggacactttgcttgagttggcccgtcgacattccatcgaggactacgctttgcccgtcatgcaaacatggcttcgttgcattggcatcaagtctcaacagccgcgactgatggagttactcggcatcatcgtcagagtccgtcttcatttaagctttttggcggaaaaagttcatttccccttcattttcagaaatggactcagttttctgtgtacaaagagaatgtaaatgccgccttggtgcggtgtcgtgtcgaaccaatgctgtgccatgagtaccaggaacagttggcacttctccaggcgccttcatacgcacgccaacagcagcagcaacaacagaatgccattggcagtggtggaggcgtttaccaacaacaacagggcacattcagtgccagcacttcatcaccattattcgcgcgtcaagtgtcttttttaccaccaccgccgacgcaaaacggcggggcgacaacggacacttcgcccttgcccgacgcacacaacggaattgtcgggtttttacccgggcccggcggaagcagtgcggacatgtctcgagtgcacagaatgtcttcgggtaaggcgaacaggaaaatgccgggacgaatggttgggtttaggccgtgatctttcccgcttggccatcaatttggaccaattgcgtcgcttttggacggtccaaccactgctctcgcgtgaggattggcttcagtgggttggcactttgcgcaaccaattcatccgtcagagtccgtcgtccgcacttcgcgcctgcgctgtgttggccgaaatgtgcgagtcactctcaaagtcgttcttttttccccttacttttctatttttaatgaaataatttacagggaattattcaatgccgcttttatgtccgtttggactgaactgccggagcgggaacagaacgaactgaccaatcagctgatcgatgtgttgaggcactgcccccatgccgaacccattcagaccatactgaatttggccgaattcatggaccattctgagaaggcaataaa

SEQ ID NO: 73314 - DNA, 92 bp, Heterodera glycines
  Genomic contig location: Contig_ID=SeqID_1406; Location=936..1027; Strand=-
  SCN-specific regions: Sequence locations=1-92
attttacacggcgcttcaattttgggctccaagtacaattaagttggatttttcgtcttagggtctgtgagttagtcaacaaaaaggggtct

SEQ ID NO: 73315 - DNA, 4274 bp, Heterodera glycines
  Genomic contig location: Contig_ID=SeqID_1406; Location=698..4971; Strand=+
  SCN-specific regions: Sequence locations=1-68,90-469,507-791,813 -1119,1142-1445,1468-1546,1568-2010,2034-2180,2203-2354,2378 -3495,3518-3636,3659-3847,3871-4097,4121-4237,4259-4274
  Gene Ontology: Mol. function=protein binding
gtcgaccgttttccgtcgatgtactttaatgaagtgcaaaatgatagtcgacaaatgaaaatggttgcatatttatacagaaagaaaaatcgaaatgtcaaaatcgaaggaagttcaaatttcaccgaacactttttgaaaatttgtttgtgcacgtttgttttttctttagtataaaggcgactcaactcaactcgcattatcatttctcgactttgttaaattcaaaacgctttttagacccctttttgttgactaactcacagaccctaagacgaaaaatccaacttaattgtacttggagcccaaaattgaagcgccgtgtaaaatttaacaaattcggacgattttccctaaagcctcattttgaaaatttagcctcattgatctatcaaaaaaccacaaaatgaggctaaaacctcagatctgggccctgatataggtacctaatcacagccctattaatgaagataagattttgtgtgttttttaatcttttgaaacttattatttcaattcgaaattctcaacccattattttaattttgttttcctttaattaatcatatttctatttccttttctgtgttattatgcaaaattcgctaccttcgccaatgcttgcacccattccaataattgagcccgcaactgtcactgttccgcccaatgaagacgttgtgggctcagatgctgagaatcagcaaagagaagaggaactcctggtcaatgaatttgtcatcaattcggaagcgatcaagcgcatattggacgacccgcgctacgctgacaaaaaggtccacaatattttcaattaaagtgactctgacttaatggaattttttcattaataatttatccaaacttttttttacaaattttggtaaaatgtcgatgagctctatttttcggcaaaaaaatcattaaaaaggtgaaaactatatggctaaacacaaacatagcatttattttagccctattccgaatttcacttcttaaaattggaacaaatgccgaaaatatttatttacggataactcgataaatacaatctcaaattggctgtgattcggaacaggccaaatgaatgtcacatttgtcttttttgccatataaaagtaaccatttgttttccttttaggtgtgtgtagtcagcgtggcgggcgccttccgcaccggaaaatcgtttattttaaacttttttctgcgttatttgcgttggcactcagcacctgttgctgacagaacaggagattggttggaaatggaactgacgttggggggattcagttggcgaggcggtgacgaccgggacaccaacggtattctgatttggccagagccgttcctactcgaagaccgcaacggagagcaggttttggcaggatggggttggatttggagaaacagcacacccaaaatttaattcccgagaaattcattggtctatgtatctatgtatttattcggatgatttttcaggtcgctgtcctcctcatggacacacaaggcattttcgacagtgtcagcactttcaaaaattgcgccaccgttttcgcgttgtccacgatggtttcctctgttcaggttttaaactgaaaaaaaaattttcgagtcaaatttaagggattccatccgttttttcattcatttgcttcccagattttcaacatcaacaagaccatccaggaggaccatctgcagcacttgcaactgttcacagagtacgcccgactggcgctggacgagtacaacaacagcaatccgttccaggcaatgctctttcagctggttgaccatttcgctaatttcagtcgcttttgttccttgtccgtgactggagtttcccttatgacgcggagtacggccaaatcggtggccaacgcattcttgacaaacgattggaggtactcaatttgactagtatataaaatcggatgcgtaaacggatgtactacatccccaggatcagttcccccgtattttattcacggcttgtcgatggatttgttaaaaaatatgtttaattttgccaggttacgccccgacaacacccggaacttcagcagctgcgccatcacattcgctcgtccttcgacaacattggctgctttttgctgcctcaccccggcctcgacgttgccacaaatccacacttccgaggcgaacttgacagtgtgtttgtttgctctttttgtgtgtccactgaattcaaagcatttcggttttccctttaggaatggaactcgacttcaaggcacagctccgttcgctggtgccccatctgttctaccccaacaatttggtcgtcaaacaaattggcggtcagcccatcacttgccgagagcttgccgtctacataaatgtgctctttttgcgttgaattcaaatatttaagttcaaatttttaggcttatttcgaggtgttcagcaaggctgaactgcccgagccgaagacaattctaaatgtaagcattttgatgctttccctccttatgaatgccaattgcttttatttttattaggccaccgctgaagccaatcatctcgcggccgtggtgagcgcaaaagcggtgtatatgagggagatggaagaagtgagttttttgactgattgttggggcgaatgataccgaaaagcaaatttttttgagatggcattgggtacacggcatacatggaaaaaagggtcgaccctattccctctttttcatgtacggttggcagggttccattcaataaacagaccaaacccagaaacattcacacgactcttcccaccccactcattcgaactttaaccaattcagtcgtgcggtggcgacgcgccctttatgagcggcgcggaactgcgaagcgagcacgcgcggtgcagggcggaggcgatgcgcaccttccaaacggcgaagaaaatgggcggtcccgagttggcggagcaattcgcacaaaaattggagcaggacatcacggtgggctttcaaattcttccattgaaatattaaattgctgaaagttatgatatttttgttaattcgctttctgtgcttttcaggaggcatttgaatcgtttgagcgcgttaacaactccaaaaatttgttcaaatcaatgcgtacgcccgccgtgctcgtcgcttcgatgattgccctttactgctgttcgttttgctttccctgggccattgtttgtgttcaaaattattctcaccaattaatgcaatgtttcaaattggtattttggaaggcccgtaaccaaaaaagatttgataagactttgtatgaggcaaaatcggctactttttttcctttatttttttgctcttcgcctgtaaaaattatcattgtcaatgttagtttaaccgaagaaaaaatgcattattatctcagttaattgatttaatgcaaaaaatttgacaaatttttaggtttttgtcccacccctatgctcattttccaggccaagaatttttccaactgctcggcctcgacaccatcgcctccattttctccctcttccacatgctgatttttgtcgcgcttggcatttggacatattcacgctacagcggccaattccgccatgcccaagtgttcatcgacggacgggtgcacgcgttgttgcacaatgtgttggcgcgggcctttttcaaggccttcaaggccgctggtcgcttggcgctgaacatgacggtgattagccatattttgttttcttatattctctgaaccgttttttaggcgaaacgcaataataatttgaagcgaaaatgaacggacggcgaaagcgggtcaaagcaacgaaacttatttggaccgaccgtaacaatttatttgatgctcatttatcccataaataattgttggttgattctttcgttcgaatatatgtttgtttttgtgaggcaatttcgactaatacaaccaaatttaaaaatttgaataacttatttttcgacaaatttaaatttaagcctttttttatcacaattaacaacattcaatatatacaaacaaaactgggatttgttagaattacaaaatgtgagtgttcttttgcgtgacttattaaatgcgaagatgaaagggattgaaatgatgtgaaattaaacaataaattggaattattcattggaaaagagagttgccgccttccccaattccgctcgcgtccaacagattggccatgatgcgcgacatggtcgcttttctggagttcgtcgcgacggaggacgagctgttcgccgccgccccagccgctgcatttaaaattgcgctcg

SEQ ID NO: 73316 - DNA, 1394 bp, Heterodera glycines
  Genomic contig location: Contig_ID=SeqID_1406; Location=5148..6541; Strand=-
  SCN-specific regions: Sequence locations=1-116,139-321,345-479,501 -591,613-760,783-1041,1065-1394
atggccaccgttttgcggtcgtccgctgaactctccgtcgagtcgattgtcgctttgttcaattgttacgtccattcggtaaatttttcactttgcgtttttcctatcgctcattcctctccattttgtttttctcttcagattttcacatttttttgctcggattttgatgcacaacaacaacagcaaatgttcggcaccaatttcgtcacttttcgcctccgccaatttgtgcaatcaatcgaaaagaaaatgaatggcccgggggcgacagagggtgggcaagacagtgtggaaaatgcggaggtgacagacacacagaaacaaaccaattattacaaatatggcacatgccaacgttttagctttcgttgttttgccgtcggtcgtcgctttgccacgcgttggacagaaacgactcggacaaattgtttttgctcgtcgaaagaattgttggcgttgagtcagtgtatgttttcctttctgttcttttgatttttatgcatcaaaatttggatgctttccgcagtgttttcctcgccaaacaaatggaattgcttcggcctttcctcgaggcgcttttgccaaaaagcggcggaggcagcgacagcaatttgtccttggactccttctatcgtgtttgtttgatttaaacgtttatactagagctcgattggacctggacccaatcctggggttttcctggacctggttttttgcccaagtccaacattgaatccaggtccaggcccattttatgccacaaatttgttttttcccccatatgcattttaccccattttcagtcccttgcggcggtgttcgatttgggcgacgcttcgtttggctgtgtggcggccaaaattatactctttcagtcaattctgaagcaaatttcggcgaccgattggacaaccggggaaatccattcgcaacattcgccttatgtggacacaattgtccaagtgaatggggaaaacagaggggggggggtgaatattggccaaaagcaaaggaaaaaatggccaaaataacaattgtcagccttttccataaggtgttttactggtgttcctttttaggaatgttcgcaattcaaacaaaagttcgtccgccttttcccctacgttcacatttccgacgaattgtacgccgccatttggtccatgcttttgctgtgcattttccgtattttggtccaggggtacgcggacgcccaatttgtttcagtggcaccattgacaaaaacgtaattttttaggtacgccgacgtaaaaaagtgcagcattgagggaagagcactgcaactgttggatgtcgagcaattatgtggggaattggaggagatcaccggactgaggcaatttcacaatcatccctttattttattgtaa

SEQ ID NO: 73317 - DNA, 436 bp, Heterodera glycines
  Genomic contig location: Contig_ID=SeqID_1407; Location=623..1058; Strand=-
  SCN-specific regions: Sequence locations=1-137,159-373,395-436
atggaggaagttaaaatgtttttggagagcgaaacgttcactctttgcccggtgcccgtccaattcacactgtttgaccttccggtgagaaagaattggtcgtttttaagtcaatgattgacacttttgacggggttttccctaggttttcccaatggattgcattttaaaaaatgcttttcaaatttaggaatttttcttcctcaaagagttgcaacagaaacagcaaaatgatgaacaaacggaggaagagactgaacagaactcagtggagacatttgtccacggcaaatccatccgtttttcggtgtttcgacattcttcggaaatggacacggaaatattcccttattcgcctgaacaattcgacgaaagtgtgaggagaaaggcacaaaaaatggacatgaaaaacttttttgcgaagagaaagcattaa

SEQ ID NO: 73318 - DNA, 1354 bp, Heterodera glycines
  Genomic contig location: Contig_ID=SeqID_10200; Location=841..2194; Strand=+
  SCN-specific regions: Sequence locations=1-913,935-1354
atgacaccgcccattggtgcttggcctttacagggcgccccggtgtttagaataccccaaacatttccaccaagagcacttggaactaatcagcaattctcgcaaccgtatgacaatatttgtttaattggtattgttttaatttctcactggttttagaacaaatcaagcaatggcaaattacccttttatgctttcggcatctgttcctcttcctcaaacgcagactttccctctgccaaatgctttgccatttgccatgaattctaatggcggttctttaacatatccaacccaaatgaattacgcgcaaatgcctgcgcctgcacagaacactcattctgaacaagttccaaagaagaaaaaaaatacttcaaaaaagcaaacgaagtagtaagaaaaaggcttgagtcatgatgagttagtttcgatcttttgacaaatgctatgagaaggaaacgaattttagggcaaaagccgagaatgttttaggccgctttagcactgtttcaatgagccgagcttatagttcaatccactcaaatttattataagcccaaaaaatgcgtttccttaatgatttatcattcatttgtgtaattttttcattcttttttagatcattttcttaacgtatgtaaatttttctctttgtctacagatgaaacttcggcttcgaaaagttcggtcttcggcttagggtaaactaggcgaaattaggttatatgacaattttggtccggtcaattgttgcctgttggaagccagacattgcggccgcggtcggccattgcattgatttcatgagagccactttcggacatttgcgctcgatttcataagggctactgatgtgactgagtcctagaccttttggctaaatggtatatgactcagtcacaacaaaaaggaactttgtttttgtctctgaactgagcacgtagccacaaacgaattcacaaaatatgccccaccctaatgatggggatcttgactcgatttttcggtgtcgaaatccgattacgcacctacttcctcccctttacacaccctactctgtgcttatcggcaccacaatgctgccatggcggccttgtagacattgctgacctatttcgcgatttttcttacataaaaaagaatgccctaattatgatatatttatatatattatgcaatatacatagaaatacatgtacaaaagataaactaatttatatttttttatttcgcgggatttctttgacgcggcgggatttcgatgcagcgggattttgacagcgcgacagactcaacattttcaaatgctttggcattttttcttggaatatgcttaaatgataatttatcatta

SEQ ID NO: 73319 - DNA, 720 bp, Heterodera glycines
  Genomic contig location: Contig_ID=SeqID_10201; Location=316..1035; Strand=-
  SCN-specific regions: Sequence locations=1-12,36-418,441-720
atggcggccaacgaatttcttgagaccgggaaaatgcttctcgacgaactcccaggaaacaaacaggcggagaataaatctgatgatggacttaaaccacaaaaagcgaatggaaaggcattggaggcgaaaagtgacaattttcagcaaaaagcctttgagtttttgtgtggaatcgaaatgaaagcaaaaaatgatgagaaaggaaatgacaaaacaaagaaagatgacaatttgttagcttttaaagaattagaagaaaagcgactcaatttttgtcaaaattggaaaaatggcaaaagcatttggaaaggatggaaagaggcagggatttcaatagtaacatcagtgaacaatttgaaactgaatcagcaaatatacggagaaagtcttcgaacattggcgaaaatggaaattttcaacagcaaaaacaaagaagaatttggaaattttgcgaaattaggcattgatttactaaagaaagtaactgaaattcttaaaggtaaccaattaagttattctaaacaaagaattttattccaaatggggtaattaaacatttaattgaagatgcgagaattagttcactggctctggctgatcagtctgatcatgaccaacggaaaggcaacaacacatcacgacgaaggaaaagggcttttcatgggatttttcgccgagagtttagcttggaaaagtgttttctgtacttgctgttga

SEQ ID NO: 73320 - DNA, 1768 bp, Heterodera glycines
  Genomic contig location: Contig_ID=SeqID_10202; Location=54..1821; Strand=-
  SCN-specific regions: Sequence locations=1-117,141-148,170-349,372 -382,408-577,604-806,829-932,972-1178,1210-1249,1271-1344,1366 -1665,1695-1768
atgagtccattgtccttttcgtcaagtgtttccatggggagaatgaacaacagcagcaggtaaacgaagcaaacactaaatgccgggtgtgcattaaaaaatgccaaatatgcccataaaatatgcattaaaaactgtcaaaaatggcttttaaccctcaaaaaagccagtacttgtgtaaaaattcagaattgactttaaaaaggtcgataaatacaaaactataatatataatgacaattaatggacttaaaataaattccggctaaaaatgtgtttttcgtattttgtacattaatttgataaaatccttcttttctaatagctctaaaatttcaaaaacatcgaaaaattttttgaggttccaaaaatgagggaattgaaataataaataattaaaaataataccaaaggctgtacaaacaacgacggaggacattgctgaaattaaagcagatccgtccccaaattgttgggatgccaccgcgtgtcacagtgacatcgaaatctctgattgcggtcatttgactgccgaatatacgggacaaaatttacacggtaggattactgtaattcatttgtttttaaacaaatcacatttttgtcaaaaggttggcgttcggtgttcgcaaaacagccagtgttgctgggcagtgactcttccggcattttttatttcgaaatttccatcataaaaaagaaacagtgagtgtcatataactagggcccggatttgtatggatttccatatttttttttgcacatttatttcggcctaaaaaccacgtaaatccccatattttggtattttcactaaaaattccaaaaatacaccccctaaagatagaaatttttggaaaatatgcccctaaaatcgaaaaatttcggaaaaataacaaaaaatgtgcaaaaaaatttcatgcaacttttgctttaaaaaatattttttacaaaaaaaattactaatttttgcttttttttactaattttcagaaaattttttgtccatattttcatgtttttttctttcaacgtttttgtccatgtttcgtctatattttgctatttttcatccatattatataatccatatgttggatttttttgtccatataaatctggatcactttaaattcattgaattttctctatttttgcttattggcaccgcagtgtttaaatttcaatattttttaaaaattctctaaatttgctaatttttggacaatctattatcaaaaaatgaccaaatttttaaaccccattttttcttaattaaaatgcctaacgttgaattgtcgcgtttcatcgccccaaaatatttcttttgaattttgataattaaaaattttgattttcaaaatctcagattttttgaattcaaaatccgattgcgtgcatttcctttttattttaatttcaatttttcacaattttcagctgggctaccatcggaatttgccccaaacagtcgagcgaattgggagaacgaatttgcaatcggaccggcacttatgcatacgaaagcgatggcactttttggcttagtggctcattgaaaataagaaacgccgaatatatttatggtgccgatgatgttgttgggtttggcgttgacttggccaacctgaaactgattttcacaaagaatggccaacatttgggttttaaatttttgaaaattttatattttacaacgcttaaacaccatccatttgttcgcttcgtcttccgatcaccaattatttcctttcgattctttgaatag

SEQ ID NO: 73321 - DNA, 751 bp, Heterodera glycines
  Genomic contig location: Contig_ID=SeqID_10202; Location=2336..3086; Strand=-
  SCN-specific regions: Sequence locations=1-34,82-345,370-468,491-751
atgaaagagtgagaacttttttgccaattaatccaaatatatatatattttttgcatatttttgtttttttttaaatttaagttgggcaaccattggattcgcccccaaacgaaatgccaaattggacgaacgaatttacagtcgcatcgacacttacgcatacgaaagcggaggcactttttggatttcgcgaaaacggcaaaatccatatgaatttttcgggaatggagacgtggtcggatgtggcatctattcagagaaacggcagatttttttcacaaaaaatggacaacttttgggtgcgtaaagtgcgaaattaaaatggaaacgctaaaatttgccagaaaatttctttgttttttaaaagattttccgtggggggaaaataatgaatccattttaatgtgctttttggatgttttaggcctttttttaattttccatatcatttattttccgttaattattgttttttacagaaactcccgactttttcattcccccttctgataatgatgatgattacgatgataatccgctgtttccatttgtcacattgtctaaatttggcgccaaaattgaggccaactttgggccggaattcaaattcgatttggacactttaaaggtgaaaacagcgcaaagaattttttcatatcgtaccgtaaactgcaaaaagtacaacaagtgtccgtttttctggtgtacggtattggactgaaagggcggcgaattgccaaaaaaattaaa

SEQ ID NO: 73322 - DNA, 588 bp, Heterodera glycines
  Genomic contig location: Contig_ID=SeqID_10202; Location=3339..3926; Strand=-
  SCN-specific regions: Sequence locations=1-69,91-411,445-588
atgaatttaaaatttcatgttttcaaatcagcacaaaattgttgggatgcaaatgcgtgccacgacgacctcacaatcactggcccaaagtgtttggcggtcattttcaaggaatttggaaatggtaattttatcagacaattaccaaaattatcaattcttaaaatgaattaaaaaaaacaattcaaaatttggactgaattaatcacatcgagtcaaaaaaggagagatcaacgaattgagagagagagagagggggagcagagaaaaatactaatcacctctcattttggagaactatttctttatctctgttaattgagaaaaattgaatacattccgatatgcattggatattccgaaaaattccccattttttgaaaatctttcaggggtcataaaaaattgtccaataaaaataattatttttttttaattaaattacttctcattgttcaaatattttaaattcaaactttgttttttcagaaaagcattgttttagtcaattaaacaattgagtttttgagtaattaatgtcttccgaaaaatgagtaatttctaatgtcaaaaatttagtgaaataaa

SEQ ID NO: 73323 - DNA, 1296 bp, Heterodera glycines
  Genomic contig location: Contig_ID=SeqID_10203; Location=34..1329; Strand=+
  SCN-specific regions: Sequence locations=1-191,215-352,375-555,659 -685,933-1013,1045-1108,1141-1151,1176-1257,1284-1296
atgcttgatttgatggataacgagcaaaattatggtccgaaaaatcttccggtgacatttcgactcgaccccccgagatttttgggcggaccggtaaattggacaccaaatttctcacttaaaaaatttgtttacagaaaaaatccataaattagggctaggcctagcgcttaggcttgcttggtttaggctttatttagtataaattttatatccaacagtgtcaatttatcgggaaccgttttggggtgcacccgtcccccacctcattgaggtgccccgctgataggagggcagcgtcaaattgtcatcaaattgttcgggaatggtactgtagaaaaaaaaaagaaatttgggattttccgggattttttaaatttttgttcgacttcatttcgaccgactcgccgcccccaagcaaatcgtccggccgacaaattcgcaaatttttttgccaatcgctgctgctgctgcctccgtgcgccgaaccggtggaatccatgcggcgcaactgaaaatttccaaaattttagcttaaatatactcaaaaatggcaaataaattattaagaaatttaaaaaatattaaatttattaaaaattcgtaaaaataattgtttattttataaatcatataattaaatatttattttatttttgttttttgctggatttaagcgcagcggaaaatttttcaatattttaaataaaaatataccaaaaattgaaaatagaaaataaattaaaaagaatttaaaaatatattaatttattaaaattccctaaaaagaaattaaaaaattatttattttttatataattaataattcaatattttaatatttttcttaatttaaattgattattttattaattcttaaataaaattattttttctgactaaaaataaaataaatttttaaataataattacagtagacaaacacagtacagtatgcttttcaaaatgattacagtgaaattcctccggaatgttcttcgggcaaagttgccgacagctcctcctccccctccgccaccatatgatggcttatgatgactttcactctcatcatcctcctcatggtccgaagcggcttcctgtggagaaaaattgaaaaatattaaatttttttattttggaaaaggcactaattaattaattaaatttttaatgacaattttcagtaaaatgatttttgaaatttaaagtggaattaattagaatttattgaaaaaggcgcccatttttgttttgttttttttattttaaatatttaaattcccaaactttgga

SEQ ID NO: 73324 - DNA, 4847 bp, Heterodera glycines
  misc_feature (1209)..(1209): n is a, c, g, or t
  Genomic contig location: Contig_ID=SeqID_10203; Location=1008..5854; Strand=-
  SCN-specific regions: Sequence locations=1-249,271-526,548-772,796 -825,847-1193,1221-1372,1394-1429,1639-1770,1808-1832,1867-1919,2064 -2149,2171-2252,2327-2376,2464-2543,2619-2636,2658-2672,2694 -2745,2790-2913,2946-2947,...
  SCN-specific regions: Sequence locations=...3062-3114,3169-3313,3383 -3478,3502-3642,3750-3925,3971-4074,4286-4303,4335-4444,4488 -4538,4565-4646,4671-4681,4714-4777,4809-4847
catttttatgcccaaaagtacggacccagtgtaagcagcaatataaacagaacgccaactcacgcaacaaaaacagcaacgccaaaataattgttgccaaaagaacgccaatttcaaatttgttaccgtttcccattggcgctgtacttttgctaacaatcagcactcaattctatatcaatttttgtgccgcgaattcaatcgcaatgccaatcggctccggtgaaggtgatgatgaccgaggcaacaaaatcaccaatgattttgtttaaaattttaagcgctttttcatagataaaatcactgattgattattgattgataggcaaaatcactgattgattgttcagtaatcagtggcttgtcccaattttaatggcagagaattccatgggattttaaccaagtttaaaagggccgtgggttcgagtccgtcccgccggggcggtgctcccttttatgttttacatgaaaaatcaatcacttttctttttggtcagcagcattggagattaattatacttaattatgtcatgttttttctaaatttccagctgccgacctggacgaatttgtcgccagttcctcaacggcgccgttgtacgccccgccaatgttggcatcggacaccggcagcagtacagaatgccaaaagtgtgatttgcgttcttcgtactgtaaacggcggccgacagccgacggtggtgccaaagtgagctgcgaatgccgacaggtgagagagaatggcgcggaaagtgtgaattttggaaggcttgtattacagtaatatttttaggtgaagggccaaatttcagaaaattctccaaaatttaaaatttataaatacagtaaaaaagtaggggaggtgtaatccgtgtttgatgctgtactcaaattaataagcattacagcgttttaaatccttgaaatccggtccgagtccagtcccctaatcgtgatcatgattcaaaattttacaaattcctgtctcgatagcttttcgattaatcccaatagattttatgggcttgatcagttattgattggatgatgatgatctctgttcgatcactttaccccaaatttcccctgcatttttcaaagggtttccatcgctcaaaagtcagcggcagttgtgtgatggtgaggactccttcgccggccgaattaccgtcaaaccggttggcattttgttaatttaaaaaaatntaaaaattttagttacggcgattttgccacaaaaattggcccctcgccaatgtccggcgttgacggcggaccgccgatgatgatcagcgaaatgatgtacgaggagaacgaaagtgatcagcaatgtgtgctgggacaggcggaaaagcacgcgacgaggtgggaaaagcaatcaatgaattaattgcattaattagcaattaattaacaaatttacacgtttttaaatatttttcaatttattttttcatcataaaatatagaagagttttattttttatttatttcattttttttatcatttaacattagaaaatcttttctttgcttaataaaaaaacaaattttcaattctttcaaattaatttttttttgtcatttcttttattttcaatttttacaaactaattttattttcatttattaattgttccaaaatttaaggatactctccgacattctgaagaggtacgaccgcaatttggtgcccagcataaagggcgtggacgtcgaaattgaactgctcattcaaaaagtgggttatttattagttgttccctcattaattaattagttaattcattaattacttcattaaggaccattacttttttgaaagaccctaaaatattaatattattttatttcaaaaaaattgtgactaaaatccgatttccgaacctcgaattgaatgaattccatttttaccgattatttagttttattataaataaatttttttttaaataaatgatttattcaataaatattctttaaaatttttgaatttaaaaatatttgatttatttgataaatattatttaatatttttgttatttatttcatttttaaatgttcttaggtcagcgaaatgaatgaaattttgtcctcctccaaaatggacattatgctcagccaaatttggcacgacccgggcctcaattttgaggtaattttttaaaatttaattgctaattttaaaatgttttagcaagaagaaggtgctcaatgcttgaccaatttatcattgtcatatcgaatggtaaattaaagtaaaataataaattaaaatatgttaaaaaaaagatatatttaaatgatttttaaataatataaacaatttgttgcaattttaaacaaatgttcaataatttgaaaaacattttctaactaaaaaattaataaacaaattaaaaattaaaatttagaaataaataaatgaaaataaaaaaaaaattgattttataaataaattcaaaatttaagacaacattcaaattttggattatctaatttaaaaaagtgaaaataaataaatcaaaaaataagacggcaattaaattttaattcaataatttaaaaatgagataagaatcaaaaaaataataaaatttatttttttataaattgcaaatattagacaacattaaacagataaatttttaaggtggataacatttggatcccaaatgtttgtctggtcaactccaaatcctcattcatccattcttcgcccacccctaacatttttctcggtataaaaaaattattttataaattaattattaattaatttttaagccatttttcccaatggtactgtttggctcaattatcggtaatcgtccaaaagttaatttgttatccaattttaatgcttttagcattgccgtcgaatcgccgtgtgattttgaattcacaacatttccagtaaaaaattgaattttgaaaacttttcttttttaaaaattttcattttataaaaatttttaataaaaatttaaaattttttttagaattatttgtcatttttttagaaattttcttatgtttaaagaaaaattatttattacgaaactcttaagcacttaaaagacgcaaattttattcatttagctgatgaagaattttttcaattttttttgttaaatattatttaaacttttaattacattttatcgctaattaaccgttaattgtattattttgttgagatggaccgtgttgagtgcacaacagttttcgagagttattcattcaatgtgggcaaagttcggctgcattggaaacggcaaggcattccggtggaactgatcgccaacgtaattaaattaaattaattaaattaaattaattaaaattattttattttatttaatttttaattttatttcccccttttcaaggtcagtttgcccgatttttatctgtcccattttctgtttgaaaaggccacattccattacccagctggtgtttgggatcaggcaaattaataattttataaatattgatcattaattaatcgagtaattagtaggataattaggcctataccttgcacagcaattaaattgttaaacaagcataaactttttaacttaaatattaaataatttacaacagaattgttgtcaaaaaagttattaatccaaaaatattaatattaaccttttaaataattataatatttaataaattaaaaataaattaattaaaataaaaattttaataagatttaaaattcttatataattttagctgaacattaaaatttatttccgacgtgcctacggcttttacattctccaaatttatatgcccacttattgcatggtgaatttttaattagactataataaatattcccccatttaattaggtgctaatttcatggatctcattttggctggaccggaagtcattgccggccaggtaaaaaaagtaaaattgaaaaattttattatttttttcaaattttgccagggtaactttgggcgtttcttcaattttggcattaacaatgcaatatgccaatgtggcaaggagcttgccaaaggtggaacaaacacaatttgttcactcatttattttataataaatttaaaattgtttaaaaaataattaatataattaaatttattaattattttcaagcaaaatttttttaatttgagtttattaaaattatttaaaattacttttaatactgtaaaattaataaaatattttttgcaattatttttattaaaattgcttaaaatatttataaaaaaaaatataaaaattattttttgcattttccactgttaaatattattttaaatttgtttttcccatttttaggtcagttacatcaaaggcgtggattggttcatgatgggctgtgtcacttacattttcttctcaattgtcgaacttgccatggtcggcattttggagaaggtcggcacagttaaaaaattaataatttaaataattttaaataaatttttataccattcaatgtttcaaataagatattgatgaaatttattccaaagtttgggaatttaaatatttaaaataaaaaaaacaaaacaaaaatgggcgcctttttcaataaattctaattaattccactttaaatttcaaaaatcattttactgaaaattgtcattaaaaatttaattaattaattagtgccttttccaaaataaaaaaatttaatatttttcaatttttctccacaggaagccgcttcggaccatgaggaggatgatgagagtgaaagtcatcataagccatcatatggtggcggagggggaggaggagctgtcggcaactttgcccgaagaacattccggaggaatttcact

SEQ ID NO: 73325 - DNA, 285 bp, Heterodera glycines
  Genomic contig location: Contig_ID=SeqID_10204; Location=202..486; Strand=-
  SCN-specific regions: Sequence locations=1-285
atgacttccactgttccacaaattgtgctccgtctgttgctctttgctgtcctcattttgaactgcttcgactgttgccatgggtaagctttcggaatcggaagcatttggcctcacttttttgcttatttctcggtcaattattttcccatttttcagcagagttcattctaagtccagcacagttccaacgactacgacgaagtctcctccagctccaaaaaaaggaagtattctcgacaaactcccaatttgggccaccattgtcatcgccgttttaattgg

SEQ ID NO: 73326 - DNA, 1314 bp, Heterodera glycines
  Genomic contig location: Contig_ID=SeqID_10204; Location=1078..2391; Strand=+
  SCN-specific regions: Sequence locations=73-420,456-490,519-628,651 -907,929-1130,1153-1314
atgacgacgacaacaacgacgaccactaccaccaccagcagcacgccaacgacgccaaaggggacgacgacggaaaattggagcgaatcattagcggctgctgttggcggaaagaccacacttgtgctgatcatcgttgggtgcgtttgtcatcattcattggggaccgaccaaccatgacgaagtcgtgtttttttgaatgtcgacaatggcacgaaattccggcatttttggatcgttgggggaccgatcctgacaaatgagtgtttggagtgccggcaatgggacgaaattccggcattttgggttgttgggggaccgaccctgacgaatgagtgtttttgggatgtcggcaatggcacgaaattctggcatttttgggccctgggatttcatcatcatcacagcagataaaaagcagtagtaatttcacatttttccccatttgttttttcagcgcactgattgcaatcattgtcctgctcgtggttgttgtgtgctgctgctgctgcaaaaaacgcaaacgccgccgccgccacacttctgccgacgacgacaacgacaaggaggacaacaaaaagcgcaaacgtcgccaccacacttctgctgacgacaagaaggaggaggaccaccaccacattgaccagcacaataaggaggaggagcagcacggaaaggaggacaacaaatcgccgatacaaagcgaactgaaagtgtcgacgatttccgccgtgccaagcgactacaacacgaacaaacggctgggcgcaacagatttggacgtggaagcggaagaggtgccgaagacgaagccggttcccaaaaagccgaagtcagaaggaggcacaaagcgcaaactgtccaatttcttttggtccaccggcaccacggagaagcgaccgagcgcggcggaacatggcgtggaagtgccggaaacgattcgtgatgatgaagattgaagatgcttgaatgatggtgttgtattctgtatatacctatattatatattgtatccagtattctgtgtttagccatgcatatgtttatgtattgtatgtgcgtattattgtattatatttacggtattcaaagcgatgtatcatttaacacattcattgttggtatataaattttatttgtgttgttttgtatgtatggtctgaaatttcggaaaattcgcatagttctcaatgattttgtttttccgatcgactccctcagcttgtttaattttgttggcccacatttttttgacaatttcagctccgccgatttttcagagaaattgcacgaattacaatgactgtatttcta

SEQ ID NO: 73327 - DNA, 676 bp, Heterodera glycines
  Genomic contig location: Contig_ID=SeqID_10204; Location=5343..6018; Strand=-
  SCN-specific regions: Sequence locations=1-236,258-554,632-676
atggaagggtattgcgacgctgtcaagcagtacacggacaaagacgggtgaggattggtgggatatagaaaatgtaaaaatttaattgaatcgttttttcagccgtttggcagcggagaaaaagcgtttgttgagccgaatcgacgcggtgaaagagcgcattttcacattgctgttgcgaatacgcaagggtgggacccattacgactgcttatatgtgctgggacgatgatgaaatcccagggcccaaaaatgcagaatttcgtgccattgccgacatcccaaaaacactcattcgtcaggatcggtcccccaacaacccaaaatgccggaatttcgtcccatttccggcactccaaacactcatttgtcaggatcggtcccccaacgatccaaaaatgccggaatttcgtgccattgtcgacattcaaaaaaacacgacttcgtcatggtcggttggtccccaatgaatgatgacaaacgcacccaacgatgatcagcacaagtgtggtctttccgccaacagcagccgctaatgattcgctccaattttccgtcgtcgtcccctttggcgtcgttggcgtgctgctggtggtggtagtggtcgtcgttgttgttgtcgtcatagttgaacctgttgatcccgtcgtacttggacttgttacactgaaataaa

SEQ ID NO: 73328 - DNA, 853 bp, Heterodera glycines
  Genomic contig location: Contig_ID=SeqID_10204; Location=3720..4572; Strand=-
  SCN-specific regions: Sequence locations=1-8,30-853
atggaacaaatgtgagagaaaggaaaatgtttttgaaaattttgttttttaagcggcactttcaccgaccaaatttggctggacacattggcatggcttggacgtgaagaaatcggctggtactttgcgctggtcaatgcccgcttcgccgccctggtggacacgcagttgcagcagaggcgatggtacttgacggagttgcacatcaataagcgcaggtcgagagggagcggcgcagaagtgatggtcttgaacagcgaaggcgccttcttctcattgccattggcaaccacaccgatgccggacagtgtcgtcggcttcaacggcacattcaacatttggtagtcgccgcccattttctcaattttgaatttaatggcatttttgttcacccccacattttttctgcaggtatttggacgtccaagtgatcaagttcctgcgccgaaatcgccgcctgttcagcaccaacatctcgctgcagttcaaccatctgattacggaatttcgcgcttggcaagcgatggcacggcacatttggcccctgttgaggaacggactccgcacgctggtcagcctgaagcgcaaacaactggcactgatgcgcaaacacgtgtcgccaaccgtcctcttcgactgtccgaaccttgtcgaaatcctcaccccgattttgcccgaacgtccgaccgttgacaacaccaattatgctgctgatacatcggcccgtgacctgtacatgtggctgcacatgccgcgccctgacggtcgtccgaaggtgttcaaattgaccaaatgtaacaatggatgggaccaattcgtcaaccaattgctctcggtgggtatcgtgggatga

SEQ ID NO: 73329 - DNA, 946 bp, Heterodera glycines
  Genomic contig location: Contig_ID=SeqID_10204; Location=4587..5532; Strand=+
  SCN-specific regions: Sequence locations=1-133,169-307,329-546,591 -801,879-946
atgcctcaactgcttcgccttgttgctggagttgctccgctcgctttgcttctgtttgttgctgctgtttgtcagttgtcggctcttccttctgagtcacttttgcttctccttcttccgatgatgcttttgattgtgcagtgcccagttttgttgtttgttgtgtcgtcaatttgtgcacacttctgcctgtgctcagctgccgttgatttgatttgatggcacggacggaggagaacagcagcggcaataaaatagaggaaaaattaatattatttggaatgaatggccggaaatgctaacatcactcccttttatactgctcattcattcgaaatttgaaatcctttttttaccgaatcagagccccgagcccctataataagggtcgctgatcacgaatctgacatcactttcgactaccggattaagatttaaaaaattggatatttcgtggctcagcgaaaaaaggggccgcttaaaaaaggcgtcaaaattttatgcgcaaaattctctccccttataagggggtttctgtgttcactttcgtcatttttgtttttgtttcaacttcaactacaacaacaaatgatgccgtcgcgttcatttttcatcaaattcaaatgggaatttgcctttgtcgcgtttctgctgctgctcagtgaatgcttttgctcggttggcgcacaaccaaccggcggccgaaagtaaaaatgccatttttttttgcaaaattttccattttcacctcccctttttatttcagtgtaacaagtccaagtacgacgggatcaacaggttcaactatgacgacaacaacaacgacgaccactaccaccaccagcagcacgccaacgacgccaaaggggacgacgacggaaaattggagcgaatcattagcggctgctgttggcggaaagaccacacttgtgctgatcatcgttgg

SEQ ID NO: 73330 - DNA, 1180 bp, Heterodera glycines
  Genomic contig location: Contig_ID=SeqID_10206; Location=1..1180; Strand=+
  SCN-specific regions: Sequence locations=1-451,474-546,568-768,791 -863,906-1004,1026-1028,1051-1180
  Gene Ontology: Mol. function=proteasome endopeptidase activity; Cellular component=proteasome regulatory particle (sensu Eukarya); Biological process=proteolysis and peptidolysis
ttttcctacaaatcgttgggaaaatctggcttattgttagaaaatttttttaattctttggggaacgaaaacgatctgggggaaatgaaatgcactccaaaattcattggcataaatatatgctttgttgcgcttatttgaccatattttcactttcgacagacgcgttacggtgacgcggccattcgtcgcgcggtgccgttggccctggcgctgctgaacacgtccaacccgcagttgacaatcatcgagacgctcagcaagtacagccacgacgcggacacggagacggcacggaatgcaatctttgcgctcggattggtcggcgccggcacaaacaatgcccggattttggcaattctgcgccagcttccactccaatgaccaggtaattattgaaaatgcagtaataaatgctaagtttagtgcagtaattagtaacaaggaggattttgtttctttgccactttttataaacgggtacttgggccctgacaaattccaccaaaagatatttcaatgatgatgatttttcatgtagagcatggttgatttactattgccaatttcggcttttttggctccgttgccgaaagtgatcagaaaaaatcgatcaaatgaaaattcaaccaaaaatgccttaaaatttagtgccattttttcttcttacgttcaaatgaccatttttcatgggtttgggggtccgttcggcagacgatgaattattttgatttttcttctaagtattattccacctagcatcttttgatttagtattttatttaatttttgatcctattataatagaaaaatttacgctgaacgtttttacaaaagatttacgaatcaagcataaggttggatttttaagaatttttaaaaaattaaccattttccaaaactttggtcgattttttctgatcacttttggcaccagagccaaaaaagccgaaaattggcaatagtaaatcgacactactctacatcataaaagtgtcagaaattaatttttccatgaatttctcttattttttaaaaacattattttgcataattgcacatccaaacacagaacacgatgatgctgctgcggatcacccatggactgatgcatttgggcaagggcactcaaacgttgaacccattccactccgatcgtcagttgatgtgccccgcaatt

SEQ ID NO: 73331 - DNA, 395 bp, Heterodera glycines
  Genomic contig location: Contig_ID=SeqID_10206; Location=3012..3406; Strand=-
  SCN-specific regions: Sequence locations=1-106,149-395
atgaccaattcaagcagtaaaaatgccgaaaaggaaggaggaacgaagcaagcccgagagcggcaccttcaccgttctaatgtagaagaagctgaagcagccgttgtggaagctgaagcggaggaggaggaggacgacgacgacgacattcattattcgaagttcgccgatgatgccaagctgctgccagccctgctgaagcccgccttccaggtcgagcagttcacgctcaaggtgaaaagctgcctacacatgcccttccgttggaaatacaacactttttgcagaccttctttgaactccacttggaagtcatgggccgacgcgactcccgggcgggctgcttgcgcacattcaacatgacggtcggagacttcgagcccgatgccacctga

SEQ ID NO: 73332 - DNA, 970 bp, Heterodera glycines
  Genomic contig location: Contig_ID=SeqID_10208; Location=401..1370; Strand=+
  SCN-specific regions: Sequence locations=1-295,365-496,518-543,567-970
atggagttactatatacattgaaaggtggcggtggatcaaggttttctcgaatggttccgggtgtcgtgtgataacgagagcgcattttgaggcatatgcctttcttctgtgtgcaatagttccgatatattaagcataaaaaacgctgtttccgcttggtctgaagcttatacttcgacttttattttgcctttttttgcctttttggcattttaccgttttggtgtctttttggagttttttccgaaaaattccattaaacttcaataaaatcgggaaaaattcggtggtttgtaaataaaagtattttataaaaaatcaatataataaaatcatttattttttatttatttttatttttatgagagttgttgatcggtctatgtcagttcgtcccccacggttcggccccagcatgtttttccactatagctttctataacttttttctttgtaatccaaatccaacattgttggtatcattcgaaagcttaatctgtttataagctttttctaagctattgctttgcgatacaattgcgaaaaaagttatacattaaaattgcgaaaaagtcaaaattttcaatttttttcttaataaaattttttccaggcttgaactattcgcttttggtaggctaatagagcatgttaagagctttcgaatgataccaagattgatggatttggataacaaataaaaaagctatcgtggaaaaacatgctggggccgaaccgtgggggccgaatcgtgagggccgaactgacgggttccgttgttgatacctttttatacacttcgccaaaatactatttaatttgtaacaaatttaaaaatataaaacaaagaaaaaagcatccaagagatgaagttcattaaatacggcgttacctttaccataagctgcagcatcttttaatacgcgattaggttaattaaaagctaaaatataatattagcaacacaaa

SEQ ID NO: 73333 - DNA, 2091 bp, Heterodera glycines
  Genomic contig location: Contig_ID=SeqID_10208; Location=2610..4700; Strand=+
  SCN-specific regions: Sequence locations=1-25,48-118,142-629,684 -1239,1261-1328,1351-1501,1523-1899,1921-1960,1982-2091
atggtcagcagaattaatattattctagctaatgaagatggagaaagtttagcagagagtgtgaaatcaataagaattgggcaaagagaaaaaattgaaacagaaggaaatggcgacaatgaaaatttacttaatgcaaatactaatttttttagaataaataatcagggccaaagaaatgggaatggtagtgataatgtgaactaccctaaggcaccatggccacattttgaaggggatccattaatgtggccggcattttggcaacaatttagtgctaatgctggagacaaaaatattccggatgttcagaaatgctcttatttacttatgagcctaagagggagagcagaaagagcagtaaagggttatttagctacgggagaaaattatccgttaattgtaagtactttgaaaagacaatttggggatttaaaggtaattagggaatcgcttcaaaatgagttgttgaatctaccgaccgcaaatgaatcagttatgtcactgaggccatgttttgaagaattagaaagaatttgtcggcaattgcataattctggattaaatgaaggagaagatagtgagtttatgttaatgacattaaagaataaattcccaagagcaattgtgttggaaattttgaaaaaggagaaagattctgggaaaaaatggaaattaggagagtggcgaagaaatttgaacgatgcgatatctttaagagaagaagctgcccgatgtactcggagcttaaatttaaatccaagcgaattcagaagagtttttagtatacaaacaagtggtcggaggcctggacaaaattctgaaaacccaagaacgggaacaatcccaaattgttttttatgtggtaagacgcattgggcagcaaattgcaaacaagttattggaagagaagcaaggcttagaattataactgagcaagggagatgtcataaatgtttaagaaaaggccacagtaaaaaccaatgtactggaaaaaattgtattatttgcaaccataaccatcacaaagtcatttgccctaagggtcaaaataaccatcgaactggagccaatgcaattgaattaggaaaccaaaataatttcagacaatcatctcgcatgagtactgaaatgaggaacgggaacataattgcattcaccaacgtaaagaatggcaaagaaattctattaatgacaaggagggtaaaaatatttgcaggaatgagttcagaaaggtatataacagtactattatttttcgatggcggcagccaagtttcgtttattacggatgaattaataaggaaactgagacctccgcgtattggtgaaggatattttggatttatttgcctataggcagcaaacaccgacaagaattattcacctaaatattatgtaaaggttgagttagaaaacggcgaaaaagaaggtataatagtgagcaggattgataacataacatgcaaattaaaaaggcttaatttaaagtcaggagagattgaattaattgatgaaaaaccagatattttgataggaatggcagaattttggaaattctttaagagtgtttctccgataacagataaattgtttcgggttaatacgacagtgggtcctatagtttgcggtcaattggactataattctgaaaccccacaatttgggggagttgttgcgactgaaaaatgtgaagaagaacctaaccagttttggaacttagagacaataggtgtctgggataacccggaggagaaagatgatgaaattgcattgaaaatgtttaatgaaacggttgagaggaaaaataacagatatgttgtcagttggccatggaaacggccaaaaggagaacttccaaccaatttttcggttgcgtatcgccgtttaataaatttgctaaataaattaaaacttacaccaaacgagttgaaagcactaaatgatgcgtttcaagaaaatttaaaggaagaaattgtagaggaatcaaagattttgggatttaatgagcattttcttccacatcattgcgtttttgcgtcaggaaaaaaccgaggattgtgtatgacgcatccgccaaaatcagaggag

SEQ ID NO: 73334 - DNA, 519 bp, Heterodera glycines
  Genomic contig location: Contig_ID=SeqID_10210; Location=1639..2157; Strand=-
  SCN-specific regions: Sequence locations=1-216,242-252,277-353,390-519
atgacagcatcgacaaggggacaatcaccagcagccccagagtaagtaatgccgtcaccgccaaggccaatttccgattgcttttcattgtcagttggtcgattgctgacgccgacggcatgcttcagcgcttctgagcaatttttttcagcagattcggcgaaaaagccggcccggcacgaatggtgttgaatagagtccggtaaaaaaaaatttccgggagcgggagcgggatcgggagttcaaaattttccgggagcgggagcgggatcgggaatcccgtgaaaatcccgctcccgttaaaatcccgcagaaattttacgggagtcccgggcgggagcgggagtaattcgaaaatttaattaaaaactaacaaaaatatttttaatgcacaaatttgaaggaaaatccttttattaaagaaaaaatagatagaaaaatttagtaagcagaatttgaaattaaaaaatcacatttatgggtcgaaaatcagtattttttcaaattgcttcaaataaa

SEQ ID NO: 73335 - DNA, 1038 bp, Heterodera glycines
  Genomic contig location: Contig_ID=SeqID_10211; Location=55..1092; Strand=-
  SCN-specific regions: Sequence locations=1-54,103-244,271-593,615 -718,740-824,846-1038
atgaatgttggtaaaagtgctgcttcaccacgtccatggtcttcacatagtaagtttttaatgaattttttaatttagatttttttttgaaaaaaaaattttgcttacatttattagtttttgtacaaacaatatttgtctctgatcagcgattaatgcgttcgttgctttagcagacaaaagtgagcgaatgaagcagcgatcaaaaacaattgacaagcgaaaaggtggtccacaaatgcaacaccaacaacgacgagcagcgacaaatttccaaaatggtcgaaaaacgacgacacaaattcaggtgagaaaaaaacaacaccataaatggtgcacaaattttagacatgaattttatgtacggtttgtatgtccctactaaatggtgtcgaacggagttttttacaatttcttccataatttttttttcattttttagcaattattttcaatcatttactcagaaaattgtgttttttttcaattttggatgtccaatgttttaacatatttgtgatttgtcctcatttttgaattttccaaaatcatgcacattcgttgtgtgttgtgtatagggaaaacgcggacttttatgttctttctcttttccaattgattttcttttctcttccattatttgtgtgctcaattccactgtcattcattcattttcttttttcattttatttatgtggcgtttcgttccaaaagcgctgttttaaatctttattttctcctattttttcctgcaaaaaatgaccaatttgttctctttttcactcacttttttttctaaattttcttctccttattttaaattcttcaaaaatttgtatcttctactatagtttgacggaatgccaaatttaaaaaaaatgggaaaataaaattatacaataaaaaattcaatttgtcttttcagctcactcatcaattcttgtccactgggctccacgcgttgttcccctcgctcaacggcactcttcccactgcgaatggtgccgaccgaggcgggttggcactgctcgagcgtga

SEQ ID NO: 73336 - DNA, 898 bp, Heterodera glycines
  Genomic contig location: Contig_ID=SeqID_10211; Location=2194..3091; Strand=+
  SCN-specific regions: Sequence locations=1-339,361-643,680-898
atggatgtcggattcataatcaactactccgaaaaccaagtaattaaggtttttatttgcaaagtgaaaaaaaacactaaaaaaatttggggcctaaacggaatacatatgtaagagtccgtgtgatttgactttttaatttgtttgataatttggaaggaataaaaaatgttgggaaaagcacccaattttgtttacagattccgagacccaaactgtttatgacaatgtacatacatataagcgacgcctaaaaattcgaaaattagaataatttcctgacttcagaaatttctggaatttggaatttaagcatgccgagtcccaaaaaaactgtgaattttttaaacaaatcaattttgttcgataaggctatgtatgcacagatacgcaaaattttagtctcaaaatctgtacgtatggtgccaaattatgtcatgaggattcaatcaagaatggaactcttgaattgaatgctttcatttggcacccgcccttactctgcacgaaacatccaattgactttttgtatcgaaagttgacaaaatatggaaaagcttgaaaagtcgaatctgttataagatgtgctaaattagaatatgaaatggaaaaggtctcgttatttttacttcaagaattatgcaaaaaaatttatttaatattttcataaaaattttttgaattttcaaaggcacccattcgaatgtactaatttggtatgtttattagacttggtggggtaaagtcaaattagtatttaaaacacatacttgatgctaatgagtttctttttatttgtgccgaaaaaaatgcaattaattttttttttgcccttaaaatgtgccaattcagtatcattcattatttgctaggctaaatttattccgacttacataaa

SEQ ID NO: 73337 - DNA, 965 bp, Heterodera glycines
  Genomic contig location: Contig_ID=SeqID_10213; Location=1063..2027; Strand=-
  SCN-specific regions: Sequence locations=1-265,287-811,880-965
aaatggccgacttccccgattcgggaaagcattgctccgtgccggactgtcgacaactcggtgagaaaaacggaggggacgggggagtacggcatggatttacgcccaccatttttagactatttgcccatcacttgcgatgcttgttcgcgcattttatggtaaattcatagggcatggtattacggaggagagattcattttgggccaatcgtattaaaaaaattgaatttttggcttaaaggaagatgccaaccgaacccataatgaattttgatttaattaacaaataagagttgtttaagcaaacagcacagaacgtacgactcccacggctgcacagagtcatacaaaaaggcaatgtttgcaaaaaccattttacgtttcatattttaccaatttcagaatgtccaatttccgatttgtccgttgtgccaacaaacggtgccaattaaacgtggcgaaaagcccgacctgcgagtcaatgagcacatcgaacgcgactgtcgttctgagttggcaaaaaagggacgttgggcacctaaatgcggcgtgaagaactgcttccggagagaggtgaatttcggcaatttgaaaaatgccgcaaaaataaaaaaataaatgctttccccatttgccaactttcgcagctcgtgccgatggtttgcaaagaatgtgccgtccatttctgcctcagccatcggcaccaatctgaccaccaatgccccaaaatgttggcactttttgtttaaaatcaataacggaccattttcatattttaggccaatggtttcccatcggacgacaaaggtaaaaataaaattaaaaaataaatggaaatttgtaaattttatttgattttttaatttgtttatttttcagccaaaaaatgtctcctcaaaaagtgccgctgaacaaatggacgccctttttgctgcgcaattgcaacgcgaagaatacgaaag

SEQ ID NO: 73338 - DNA, 297 bp, Heterodera glycines
  Genomic contig location: Contig_ID=SeqID_10213; Location=125..421; Strand=-
  SCN-specific regions: Sequence locations=1-114,136-297
ttcgaagcattgacttctcgagattgagaactttctgaggcttaaggccgagaatggcctcaagactgacaatgggccctgatgagtcccgggctacgcacggttcacagtccggaccaacaaaaatattttaaagttcgattcacacggagttcagttaaatcgaacattttttcgggattcatcatgcacatcagccaaaagttaaatcacttttgaaattgcatatcaatttgagattaccactccatccatataattggcaattcatttttctaatttttgtatatattaact

SEQ ID NO: 73339 - DNA, 678 bp, Heterodera glycines
  Genomic contig location: Contig_ID=SeqID_10214; Location=875..1552; Strand=+
  SCN-specific regions: Sequence locations=1-16,46-199,222-267,327 -337,381-610,637-678
atgtttgcccactgttcaaccaaaacaacaacaaaaccaacaccattctcgagaacagacaaagcgtaagtcgaagaaagtgccgaccaatgattctcattctttttgatcactgatttgtgggtcgcgtccgtggtattcttgttgtcttattgttaggcttggttctgctctatccccccccccccttcagcttatcttctcgtttccgttttccttctccattaatccctgtatttttttggatcccatcattcaacactactcattaattaattaaatttaattaattattaaccttacttttaataaaatataatttatttcgaatttcccctttcccaaaggctttccttcgtcccccgtcggccccgcccgttccgtcattcgtcgcgcaccgttcatacgcccgcagaacgaacaaatgcacacaaaaagtgcgccggtcgccgccgcttttgccgtccatccgccggcgattcgaccgccgaagggaatggcaacgaaactgaaccaagccaaactgaaggacttcttcagtcagatcagaatgaagttgcaaaaagcatgacgaagcagcagcaaaatggacaaatttgatcagagggggcgaagagaaaagaaaagaaaatgatcagaaaagtcacttttgcaaaagttcgattgcacaaaacataa

SEQ ID NO: 73340 - DNA, 623 bp, Heterodera glycines
  Genomic contig location: Contig_ID=SeqID_10215; Location=16..638; Strand=-
  SCN-specific regions: Sequence locations=1-111,133-303,325-418,442-623
atgcgtccaacggagtgcgatgccgacgacggcggcttcagcgccgccttccgcctgggcaccagcggcgctaaagcgcccccaccgccgtacaggtgagtacggagcaccgcaaagccacaaggcatacaaatcaggatgtttgccgacgccctcatttcgaaaagcggaattccgacatctcaaatttcggcattaaatcggaattcaaacggcttaaaaaatttctgaagtcatatccctggggtgctagcgcgtttgttaaaaactgccacccatgcgcgtttgttaaaactgacaatgggtttgaaaacaaaaaatgggtaaaataattaaattaatagcctggctcaaattcaaccaaattaatatttcgtggtatcattcaatagctttaattgttctctttcagaatataattttcttatatttttaacttaagtataaaagaagttatggtcacaaaattgcaaaaaatcttaagtcagcattttttgttcagaactgttttgaaactcaatgaaattttctaaaattttaaatatcaatagagaattcttagggctatcgaaacataaattacttctggctaaattgcattctaaagagtttacgatattaaa

SEQ ID NO: 73341 - DNA, 163 bp, Heterodera glycines
  Genomic contig location: Contig_ID=SeqID_10215; Location=197..359; Strand=+
  SCN-specific regions: Sequence locations=1-1,25-118,140-163
cttaagttaaaaatataagaaaattatattctgaaagagaacaattaaagctattgaatgataccacgaaatattaatttggttgaatttgagccaggctattaatttaattattttacccattttttgttttcaaacccattgtcagttttaacaaacgcgc

SEQ ID NO: 73342 - DNA, 1293 bp, Heterodera glycines
  Genomic contig location: Contig_ID=SeqID_10215; Location=1345..2637; Strand=-
  SCN-specific regions: Sequence locations=1-15,37-420,443-632,707 -926,988-1258,1280-1293
  Gene Ontology: Biological process=regulation of protein activity, epigenetic
gccggcggtggtggtaatgggcagctgcaacaacagcagatgcaccatgtacagctccaaggccgactcgtcggcacacagtgcgttttgggatagtttttcaaaaatatgtgccctgccttcgattttggcacactacatagcctaaaagtctcgagaaaaataagtctcgacaacgcaaagttttatggcggcattttaccctatttatggcacattccgacaaaatatttggcactatttttttggcaattacctttccgctcccccaccccttcctggcattttttgtgccacggaatttatccaaaaaggcagtcattgacgttttacacatcctccccggccaccccttaccaagttccattattcattggcatttttctctttttcttactcattccgtggcactttttgtaccaaccattaatttccccaaaaagactgtcattggcattctccgtcacttgtcgtggaccacttttgggccccggctgtgacttggcatgcaacagctcagcagccaatccgtccacggcaatttgccaaagtcgtcgtaccggcttcttctcattgtgccgatggataaatggcggtggcggcggaggcattgggcaacagcaacaggtgggataaaaataataaaaattttaaaaaataataaaattttttttacttttttttccttttattaaaaaaaattaaagctgctgatcccttcagaaattgagacatgattttgttatttcgagaccaattaaagaaattaattacaaatttgatttaaaaatatcatagaaaaaagctaaaattccaaaaatttaatttccgaattaggaactaaaattcaatcatttttgacttgctttttttatatacagtacaatttgatcactctttctgacaaatgatcatagccaaatagcaattaaaaataaataaaaattatttaaaaacaaataaaaaattattttattttatttttttgctgtgaatgagtttcgaagacttttttgcaagtttccaccagaaatccacgacaaattttgtcggtgaatttcatcctcgattccccgacttttctctactcgccgaagggttggggcttaagcctaattgcatcatttaattgtcattcattattccttccattctcggcagcaggtgtccgactgcaaaaactgtccatggggcatcaaagagaatgcgtattgtgcggacggagaaggcggcgtattggagccaaatcatgcggtgattttggatttttggaaatttagagatttccatttt

SEQ ID NO: 73343 - DNA, 254 bp, Heterodera glycines
  Genomic contig location: Contig_ID=SeqID_10215; Location=2027..2280; Strand=+
  SCN-specific regions: Sequence locations=1-169,192-254
atgcctccgccgccaccgccatttatccatcggcacaatgagaagaagccggtacgacgactttggcaaattgccgtggacggattggctgctgagctgttgcatgccaagtcacagccggggcccaaaagtggtccacgacaagtgacggagaatgccaatgacagtctttttggggaaattaatggttggtacaaaaagtgccacggaatgagtaagaaaaagagaaaaatgccaatgaataatggaacttg

SEQ ID NO: 73344 - DNA, 66 bp, Heterodera glycines; identical to SEQ ID NO: 59916
  Genomic contig location: Contig_ID=SeqID_10216; Location=73..138; Strand=-
  SCN-specific regions: Sequence locations=1-66

SEQ ID NO: 73345 - DNA, 146 bp, Heterodera glycines; identical to SEQ ID NO: 56264
  Genomic contig location: Contig_ID=SeqID_10216; Location=245..390; Strand=-
  SCN-specific regions: Sequence locations=1-79,113-146

SEQ ID NO: 73346 - DNA, 146 bp, Heterodera glycines; identical to SEQ ID NO: 56264
  Genomic contig location: Contig_ID=SeqID_10216; Location=497..642; Strand=-
  SCN-specific regions: Sequence locations=1-79,113-146

SEQ ID NO: 73347 - DNA, 146 bp, Heterodera glycines; identical to SEQ ID NO: 56264
  Genomic contig location: Contig_ID=SeqID_10216; Location=749..894; Strand=-
  SCN-specific regions: Sequence locations=1-79,113-146

SEQ ID NO: 73348 - DNA, 319 bp, Heterodera glycines
  Genomic contig location: Contig_ID=SeqID_10216; Location=1102..1420; Strand=+
  SCN-specific regions: Sequence locations=1-319
atgtggcacggcaccgccgctgctggtcagcagaggttggataaaagtgtccacaacagtgacagtgttcgtctcgtacagcgagccgtccatgttgatttgtgggcccaaattatgcacaacgacggcgatggcactctgtgcgtggggtttttttggtggttcgagtccgttgtgcaacatgaatatttttatttatttttgtccaaaaaattaaaaaatgacgatttttaaaaattatttttggaggtttttaccaaccaaactggacaatcttgtaatcattcgaaagcccttgattaggagaagccttttctaa

SEQ ID NO: 73349 - DNA, 1068 bp, Heterodera glycines
  Genomic contig location: Contig_ID=SeqID_1408; Location=981..2048; Strand=-
  SCN-specific regions: Sequence locations=1-35,57-90,112-226,268 -699,722-815,837-934,1015-1068
atggataaaaatttgaaagaattgcaaaatgaattctgtaaatcatttaaaactggaaattttcaaaatgcgatggaaatgtttcaaacgacaaaaattgaaaagaaagaatttgacaaaagccaaatggacacagtcttggcaaaagatcaaattctcaatgagaacaacaagcgaatgtttgcaaaatttgtcaatttttccagcaaaatgatagaaattcttcaaaatttaattgaatgtaaaattttattttttaatttaaaacaatttccgttttcagcaataaagttgcccacattccaacaaaagccaaactttttcatggccagaaggaaaaagcgtgcttctgtcttcggtggctgcttctttggattgcttttagcactgatcgctaccgtacccttttatggctacaacagcacttttgtaattttctataacaatggttattctaagttagtgatcgagggcaacaatttacgttctaatgaattcactgtctattctgatcattatcctgatcacaacaacattaatccgtggcacactttgtttgtcattttcgcactcctattaaccattggggcgatctttgcattgatgttttgttcatgtttctattgtatctaccgtgttgggtcacgcatattttctgcgtgagcacacaattacggtagatctgactttagtgccaaagtttttctcaagtgtttcattttaatatgccagcggtcaactgatcaattgatcaggtgatcagaaaaatgtctgacattatccggttatttaatcatttttaattgaaacacttgttgttggttttcactgttctgtcagtttccaaattgggcctttctttatcttcatttttggacattgtgtttttattcgctgctagggcgaaccgaaaaatagtctcagtgtcaataagaatatttaaatttaattatttaaatcaatgtttttttattgcacattaattataattttcaaataacaataatataatttcgaggttcaacttttcttcaatgttttttcttcaaatattccgctcaaaataaa

SEQ ID NO: 73350 - DNA, 496 bp, Heterodera glycines
  Genomic contig location: Contig_ID=SeqID_1408; Location=2077..2572; Strand=+
  SCN-specific regions: Sequence locations=1-421,443-446,468-496
atgccaatcgcattttcctgtatccattcaatggccgaattggcaccaaagtttcccttttttatttggttaaacaaactcgttgcttggtcaaccagtttgttagcttctttgagttggtctaaaacagataagagcagtgacgcgataaaatcgaacatgagtatcagggctgcacgcaagtggatttacaattacggaaatccgcaatccgcaattgcgggggtccaaaaaccccgcaatttccgtaatccgcaatccgcaattgcgtgcagccctgatgagtatagaatgtcataattgagacctcctatttatttattatttactgaaaaaattgaacttagaaaaagcaaaaaactaaattttgtaaaaaaaaacattacgcgaattttgctcatcaagaatttttgcacaatttttgtattctttccgaaatttttcgatttaagggagtccaaaattttaaaaccctgaaatatggaaaaatatggaa

SEQ ID NO: 73351 - DNA, 588 bp, Heterodera glycines
  Genomic contig location: Contig_ID=SeqID_1409; Location=226..813; Strand=-
  SCN-specific regions: Sequence locations=1-88,122-380,402-481,505-588
atgtccttcccacttccattgcgcagttttgaaatgggaatttgcaaagattggtcaaccagggccagtgggatgttgcactttttggataattttaaatatttattttttaatttaatttccaacataaagagagcattactatcatttcattatctcaatgtaattcgcttaaattgtccgtgtgaataaaagaccaacatcaagtgtgccatctatggttttccccgacttttgggaaagaaaagtcggagacaaattctcgtcgggaattagtcttgtgtctcatattttggcacgagataagggggaaggggggggggggtaaaaccttcatatgcatttgtcaattcggaatttaaatcaaaatttcagctttccaacatgcttattttggccctcgttttgccataccaattttggccctcctattattatgccaattttggctgaaagacagatacaataatgaaagagtggggaaatggagaggaagagaaaaacacaaaagcaaaacgaaaataatgcaaattctcgggggaacaccacccgaatagaacaaactttgtttaaaaaaaatcaattaaa

SEQ ID NO: 73352 - DNA, 408 bp, Heterodera glycines
  Genomic contig location: Contig_ID=SeqID_1410; Location=2184..2591; Strand=-
  SCN-specific regions: Sequence locations=1-408
atgggagacgcatcaatccaacgattgacggatattttgcagcagttgttgaatgcacaccagcaaaacgcgccaccggcagagaatgcctctcaattgccaacacttccggacgtggaatgttttgatgctagtcagcatagtggctgtgaaattgaggactggctcaagcgatttaagttcgctcttgactgtgccgcgctgaaccttcaggacgagttgaaggtgaagctgttgatgaccaaattgtttggaccgacgttcagcgaatattgtaagtccgtcttaccgagagaagtgaccgacttcaattttgtggagactgcggagaagctgaaggcattgttcagccgacctcaatccgtctggattgacaggtatgagtgtctctgcgtctccgctcggtga

SEQ ID NO: 73353 - DNA, 924 bp, Heterodera glycines
  Genomic contig location: Contig_ID=SeqID_1410; Location=917..1840; Strand=-
  SCN-specific regions: Sequence locations=1-176,204-418,450-576,598 -817,839-924
atgtcgacaggaactcggagcagcaaccgatcgcagcgcgaatgctggcgatgcggtgggaagcattcgtcgagggaatgccgacaccaagaaacggtttgccgaaagtgcaagaggaatgggcacttggaaaggatgtgtgccaagcaccaggcatggctaaagaagaacggaggaaagaaggaaaaagcggtgaacaacatccgagttggaggagttttcctggttaaagatgagaaccagaggaagaaaggaatgatcgaagttccgattgatgtggacggaacgaatgtggatttcattgcagattttggcaccgaaggaactattcttcgtgaggacaccgtgcgaaaaatcggagctttgaaattgagccgttgtgaagaacgtgctctgtaccatgatggaacaactcgaccgtttgttggcaaaggaaatgcaacattttcgttcggaaatcgttcagcatttgggcatttctttgtttccaaagacggatcaaagaacttactcggaatggacatgatggacagactgggattgtcggactccatcggtctgaaggacaagttccaaactgagactgccaaaatgaacggagtgagcaagaagaaagtgaagaaattcttcggaaaacacggacgtggtaagaagcagaacttcgccgttggagcgaatgtgatcgccagcttgggagacgagccatggcgcgccggacgtgtgatcagccaaaaaggaggcacctacgacgttcagttttcggacggcacgaccggagaattcccggcaaagagtgtacagccgtacatgccggatgaagatgaaaattttaattttcttcttgacggatttggactgaagagcgcctcatccggtggatctgtcgggaagcaccaaatcggcagtgacggccgacgagattaa

SEQ ID NO: 73354 - DNA, 1683 bp, Heterodera glycines
  Genomic contig location: Contig_ID=SeqID_1411; Location=44..1726; Strand=-
  SCN-specific regions: Sequence locations=1-175,199-418,442-498,520 -552,597-877,900-1061,1104-1211,1233-1427,1485-1618,1641-1683
atgttggcacaagtttatggcacacatcttggccttttgcaccgcatgaggaagcaatggcaaagtgccaatgccaataccaaaattcatcagaataaaaatgagcgctgtcaatttcaaaagtgtttggatgctttgtatgaatatttgttccgcgagcacatcggacacaacggcgcggtgaagcccatttttctctacagtacctatgacaattcggacagatgcttcgctacggtatttgatgacatcaaatgcatggccagagtctcgaaaatccattttaattggccatttggtgaggacaatgaagaacggatggccatgatgtttgacacatgggaatcgtttgatgaaccgccattgattttgaacgagtcggcgctgatgggctattttaaggcaacgaatgccaaacggtcgcagcagaaagtgcagcagaccgaacagagtcagcacagggatggcccccggggttcgtttagcttggagaagctaccgcccccgggcggaaaacaaaattttaccaattataacaaatttgaccaaagattgttaatttgttggtttttggaaaaatttagcaaacttttttgagaaatttgggtgcaggaggtctaggagggtgtaaggagcgagcaaattgtggaggcaggagagggcaaggccggtagtttagcttgtacaacattggtccggaaagccggagacgccggttcaaacccggaccgccccatagattttgcctcaaaggcttcccaattcagaaacactaattctgtttgaataaagttcaagccttttttgtctatatcttaaagctttcaaactttatgagtgaaggtaattttttgcttgagaaaaaaactgtggaaagaaaatttattttcattttaaatcaaaaaaaaacttagcaattgcacgtgctaaatttgaaaaaaccatggagaaaatgtacagaaaagccgtagaaaacaaagaaaaaatggaacaaaatgaaacgaatgagaaaatatttctacttggcaatggacaattattagacatggaaatgggacaaccatcatcatcatcattattggcttcatcaacatcatcatcattggcatcaaaaagtgccgacaaaaaatcaaaaagtgccgacaaaaaccttggcaagaaaaaggatgcagcaattttgcatttgctagtgtacaaagtggaaagcgtggtaaaattaataataaaattgtaattaccgcctgcaatttatggacgtaaaccagcgaaaaacggccataaattttgtagggtggtcggcattatgccaattttttaattccattcatatctgtaaatgtttttaactttaattgttttttttattagtctaaaaatttttaagaggccattgaaagacacaaaatttgttcacagcttttttcatcaaaaattaaatgatattattattttttcttaaaaataataaaaataaaagataaattcattgaaacatagattgatgatgaagcattcctcatgtttgtgaaagggcaatccaattttatgtatgtgttagagtatgcctttgatacggtaactcggcacaatctgaggcaaactgtagatgaaacaaacaaaatattttacacacaaaaatatgtaaagcaccttggcagtttgcatttgatgcgaagggattga

SEQ ID NO: 73355 - DNA, 394 bp, Heterodera glycines
  Genomic contig location: Contig_ID=SeqID_1411; Location=2284..2677; Strand=+
  SCN-specific regions: Sequence locations=1-217,248-289,312-365,387-394
atgttttgggctccaccggcgtgccccacccgcctggattcggggtaggaatgtttaggcagggattaatcgcggccgcgggattggcactggggctggggtgaagaacaaaaagcatttttttgaaataataattttcaaaaaaattccgtcaaattaattaaatcttgcccaaattataattaccggagatgaaaaagcaattgcgtaaactgacaaactaataataataataatttgagcaaaaatattggaaaggaaaaaattcatttgtaatttttcagagaattaaaatatgaatgaataaaaaattttatggatgtatgcttttccaatttggtgaatgaatttctcatgtaaaaagccttaaattttttctttatttggcaaatca

SEQ ID NO: 73356 - DNA, 67 bp, Heterodera glycines
  Genomic contig location: Contig_ID=SeqID_1411; Location=3610..3676; Strand=+
  SCN-specific regions: Sequence locations=1-67
atgaacacaatgccatcatactgtatcatattctttggtgttcttctgttggcggtccatttttacg

SEQ ID NO: 73357 - DNA, 1005 bp, Heterodera glycines
  Genomic contig location: Contig_ID=SeqID_10217; Location=266..1270; Strand=+
  SCN-specific regions: Sequence locations=1-14,36-212,237-312,334 -741,763-892,915-1005
atgtgcgattttggtctttttccatctatttcatcatcaaatgttatcccaatggaaacttccgcactcccggatatggacgaactgcttgataggcttgagaacgaaccccttcaacttgtagtagaattgccagctcaatctgtggccatcaaaaacgagttttctcctaacagtaacagcaattcggatcaacaaaactcaataatagaacaagaacaacaacaacgagaaaagcaagttggggtgacaacatgcgacaataacgaagagtctgacagaaacctccaaaacatcgtaccaaaaagggaggagaagggtgcatgccttgaagcacatggtcaaattgtgccagagcaagacaaggaaactccaattcaattccaatgtctaagacttgttcatgacggacaaagcgaaaatcgaatacatacggcagaagtaaatattgtaaacaaagcgtaacggtcaattcaaaattttaggaatgcatattagcttttaaagatggatatgaaacaaacaaaaaaaatgacgaggatatttttgaccaaattgatcagatggcagcgcaaataaacgcggaagaattggaccaagaaattgaagagacacgtgacgaagaaattgtgaaaaaatctgatcttggtaagccattgaagctgcaataacacacttataagaagaatcttcagaaagtagttattatcatgatacttttcctatgaaaagtcaatgtcttgaaaaatttgtggaggaaatggtcgattcagttctacaaagggtaattaattcaattttcattttggtattaaatcaaaggaacaaataatttaggtgctggaagaagcgatcgatgtaaatgaaaagaatgggcaaaacccaacagaaataaaagaagaaatggaacaatgtgatggagaaacggacagaggccaaaggaaagccgacgaagcgcaagaggcaagggaaacggaagccgaaaaaggtgccaattttgaatga

SEQ ID NO: 73358 - DNA, 870 bp, Heterodera glycines
  Genomic contig location: Contig_ID=SeqID_10218; Location=1279..2148; Strand=+
  SCN-specific regions: Sequence locations=1-82,104-870
atgtccagacggtcgagggaaaagcgcatggaagaggaagcacagagtttactaattttaaaagccgatacaaatcaaacgcaaaatgaatgccgaatttggtcggttgaattacgcagtgatgggttcgaggagttggtgaggcgagaattggccgaagttgcaagagaattgtgcgacacggagaaagagagaagggaatggacaattgcattgcgacggaatttccatttacgcattgaacgcgggagaagtgagtccatttccattttaatgtttcttttttcacggtccatttttcaattcacagtttgtgccgaggaccaattcccaactttggccgtttccactcgtggcttggcttcactcggcgtcgatgaactgtttcttgcgtttcactttgacccctcaatttttgcaccaaatgaggtgagtttttacggaggtaataaaatgcatttcaaaaaaaagttggacccaaaatcggacctattggtactgctgcaacagtacgaactgatcttccagcagtggtttggtggacccgcaggaagtccatcagatcgaccataaaatgggaatcagaaagtagacattgggcttttgattttcaattttattcattttacttcctcaatgtcagatgcgtttctcggatgactcggctttatccatcgttcacaaaggatcagtcaatatttggccataaagcagcggcacttctgttccatcgtccacacttcaaacaggtgggcagggacagttgaggtgttgggataagaagtactaatttatcttatggtgattccaattagctccacagttatttaaaaatgttatagattttgaacagacagtatgtttagttaa

SEQ ID NO: 73359 - DNA, 539 bp, Heterodera glycines
  Genomic contig location: Contig_ID=SeqID_10218; Location=2714..3252; Strand=+
  SCN-specific regions: Sequence locations=1-63,85-539
atggcgcgtctttccggttgcattgttgcaattcgtgaaacaaccaccgtcatcattctgtcttcttgggctttggatgacattcgtcaaatagtggcgggcaatcgcaatatggtcggatgggcattggaccaattgagtgctgcagccgacgcggacgaggaggacggagttacggaagtgagtggagggatggatggtgggcttgtgcaatgaacaaccgaacatgttgggtccttgtcagatcgattcccatttggtctgtgtccaagaagaaaccgacgacggagtgacgccctctttcagcactcgcgtcttctccagtagcgaaagcaactcacaatcgacgccaattacgacaaaaaagggtgaaagaattgtctaaatacagttgcattagcgatataaacaattgggtttcttcagtcattggtgtttcatttctgatttttgacggtgcccttcgcggcagtgaacagctttcggtcagtttggttgaggatggactcgtcgttcgactaaatgccgatctgatggag

SEQ ID NO: 73360 - DNA, 505 bp, Heterodera glycines
  Genomic contig location: Contig_ID=SeqID_10219; Location=691..1195; Strand=-
  SCN-specific regions: Sequence locations=1-505
aagcatgtgacagcagttagagacaacgaaaaggtacgcctaatcagcgacatttacattctcctcattcaaaaatttaagggtaaacgaaacgatttgaatttgttggcgtccagctatttggtacaactggcgaagcggaatgtgaaattatgggaactaaacgaattcgcagacaccaaaatgacggtgaaacattcattaattgccccaattatgatgctttaactacatacagaaaacccaatctctagtaaaagcgaatgggaccgccagcggtggtggtggcggaacgacaagaaaagcggtgacagcaccgagtgagttgcgcaattatgggaggatgggccaattccttcttctcctaactatgcttttttaggttctgaacgaccctcgtcaacgacacattcaccgcgaagaactgccgacgatgccacttcaccgccctcgacaacccccgctaaacggagtcgaccgtccgtacgcagtggtggaagtggag

SEQ ID NO: 73361 - DNA, 344 bp, Heterodera glycines
  misc_feature (60)..(60): n is a, c, g, or t
  Genomic contig location: Contig_ID=SeqID_10219; Location=1..344; Strand=+
  SCN-specific regions: Sequence locations=1-282,304-344
ttgctttgcgagtccatatcgacggcgaagtgattcctcacaaactgagaaatgggtggnattgccggaacaacaccttgggtggacggtgacacttgatgaacaagtaacactgatgacaaatcacccttttatacacatatattcatttttagcttatcccttttctatatgggctatgttcctggttaccaagcgtttttttcgttgaattgcacacatttattgtgtccactcggccgcttccggctcttactgttcctgacagtcccggcgattcataacataaaaatcacaattctgtctgatttaaagtgaccgaaaatagagcccggaaattttaa

SEQ ID NO: 73362 - DNA, 315 bp, Heterodera glycines
  Genomic contig location: Contig_ID=SeqID_10220; Location=3264..3578; Strand=-
  SCN-specific regions: Sequence locations=1-315
atgcacctcggcaactgtccctgggaccgtctcggctgttctaaatgcatcgtcgtcgctatgtccaaggacgacgagtcgtctgttgatgaaccgaccccaccgcccgctgttgtaccaattgttgtaccagccgaactgctggttgacgaaacatttgtatggtgccgctggttggagaaacgccgtcgcagaatgactgccgatggcatcacatcgcaagcgaattcagaagcagcagcggttgctcgtctgccaacggcactttcgtgggaagaatcttgggagtcggagcaattgccaccacctaagtag

SEQ ID NO: 73363 - DNA, 2520 bp, Heterodera glycines
  misc_feature (1669)..(1669): n is a, c, g, or t
  Genomic contig location: Contig_ID=SeqID_10221; Location=188..2707; Strand=-
  SCN-specific regions: Sequence locations=1-363,385-753,775-919,968 -1125,1147-1532,1610-1829,1852-2495,2517-2520
atggcattgaacacgtcaaatttaatgtttttgattgccacgggttttgttggaggtttgtctaaaaagctattcgtctttataaattcacatttttggcacgacctttgttctcatcttcggaaataagacgatcgaactcaccagaaataccccacaaaatttgcctgtgggctcgaacatgcttaaaggtaaaaatgttatgcttcgagaattctatctgaagtgtatgccttggtttcgccaccctcgtcaaatacaaacaccaaatcagcaacggacccagtcaataataaatttttaaaacgagttgacacggaagacatttcaaaattaattgtattttaaaatatgtttgctcctattagaaaattgcaaaagaaattagaaggaacaggcaattgcaaaataatgaataaatagagagaaataacaaatggcacagagaatgaatgactgaccccaatgaaagggtcaaaaattgaaaaagggcagagtgaaaaataaagtggggaggggcggggggattgaacggacgtgggaaagcaatttgcaatcgataagaactttattaatcattcgtattttttaatctatgcatgcatatgctttatgtgcctgcgtcattttttttattcaaggagtatgtgcatcaacggaacgaaaagggtctttttcacatgaatttaccgtattggtaggatggcattctaatgcccaaagattgggcagagcttacctaaatattgccactttattttaaaaataaatcagtcgaagaaatattgttttctaggagaaaagcccattgcttaatgtatgaaagaaagttgcttaatgagaattgttctgtgaaatctgcttattttactgaccacagaaacgagtcaaactttcaaaaggacagagtgcaaaataaaggggggggggcgggggaaggaggagggagaggagcgagggggaggggttgagcggacgtgtgaaaggcaaaattaattggtaatcggtaagaaatttgttaaacattcgatttagggcatttttttgattttagcggcacgatggttttctttcgaaaacactatttctccggattctttatgagtatagaggtccggggtcaacctgatcatgaatttgacattttttcaacagttctgtacagaaatttataatattttattggaattgggttcgtggtttaatgttggttaatataaaatgtaatattcatgcccaacgaccccgaaaacccctagaaacaaaaaaataacaaagtgaaatgttttttttgttaaaaaatcgttccaccttgcatttttaatatttacattggagagtagacggaaacaacaaaaaaacctgataaatagggcgcgaatttttaagtttctacatattttttatgcggcttgaactcgacgagaaatgcacaaaaacacattttttgttcgaaaaactttcgttttaacgcctctattcgacccagttttttgctcatcgcaagcaatttataaaaattaatctcttcgaataaaaaaataacatttttaaataattatctaatattttaatgaaggattaaacaaaaaaaaataaaaataaaattgcatataaagcaagaaaaaatcttatttaaataatgccactcaattatcataaaaataantatattgggggtgttcggaaagttctttcatagcggtcgttttatgtaaattagaattttttagcacccaaccgcaacctttggccaaattctttctgttctatggcaaggagcagattttgctgcatatgttacgagccatttcattttcctttctttgtaaattgattttttaaaattatcccaatggagcacccaaaatcccaaatccgatcacttttattgtacgggtcaaaactttgctttgatcagttggaaatttattaaaagcagtttggccaaatcaagtccggagaatccaaatctggcctcagatttgatctctgaattttctctggcattgtactgctccatgtcgttgacaagaagttgaagcagtacagggtcatagaacagcaactgactaaatctgaggcgatattcgcattctccgggtttggtttgccaatgaaaacatcaatttcattttattatgtcttttcagaacaatgttgtacaaagtggatgctgaatcttggcacttttgagcacccattttcagacaggacaatttaaaaaaataacccgtcggtcttggtggctctttttcagcttgtcagatagtcccaactttgctctacaaaaccataatttgttttgtacctttagccttttcttggccaagaaatcagtggttgaatttgtccacttttttaagtagacccatcagtttatttgagtctaactatcttgaatttaatcgatagatcatttttaaaatctcacaaatgggagaagatggtcgagaataatggtgcgtattttgattaaaattggtttattggttaatatgttatgaattttcaaataaa

SEQ ID NO: 73364 - DNA, 1475 bp, Heterodera glycines
  Genomic contig location: Contig_ID=SeqID_10221; Location=2835..4309; Strand=+
  SCN-specific regions: Sequence locations=1-122,148-307,329-812,836 -1215,1251-1475
atgagcgaacttgtcgccgaatgtctgcaatttgacttctccgaaattcccaacatttttgctgtgttttccgaatgtctcaagctgaaaggacctaatgtgcgttgctatatataagcaaatatttataaaactcattttacattaagaaaggattaactgtatttgacttaactcgctaattaggggaaaggagcgtttcggcgccagcccaaatttttgtgctataattttttttagtttcaacgaaatcaaaccttctaaacatgctatgagttcgaatgatgccaaaagattgttgattcattgaaattaaaaataataatagcccaaaaacttgggatggcctcgaaacgacccagccaataattgtttttatttagttcgaacattttgcgcagaactgtctccgttttatcgatgccaatgccaaatcactccttttttccgacgaatttctgcacattgatcaaaaaatgttgtgcaaaattttggagcgtgatggacttacaatttgcgacgaatttgacgtttggaaggcggtaatcatatgacaattgaaactaattgcatatttattttattgttaggcaattcgttgggcgcaaaatcagtgccaagaaaaagaggatgaacaaaatgcttcggcattggatctccgcagaatgatgggagacgcactttacaaaatccgttttccaattatcgcagaaagggacttttcggactatatttgtaacaaattattaattagatttcgtttttttttgtgacatgagtccaaaaaatgacgagggcaaatgacttaataattatttgttagataatttttgtagttcccactggcgtgttggacgctgacgacgcgttgagcgtgttcgtttcgtattcgaattcgggccatacaaatgcaaaattctcaattcatccgagagttatgcaaaacactggcggttcaagaggccggctcacgttggacatcgaaaattttgaagattttttgatggaagatgaaggaaaacgagaaagtgtggtcaaagtcatcagaggacttccttggcagtttactgtaactgcaaaaggttttccggaggtcgtcgtcaaatacttggacatttcgattcagtgcaatgcacaaaacggtgatttttgcgttttgggattaattcaaaatttttgaggggaattaggtaccaccgtatagagcccccaacgaaatttattaagtaaaataatcaaaaatttattttgctatgaagataaacaaaaggtcgccgccaaagcgggccatgacaaaatggcatcgcaaaaaaattgctaaaataaggaaaaaaattatcaattacatacacatattttacgaaattttttaaaataagtttgcgattattatttttttgttaaaatgactatctgaacgacattttgtctcgatgaacttttggagtgcacgtgccgaatgcacaaaattgtta

SEQ ID NO: 73365 - DNA, 212 bp, Heterodera glycines
  Genomic contig location: Contig_ID=SeqID_10221; Location=4453..4664; Strand=-
  SCN-specific regions: Sequence locations=1-61,125-212
atgagcaaaaaaggctgtagctcgggggtaagggctcgctccatatctcaccctcgaaaactttttaaaaattttcaaacttagaaaatttcaaaaaaattcaaaaaaaaatgaaaaatttttagggaatgttttgtacacccacgcccttgcggttatactataataattactttggacgtgacgaaatcgtcaatgtgaaaaagatttga

SEQ ID NO: 73366 - DNA, 504 bp, Heterodera glycines
  Genomic contig location: Contig_ID=SeqID_10222; Location=57..560; Strand=-
  SCN-specific regions: Sequence locations=1-257,279-504
atgccaaatttcgatcttgcagcattgatattaactgataaaaagcattcctttgacaggtgcattgaccaaaaagtcgtcgaatttctccgtttcaatcatcaaattttcgatgaaaaaggcaccgaattaagtttgaaaatttattcctcacaaaatgccaatgtcactccgatttggagtgtttttgttcgtgaaatttggcccatttttgcgacaaacattcgccacttcgcctttcctaatagtgatcatctcagcaaattgcttttcctcacttcgccaacaattctcaccgatctcaatcagttgaactcaatccaatcagttgatctgttcccggacgtgcttggtgatgatgatgggccaaatgcagcttattgtgctcgccaagcattgttcaaatggttgcacactccgagaaaagacgagaagccgaagcgattgagttgcattatttatttcacatcacaaattaaaaacaggatcaacaatttcaaggag

SEQ ID NO: 73367 - DNA, 1550 bp, Heterodera glycines
  Genomic contig location: Contig_ID=SeqID_10222; Location=944..2493; Strand=-
  SCN-specific regions: Sequence locations=1-44,69-72,94-118,142 -159,184-186,208-285,307-762,786-907,929-946,968-1000,1095-1186,1216 -1245,1267-1298,1321-1350,1379-1550
atggaacaagaattatccaccgccgtcatttcttctgccattagagaaaatcagcagcagcagcaaccgttgtgttcatttgtgaaaacatcttttggaaggcgacggcattggtaaaaatctgtcactaaataataaaaatgctcagttttttatcggaattttaattttattttttttttacctttttgcatgtaaattttaaaaattttgtgcctaaatgtccgggatctatctattagattacaaatttttcatcatttcctttttaagttatcacatttttggtgtgattatgaaaataaatcaattagtaaaaccattttgtgccttttttatatgttaattgcaaaattttttatttccaaggttatttttttcacaatttcagttggatttgcagcgatgttttgatggacattttcccctttttcgaccatgctcaacttggtctaaaattggcactgatttcgccacgtttcgatgttttagtggacacgcatttcaatggcaaaaacgaattgaaaatttggagaccaatcgcgattcacaatatggggacaacaacaaaaatagagaagcttggcatctttaccaaatttgtgcaatttccaattccgcagcgtccgctgcacaataaaatccgctttgaacttcttgaaattgagtaagttcaaaattttattgaccaatttcggtaatactgtgttttgttccccccccccctttttcgaaaaaattttttcaaaaattttgatgtcataaaaacaagtttcctgggcttttcaaggttgttgatcacgaattgcgaaattcgaaaatttggaattccgactttttgttagaattcgggtccgggtttcggaattggccgaaatgtatgccggattcgtgatcagcgagctcgaaaagcccaggaaagaaatttttgaaatttttttttcgaaaaaggggaggaacaaaacaatattaccccaatttctcccatttaaagaatggcaaattaaaatttttttcttttaaaaatatgttttttaaaacatcaatattgacgttgatatttttttaatatcaatattaattttaaaatttaagtaaatgtaaaaactattttggcgctaaaattattgtggagagggaaaacgcaaaaatgagagagtgctaaaattctgtactatcatattactttaaattgttttaaatattaatatttaacacggcgagtcaattttgggctccaagtacaaataagtttattatttatttagtaatcagaacgccaaaactttgcaaaacttaaaatttattggggattttcccttgtaaaaatggaagagtcgatctcgagttagaaaagaaactttcaaaaaacaaaagagaattcgatagagagggccgaaaaactagcctaggcaaaatttcaagaaaatcgcaactttggaaaaatttttacgactgggcaaagttttttctttttctctcattttgacgcactatttccatgtctctaacatataagataacacatggttcatttttttgccaataaa

SEQ ID NO: 73368 - DNA, 672 bp, Heterodera glycines
  Genomic contig location: Contig_ID=SeqID_10222; Location=3296..3967; Strand=+
  SCN-specific regions: Sequence locations=1-351,373-672
atggagcacagaccgcatgctgatgaacagaaacgtcagcgagcacgggatagtactattcaacgtttgagatggtttggagagcaattaaataattctttttttattcgttatgtttctatttttaagccgtcttcagcgtgaacaggttcacgcacgacgtgtggcaggggcttggacagcagcttgtaattatgatggtcatggtactaatcaaggagatgtgaactttgaatgtgcgcgcaatcgtcctagaggacgttcatgggggagttggcagctagaaatgggaacatttgcaacttttgttccgcccgagaattacgcttttccaccgccgatggttaatggatgccagcgggcaggggccgcaatggttcgttcccagagaacgtcggcgccgaaaagtacggctttgaagcgtagtaaaactatgtaaataaattgatattaactttattggtcatccattgtttgattgacacaccctaattttaagagttccaaaatgttgcccaaacacgttattttggaatgtctgtgtctgctaccaaattggagggaagcagaaatgagtgtcgacgcgttgtgccaagtgcgcaacgttcaggggcggggcctggcaatgcaaacaagttcgtgcaaccaattgcttttgtttgtaaagtataa

SEQ ID NO: 73369 - DNA, 387 bp, Heterodera glycines
  Genomic contig location: Contig_ID=SeqID_10223; Location=1556..1942; Strand=+
  SCN-specific regions: Sequence locations=1-60,82-387
atggcacggtgcccgttcctgtacatcatcctcatccctcttctcctgctggtgctcatcaatttccctccaattttggcatggatattgaagcgagacgatgtcctcttagcttattctccaaatgaacttaccacagatgaaacgaaaattattggtgaaaagcaattgtgcccagccagagaatggtctttggaaaaaacttttgggcttcccattgaaccgaattctgaatttggcaaaatgttgcctggtctttctacagaattcaaccatgcacttcccggcattggaaaatctcttgaatacatattatgtacctttgacaagatgcactgtcgtcaggtgaagctagcgagtttcttagaaactgccaccaataaatag

SEQ ID NO: 73370 - DNA, 873 bp, Heterodera glycines
  Genomic contig location: Contig_ID=SeqID_10224; Location=854..1726; Strand=+
  SCN-specific regions: Sequence locations=1-138,168-246,268-281,303 -560,600-801,823-873
atgccattttgggccgagtctgttgacggaggagtagtgacaaaaattgaggtaattcatcatacccactcaaacggtgctaggtcgtttcctaaaaaccgccacattgggcgtttcctaaaaaccgccttctataagaatattatttttcaaaattttttaatatagcataaaaaagttatggttattaaattccacaaaatcttaagtcggaattttttttcaataacttttttaaaactcaatgaaattttttgaaattttaaaggtaaatagattaaataaagtacttgaaattctaaaaagaaaatttaatttaattgcttttgaaagaagttataaagtattgaacaggatatgctttttacgatggtcatgcgaacatttaaaaatttttaagtcaattaaaaaatacaattaagtcaaaatgaatttatatattcgattgtcctaagaattctctatttatggttaaaatttcaaaaaatttcattgagttttttaaaagttctcgacaaaaaattccgacttaagattttgtgcaatttaataaccataacttttttacaattttttaaaaaaaatttaaaattaatattcttgtagagaacaccttgtgctatcgaatgataccaagaattattaattaggttgaacttaggccaagttatgaatttatatgtcttacatttttggttttactaccacttggcggtttttaggaaacgacccagcacgatttaaaacgaccgacaaagctaatggaattgaattcattgcttaagatcacaaaaccaggaatgactaaaaagtcaaaaatgaattgatattccaataagtaaaaaaattctggaaaatcacaatcgaagtaaa

SEQ ID NO: 73371 - DNA, 688 bp, Heterodera glycines
  Genomic contig location: Contig_ID=SeqID_10224; Location=1..688; Strand=+
  SCN-specific regions: Sequence locations=1-106,156-187,234-271,293 -309,444-650,679-688
agatgcatgccatgctgcatggatcattttcagtacacatgtgtcaacgattggaaggaggtcatttttaattgcaaatttcacactttaaaaaaaatcatttgtcattttttgattatttaacaattttttttgtctatttattattttattttgtgcggcacgcgcacggtttttttaaaacgatccccccccccccccccccccctcctacaaaaaattaagaaaaatttcttatggtttgaaaaatatttaaagaaattccgataactaagtttaattttttcaagtttatgaaaaactttttcgaaaaaaattttaaatgagtatttagaattttttaaagaaaaaatttttttaataaaattcaacaatttaacatttctttgtttgatttctatgaaattttatttttcatttaataatttattaatttaaattttcggatccgctgcgcaattgaaactcaaaatttttgctaggccgaatatgattaacccacaaatccgcatttaaactacggaatcccgcgcagggattacgggattttgaaatattgaataaattttacattcttattcagcttagaataatcctttgttttttataaatttcccatcaaaaggttgaggcaatgtttccgaccacaaccacaactacgaccacaacaactacaacgctggcccca

SEQ ID NO: 73372 - DNA, 2325 bp, Heterodera glycines; identical to SEQ ID NO: 10225
  Genomic contig location: Contig_ID=SeqID_10225; Location=1..2325; Strand=+
  SCN-specific regions: Sequence locations=1-239,296-376,401-428,451 -484,508-524,603-751,780-810,833-886,908-942,964-972,1026-1169,1196 -1200,1222-1298,1363-1533,1557-1561,1614-2325
  Gene Ontology: Mol. function=structural constituent of muscle; Cellular component=striated muscle thick filament; Biological process=striated muscle contraction

SEQ ID NO: 73373 - DNA, 1501 bp, Heterodera glycines
  Genomic contig location: Contig_ID=SeqID_10226; Location=1009..2509; Strand=+
  SCN-specific regions: Sequence locations=1-216,243-296,318-358,381 -417,439-480,606-727,756-785,807-835,884-957,1023-1043,1091-1129,1161- 1233,1290-1438,1482-1501
  Gene Ontology: Mol. function=ATP binding; Cellular component=striated muscle thick filament; Biological process=striated muscle contraction
atgaaagagacattagccaagcaggaacagacacggaaagctgtcgaagcggagcatgccaaggtggcggaagagcgcaaaaagttgcaagaggacttggaacggacgcggaagggcggaagcgcaatcgaatcggaagtgatggtgagtcatcggtgttttaaaaaggcggaaaatagggaaaattaattatttcaaaaaatggcagagaattggtaaaattaattaattatttaattttacgctacgcgaatgtaagaatggaaaatacaaagaatttagaaatatggaatttccttaaatttcttaaaatattttgttgtagcaaaaaaatttttgattggtctacgaaatttcaataattttttacatattttgagaagtattaatataattttaattcaatattcataggtaattagaggcaaactttacattgacaggcaataaaattgaaacggtttattttataagtagaccaaatttaaattatttatttaattgctaattgttttttaagtcaatttgaattaaattagttttataaaaaatgtttcaaattcatttaaatgatttacaataaaataaatatattcaaaaattttgcccaataaaacatttagaatttaaacacggcaaaagtgcaattggagcgccaattggaggatgccaaagatcggctggaggaacagcgccaacgcgcggaagagacacaacgcaatttgaagagggcagaaaaagaaaaagacagtcttaacgaacagattgggtcactagagcataacttgaagaggtagagaaagagacagaaacgccaaaaattaggctcacaatcattaaaaaatattaattttacttattaattaaaaaataaatttaaaatcccgccaaagaatgagcgaaattcgggttcatacacaaaatggttttatgtttcgaattctgcgcattggacagattttttttcaatttttattaaaatttctgaaattttaaatttaagtttatattttcattaaaaacaatcgcattataaggagctcaatttttaaaatatattttttaatatttttaaaaaacaatttaaaaagaactttttcttttatgtcgttgaaaaatattttatcggcatttttagcatattaaaatatctcgaagttctcattaaaaattacagggcttaggttctgtgacactgattcaaaaaaaaaactaaatattattttgatgaaattattttttaattttaatttaatttattttttaattttaaattaatttatttttttagagttgaggaagacaaaaagaaaatggacgaccgcatcaaagaaaatcatgaggcaattgcgcagcaggacgaggccattgccgcggcaaataaggagcgcagaagggcggaggaggaaaaccgacggatgggcgaggaattacaggcaaattaatgaattaattaatttaaattaaattaataattattagggctgtgaattttatgtaa

SEQ ID NO: 73374 - DNA, 937 bp, Heterodera glycines
  Genomic contig location: Contig_ID=SeqID_10227; Location=83..1019; Strand=+
  SCN-specific regions: Sequence locations=1-51,73-125,153-157,179 -205,231-245,299-386,408-487,527-701,723-803,833-903,927-937
  Gene Ontology: Mol. function=structural constituent of muscle; Cellular component=striated muscle thick filament; Biological process=striated muscle contraction
atggagaagaacaaaaagaaattggaatcggaagtgcatctcgttgagggtaattaattaattaatgagtgtctcattaacatggacaattagagctgattaatgcacaacacttttaaaaaaattttgtggtttttatgtagtaaaatttagtttgtttatattattttattttttacattttccaattttttcaactggatcttttatgaaaaataattttaaacattttatctgcaaaattgaatttttttttttaaagttcttaaattatttagtatcaaaattttaattattactgaattttgatatgggtcaagaatttataaatggacattttagcaacgaaaaaaaaaatatttgtcgaccagtaggaaaattttcaaaaaacatattaattctatggcaaacaaatataactctttgtagagctttctaattttcaatgtccttgaaaaatgcttcgactcaaatttattttgtcaacatttaattttatattttcaatctaaaataatttatatttctgcagaacatattgctgaaatgcaaaagcaaaaaggggacacggaaatgcgacagcaacgcgttgagggcgaaatcatggatttgaatggcaaattggaggaacagaacggcattgtgggcaaactgcaacggcacctgaaggatcgccagactcgtctcgtggaattggaggaagagttggagcaggagaggaacaggcaagtgccaactgtgaattatttgtttttgttggcattttttgattaaatttaatttgaattatcttaattgttccctaaattttgattattaaatttttaaataacagaattattgtatatgaatattgagtattggaatttcgtgatcattaggcatttcatttcttgccaattcaaaattaattaaattttttaattgtcaactaata

SEQ ID NO: 73375 - DNA, 108 bp, Heterodera glycines
  Genomic contig location: Contig_ID=SeqID_10230; Location=1448..1555; Strand=+
  SCN-specific regions: Sequence locations=1-21,43-108
atgaaactgatttggctaacctttttaccttatttttgttttgcggctgttgaggtgcaatacaagtgcgaactttttggtgatgatacggcattgccaaaatcagag

SEQ ID NO: 73376 - DNA, 552 bp, Heterodera glycines
  Genomic contig location: Contig_ID=SeqID_10232; Location=86..637; Strand=+
  SCN-specific regions: Sequence locations=1-122,144-246,272-352,374 -391,414-440,462-474,497-552
atggaaatgccaatttgtgcttttcttcgcgcccggaaaaggaccatctcattatgcggatgcacatcacatattcaagctgaacgaaaatttaggtgagagtaagagtatataggtacacagagggacatgctgggattttttaagcaaaaaaagaccaattacaacaaatatactaaaaaatctaaggctactgaatgataaattgatgaaaaaacaactataaatagttcgcaacttttataatttaactattttttaatcatttgttttgaagaaatcagcgcaaaaatttacgaacaatgaaatttttaaacctaaaatttttatcaagaaaaacaaaatgttgctgataaatttttgaaaaatttttcttagcggtgtatttctgaaactttttcagttcattttcttaggggagtatttcctcgattttattgcattttttaatggaattttttggaaaaaacgtcaagaagcatcaaaaggtcaaaatgccaaaaaaggcatttataaggcattaaaataccgaaaaaagggaaaaaaagcaca

SEQ ID NO: 73377 - DNA, 1405 bp, Heterodera glycines
  Genomic contig location: Contig_ID=SeqID_10232; Location=1042..2446; Strand=-
  SCN-specific regions: Sequence locations=1-24,47-345,367-434,456 -1207,1229-1370,1392-1405
atgactgagattaaaaataaattcaaacaccaaaaaatttgggcatcggttgatgagacgactgattctcgtggcagatatgtcgcaaatttgatcattggcattttggatgggaaattgcacaaaccgcatttggttgcggccaaatttctggacaaaaccaaccatgaaacaatcgctcgctttatcaacgacaatttgagggagctaatttcagctgacgaccttttgttacttgtcactgacgcggcacgttacatggttaaggcagcacaggttaacaatgaaaaatttataaaaagtgctatctatgtaaaccaatttttttaagggcctcaaaattttctatccaaatctcattcatctcacatgtttgtgccatgggctccatcgtgtgtgcgaggaaattcgtggcctctttccaaatgttgacaaattgattgcaagtaccaaaaagactttttcaaaagcgccatcccgcttggccaaattccgcgaacgttgtgatctccctctcccaccgcgcccaatcatcacacgttgggggacttggctcaacgcagcggattattactgtcaaaatcttaaccaaattggtgcgattattcgggacttcaacccatccgattctgatgctattcgccaatcacaaattgcctttgactgttcaggcattcgtggagatttggcctttataaaatcacattttgacattttacctggagcaattgaaaaattagaatcacgcaatctcacactcattgaaagtttgtgaaaactcgatattttctatgcaaattttctaggtttggacttagtgagcgatgttggaaatgaattgcaattggtaccgggcaatgtgggcaaattggttcgagaaaagtttaacacggttttgcgaaacaacccgggatttgatagaattttggttgggtatatatacaaacagtttttaaaactcaattttttctaggaaattggtatggtgcttcgaggggaagatgttcaaacacgtttgccgccggacgttattgcaatgttcaaatatgcgcccattcagtcgtgtgaagtggagcgttccttttcagcatacaaaaatattctggcagacaatcggatgagctttactccggaaaatctcgaaaaatttctgatttgtaacacgcataaaaagaaatgaccatttttactgccctaaaatcgttgataaaaattttttatacttatttttgtacttgtttgatgctattttggcatttttttttaacatattttggtacatatttgaagatttttgtacatatttcttacatattttggcattttttaatacatatttatgtacatattttgcgatttttcttacatataaatctaagccctaattataacaaaatgtaataaa

SEQ ID NO: 73378 - DNA, 1715 bp, Heterodera glycines
  Genomic contig location: Contig_ID=SeqID_10234; Location=629..2343; Strand=-
  SCN-specific regions: Sequence locations=1-23,45-269,291-334,375 -486,550-562,587-692,765-795,817-960,1013-1223,1246-1404,1437 -1562,1584-1715
atgtgtggagaatggatgagaacagggatgggaagggatggaaaaggagcaataaatgagcaaaaagcaaagtaaaacgcaaacatttttatcgacatatttattttgttttatttttcagtttatctaattagtaaatttttaactttagattttaaaagtttcatttgaattgtaaattgtagcctgccaaattattacatcatgacgcccaaacgagtaaaagaaaatcctgaaatcttaaaaaaatctattttctttttttcatactttggcttaaattttgaagccaatggtgacgagtatgttcttatttaaacttatcggaaatttgattttttaaaattataatcttttatttaatttaaatatttgtagagtacaaaataatcataaagacaatagattaagagcaaacataattaattatcaaatttgcaaaaagattgttctaaataaattaataaatgttatttctatggcatcattaaatttaaacttaatatttctaaagtaacttttttatattgaattagataaaatattaatgaaaattctctatgattttttgttttattgtttatttcaaaaaaattctgaataatatataatgtttttcaaaatggaggtaataatttatgaacttggtcaagtggaatgaaaatgaatttaattatttatgagctatgttcaattatttttgataaatataaatatccttaaaaattatgtttaaaatttcaatttaaatatcaaatttaaatggaaagctctaaacaatgtcatttcacaatctataaatgtaaaaactacaacggagaaattataagaaaggaaattacacagtaaggattaacaaattttattaacattttaattccctttaaagttctctcaacacaattggctaaaattgaaaagcagtataaagacattcttaagcaaaatgtaataaattgcattaaataatattataattataataattataattaatattataacatttaatgtttgattttcaagaaggaaatatatgtttgccagctaattgtaagtaacggaagattatatttatgacgactatgttttaacccgaaaaatacaaagaattaatcataactctgtttcaacataaatcaaaaaaataaaaagcaaataccttttatatttccaaagtaaaagaattataaaaagactaaaagaatacatttcttcagatgaattaatttttatattttaaatcttcagagaatcagaaacgaaggtgagagaacattcaaagatagaagcgagagagtgtagggatggatggatgagaggtggaatgccacactgtgaccagtggtcacaatgtagcgtcggtttgagacgggtgatttatttcagccaccaatacaaatgatttattttattttttaattatttttataaatggaattgcgtaaccgaaaaattaaattaacaacaaattcaagcagtacaacagacaaaaagcggcggcattttccccgtgaacttctcaacgaggtgtcaaaatggctaacatgctgactaattataaattaaatgacttttaattacagcaaaataattcttaatgtaaatcccatttttttaatatttcccgtatattaaaaaactcaaaaactatgtgtactcattcttaaaatgcaattacatgtaaggtggtgaatacaacagtatttaataaa

SEQ ID NO: 73379 - DNA, 1179 bp, Heterodera glycines
  Genomic contig location: Contig_ID=SeqID_10234; Location=4697..5875; Strand=-
  SCN-specific regions: Sequence locations=1-50,73-86,128-251,316 -402,442-631,682-713,735-749,772-813,965-1057,1088-1145,1167-1179
atgtcgaataagtaagttctcgatttaattgagcgaatgaaatttattccatttaatttttaaataataaatcaactcatttgctgtaatttaaatttaaaaaaaaaatacaattaattaaatttaagaattgactgttggaataattgaaaaaagttattatctaaaaatgagtatattggaattaaaaaaaagtgattaataaaagcaacccagcacttgcattataattaaaatgttttcgagaaaacaataattattatatttaaagttaaataaaatatgactaataattataatatttttatattttatcttttgatagctataaatatgatcaaaaatatacgatttgaaaattggaattcattcaatatttaatcttactttttaataaacgatttccttaattatttaattttaaaaccatgattgtaccctttttaaccattattgtagcttttcgacagtggttgtacttcttctaatcacagctgtatctcttctaatttttgggaggccagaaaatttcatgataatataatttattaactttatgaaaaggaaaaaattgcaaaatgatcgtcataattaataagctatacatttttctttatcagaattatctatgtaaaaataataattaatttataaataatttttcattatttatcaatttaagcaattgtttaatttagctttcatgatgttttaatcataaattcattttattattaaattcattattgtttctcattttatgtgatttttgaagtgaaaagaacaaccaattttttaatttaattgtgaagcttatttttttataacaataatattaaatttggttaaattaatttaattactttttttaatctttatattccataaatttatttaaatttcttcatccttaaaaaaatatataaaataatttattaatataaatttaataattacttatttagtttatctctgtatttaagagatcggtcatgtgccgcggccaacaatgaggcggtgttatgggatggtgatgtagatatttacaagtatcataatttattataaaatgtatttaatgcttttattgtccttgaaatagtttacaaacatttaatttttagttttttaaatttttgttttgcttcttattttaatagaaaagaataagataataaa

SEQ ID NO: 73380 - DNA, 504 bp, Heterodera glycines
  Genomic contig location: Contig_ID=SeqID_1412; Location=236..739; Strand=-
  SCN-specific regions: Sequence locations=1-150,172-504
atggtagagaaggggaccgaaattcaaacataccgaaatgaacttaaatcttttcaagatgaagtagataaagccaaaaacacaacattagagcatgtggaaaagaatgacttgaaagaagcaaagaaatcagctgacgtcgcaaagggaatagccaaacaggcaaaaagcaaatattcatcaactctcgaggaatataatgataaatcggaaaagggttatatcggaatagtgaataggcttaatgaggctttgggtgagcatattaaacgtaaagatattgaaaatagacaagtatctgaagctgagaaaggaccacaaaaaagagagagactagccaatgaggatgttcaatttcaatatgacagcattgatcaaaaatttattgtctatctttccgctgctgtctcccacatagatttgtcaaaacacctcgcctatgtgcttggttttaagaacacaggttatttcatgcggaagaggcgaattatatgccagatttga

SEQ ID NO: 73381 - DNA, 362 bp, Heterodera glycines
  Genomic contig location: Contig_ID=SeqID_1413; Location=566..927; Strand=+
  SCN-specific regions: Sequence locations=1-362
atggcagcaaatccgacaattgatgaattgacgaaattgctggccaagcagcagaaactagtggaacaattgctgattgctcaacagacgaatgccgcgccagctcaatcaactcaactcccagctctttcaaacgtcgaatgttttgatcttgatgatcaatctgggaagaacatcgaaagctggatcgaccgttttgtgttggccctcgactgctcttcaccaaacatccaggaccaactgaaagtgaagctggtgctgacggaattgagcgagggagcatacaacgaatacagcaaattttgtcttgcgaagaaggcgaccgagttcgacttttcggagacatcggcacaactgaaaaa

SEQ ID NO: 73382 - DNA, 4426 bp, Heterodera glycines
  Genomic contig location: Contig_ID=SeqID_1414; Location=590..5015; Strand=+
  SCN-specific regions: Sequence locations=1-3151,3173-4426
atggcagcaaatccgacaattgatgaattgacgaaactagtggaacaattgctgaatgctcaacagacgaatgccgcgccagctcaatcaactcaactcccagctctttcaaacgtcgaatgttttgatcttgatgatcaatctgggaagaacatcgaaagttggatcgaccgttttgtgttggccctcgactgttcttcgcccaacatccaagaccaactgaaagtgaagctgatgctgaccaaattgggcgagggtgcctacaacgaatacagcaaattttgtctgccgaagaagccgaccgagttcgacttttcggagacatcggcacaactgaaaagtttgtttgccaagccccaatcggtttggatcgaccgatacgaatgtttgcgggcatcgaagcaggacgatgaagactttcgttctttcgtcaaccgccacaagcggctgcttcgcgattttgattttaagaagctgaacgaagagcagttcaactgccttatgcttctgatcgctctgaaatcgccgaaagacgccgaactgaggaagcgaattttgggaaagctgacagcagacggcgacaaagcaaagtacgaaaatgtcgtcagtgacttgcagatgttcctgtcaacaattgctgaagctaaggccattgagcgcccatcccattcgaatgttttggcgatcaatcggagaccatttcagaagagggaaccaaacaaaagcccaactcagcctacttgttggcgttgtggcggtggacatgaaccaagatgttgtcctcatgcgaaagcaacatgccgaaaatgttcaaaagttggacatttgcaaaatatgtgtgcgcgtcatcgagaatggctttcgaagcattcgagaaagccgacgcaaggaaaacagatgaatgctttacaactgggaggtatttcagtgaacgcactgaaccaaccgagccgtcttgtggaggcaccagttgatgtgaatggcaaacccattaattttgtgttcgatccgggagctgagataaccgtgatcgacgaagaagcacatcttcaaattggacgtccccgactaattctatgcagcgaaagtgccaagtaccacgatggaactgaatgcaccctgctggggaagggttttgcgactttcacgttcggaggacacacacaccaaggacaattttatgtgaccaaaaagggttcactaaatttattgggaatcgacattttggacgcttttggcttattggacacattcagagccaaagttaaaatggcaatgaaagtgaatgtcgttaaagcgggagggaaggaccgaatgaagagtcaaatcccaatgaagaaggacacgactttgctcgaccttcagtcaaattttccgcatgtttttgcagaaggcctgggccactgcaccaaagccaaagcccatttggaactgaaggcagatgctgttcccgtgtactgcaggccacgtccagtgccattcaacacacgtttgattgttgaggccgaattggaccgattgttggcgcagaaagtgatcagaccgatcgatcacacccgttgggccgcacctattgtggttgttaagaaggccaacggagcagcacgcgtttgtgcagatttttcaacgggcttgaacaacgcgttgcttttgaatcagcatccattgccgttgcccgaagacattttctccaaattgaatggaggacgaattttttctcagatcgaccttaaggatgcgtatctccaggttgaattggatgagaaatcgaaagaactgtgcacaatcgccacgcacaaaggaaatttccaatatttgcgcttaccatttggggtgaaatcagcgccagggattttccaatcgatcatggattcgattttggccgattgtcagttcgcttttgcttaccttgacgacatgatcgtggtcagtcgttcacatgaggagcatcgaaaacatttgaatgaagttttcaaacgaatcggaaattttggattccggattaaacccgacaaatgctttttcaatcagagacagattaaatatctcgggttcgtcatcgacaaaaatggaagacgaccggatccatcgaagattaaggcgatttctgaaatgcccgtccctacaaatgtttcggagcttcgatcatttttgggaatgatcaatcattaccaacaatttgtgaagaacatgcgatttcttcgacagccgttggacgaacttctgaaacaggacgtggcttgggtctggtcaacggaatgccaaaatgccttcgacaaaatcatcgaagtgctgaaatctgaccaactcttgacccactacgacccggaaaaggacatcattgtatctgccgatgcctctgattatggaatcggagcagtgatctcccatcgttttccggatggcagcttgaaagcaattgcacatgcttcttgctctttgtcgcctgccgaaatgaactactcccaaatcgaaaaagagggattagctcttgtctttgcagttcaaaagttccataaatatctttttggaagacacttcgtcctgcaaaccgaccataagccattgttgaccatttttggtaacaaaaagggcattaaagcgtgtacagcaaatcgcttacagcgctgggcactcatacttttggcgtatgattttgagatcgaataccaaaacactgccgattttggtcaagccgatgctctttcgcgcttaattgcaaaaacgccagggcccgaagatgaatttattgtggcaacaataacggaaagccctaatttggcaactgtgaatgcctttacggcacaatttccaattgtccacgaggacattgtcaatgccactaaagccgataatttgcttcaggaagtgaagggattcatcctgaaccaatggccaaacaaagcgaatatgtcagaggacattttacaattccatcgaaggcgagaagctctttcattcgaaaacggatgcattatgtacgccgaccggattgttgtcccagcatcgcttcagacggaagtgcttaagatgctacatcgcggacacccgggaatgaagcgcatgaaaagtctcgcacgccagcatgtttactggcccggaattgatcaccaaatcgaagaagtggtaagaaaatgtgagccttgtgccaccgaagcgaaggcgccaaggaaaacggagctaaattcttggccaaaagcggaagggccatggaaacgtgtccacatggactacgctggtcccttctttggaaagatgtacctgatcattgttgacgcacactccaaatggccggaagtgttcgaaatgcgttcgaccggatcagcagcaacaattgaacaattacgttcattgtgcgctcgttttggactgccggagactttggtcactgataatggcacccagtttagctccaacgaattcaaggaattcgtcaaagaaaatggcatcaaccacctcttctcagcgccatacaatccgatgtccaatggacaagcggagcgctttgtcgacacctttaagagggcatgtcggaaactgaaaaaagagggcgcgcaaaatgtggtgaacacatttttgacgtcataccggacgacgccgaatgacgctttgcccgatggcaaaaaccctgccgaacttttccttctgcgaaagcctcgcacaacattggatttgctgagagcaaaaccatcggcaccactgatcagagacgaggcgatggaaaagcagttcaatcgtcgttttggtgcaaaacctcgaaaattttgtcttggcgataaagtttttgctcgtcatcgccaatcgcaatcatggcgcgctggaatcgtcagccaatgtcagggagtcatttacgaggtaaagttcccgaatgacacttccaaccgattccatgcaaaccaaatgacggcccgtcatacggatgatgatgaccatggcaacgaagcgttgaacattttcaacgacgcttttggtcttccgttggcaccgccggatggtcccaacgaaacagctctgccagctgatcaacaagcggcacctgcacaagagacggacgaagcaaatgctgaacgaggccatgtccgtgtcgatcgcccgcaacgcaatcgacgtcctcctcaacgctattctccgagttgagcggactgatcactgatcaacggaccgatggatgaggacagacttttattttttttaaggggggagatgttgggaagggtactgatttgtcccgcttaattattatttaattcctttctatctcttcccctcccactctctctctctgttgcctcctccataaatacccccgtccctttgaccatccgttcattccctcatttatttgttgtatgtgcccaactccctcaatcgatactcctgcccccatttctcttctttatttaattgtgtcttcaccaaaattgga

SEQ ID NO: 73383 - DNA, 922 bp, Heterodera glycines
  Genomic contig location: Contig_ID=SeqID_10235; Location=122..1043; Strand=-
  SCN-specific regions: Sequence locations=1-589,632-922
atgactaattgggcaccactcacaatgcctttcagaggtatgaaatggcggtgcaacagcttctggaacagaagggcgtcgtcaatggtatcaggtgaatgcacttttctggttatttaaatgaccaattctttccctctctcgcttaattatgcaaagttcgttcagggatgctttggtcttcgcggctggtgccagcaaatcatcagaagttcaccatggacgttgtgcgagtgaggataaaatgcgtgttgcggtttgttaaagtaattgagattaagcttttaaacaaatttatttcagatgagggacagcggttcagtcatcacatgctctatatgcctttatccaatttacaacgacgaatccgtctttttcctgtcatgtggccattgttatcactcacaatgcctttcgaactggatcgttaaatctgtgcctccacagcgtagctgccctctctgttacccactgtttttatgcaattgttgtaaaatacgttagtcctcatcgttgccaaatgatctcttagaaattaaacctcacttcatcactgtctgtcctttcaatattgttgttgtcttcgcccatttataaacatttatttatcaaaatataaattttaattaatgggaatataacaaatgaaaaaaaacataaatgttttgaaactctatccgtggtcactgccaatcgttgccccttctcccgaccaccgatgcgtccatcgtcaggcacacactttcgtagttcggtacccgaacaccgtcacgccgcgcgagtgataccgaagactccgttttgagtcgcgatttcgtcaaaccgcgccttgcactcgtccctcacggcgcagttgggccaattgcacatacgcaaaattttgagtcgtttttcgttgacaaaaatccgaaaagaaaataaa

SEQ ID NO: 73384 - DNA, 271 bp, Heterodera glycines
  Genomic contig location: Contig_ID=SeqID_10235; Location=1..271; Strand=+
  SCN-specific regions: Sequence locations=1-110,133-271
taaggttcgctggcgttaaacaattttgaaaggcacaagtccaattcgaccatcaaacaggacgaaattacttacagaaaccgagtgagtggaccaacgagattttttggttacgtaaatatttattttcttttcggatttttgtcaacgaaaaacgactcaaaattttgcgtatgtgcaattggcccaactgcgccgtgagggacgagtgcaaggcgcggtttgacgaaatcgcgactcaaaacggagtcttcggtatcactcgcgcggc

SEQ ID NO: 73385 - DNA, 1526 bp, Heterodera glycines
  Genomic contig location: Contig_ID=SeqID_10236; Location=1744..3269; Strand=+
  SCN-specific regions: Sequence locations=1-185,208-354,391-432,480 -567,589-747,769-1526
atgtgcctttctcgattgggacaaatcatttatgggggactcgctcttgtcacgattgttctcatttgtgtgtcgatgttcacagacggtgagtgaggagcattttctgtgatggtcagagaaagatttgtttgaatgcaatttaaaaaatggaaaaacattctttgtttgggttccgtttttgtcaaaattttttcttttattgaaccattctgagaatttatttcaccaggcatttctgaatttttgggggaatttggtgcattttataaattctttttacaattttttgctgcgtttttcaaaagtggaggcgcccggtggtgccggaaggcgcccccgggaaatttttggtttattgtgtttaaaaaataaacaaataaaattttactgtattatctatgtatctcgagatcaagttttactaaattcaaatataatgttaaacaaaatacaaaaataaattatttttttaaaatgtgctgctctagttcagtttatgcttccaagcatatatgaatagaatatgacgtggtttatcataaaatagcaaaaattccttgtgttaatttgaatataccattcgaagagaaaacttaagccaaaaacgatttcgaccaaaacattggtcccattttgacattatgtccatattgacattttcccaaaaagcctctattaaaacggcctccttcagctaaattggcctttttgctcctaaagataggaagattttccgaaaaaataattttttaaggaaatttctcgagaattttgttaggtaaattataaattttcttaaaagttggtaatgtgccaaaaataagcaaaatatctcaacaaaagctttcgaatgatgcctttatcaggcgacttttctaaaaatctccaatttaaatcaaggggacttttagccccgttctttcccgataatagtcaaatcccggtcacattcttatttgttgtccctaattactaaaatattcaaaggatggcgcaaactcaattcttcctcgaacgccaccggcactgtgatggattttgttgagaatccgacggtcaatatggggctgatgttctgcaaagggccgacgatgggcgtcaacggcagcgcatcggccgacggtgcgtcggtggcgcacaacgaaaaggaattggtggatgtgtgcaaggaatggttcctggtcagctccgttgaccaattgccagcacaatttgtcccttcaccacagaataaacccgactgggagaaattcgttgtcggtgcgatggtcgtctctttggttttggcctgcctcgcgttcatttggaatttggtcactttctgcgcctgcttttgccactcccacgtgatgaaaccgttgcccgggttggccggactcaccgccatgtgtttggcagtggcactcactgttttctacatgaaaaaccagcaatacatccgtaactcccgttgtttgaatttaggcataaaacaatgctttggttttagcgatgatgaaggacaaacagttcgacaacactga

SEQ ID NO: 73386 - DNA, 685 bp, Heterodera glycines
  Genomic contig location: Contig_ID=SeqID_10240; Location=334..1018; Strand=+
  SCN-specific regions: Sequence locations=1-137,159-590,612-685
atggttatgtgcacatcttctgacatcagtgggaagggactcttctacacaatttcgtttaatcgatcagtgataatgcacattctattgatcatcatatacatcgcaattgttctggttttaaaattcaaaaacggtaaaaaaataataaatatattgtaacatattctaattatcacccatgagcaaagacgaacccttcacacatttccctttttggccaatcaatgttattcatcttttccacattccccccgttcaccattttattcactatttctcttttctctaactctcacaaatccccgcaaatccccgccccttttccgttcaattgtttcccccaccaatcagtcagtcgagtcggaggagatgagagtcggacgtcggagcgatcaaagacaaattaattatttattaatcattcatttattcgcgcatttaatccgacataataaaagagccatacgaacgattggaccctttggacttcttggggatcagggcccgattcctaagattaagacccttcagtcctgggacaatccgtctcctcccatcccgctctggcatggatcctcacgtcttactgaaacaacgaacagcaaaaactttattctcgaatttattgaattaacacccaatgaaattgctttttaagcacacctcacaccgtctgggtaca

SEQ ID NO: 73387 - DNA, 648 bp, Heterodera glycines
  Genomic contig location: Contig_ID=SeqID_10240; Location=2462..3109; Strand=+
  SCN-specific regions: Sequence locations=1-57,114-232,255-346,486 -530,556-605,643-648
atgaaaaaatgtatgaaaatacgacagaaatgccatggaattagaaaaagttataagaaaattcaccaaatgttgaagaaaagaaaaatcgaaatgaagaatttggtgagaaatttggcactttcatttcgtcgccattttcataattttgttttgatatcagaaaatccgctctctgcagctcattatattttctaagtattttggtattttatagcgtcgggagttaatctaacaaatatattttaaaatatgaagatgactttcgattttgattaaattaatttaagaaatattccctatgctatagaaacggtcttcttcttcaattttggtcattttcaacttattttgccatttttcctttttttagatttttatttgttaggattgtttaaattttttcgaaattcatattttctttctgatcgataatctttttttaatttttctttttaaattatttatatctgtctgtttgttctgccacccataaatgtaagtaaaaaatatgctcacatattcgaactattcaattgaaaataataaatttattaccaacattattccagaaacactcttcacaaatcgtgattccttgaaactaaaaaaaaatttttttaaatttaaatttctaaaattgtataa

SEQ ID NO: 73388 - DNA, 1847 bp, Heterodera glycines
  Genomic contig location: Contig_ID=SeqID_10241; Location=205..2051; Strand=+
  SCN-specific regions: Sequence locations=1-43,65-186,208-257,280 -475,497-735,757-916,938-1173,1195-1722,1746-1847
atgtctgaggcgaaaaaagcagaattggatgctgataatgaaccgaccaacgagaagacggcgctaagtgaggaattgaatgatcaggaaatacttttaattagtgagttgttaatggagtgggagcgagtgcatagccctaaaaattccggggggagaatccgaaaacttttttgctctccggtccaaaaaattttccaagattcatgaaaacctttgggttcctagggatttattagagcactattgcatgtttttacatatattttttaaaaggtacacgtgaagctctgcattgtttctactgccaaaaatcggaagttgcaacaccaacagaagttttgataagaaaagatggcacaggaattgtaagttttcgtttttgtagattttaaaaccatggaaaataataatttgacattatctttttcgggatttatcctttgtttagggggtttatagggtctgcaaaaattaaaaatgaaccactaataattatgtaaattacaaaaatcattattttacgcagcatttggcaaaccgtgcataatttaagagaatcagccggcgatagtgactatttaaagttcaggcaagaaggcggttccataatccgttgatgctcggccgggacgaacatttattcgaaattgagtttgcgctgactgcgaccattggtgaaaaaatgatattcggccagaacttcgatgggtgcaaaagtgacattgaacaggcaacaagtgtaagaaaatatttaatgttgaaattgactgattttgggcattggtaaaaaattttcctttttcagaacctcaaattaattctggaagaagatggcttgaaaaattttggaagcatgatcgacacaaccgtaattttttttttgttgtaaacagccaaaaaaacaaaattatttggcatttaattcaaaaaatttgcagaaaaaggatcgccacatagaattaattcggttgttaattgctagggatgcgatttttaggtaagaaaaatcccagaataggtacttaaataggtaaaaaaaaatctcaaaatgggtaaataaaaattttttttccaattcttagggtgcatttttgaaaatttttttggtcgattcttatgggtatattttttgattttattgcatttttgttaagaattttttgaaaatcctaaaaataggtaacaaaaatgccgaaataggtataaaaataggtacctaggtaataggtagaaaaatcccgaaataggtaaaaataggtattataaaagtgggtgtagaagctccaaaccaagctaaaaactcgttttttatgcttatctcaacgttacaagtgcgcaaaaattttaggtatttaactaaaaatcgcatccctattaattgcacttgtttaaggtttacaccggtccaagcataaaggaaaattttgacaaaaaattccgagaagcaatggacgaatgcgtaaagcgagtcaaagagctgttggaagcggagggcaatttggtaacaaaaccaaacaaaaaatgaatggaatattaaaattttaggagattgtcgaggcgctcgctcggcgcatttccaaaagcaaaaattggacaatgtccgaagaggaaattaaaacgtttttcgagaatccgatggcggacaagaaacagactggccgttgaatgatttaacatttgccactgccggaaaagcaccaaaatatttatttacatttctatatatttttacaaacaaaatttctgataaagatttctttattttatcaacacccctctttaaaaaagcgtaatgtaaaaagaaaaataggaggagaagaaaatggctcgtcacacaatcacaa

SEQ ID NO: 73389 - DNA, 1552 bp, Heterodera glycines
  Genomic contig location: Contig_ID=SeqID_10241; Location=2100..3651; Strand=-
  SCN-specific regions: Sequence locations=1-181,203-290,318-442,464 -968,990-1295,1323-1552
atgggcagccaatcgcattcgtccgcggtggcgtcgtccaattcgggcgcggctagcagcgactcgggcggcgagaaggcggagacggaggacgacgaactgagcggcggaggtgcggcgggtgatgacgaggaagacgacgcgtcgccatgcgagtgcgttcaatgcgaggtctttggcatttttgtgctttttgggagccccagaaaaaattcaaatttcggaggtttcgactgttttttaggtttgtatggccgagaattggtggcgtatggccgcctaccaaaacacttttcttcaacagcagcagagccaaacggacggtgacacttcgggcgccacgtcagtcaccgattcgaatggtttagcaattttgaaaaatgcaatatcgtctgacaaattgttaccgaaatttttttcccgtaatgaactaattttagggattttcagggcctgagaaattgaagaattggtgattttcagtcagaattggattcctgacccagaaaacccctaaaatgaattgggttttttttcgaaaaagtgtgctaccatgccactattacccgagtttccaatccacacctttaaaaaattgctgccatgtattcctttccatccttttcatacgaattccccacgccccctcaatttttccattttcttcggttaatttagtcaatccccaacaaggcttcgacgtgccctccaacgcttcgtccgccggcttggatttgatcggctccgccgccacgctcattctcagccagcagcagcagcagcaaatgatacggcagggcgacgccgccgagcccagcgcggacgaccttttgcgcgccgacttttctatgccaaaactgcgcgagtttttcgagtgccaaaaagcaatgggcgtgccgaactttcccgaggattttggtgcgaattttatttttgtaattcttctgttggacaatgccagttctcggtgattgcctttttaaatttgctttcgccgtaacaaaatttgtccaaaattatttcattttccatttcctatgcttttatcagcagttttttgatgggagcttaggaaaagcgaaacatttattttaaatacttatttttcccgattttcattccaaaaatttatctcatttttttcattttcagatgaattttggctgctcgtcgtcaaggcgcgtcttttcaacgtgttcaaataccgcggccccgaggcgtacaatcgaattgtgctcaaaattcgtgacattgcgcaccaattccgagcccaagtaaaacaaaaatggatgagaaaatatccaaaaccccggggattttaatcggattttgtgatataattttttaaatttaaggtcgaagaaaatgagcacagcgatgggacggagaatccgaaaagagggaaaaaggtgaaaaaggaaatctagaaaaaatgaaaagaatttattcatttttcccttcagcaaatgaccaattaattaattaacaaattgaccgaccgatgccaaaggcgaataacggaggcaaaaacagacaatgaccaaacaataaa

SEQ ID NO: 73390 - DNA, 95 bp, Heterodera glycines
  Genomic contig location: Contig_ID=SeqID_10241; Location=3709..3803; Strand=+
  SCN-specific regions: Sequence locations=1-27,49-95
agaggcgaaagaatgcacaggatcactttctaatagggaaatattgacagaatattcagctaaaaacgggtttgatcatttttagcgcattttta

SEQ ID NO: 73391 - DNA, 776 bp, Heterodera glycines
  Genomic contig location: Contig_ID=SeqID_10242; Location=177..952; Strand=-
  SCN-specific regions: Sequence locations=1-3,26-458,480-776
atgccttcctccctttcttttccctccactttcgccactcttcctttgttctcgtttgtacgcgctcaactcgtccaaccatgtcgccctcggttccggttccgatgtccgacttctcctgggttgggaaatggtgaaattggtccgaaaaggggtgtgtttcggacaccaagcgacagaaaattaccaaccagaaaagtgcttgaaaatggatcatgggccagcgatggtgcaaagtaccctcacttttgcgaaccgattcgaaaaacagaagttcttggagttgaggtgtaaataatatgtagagaatgatttgacttgaattttaggaacgacggaaagtgcaagcagaactggcacttgggtccagagaaaacattgcatcggcgaaagtgcgcattgaatgcatcgtggaagaaaattacaaacttttacctactcaggaaaaagcggaaatcagggacagcgcttgtggtaatgcagtggcaacaaagaaggtaggaactcattttaagtccatttaatttttaataatatgctcgtttaaatctcaataggcgttgtactatgcccaatcaaagaggacgatgaaaatccggacattacaggaacttcagcaagaaataagcaagcctctgtggctgacttatcgtggaagaattgcacacgaggaaagcgatcacttccaagaactttttttgctagagtgtacggacgtgatggcactcttttcttcgccccgtcagttggcgctttttaaacgaacggaaacgatt

SEQ ID NO: 73392 - DNA, 452 bp, Heterodera glycines
  Genomic contig location: Contig_ID=SeqID_10243; Location=56..507; Strand=-
  SCN-specific regions: Sequence locations=1-19,46-102,214-416,441-452
atgaaattatttccgctacttttattaattatattatttttaattgtcaaaattggatcagaaaagaaaaaattgcaacaaaagtcatttggcgaaatatttggagaaaaatggcaagaaaaagaagaagaaaaacgaaatgaactcaaaaaaagagaaataattggaaaattttataaaataaaagagaaaataaagcaaaaaggaagaaaacattcagcaaaagaatggaataaaattgatggaaaaatagcgaaaaaaatggggacaaatcggaaatatatttataaatggatcaaagaatttggtcttcaaaaaaataaaagttataaatcaaaaactgatgaagaaaaaatcaaaattgttcaaaaatttattgaaatgtcaaatgaatacaaacaaaaaggaaaatattcgccaaaagaatgggagaaaaatttatgcggaaattt

SEQ ID NO: 73393 - DNA, 787 bp, Heterodera glycines
  Genomic contig location: Contig_ID=SeqID_10243; Location=784..1570; Strand=-
  SCN-specific regions: Sequence locations=147-526,549-563,602-718,740 -787
aaaaatgggaagaaaaagaaggaaaacaacgaaatgagaagaataaaagagaaataattgaaaaatattataaaataaaagagaaaataaaggaaaaaggaagaaaatactcagaaatagaatggagaaaaattgaagtaaaaatagcgaaaaaattgggggcaaatagacagaaaatttataaatggatcaaagaatttggtcttcaaaaaattaaatgcgatgaagaaaaacgtcaaattattcaaaaattcattaaaatgacaaatgaatttaagcaaaaaagaaaatattcaagaaaagaatgggaccaaaattatgaagaaattggcaagaaaattggagttggctatagaacaatgacgaattggaagaaacaatttggcataagcaataaaagattaacggaggaagaaaaaattgaaaaaatgaaaatttattggcaaataaaaaaacaaaatccaaaaatgagtgagaaagaaatcgcgaaaattatgaaaattgatagaacgaccatttcaaaatggaagaaacagcttggaggagagattttggaggatttaaatggatgattataagaaaaattggataaattttcaaacaagaaaattatttacgacataaaaactgattaattcttacattttatcgaaccattgtcaaaataactggcataaaatccgtttatttttctcaattggatacgctgaatttgcttctattgtaaataattttttcttagtaacgaaccatcattgttatgatttccgactgtccatataataaa

SEQ ID NO: 73394 - DNA, 295 bp, Heterodera glycines
  Genomic contig location: Contig_ID=SeqID_10244; Location=113..407; Strand=+
  SCN-specific regions: Sequence locations=1-96,146-295
taatgacaatgttttattgtgtaatttcaccacatcactgaatagagcacatcccaacaaatgattcattgttcatttttttacaaagaccgaatgaataaattaataaatattgaaaatgtacaaaatttgtataaataaaatagcatacataaattatgtaatacatacagcaaaagaatgaaccggctattacctactatagtttcggagaagcttatcaaagtaattaaatgccaaagtcgtccttcgtgaacttcacaagtgccatttcccgtccattttcttgcatttt

SEQ ID NO: 73395 - DNA, 1284 bp, Heterodera glycines
  Genomic contig location: Contig_ID=SeqID_10244; Location=1273..2556; Strand=+
  SCN-specific regions: Sequence locations=1-223,274-692,714-770,792 -828,851-1068,1090-1284
accgccggtgaacaacggatttgcggtgaacgcgtcgagaaggcttccttttggggcatttgcgagtgaagcgcccgcttctgctgacggagcggacgaagaagaagggaaaatcgatgaaaaactattcatttgagcaaagtgctaaaggactaattaaaagaaaaggagcatattcatattctcaattcaaaaatagcctaattgaatgaaatagaaatgcttaaattatttaatttttttgtttaaaattaaaaaattgataattaatttggcttggctttgcaatttcattaattcgggattatctatacatttagggcagtatatgtatctattgttttgagatgaatactgaaaacaatgaaaatcacaccaaagagacttatttctcgcacaaagagcgaatgttcccggaattggatggaacggacaaacgacttatacccactgaacagtttttaatggcgtgccagggaattgcggaattcgtcggtcatttgcggcctcatttttattgaccgtttatttaaataggttttctcggcatggcttttgtgccggtgaaaaatgacattgccggaaatgtgcacaaagtaaggacaaaatttgagacggaccggaaaagtatggaagtgctccaagacttggtggacattgacttgatggaaaacggtggaaaaattggcaccgccacggaaggtcttttgtggctgaagcggtgcgttttattagtaatagaccaacaaaataatgtgattttaccaattacaaaactttccctaaaaaaatttttttttttgagaaattgtggatgatttttatccgaaaacaaatgtgcatccttttacagggggcttgaatttatgttggaattgctgaaggcgttggtccgtgactacaaaaaggcgcgaacggatgtcggcgcagcaaccaaaacggagaatttggcggacattcttaacgaggcttatgaaaagacgcttaaacggcatcacaattttatctccaagcaactttttaaagtgtgttatgcgaatgaaagtgtgtggggggataagatatgcctttttaatttgtcttaattaaaaatcaaaatgtttgtaggttgttctatatgccgctccccgccggcgcactttgttgttggctgttgcatacggccacgaaggacttgaagaaatttgtgttgaacacatcgctgagctgctcacgaacttcgaggctaatgtcagtgcactggtcgattattaccattcaaaaaagttggaaatacctccccca

SEQ ID NO: 73396 - DNA, 1138 bp, Heterodera glycines
  Genomic contig location: Contig_ID=SeqID_10244; Location=2626..3763; Strand=-
  SCN-specific regions: Sequence locations=1-679,701-760,782-816,838 -943,965-1138
caaaaatgcacaggctgcgaaaactgagattgagaagatgcaaggtcgagaaaaactcagcaaggaggagttggcaaagaaggcaatgcatgcattgttggcggttcgggacgagggcgcggcggggcaacgtgtggagatggcgtgggtgggcgaggacagcgacggtctttttacggtaagtgttccgaaaatacattacgaacaagcaatcaatttacaagctgaataagtttatatcatcaaataagaataattcttcgatttaaattatttaatcgaattggtgcatgaatcacaataaacacagggaaaacagttccgcgtatttgttagagttttcataccataaaagtaccgttcaactgatttttttaaagtttttgaacgaatttcgcattttagttattatataaaagtgtttgtttctttcaggtggttccaaaagagagcattgacaagtgggaagtgactgtgctggccgagatcaattcgatggagcaggatgattaagttttaaaatcataattgttttttttttgctcagtgttcccttgtttaattgtttctttgccccccccccctccattttttgtcgtaaaggggacttggtaccccctttccttccctaattttgtcataggggactttgcacccccgtttttgtcataaaggggacttggtaccccctttttaaaggggactttgcacccccgttttaaaggggacttggcacccccgtttttgtcgtaaaggggacttggtaccccctttttaaaggggacttggcacccccgtttttgtcgtaaaggggacttggtaccccctttttaaaggggacttggcacccccgtttttgtcgtaaaggggacttggtaccccctttccttccctaattttgtcataggggactttgcacccccgtttttgtcgtaaaggggacttggtaccccctttttaaaggggactttgcacccccgttttaaaggggacttggcacccccgtttttgtcgtaaaggggacttggtaccccctttccttccctgatttttttgtcataggggacttggcacccttcccccgtaatatgcaaaactcattacacttgggaacactgttttctttatcgtaaataaa

SEQ ID NO: 73397 - DNA, 199 bp, Heterodera glycines
  Genomic contig location: Contig_ID=SeqID_10245; Location=874..1072; Strand=-
  SCN-specific regions: Sequence locations=1-62,84-199
gtccgccgcttcgccccacgtgaaaagttacgtcgcgttggacgccgctggcgagtgccaatggctgctgctgaccagtgccaatttgtcccactctgcctggggcaagttggagaagggcggcacccaactattcatccgctcctttgaacttggcgttctgatatgtgcaaaggaccatcttcgccgacaatccccc

SEQ ID NO: 73398 - DNA, 1306 bp, Heterodera glycines
  Genomic contig location: Contig_ID=SeqID_10246; Location=237..1542; Strand=-
  SCN-specific regions: Sequence locations=1-402,424-483,505-707,759 -1077,1100-1268,1290-1306
atggactcggatttgctcaatcccgaaccctggactcaaatcggaatattaaatttgattttgacaagggtttgttcaaaatttaaaaaaaaattccaaagtggctgcgccaaagtgaccccgacccgccccagcatgcttttccgaaatatagcttttttctttttcatccaaattcaacattcttggtatcattcgaaagctcttcacatgctctattagacttagaaaaagcgaaaagattttcaagcctgaatttgttattaagaaaaaacttaaaaatttcgaccttttcgcaattttcatgtataacttttttagaaattgtctaatcgcgaagcaaaagagctaagaaaaaaggaaggtacaagcattttcaaatgcggcccgacagcaccgacattttgtgtgttgcttatttgttagcggaaacggggaaacagcagcattcaaagcgggagagtgtagtaattagtaattaggataaattatttataattatttgagcatttcaaatgaggattttagatgtccaaatgagaataccactaaaataaatttggtttttattctcacaaaatatttttccataaatttcatttaaatgaattctgattttagccaaatctgcagaagaaacatgctctgatgttctttaaaattgatgaaaacaccttatccgccttttcaattcatattgaatacattttttaattctatattgatttttatttgttattttgattttgatttatattgaaaatgtttgtttgaaaaagattattaaaaaggttggtgccggaatggacaattatctattaaattgtatattatcagcagggcttcgtttttaggcacaaaaaatctcaaaataggcaaaaaaaaattttattaacccattttagccagcaaaacacgtaacttaatcaaaaaagttaatttgcttatatttcaattgtatatgaaatattaaacttttcgaataaggacacttttttctctatcattaagggaacggaaatctcatcgaatcgttggcatttttaatttaacaattactgaaaatttctatcggatttcaattgccctttcactgatcgaacgatttatttttcggcattttctttaatgcatttcaaattttgccttaaaagtgagaaaaaaacataaaaatcccaaaaaggagaaaaaagacaaaaaaaaactaattaaaaatttgacttaagttcccagccctaattatacaacaacaaaaaaaagtaaatgtaaattttacaatttaaattaatccaattaaagaaataaa

SEQ ID NO: 73399 - DNA, 511 bp, Heterodera glycines
  Genomic contig location: Contig_ID=SeqID_10248; Location=17..527; Strand=+
  SCN-specific regions: Sequence locations=1-247,270-441,463-511
atgcaaatcactgggactcaaatctccggcatttcaatcattgggactcaacccaccagcattacaatcacttgtactcaaactcagcaatccatcgacttctaccgcattacatcactgggactcaattctacgacattccaatcattgagactaaaacctaggcatttaaatcattggactcaaatctccggcatttcaatcaccgggactcaaatctccggcatttcaatcactgggactcagaccaccagcattccaatcactgggactcaaatctccagcatttcaatcactggactcaactctccagcatttcatctccgggactcaatctcaccatacgaatgtaaaattgaaaaaatgcaaatgacaaattttttactgatttaaacagaaatcaaaatgaaaacgaatgtacaaactgaccttataccgttatttgtaaatccattttgtaaaattaactcctctgccaatgagaacagtaaataagcgataagtccaacca

SEQ ID NO: 73400 - DNA, 1249 bp, Heterodera glycines
  Genomic contig location: Contig_ID=SeqID_10248; Location=1061..2309; Strand=-
  SCN-specific regions: Sequence locations=1-160,187-266,295-356,389 -460,482-783,805-887,909-1029,1065-1179,1210-1249
atgccaagggcaaatgattttgcttttgctgtgttggcatgcgattcactgctgatcacggcacagacttcaaccttttcttggtggattgcttatttgatgccggacgatgcgaccattttgtacaattcggactttattcagtgtcagtttttccatgtttttaaaaatttaaaattattttaaccaaatttgccaaagttttggccatggctttaaaaaattgtattttttctttttaaaaagtgtgaatatataatataatacaatgaatgttttatttgcttttaaatttagctcttcatcatcgacaacatttttgcctgaatgggttccgattaaactgatcgataaaattttttaaatggtaattttttgggtaaaaattcttcgtaaaaagtgaaacaggcacaaaatgccacaaaaatgaccaaaataggcttagaatcacattttagtacattaaatattaatttttgatatctcattttttgaaaaaaaaaatcgatttttagggatgcattttcaaaatttttttttttcacaaaaaattttatgaattctcaaaatatgaaaaaaaatgaaaatgtgtacgaaaaattgcaatttttttggggaatctaaaaattttccttaaaaaatcttcaaaaattgcaaaatatgtacaaaaaatgcgaaaaagtccaaaatatgtataaaaatatgtacatatgtaatatgtataaaaactccgaaatatgtaaaaatatgtaaataaaagtcccgatttttgttcgcaaacacaaaaaagaaagtgtttttcctactaattaggctatggagaatccaggaaaaaaatatgtatttacataaaattagcagccctagttatgggtgtcgaagcgatggcatttttggcagcagtggtcccaatcggccatatacaaagccaactccgccggcaatgttatcactggcattttccactagacgtggtcagatgtggtgcttatttggagcattttcacgaagaatggacgacgaacgagcaatttttttttactaaataattaactttattatttgttttcaagtgcaaaaaattatagtaaaataagggcgtttttttaaatataagataaccaaaaaaaattttaaaaattcatccatttaagcaataatcaacattaatcgaaatcacttattttcaaaatttttaaagaaaaatgagaaaaatcaattatttaatattttagtcttatataataaa

SEQ ID NO: 73401 - DNA, 637 bp, Heterodera glycines
  Genomic contig location: Contig_ID=SeqID_10248; Location=2357..2993; Strand=-
  SCN-specific regions: Sequence locations=1-180,230-249,298-312,334 -607,629-637
atggatgtaagcctttgttactgtattaaacatgataaaaatgaattgttcagggcgaatcttgtctccaatcgtacaaatactttgaaagtcggaggaccgaaattcgtcaaatttttcagtttggaaaaggcatttgtaaaagagttacggcattcaaaaatgaattatttgggttggtataaaaaaataataattaattatttttaaaatgaacaatattttattacgtacggtcattaattacacttttaatacattttaaaaaacgtaaaattaataaaataaaaatatattgaatttactagtttaatattctgtttttcttcttttcagagatgatcattcgcacaaattttgcgtgcacattcgaatgggagactttgtcaatttcggttgggaatcgaaaaaggattttacggagaaaggaattgaatttggatttgaatatttaagggtttgttcgttaatgagcattcattcactgttttaattatgcaattaaattcaagaagaaatttggcaacattttcgtttctgttgttttgctgggagaagaaaagcaatttttgacggatttatcattcaacggccaggcaaagaatgatttaaatatttgcttattaaattaaataaa

SEQ ID NO: 73402 - DNA, 141 bp, Heterodera glycines
  Genomic contig location: Contig_ID=SeqID_10249; Location=539..679; Strand=+
  SCN-specific regions: Sequence locations=1-141
aaattcgcataaaatgaccggaccgccgttgagccgtaaacggcgtggggcggtgcccacgcgcatcgaacaattggagcgcatgttggacatgacaaaatttatcgaccaattgaaacgcctgatcgactagccgattaa

SEQ ID NO: 73403 - DNA, 319 bp, Heterodera glycines
  Genomic contig location: Contig_ID=SeqID_10250; Location=1006..1324; Strand=+
  SCN-specific regions: Sequence locations=1-319
atgggtgacgtcaaagaatatattaaattgttcaacacaattgctgagccgtccggagacttcggagacgccatgcacaaaattggacgaatttcagaaaaagcggccggcctaattggactttctgccccggtggccaatttgttggcatcgattgcgcacactgaagtaaatttattcatttttctctttaattttcagcttttttctgagcttttcaagcactcatatgtacaaatttaaactttttatcttttgtcaacttaaatttgatttgcaaaatttttgatgaattacgtttagttaaatttttccttaa

SEQ ID NO: 73404 - DNA, 82 bp, Heterodera glycines
  Genomic contig location: Contig_ID=SeqID_10250; Location=1..82; Strand=+
  SCN-specific regions: Sequence locations=1-82
ggaggaaaaaggggatattctcatcgtcagttcaattggtgggtaaattgtcctggtgcgctgaagggcgtcgaaggattcc

SEQ ID NO: 73405 - DNA, 225 bp, Heterodera glycines
  Genomic contig location: Contig_ID=SeqID_10250; Location=1390..1614; Strand=+
  SCN-specific regions: Sequence locations=1-225
atgatagtcctcagtccggctttcctggttcatgagaaactggtcctggtattaatggtagcttattaatattcaaaatatgccttttagccgcacgaagaagttttgttggcattgtccgaatttcgtcgagacattttcaaacgcctggactatctggaaatgaaaaatttccacttgatgcgcgacttcaaactttctcagtacttgacgcaatatacgttt

SEQ ID NO: 73406 - DNA, 1179 bp, Heterodera glycines
  Genomic contig location: Contig_ID=SeqID_10251; Location=339..1517; Strand=+
  SCN-specific regions: Sequence locations=1-38,60-251,285-511,549 -575,606-834,857-907,941-1094,1125-1179
atgttttggccaatcgttgcaaagctctacgtaaatgaaacattgaagaaacaacaaatgcccattcaaatttcaaatttcaacagcactgcccaaattatcaagcaagcgcttgaccaacgtggctcgtacaggtaaatcgaattaattcatgatcgaaaagagaaccaaaaattaaattggataaaattttataggtttagtaagattattgtgaaatagatttttttgctttgcgttgtatgaaaaaacctggaaaagagataataaatataataaattgacataggtacattaggagttgctaattatttctaagattttttaatgcttttaaacaaatatttctgtgtcgatatagaagattcttgctttgtaaatggatgattttaaaatttattaacaattaacaagctatgtcgattagaattttgcttcggtaaaataagtaaaggtgcttacttataggggtaaatttccatttattgtttgcctctatattcggaaaatgataaaaaataaatttttacttttaattaaattaaaatccagttttataacatttccatcgcctaatcttcataataaaaaatttttatacaaatttagcttcttcaacaacattctgattggagaaaattggagtggtgatgaatggatattcacagattttgatggttctagaggatttaccattattaatgaatatggcatcaatgtttatgtctttcgttgcaaaagcgattatgtgcgcctgctaaaagcaaaacagtggcttttagaccatcggaaacagatagtttccgtcattgagtgggtctaattttttttaaaaaagtaataaacattgaaaaaatgaagcctgcaaatggtttagggtggctgagtctcaacaaatttgtaacaataatatttttgaactttattttacttattttcagtatttttaaaattgaacagctgagaataatataatgaattcttttttgtgttgaaatgatatttcgcccttttctcaaaatatttgtttaggaaaaatgaaaggtttttaaaaatttattaacgattaaaaatttttgaaattttccaggcggatagtatttatttcaaaaaattctccctgtaaaatttcatcattctgaaaaaaagaattaaaaatttgatttgaaattttcgcaa

SEQ ID NO: 73407 - DNA, 319 bp, Heterodera glycines
  Genomic contig location: Contig_ID=SeqID_10251; Location=4432..4750; Strand=+
  SCN-specific regions: Sequence locations=1-102,125-319
atgacgtcatcaccggctgagcaattaagagaggcaacagacgccgcatttgactcggtggccaaagctgtggaggccaaatatcaccagcgtgaggagcagaaggtcaagcagtaccaggaagaacgggaggaatgggagcgaaggatggcggagacgagacgcaaatttgagacggaacgccacaattttgagcaaaaaatgcgcatgaaaagggaacaacagacggaggaattggcacaaatggaacaacaaatggacgaacagagacacaaacattgccgagagcgagaacaacaacagcaacgataattaaata

SEQ ID NO: 73408 - DNA, 849 bp, Heterodera glycines
  Genomic contig location: Contig_ID=SeqID_10253; Location=347..1195; Strand=-
  SCN-specific regions: Sequence locations=1-139,182-260,318-429,473 -543,569-849
cgatccattttcgtttgatattcttagaaataaagaagagacaaatttgagcaaaagctttccaattagccaacggattatgcgtacggacagcacagtacataagtccaccgatacattggtaagaaaataattttcgaaataattcatttttttaaattaatttttatcatttttttttcacagttaaaaatggccaacagtttcaacgggcaaagcatcattgacctgtttgacttatcaatgtgttttaccattgcaaattataataaaaattattttaaaattttcattaattatttgattgtaatatatttcctttgaaaatgatgacaaaagggcgttaaaatctcaatattacctaccaaaaaaagttttctttgaaatttttaccaagtttttcatagattccgttataaaatcatccaattttagggttttggaatatttgaaatttcttttttaagatttggtccatttcataagattcagattctcaaggacaaagctcgtaaaaataagaacaattggcaattgccctggaaaatatttaatattttatttttaagatgtgatgagcccgttcaaaaaatgccgagcatcaaatcgttggcggaacgtcgtctgaaatttcagcacgaattgcgctggagtttcgatgtgcatgagaataaaaaattgagctacgaagaccgaattgttggacgaaaaccgcaaacggccaactcaacgccaaccacaaactcatcgtactcattcagcggctatgcaacggcggtcaaaaaaacgttgcccaccgatgggtcagccgattcaggactgaatataaggtgaaagaattgaaataaa

SEQ ID NO: 73409 - DNA, 385 bp, Heterodera glycines
  Genomic contig location: Contig_ID=SeqID_10254; Location=1782..2166; Strand=+
  SCN-specific regions: Sequence locations=1-4,167-167,192-262,291-362
atgtggcattattgcttaaatagtgcatatcttttatttttgatcaccttaaatacaatatccggttcggttttgactcggcaaaggcgacaaaatgccaaaataactgcttacaatgaacagtatgccaaaacaatggcggcactgtcggccggggcttatgccctatcgccaaatgaatgcatccggcggtaaatatgaaaatttcaactaattaagaattgttatgcatgtttcataaaaataagaaaaattttctctgaatttatttttttaaatttaattaaattgtgatttgagacaattccgaattgaaatgaatatttgaagaaatttgttattattttctttataataatcaaaattcacactttttatttaaaaa

SEQ ID NO: 73410 - DNA, 559 bp, Heterodera glycines
  Genomic contig location: Contig_ID=SeqID_10255; Location=82..640; Strand=+
  SCN-specific regions: Sequence locations=1-304,336-368,400-519,556-559
acttttccggtgacttttactgggcattcattaggaggagcattagcagccatcgcagcagccaaatgtgtcgcacttggacttcgaatgtacgaatctaatggagtaaaaaaaattttaccaaaagaacagagatgccagttgtcctgatttcgggaattcatttttatctaattaacaaagctcacttaaattttcaaaaattccctggcaccatctgacattagatcccttaaatttgggtaaattcttatgaaaatttctgaaattggaaattcaggactaaaaaaacgtagctgtgaggataaaaattgataatttaattttaaaatataccgtatgcctcctaagggaatttgcatcaaaaattttggaattaaatttttatttcaggagcaatcaggtgacattgtacacatttggtgagcctcgtgttggtaatgccgcctttgcttcaagatttgatcaacttgtgccgaataggtgagtgggcattcagcaaaaacatttaaaattgactaaaatatttttaaaaaatgtttaaaaattaataatgcaa

SEQ ID NO: 73411 - DNA, 927 bp, Heterodera glycines
  Genomic contig location: Contig_ID=SeqID_1417; Location=1357..2283; Strand=-
  SCN-specific regions: Sequence locations=1-84,179-288,335-376,398 -491,546-750,774-927
atgtataagaaaaataaaatcaatagaagccaacaatataaagatgaatgtacgtcatacaaaaaaatattgatttgatcaatattatttttatactttttcattttcattttcatttccattttattttattttaatttttctatttttatttccatttttattttattttcattttcttaccattcctcaaaaattcataggctgacaacaatgcttcttctgttccttcttatgctagtgctaaatcgtatgttgaaaaacttgtaaaaattttagtagcaaatgaaaaataaaattttataatttaattttcaaataatttacaaattatggataaacttagttccccatagtctgaaacgcacgaaaaacatttttcttttcggttgttgttaagctacttttttgagtttacaccccctaagaatcgaccgaaaatttccaaaaaaacaccgctaaaaatgaaaaatattctcaaaatcgtctccaaaatttatttattttttttgataagaatttaaattttaaaaattatttatttagcccctattttggggttttttagactatttttgcagtttttagagtttaaaatcgtcgcccctactcataacatttgtctcattcacaggcattcatttggcttacgcggataagcttgatccaaacaagtgtgttgctgatgttcaaaaatattgtgagcaatgtgcccgaatatgcaaagaacgggttgaagaagtaaagcataagaaaagggaaaattgcgaaggtggcggacctgtcaaattgacaaatgccgtaaattgcatctgcaaatgggaatctgttctttttgtacattattgtgttgcaccggaagcggttcggatggcattgaacgcggcacataaatacggcaaaattggtgacaacaacagccgatga

SEQ ID NO: 73412 - DNA, 2864 bp, Heterodera glycines
  Genomic contig location: Contig_ID=SeqID_1417; Location=1289..4152; Strand=+
  SCN-specific regions: Sequence locations=1-222,246-450,505-598,620 -661,708-817,912-975,997-1212,1242-1399,1563-1707,1730-1777,1799 -1882,1920-2013,2036-2242,2265-2574,2605-2864
atgctggggtcgaatcgtcgaagccgaactgagcaagtccgaaaccacacacattgtttccctgttcatcatcggctgttgttgtcaccaattttgccgtatttatgtgccgcgttcaatgccatccgaaccgcttccggtgcaacacaataatgtacaaaaagaacagattcccatttgcagatgcaatttacggcatttgtcaatttgacaggtccgccaccttcgcaattttcccttttcttatgctttacttcttcaacccgttctttgcatattcgggcacattgctcacaatatttttgaacatcagcaacacacttgtttggatcaagcttatccgcgtaagccaaatgaatgcctgtgaatgagacaaatgttatgagtaggggcgacgattttaaactctaaaaactgcaaaaatagtctaaaaaaccccaaaataggggctaaataaataatttttaaaatttaaattcttatcaaaaaaaataaataaattttggagacgattttgagaatatttttcatttttagcggtgtttttttggaaattttcggtcgattcttagggggtgtaaactcaaaaaagtagcttaacaacaaccgaaaagaaaaatgtttttcgtgcgtttcagactatggggaactaagtttatccataatttgtaaattatttgaaaattaaattataaaattttatttttcatttgctactaaaatttttacaagtttttcaacatacgatttagcactagcataagaaggaacagaagaagcattgttgtcagcctatgaatttttgaggaatggtaagaaaatgaaaataaaataaaaatggaaataaaaatagaaaaattaaaataaaataaaatggaaatgaaaatgaaaatgaaaaagtataaaaataatattgatcaaatcaatatttttttgtatgacgtacattcatctttatattgttggcttctattgattttatttttcttatacattttatgcttgaattaaaatctgaaactcaataatatccatctaacattaccttatttttttggactcaattttcccgaaattgtccccaaatatcagtccgcaaatgtcagtaaggcgctatgaccgatcaaaataagcaaacaatactttgtttcgatttatagaaaattgttttttggtttttgcacaacccaatcaaatacccaatcaacttagtaaaaatttatttaaaaaataaaatttaagagattgaatcttcgtgaaagttttccatttctagggaaagttgggttttatggaacttgatgaattattggtagaggaaatcaatcaccctgttccacgtggacagttcagaacctcacagccatttcggcgccaaaatacttttgcaaatcttttaaaggggaggcgcgaacgccgtcccccgcactcaaaaatttagctgtgggcctatcccagttcgggaccgccctgcgggtcagccccgaccgaaagtgcaatggtggagcctcgccacaggagccctgcctttgtgatcgcaggaactccccagccaggtaagtttagagagcagcaaccagtccaactgacaggcaaattaaagaagaaatgagagatggggtggaaaataggggagagatgaagaggattgtggaaagagaggacactctctccccaggcacactcgtttcttttccaattagctgtgcactatttccttcccatgatcgtctgtcagttggctgaaattcttcactctttttacacgtcgtccttattttctttccctcaaagaaagcgtaagacacatgcacagatgggcaaaaaagaaaagagataataataccaattacggtttcagaaaatcttaaaatgttttaacgaattaaaactgatttttgtttcacacccacaaaaaagacgaaaactattccatttaaattaaagtacagcggaaccgggaccaaaacacggacaactgagtaccgaagtcccgattttgaccgggactagtcccggtttttccccggttttcccagccaaaaattcccggtttttcaacccgaaaaggtcccggtcccggttaagactaaattcccggtcccgctgctctctcatttaaatttaacttttgaatatcattttcccgcttgaatttttgtaaatgaatcctggcacttttcagtgcctatgcatccaatcagtcagtgatcatcctcagtttcttgggccatagcttttttccataattggcattcatcatggttgaaatgaaagcttaatacaattctttgtgattaagaaatacacgaaaataacaaatgctgacattgaacaaagattgaaaagagaaaatccgaaattctgcttttttaaagtatattcacaaattgttttttgtctgttggctttagccctgaatttagctatacaaaaacttggctaaactccaagctttcaattgatacccaaaaatgtgggcattgagcaaatgaaaaaaaagttttggcctaagaaactaaggatagatcactgcaaaagcaatgtaaaagcaaaatcccaatttcaatatcaattttgttttcccttttcttcagcttcatctccggcgattgttggctggcggtgtacgatttgctgccgccgtcacaacttggactgggaattgcgacgatcagcctccgttatgactattacgtggacgaaaatttcaagacgcgcaaatgggcactgaaatttatgcgaattcaaagcaaaattggagcaaatgggatggaaatgcaaattgtcaattcagttggggaagaattgccaattccacaatttgacgtgcctcccaaagtgaccggcttcgaatgcatcgt

SEQ ID NO: 73413 - DNA, 1002 bp, Heterodera glycines
  misc_feature (133)..(133): n is a, c, g, or t
  Genomic contig location: Contig_ID=SeqID_10256; Location=222..1223; Strand=+
  SCN-specific regions: Sequence locations=1-112,140-140,171-273,310 -1002
atgttggaacggaaaaaggagtcggataatggaggaggaggaggaggcggaatgcacggacctttgtgtgggttcggtttttgttcttttttggcacctttttccattctctcccccccccccccccctcccntcccccgcctctcctctttttgttgtgtgtttgtgtgctgctgcttctggtgggcgtgtcgcgttgtttccactacctactcatttctctcgctttttctttttttattatttgtttttccgtcgtcgtttccatcatcgataaatattcatttaaaaattttcaattttttcagccctcgggggcgatgtgtgtgaggagacagacaattttgggagtggagttggtggagaggactgaactgacagacaaggagtgctcaaatcaggattcacacacacgggacgggggacaaaaattcaaactcgaggagcacactcactcactcattcgggattctcgaggaatgggacgggactaggagcaactagcgaaccatcctctttcaccgatcacgccaatcagtggatgatcgggacgggatcggacacaatcacactcagacgggacaggaatggaacggacggcaaataaggacaaattattgccttttgaatgtgtgaggcatttcaaaatgttggcccatttttagcccaactcgggccattggaggatggtggagtggactcgatgaggggacacacacaatttgtggatgggacgggggatcaattaggagccacagaacgaattgaaggacactgaggaacaaaaccgaattgaattggacatgtgcacactttggagttgcatcaagaaacggactgtgactcccttttttggaatagaacgggggcagggcacataaatttttaggtcggttcgaagtggactgcatttcgttttaaaatggcatggaatttggtggcgcttcattcgtcagggagttgaacgcgtacaaatttttggctattttatcggctagtgaa

SEQ ID NO: 73414 - DNA, 572 bp, Heterodera glycines
  Genomic contig location: Contig_ID=SeqID_10256; Location=1658..2229; Strand=-
  SCN-specific regions: Sequence locations=1-192,222-233,256-370,402 -504,529-572
gttttgaccaagtggattgtgcagaatggcaccaaggatgagtgggcagtggtcttttatgtgtcagcagttgttgctgcactgccggtaaaatttaaatttgacgagaaattcaaaatgtaccaataagtttaagatttttacggcttttcggcatctcttcaaattttgccaaccccgaggcttggtttttggcataaattccaatggattcccattttaaactcctgtcataatttttcaatttttatttggatcgacaaaagcctccaagagaaaaattgttcattagtgatatttatttctcaaaataacattccactgacccatttttcaatactcagaaaaccaactttgttttaaaatgtgcattaatttttttaaataattattaataatttggtctatcatttaaggttgtcgtcttctcaatgtggggaagtgatcagccccaactgtgggctcgctcatcatcaatgaaacggacacaaaacagcatcgcatcaacaatcacaacagcaacaacaatctcagtgaagcggaaagaatgcccagacacagcaaaaatatga

SEQ ID NO: 73415 - DNA, 2615 bp, Heterodera glycines
  Genomic contig location: Contig_ID=SeqID_10257; Location=1..2615; Strand=-
  SCN-specific regions: Sequence locations=1-3,34-120,147-325,351 -621,676-693,808-852,876-1415,1480-1484,1507-1543,1595-1611,1787 -1787,1813-1821,1843-2256,2280-2615
  Gene Ontology: Mol. function=inorganic phosphate transporter activity; Cellular component=integral to membrane; Biological process=anion transport
accaaattatatttaaaataatcaaatatatttgtagcgcagtagcgatcggttgcatcactggcggccgtcaattgggcacacttttcattttgccggtggccggcgctctttgtggggtaatttattatttttaatttaaatatccctatcttaattgaggacactcattaatttaaaatgtttacgtttttttttttttgattgtggctgaaagttgaaaattgcttgcctaaattttaagcataagcgaatttttgaaaatactttcccttttttagcgcattttcccgaaaaattttcggaattatccggaaaaagaatatttgctgttgtttttgtttgttattccgcctgcatttaattgcctaattaattttcttcttttttttcattttaattggttacacagaaattttaattccttttttttttttgtttttcgatttttcgctgctttttaaatttccatttttttcagaattggcctctgattttccatttgtcttctttggtcgccgctttggcggctttcctttggcttccaattggtgccgacaaaccgtccaaacagtgctgcatgcccaacaaagaacgcctgtacattgaaagcaggtgggaacaaaaaattttgaatagaaaatttaattattttatgtatgcaatataaaatcaaattttggcaatttcatctttttaattaaattttttagcatttattttataatatttcaaaataaaataaaaaaataaaataaaattatttttttttgaaatattccaaaataataaattttaaaaaattttcttcaaattcatttttaggtaatttttaaatctttttttttggcagtttttacattttcaattaaaaatttagcatctaattaatttgcttttccccaggatcgcctgtgaacacatcggcaaacgcactcagtccaggcgtgtgccgtggcacaaaatggcacggtccgtgccgttgtgggtcaacgtgttttcgctgatttgccatgtccgttttttaaccggcttttcttctgagtattctggataagccatttatgtagttgaggataaatcggctttctttttgttgtaaaatccgtatttaattacaacaaaattttatacgctaatcaaattacctaattggtgttaattaattggctcctaatttcccttcaacaggaatatccgctggtgatcatgctgcagtttttgcccaattacatgcgcgacgtgttggagttggcgcccacccaaaacggggtgagtagtagagaccggacaactggggtcggagggatcccgaggtcgggatcccgaatttaatcccgcgggatcccgaagaaatcccgcgggatcccgatcccgtccggtctctagtgagtagtcaatggaaaagcaaaaacaaaaaattgaaaaataatttaggtatattaaataaaaaaacaatttaatttcaaaaaataaattcaaaccaattttcaaaaacattttttatcctgagtatataagggcgggcatagattatcccgtctattaataattgaaaattatttattttaagtatttaatttagaaaaaatttcggaaatttttttttatttcaattaaataaaaaaaactaataaaacaaaaacaaaaagaataaattgaattttgaatttcgaaataaataaaaaattaatttaaattatattaattttatttaaatgaaaaacttcaactaattaaacttttattttatttgaattaaattaaaagaaacaaatttaaattacaaatttaaaaataaatataataattcagattggatataaaaattggtaataaaaacattttttcccaaattcagcttctttccgcgctgcccattctgtttttgttggccagcaaatgggtgtcctccagcctttcctcatggatcagctcgcgacgcgaagctgcgtcctctttcgcctccggcgacgaccaaacggcggtcgacgcgtgggaggagcggaggcgcggcacgcgcatttgcaaggtgatcagactgatcagagcccgagaaacacaaatcgattgcaacaacatttgctaatcctttggatttgtttgatcggcacaaggaatgtgtgccgacaccctcaaaaaattacggcaatcggcccggaattccaagcccgaaaagtcggcacacggaaattggcattccgacactagtgctgctgttcgagaccaaaaatttcccgagacttgaccccgagactcaaaaaccccgagatttttctcgagtcgtcgggactcgagagtctcgaacagcactatctatccgacgcatccctggttggcactgatagtgatcggaaacaatttttaaaacctgaaacaatttgtttcgtgattggaaaccgttcaaaaaatttattacgaaagcatttgatcatttgcctaaaaggggtgtacacctctgcgatcatccctgggaattttccggcattgaacgagaattgattgatcaattgcgattaacgcgcttaggcatcacgggtgagcgattcgcggcgtttttccgcgatccgcgggcagaaggatccgttttcgaaatccccgtgattttttgtgtc

SEQ ID NO: 73416 - DNA, 522 bp, Heterodera glycines
  Genomic contig location: Contig_ID=SeqID_10258; Location=267..788; Strand=-
  SCN-specific regions: Sequence locations=1-522
atgcaatttcatcaaaatgaaacatcggacaaagcgcatcggatggaacaaccgcagaagcaagaaggtctgcaaattggcgcgttggagtttgtcctaacaatggaaagattccctgagctgaaaggaacggaaggaccgaacgaaatacggaaatttttcaaaaaaatttcgtcagcaacaggaggatggccggaaaatcgacgcatttcagcactggaaagcaaaatgagtggaaaagcacagcgtgcatttgacgccgcgatgaaacatcggccgaaaaatttcaacgaaatttgccgcggaatggaaggaattttgagcgaatgggactgcaccgaaatgcgggctttcaacgaattgtggaatgaaatgaagcgacgatcggacgaatctttggatgaatttgcggaacggctgtacggcattgtcgagtgcgcttacccaggtttgccctcaaatttcgtcgacgactttgcagtcaagcacctaattcgtgctatggaaaatccggaaatttcg

SEQ ID NO: 73417 - DNA, 889 bp, Heterodera glycines
  Genomic contig location: Contig_ID=SeqID_10259; Location=230..1118; Strand=+
  SCN-specific regions: Sequence locations=1-43,69-75,99-165,187 -359,381-510,532-730,752-811,848-889
atggacaaattaaattcagtggaaaccgtcggcatgaacaaagtaaattattttttataattttaaaaggggtatagaaaagaaaaaagaattttattccatgtaaaaaaatttacaattgaattaggttgctcatttttgataaacacaatttaagggtcaaaatattttaccaaaacttttggcgaagcaaagccgtggcactggtgtttttttgccgaaaaatgcctaacaacgcgtggcactgctttacagtatacgtcgaaggcgaaaatggaagaactttgaaaaactgtaacagtttatggtattgtgatttgtaggaaaaccttcaattacctgtgtggtgttctgttatttttctttcttttatagacaaaaaagcgacatttggggactttttattacaaaaagtcggatattcaaagatcagcaggtctcaaaatattagttagactcctaaatatctttttgtcttcaatagtacttttatcatgttgtgtaaagcattgagtttgttttttaaaaatggctaactgaacattgtgtttgtattccttttaaccgtatttacaacattaatattctcccctataattaatagtctctccccctaaaaaggtactcctactgaaggagtcacaccgtgaaaatttttgagaattcagttgagtttaacaaaaataagaaatatttttgatctgagagaggggggagggtgaaaaatagtataatattttagaaaaaatttactattcataggaattgaattctcggtgctatgtcgaagcgacaaaaatatgggtgtttgtaataattaatttaattattattttaattttattttccaagtaattaatcataacttagcttaagcttagtcaaatta

SEQ ID NO: 73418 - DNA, 586 bp, Heterodera glycines
  Genomic contig location: Contig_ID=SeqID_10260; Location=560..1145; Strand=+
  SCN-specific regions: Sequence locations=1-3,30-89,111-180,222-586
atgaattattattttatttataaaattttcgctttaattgcccttcattttacatttgccattccaaatgttgtaaaggcagcggttcgtttttaattattattattaaactaaaacgagaataaatccttttttgagtaatttgtagacaaaaaacaaatttgattgttgaaatggaccaattaattttatttaaactacttaatttaatttaaaaaattccctttgatcagttgaaaagcgatgacaaattcgtcacttttgtaatgagtttgccacatatgccaaaataccatgacgagtggaagaaggaaattttggatgaaatttaccgtacccctgtcgctgaaaattcctacgattttgaagctcaccttggcattttgtttttgatgaaagagcattggcattgtgtcgaactcagaaaagaggatggagaaatttgcagaaaatatcgcagacaggcgcttgttttgtacgaatatttcctacgagtgtatcaccaaggtcagagaaagctccaaggcccgaggtgtaattctgctcgagatgaaattgctcgagactcgagagcaaggctataaga

SEQ ID NO: 73419 - DNA, 789 bp, Heterodera glycines
  Genomic contig location: Contig_ID=SeqID_10261; Location=1455..2243; Strand=-
  SCN-specific regions: Sequence locations=1-58,82-354,390-506,530 -646,669-789
agccttgcacttcttccgccggacaacagccgaggccgaggacaacgagcagtgcaattggtggtggtggtggtactgctgacgaactgcaacaggagaaaaaaccaaaaagttggttggtcttccctttggttttttaaaaaaaaaatcaaccgccccaactaaaaaagtgacgattttgctataaaatatggcaaagttttgtgtattttgtggtcaaattattgtaaatattcaatgaaattttaagaccaaacaaaaacttttgaaccgaatttatgaggcaacacacccaggtttagcaaaatttaaaaaatggggtacaattttttaatactttcaaatgccactgacaatttttacaatttttttataaaaaagtataaattccataaaaatcgaaattttttttgaaatatttggaaaattttgtaatttttcgaaaatcactttaaatttctctcagaaattgggatttacttcatttcttcgttttctccaccgaaatttttaaaacacttaaaattttcaaagattttttttaaacattatctaaaaaattgtaagaaaattgggaggaattggattttccaaatttttttttaaatttccgttttaggcttaccctctccctaaaaaagttcccattttatttatttttcagtgatttcaagcgacacgccaatcccgcggaaagtgcggcgcgcattggcgacggacgacggcggcggtgacaaaaatggggcggctgaacggcaacgggaacggaggaccaagttcgatttttag

SEQ ID NO: 73420 - DNA, 264 bp, Heterodera glycines
  Genomic contig location: Contig_ID=SeqID_10262; Location=517..780; Strand=-
  SCN-specific regions: Sequence locations=1-139,169-191,242-264
atggaaacatttggacttttttgtgtgccattttacggttgtaccccatttttcggacaaaaatcgctgcggacgacggaaagccaatgccaaccgatggaagaagccattgccgacatgccaatggatgatgatgagaaggaggatgaagacgatgatgacatcgatgtcgaaagcgtgttggtccaccagaaactgcaacaacaacaacaaccaattgcatcaccaccaccaccacttatatgccgtcaattgcaccgactc

SEQ ID NO: 73421 - DNA, 73 bp, Heterodera glycines
  Genomic contig location: Contig_ID=SeqID_10263; Location=1563..1635; Strand=-
  SCN-specific regions: Sequence locations=1-73
caaattcaaaaaacgggcgcaaagcgcccgtcttgagcctcgatgtggactaaaaacccctaataatttttta

SEQ ID NO: 73422 - DNA, 737 bp, Heterodera glycines
  Genomic contig location: Contig_ID=SeqID_10264; Location=113..849; Strand=-
  SCN-specific regions: Sequence locations=1-221,260-271,303-356,397 -535,562-570,592-604,628-671,693-698,736-737
atgcaaaaagtacaaattcaattttttaaaactcgggaaaaaggcgaaaaattaaaagtgcgaggacaaatgtacttcaaagcaagaccacttgcgaacggaagcatttcttggcgttgcacagagtacaaaactgctaaatgcaacggttctcttcaaacgaacgacaacaaaaaaacaattgcctttttcaaagaccacactcatgggccaagcaatggtaaatttaatttacgaaaataattaatttttaataaatgggttaagagtctataatttattatatatattattaattaattcgtgttcgaattaggggtgggcgaaacttcggcttcaaaaagattggcttttggtaaatttatatttaatatatacatatatatttattaattagtgcactttgttctttcacatagagtggtcaatttaatttttggcccaaaaagacacaaagttggcattttttggtgaaaagaaaccggttaaaatttcaaatacttccccggggcgcctaccgaaaccgccggtacccaaaagttttattttattttcaaattgaaatgctttaagaatttataaaactttcaaatttctaagcacattttgatcaaaaaattcaaaatatttgttttattaaaagtgattaattgatctgtagccgttctgtcaattgattaaatttgatatttaaccgaaattttgttatgaaaaaatttttggaattaaaaaataaa

SEQ ID NO: 73423 - DNA, 157 bp, Heterodera glycines
  Genomic contig location: Contig_ID=SeqID_10264; Location=1343..1499; Strand=+
  SCN-specific regions: Sequence locations=1-62,88-128,151-157
agcaaaataagcaggttaattgaatttactatgatttaaattaggtgattgcaattacagacaattaaactatttttatattttaaatccttaatttggtgcccaacttccctctcacattcatttataattttgctacaatattcattaaataaat

SEQ ID NO: 73424 - DNA, 56 bp, Heterodera glycines; identical to SEQ ID NO: 68623
  Genomic contig location: Contig_ID=SeqID_10265; Location=1652..1707; Strand=-
  SCN-specific regions: Sequence locations=1-21

SEQ ID NO: 73425 - DNA, 980 bp, Heterodera glycines
  misc_feature (488)..(488): n is a, c, g, or t
  Genomic contig location: Contig_ID=SeqID_10266; Location=254..1233; Strand=+
  SCN-specific regions: Sequence locations=1-339,361-980
atgtgtgccaagcatcaggcatggttgaagaagaacgatgaccgcatcaaggatggaaaagcgacaaattttgtaagaattggctcattaatgctggaaaatgggacgcagccgaagaaattgattgaagcggcaattggagtgaacggaaaagacgtggaatttgtgatggacatggggacggaagtcacagttttgtgcaaagaatcccaccgacaaattggaagtccgaaattgggccattgcaaggaaaaggccatccttaacgacggatccacgcgccgatttttggggaaaggatttgcaaaattctcttttggagggcaaatcaagaaaggacaattttttgtgtctgagaatggatccaaaaatttatttggaaccgacatgatggaaaaatttggacttttggacggatttaagaaaaatttgaagggcgaagtccatcgaaacatttcgctgtcggagcgaaagtgatcacaattggnaggatcacaaccgatgcaaattggttacgtcattagccgaaagggatgatgtacgacgtccacttccaagatggatatacgggacggtaccatgcaacaatttggaggagtattcaccggccaagtatgaaggacctggatttgtggactccgaatcgcaaatggaagcgatcgccacgcgaactccaatggcaaacgttgaatgccgaagaagaatggacgtgtcggacagacgtgtcgagaaaaagaatggacgtgtcagatgaaaaagatcctttttaagggtgaaatgttagggatgggactcaaatggccgccccaattatttatttgtttatgtccttcacctctgtactctctctcgactttcctccccataaatagtccgccctttgacccattctttcacttgtatcttcacttcatttatttgttgcatcatccccaatcgatattccccattgcttcatttgttatttaattttgtcttca

SEQ ID NO: 73426 - DNA, 196 bp, Heterodera glycines
  Genomic contig location: Contig_ID=SeqID_10266; Location=2778..2973; Strand=+
  SCN-specific regions: Sequence locations=1-196
aatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgactttct

SEQ ID NO: 73427 - DNA, 620 bp, Heterodera glycines
  Genomic contig location: Contig_ID=SeqID_10267; Location=236..855; Strand=+
  SCN-specific regions: Sequence locations=1-19,46-81,147-400,465-620
atgaccagtgagtgaaaagaatcattaaaaaataaatatttgcttttttggggtcactgactcatacaaaaaatgttgttgaaaatattaaaatatgaattttcaattaaaatgccataaaataatttttttaattttcaaaaaatgttgcataattttgtatatgaagtgttactttgttcagaaaggcacgggattgtcctttaatataagtacagcagaaattagaaacggaaaagaatgccccccaatttttggtaaaaaaaattatttcaaatgacgcccttagaaatgcataaacactcatcccatattctttgccaaaatagctagctaatctacagagttaaaaaattgcattagcatcgattttcccaccatttttcaattataacggcggaaaatttaattaatataattcattaaaatgtttttatttagattcagaattattaatttattttcagttgtgacgcccctttgggttggcgcaatggatggccacttcgaagtgtgccaagcgttggtcaaacacagggccgacgtcgacttgggcgcgccgcaatttggcatcacaccactgatggccgcatgtgagaacactgctcgactggacactg

SEQ ID NO: 73428 - DNA, 803 bp, Heterodera glycines
  Genomic contig location: Contig_ID=SeqID_10268; Location=461..1263; Strand=-
  SCN-specific regions: Sequence locations=1-599,622-803
atgctccttgctctctttctgctgaggacaacgaggtacagcgcaaaagtcacctgctgcagctgttcgctcgacgatgacggttctatggaccaaaatgcgaacgtggtggtagttcagtttattatttttgaacatttcattaggctagcaacagttcacaggcatcctcacggcgtgtcagacggcaataagctgcagctattcgtgctcctcccaaaaacggctaacctccaacataatcagccgcttcaatagtcggctgcagttatgtttggatggacgactaacttacaaagtaatatttcaaaaagtgagtaaacagttaaaaagtataaattttcatcttaggtctcggcaagtcgctcttcattaagccccatactgaattgcacccattcaaaaagacaattcgtgaaaacagtacaacgcttggatagctcacggggcgagggcgacaaacatcgagtggaaaggcaattccaaatggtttcgcaaggctgaagcataaatatgtccaaaggatggtgatagcttccaacttcttgtattatttcttgtaagttggatttttgtaaaaatacctaaatgtaaaagctttattttctgaggtttaaaccaattttacggccctttttgctatttttcttatgtatttcgacccagcggaatttttggattctttttggaaaaaattttttgcttggaggggggggagggttataatacagagggggttttaattcaagggtgggttctatttttcaacccccctcagtgggaatggaatggcggaaattaaa

SEQ ID NO: 73429 - DNA, 97 bp, Heterodera glycines
  Genomic contig location: Contig_ID=SeqID_10269; Location=423..519; Strand=+
  SCN-specific regions: Sequence locations=1-97
ttaaagctgtctccgcttttgcgaatgattaatcagacaaaatatatattcaaaataaatggtagctttggtcgcacatcctttcatgccattaccg

SEQ ID NO: 73430 - DNA, 248 bp, Heterodera glycines
  Genomic contig location: Contig_ID=SeqID_10269; Location=1..248; Strand=-
  SCN-specific regions: Sequence locations=1-101,125-248
ggcgcccccacaaagtgtccaagccacgaaatgtccaaaagagtaaaaacccacgaaatgtccaaaatttttcaaaatttataaaaacaaaatgagtctaatttaggatttttagggttttcggggtcgctgaatacgaatataccctttatattaccccttgcctaaccttaggcccatctgaataataaaaaactcaaattcgagacttggacatttcgtgggctggacattttgtgggtcagcga

SEQ ID NO: 73431 - DNA, 760 bp, Heterodera glycines
  Genomic contig location: Contig_ID=SeqID_10270; Location=195..954; Strand=-
  SCN-specific regions: Sequence locations=1-165,187-405,433-482,504 -700,722-760
atgaatgacataatacattttatgaaaagaatacatcgaaacgagaattataaaataattgaagttggtatgttatataatttcgtacatatttcgcaatttttgaggaaagtagtgtaaggccccttaatccgttgtaaacccccccccctgaaaaattccgccccaaatttcgccccaaattccacccacaaatttctccccaaatttggcccaagcgcatccccctcccttcctcccccaaattccccactcccctctaacgaaaagaagaataaatatgatgataaaatgaaaagaatatgagaaagaaatactatcaaaagactgttttttacttaattttaactaaattcgatcaatgttattttgtcatcagcaggtgaacaaataattgaactattaaaagataaattatttaaaatttgactagttaaagaaacaaatgcatatttttaattcgattagggcataggaaccaatttataaaataacataattgaatcataaaaaacgattattcgtcgacaatgagatgtcaaaaaacaattaaaattgattacaataaaaactgatactttagtgagggatgcgcactgtgccccccagaccaaccgcaccgtctatcccggatggaacatgggagggaatagggaaagccatgaccagtgactaagccacaaaatcccaacgactcattgactgtcgatatatttattcactcgttgttggatttacacgaagcgagaaaaggaataaa
